United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 30

SEQ ID NO: 124600 - protein, 143 aa, Glycine max
  Coding DNA Sequence Number=SeqID_7822
MTLFSFILDFCQLFFDRQAGDDKSNSKGKTDDCGQKSESVNEKIDEKTQNLNSSHETDTCPGQEVAVEHGSTDRTSSPSDNGLLCNNAPASVKANDRNSERSTSADSVSKNLTQGVDIIQDSQPARSIEISAPRGTDSTRNAK

SEQ ID NO: 124601 - protein, 113 aa, Glycine max
  Coding DNA Sequence Number=SeqID_7823
  Homolog annotation: Hit_ID=Q9FFT8; Match level="QueryCoverage=53%, HitCoverage=11%, E-value=3e-08, Identity=50%"; Hit description =Genomic DNA, chromosome 5, P1 clone:MBG8
MGDQISIVLKKARMTKKGKGNSNVGNEGFVDTLVILSSDLVQVVAKGVIFPADGVGGNITGDDEEAVAHNVCSESLTCEVENHTGPLMGAKQVNQLRSIHCIFFACHAHAIVE

SEQ ID NO: 124602 - protein, 334 aa, Glycine max
  Coding DNA Sequence Number=SeqID_7824
  Gene Ontology: Mol. function=DNA binding; Cellular component=nucleus; Biological process=regulation of transcription
  Homolog annotation: Hit_ID=Q1S2B0; Match level="QueryCoverage=99%, HitCoverage=99%, E-value=4e-80, Identity=47%"; Hit description=No apical meristem (NAM) protein
  Pfam annotation: Domain name=NAM; Domain location=18-119; Score =204.3; E_value=2.8e-58; Accession=PF02365.6; Description=No apical meristem (NAM) protein
MENNNYQREIMEEQRFELPPGFRFHPTDEELITHYLSQKVLDSCFCARAIGEADLNKKYPTGQRTNRATGAGYWKATGKDREIYKAKTLIGMKKTLVFYKGRAPSGEKSNWVMHEYRLENEHSVQNPPKKAMNDWAICRIFQKSNCGKKMPISRLLRFSTFAKDIPSLMDSSPNNNNNSESKPVLGESSHATCFSDPNQSEDKKTENENIAESYEIIMLASSYSSNPSDVSPDSWTFSKSAPTVSHQSLQVGNSHCSDYFMLHQEQSMLGMLIENHGSSTGQRTQKAQDNNKDFDADMSSVMYNNNEMFQRSFGNQEYSSPSVGHVYSSGLWGF

SEQ ID NO: 124603 - protein, 83 aa, Glycine max
  Coding DNA Sequence Number=SeqID_7825
  Homolog annotation: Hit_ID=Q9FFT8; Match level="QueryCoverage=48%, HitCoverage=7%, E-value=6e-07, Identity=58%"; Hit description =Genomic DNA, chromosome 5, P1 clone:MBG8
  Subcellular localization annotation: CTP_CleavageSite=51; ConfidenceScore=5.49e-01
MDCRNRDSITENHTSSSSSSSSSSSSSSSSSCDSLSEALLFTTMCIVGHPVDVHVKDGSVYSGIFHTASVHADYDSLVGSNGL

SEQ ID NO: 124604 - protein, 65 aa, Glycine max
  Coding DNA Sequence Number=SeqID_7826
MAEVAKLVNSADASNPTPQTKIFAKPLPDSSKVEERVHTLLDMHGVVFALSTPKPDVAANASQLQ

SEQ ID NO: 124605 - protein, 57 aa, Glycine max
  Coding DNA Sequence Number=SeqID_7827
MNRTKQYKWRLQSLLLLSDVWKFYQSNKRKSLRNHRKLLEMPLSPLEYTHEPVYRDP

SEQ ID NO: 124606 - protein, 97 aa, Glycine max
  Coding DNA Sequence Number=SeqID_7828
  Subcellular localization annotation: CTP_CleavageSite=13; ConfidenceScore=5.25e-01
MSHPIRALCTDILQHKVPYSNPPSHLFSRTKGLRSPQYPNTNSTQEFTSFHHLSRNITSQHYTSYTFSHHSRTQGSKHNITQPINIDQYTSIMQQVY

SEQ ID NO: 124607 - protein, 64 aa, Glycine max
  Coding DNA Sequence Number=SeqID_7829
  Homolog annotation: Hit_ID=Q9FHI8; Match level="QueryCoverage=80%, HitCoverage=5%, E-value=3e-14, Identity=71%"; Hit description =Arabidopsis thaliana genomic DNA, chromosome 5, P1 clone:MFC19
MKTRPISSVNDFLLAFWTPFLLLHLGGPDTITAFALEDNELWLRHMLGLIVQDVFKQFLYSASL

SEQ ID NO: 124608 - protein, 331 aa, Glycine max
  Coding DNA Sequence Number=SeqID_7830
  Gene Ontology: Mol. function=hydrolase activity; Cellular component =nucleus; Biological process=regulation of transcription, DNA -dependent
  Homolog annotation: Hit_ID=Q9M391; Match level="QueryCoverage=78%, HitCoverage=99%, E-value=4e-92, Identity=66%"; Hit description =Ataxin-3 homolog
  Pfam annotation: Domain name=Josephin; Domain location=8-191; Score =83.4; E_value=6.8e-22; Accession=PF02099.8; Description=Josephin
MGEGASNGGMLYHEVQESKLCAVHCVNTVLQGPFFSEFDLAALASDLDRKERQVMLPALSSADFESHNVSLDGDFSIQALEVWDLQVIPLDSPVAEPAQIDPELENAFICHLQDHWFCIRKVNREWYNFDSLYAAPQHLSKFYLSAYLDSLKGFGWSIFLVRGNFPKEFPISSSEASNGFGQWLSPEDAERITKSCNSVQAPHQRVNERQQNYDQFLSHGETEMLLDMEDEDLRAAIAASLMDSSPVVTNAEASTPQNDNQSSKQVATTEATPLNDQHSKQVEPIEATPPLNAQSNKHLPATEAGSPLNDQNSKEVASTIGDNAQDDNQKK

SEQ ID NO: 124609 - protein, 105 aa, Glycine max
  Coding DNA Sequence Number=SeqID_7831
MKDYLPTTVLQMVNNMTIRLATNQDGIIAWMNSSDGVFNMKSVHEAPNNGGLTFHCYERLYNLEADVDRNKRGMDRECEGDNGHIKKVSSIRDARAALDVFIREL

SEQ ID NO: 124610 - protein, 159 aa, Glycine max
  Coding DNA Sequence Number=SeqID_7832
  Homolog annotation: Hit_ID=Q9FHI8; Match level="QueryCoverage=76%, HitCoverage=13%, E-value=9e-29, Identity=54%"; Hit description =Arabidopsis thaliana genomic DNA, chromosome 5, P1 clone:MFC19
  Pfam annotation: Domain name=DUF594; Domain location=68-127; Score =88.6; E_value=2e-23; Accession=PF04578.4; Description=Protein of unknown function, DUF594
MVFNSISCRRNFFQVKEENGTEKSDEQEACMRLREVCVDHEPSAVKGDRSKSLLFDACKLASVIDGLRLEEPDKWKKADKWKMIAQVWVELLSYAAANCIPITHVQQLSKGGEFLSLVWLLMTHLGLAKQFQIKEGHARAKLIVGEEEQIEQNLAKTKQ

SEQ ID NO: 124611 - protein, 213 aa, Glycine max
  Coding DNA Sequence Number=SeqID_7833
  Subcellular localization annotation: CTP_CleavageSite=41; ConfidenceScore=5.02e-01
MKCVFVHGSSTHDFGAMRSDCLVQFSIINPFSEPMNCVFVHASSTFEFGAMRSDCLVQFSILNPFSEPMNCVFVHASSTFEFGAMRSDCLVQFSILNPFSEPMNCVFVHASSTFKFGAMRSDCIVQFSILNPFSEPMNFVFVHVSSTFEFGAMRSDCLVQFSILNPFSEPMNCVFVHASSTFEFGAMLMQSYSARALDKKTPSRLGQRCKRRP

SEQ ID NO: 124612 - protein, 42 aa, Glycine max
  Coding DNA Sequence Number=SeqID_7834
MSEIRRFGGLGMEERRKRKGDAQGFLENVIFIEQDAWPSVLV

SEQ ID NO: 124613 - protein, 105 aa, Glycine max
  Coding DNA Sequence Number=SeqID_7835
  Gene Ontology: Mol. function=hydrolase activity; Biological process =aromatic compound metabolic process
  Homolog annotation: Hit_ID=UPI00005269EA; Match level="QueryCoverage =99%, HitCoverage=34%, E-value=2e-26, Identity=61%"; Hit description =alpha/beta hydrolase fold
MAHGFRRRRRPRSDHPRPLLRFDRHLGRRRERPADPAADSAEPDRRSRPGGAERSDDPVGGAVLRPGSATPGAAGHRSTAEQVHRPRDEHHDGEDEGSAASTIHP

SEQ ID NO: 124614 - protein, 197 aa, Glycine max
  Coding DNA Sequence Number=SeqID_7836
  Gene Ontology: Mol. function=sequence-specific DNA binding; Cellular component=intracellular; Biological process=regulation of transcription, DNA-dependent
  Homolog annotation: Hit_ID=UPI0000527D59; Match level="QueryCoverage =66%, HitCoverage=84%, E-value=2e-35, Identity=55%"; Hit description =transcriptional regulator, AsnC family
  Pfam annotation: Domain name=AsnC_trans_reg; Domain location=108-180; Score=73.3; E_value=7.5e-19; Accession=PF01037.11; Description=AsnC family
  Pfam annotation: Domain name=HTH_10; Domain location=47-90; Score= -10.1; E_value=0.09; Accession=PF04967.3; Description=HTH DNA binding domain
  Pfam annotation: Domain name=HTH_11; Domain location=47-98; Score =12.5; E_value=0.0038; Accession=PF08279.2; Description=HTH domain
  Pfam annotation: Domain name=HTH_IclR; Domain location=43-128; Score=- 8.4; E_value=0.02; Accession=PF09339.1; Description=IclR helix-turn -helix domain
  Pfam annotation: Domain name=HTH_Mga; Domain location=45-97; Score =10.7; E_value=0.05; Accession=PF08280.2; Description=M protein trans- acting positive regula
  Pfam module annotation: Pfam domain module=AsnC_trans_reg::HTH _10::HTH_11::HTH_IclR::HTH_Mga; Domain location=108-180::47-90::47 -98::43-128::45-97
MGVICGDIVVLLVNAAPREAPRTDAGVITGMRRVLLVFGTMPGLDRTDLELLAALADDPRTTIVALAENLGLSRNTIQARMARLEQSGVFLSYERSFSPDVLGFPLQAFVSIGVRQTELPRIINELARIPEVVQAHGLSGSIDLLARVACRDARHLFDTDARILSIEGVERTETSLAMGEVIPFRVAGLIGLARRES

SEQ ID NO: 124615 - protein, 83 aa, Glycine max
  Coding DNA Sequence Number=SeqID_7837
  Gene Ontology: Mol. function=NADH dehydrogenase (ubiquinone) activity; Cellular component=chloroplast; Biological process=ATP synthesis coupled electron transport
  Homolog annotation: Hit_ID=Q71L29; Match level="QueryCoverage=54%, HitCoverage=9%, E-value=3e-10, Identity=97%"; Hit description=NADH dehydrogenase subunit B
MDEYASIRFMLVWVIAMRFPNIMLRIARIPEEDAIRLMRNKKGYRKFEKKSNDWSGRVRVEKRIPHFFLSFKTVHETFISHGS

SEQ ID NO: 124616 - protein, 69 aa, Glycine max
  Coding DNA Sequence Number=SeqID_7838
MQAIDKLPLFPMLLELIGIFYSVPKTTSARAHRLVVLTFGEPSTIWIAPMSSRMSLSGKWFSRHNKTFN

SEQ ID NO: 124617 - protein, 418 aa, Glycine max
  Coding DNA Sequence Number=SeqID_7839
  Gene Ontology: Mol. function=hydrolase activity; Cellular component =extracellular space; Biological process=biological_process
  Homolog annotation: Hit_ID=Q9LJU7; Match level="QueryCoverage=92%, HitCoverage=88%, E-value=0.0, Identity=74%"; Hit description=Purple acid phosphatase-like protein
  Pfam annotation: Domain name=Metallophos; Domain location=122-313; Score=46.2; E_value=1.1e-10; Accession=PF00149.18; Description =Calcineurin-like phosphoesterase
MKLNKVARRAGEECHVFVLDNVMMINSLGGWHCNVDGEQHMRVTWITDDNSAPSIVEYGTSPGRYDSVAEGETTSYSYLLYSSGKIHHTVIGPLEHNSVYYYRCGGQGPQFQLRTPPAQLPITFAVAGDLGQTGWTKSTLDHIDQCKYNVHLLPGDLSYADYIQHRWDSFGRLVQPLASARPWMVTQGNHEVESIPLLKDGFLSYNSRWKMPFEESGSNSNLYYSFEVAGVHIIMLGSYADYDEYSEQYGWLKEDLSKVDRERTPWLIVLFHVPWYNSNTAHQGEGADMMASMEPLLYAASADLVLAGHVHAYERSKRVYNKRLDPCGSVHITIGDGGNKEGLAPKYINPQPIWSEFREASFGHGELQIVNSTHAFWSWHRNDDDEPVKSDDIWITSLTSSGCVDQKRNELRNKLMTP

SEQ ID NO: 124618 - protein, 216 aa, Glycine max
  Coding DNA Sequence Number=SeqID_7840
  Gene Ontology: Mol. function=5-formyltetrahydrofolate transporter activity; Cellular component=membrane
  Homolog annotation: Hit_ID=Q6ZA55; Match level="QueryCoverage=88%, HitCoverage=39%, E-value=1e-28, Identity=37%"; Hit description =Putative integral membrane protein
  Pfam annotation: Domain name=BT1; Domain location=1-216; Score= -112.1; E_value=8.7e-06; Accession=PF03092.7; Description=BT1 family
MADVVVDAMIAEAVRYERPMSWFFLAHVTIPNLSTVIFYYETEVLKLEASFLGTSRVVGWLGLMLGTFIYNRHLKYMTLRKILMCAHIGLAFLNLLQIAVVSRKNIAFGISDKIMVLFGSALADGINQFKFMPFLILSGQLCPPGIEGTLFALFMSINNLGSTVGSFVGAGLASILNIDSGSFDNLLLGIIVHALCNFIPIAFLFLIPKEATGSST

SEQ ID NO: 124619 - protein, 121 aa, Glycine max
  Coding DNA Sequence Number=SeqID_7841
  Gene Ontology: Mol. function=catalytic activity; Biological process =lipoate biosynthetic process
  Homolog annotation: Hit_ID=Q2QMP8; Match level="QueryCoverage=96%, HitCoverage=40%, E-value=1e-10, Identity=37%"; Hit description =Lipoate-protein ligase B containing protein, expressed
MATEGSVISLICIKSKYLMKWPGLWQKEIVREKKAHIEKEGDCTDTLIILQHPSVYTLGTASMEENLQFDKKKCSVLSHAINIISKRCHSGMVATIRCYESGPHRNWLYYNCKEMVSKFLG

SEQ ID NO: 124620 - protein, 142 aa, Glycine max
  Coding DNA Sequence Number=SeqID_7842
DVDAPSGFLLKRLKTVSSGNSAQDGTIANESIDAYVPTCKNLSNPSSSASTAEYENVKRISPLTKLLAKDTVEPLMGRLEEDFEDANGSKESRLSSERVSLSGTQGESYTFVSGINVMDLEQRINRLETVIKKLKIAKFGHC

SEQ ID NO: 124621 - protein, 65 aa, Glycine max
  Coding DNA Sequence Number=SeqID_7843
MDKVDKFEADIELKVNIHSESSEANKAQKFVEKQYATSVRFVKSAVRLAFKVLSLSGLGVTAQGT

SEQ ID NO: 124622 - protein, 196 aa, Glycine max
  Coding DNA Sequence Number=SeqID_7844
  Gene Ontology: Mol. function=transferase activity
  Homolog annotation: Hit_ID=Q1SPZ1; Match level="QueryCoverage=90%, HitCoverage=60%, E-value=6e-29, Identity=41%"; Hit description =Ankyrin
  Pfam annotation: Domain name=Ank; Domain location=110-146; Score =18.2; E_value=0.03; Accession=PF00023.20; Description=Ankyrin repeat
  Pfam annotation: Domain name=Ank; Domain location=147-179; Score=5.1; E_value=5.8; Accession=PF00023.20; Description=Ankyrin repeat
  Pfam annotation: Domain name=Ank; Domain location=65-95; Score=4.7; E_ value=6.7; Accession=PF00023.20; Description=Ankyrin repeat
  Pfam module annotation: Pfam domain module=Ank::Ank::Ank; Domain location=110-146::147-179::65-95
MSTFESSTTRSFVSVESTTPIEGTEADNVNRDSLFRGCVLEGRWDFILTAYKNDSHYHKIKINESRGTALHVAVNDGKVELVNTLVGAILNHEGMDVLRDDSALKTTNERGDTPLHLAASRGFNAMCKCIIGESEERKDLIRVRNNKGETPLFRAVLTCHTKTFVYFHHVSKDIPLRNYDGDTILHHAIWREFLGK

SEQ ID NO: 124623 - protein, 188 aa, Glycine max
  Coding DNA Sequence Number=SeqID_7845
  Homolog annotation: Hit_ID=Q10I34; Match level="QueryCoverage=78%, HitCoverage=32%, E-value=1e-21, Identity=40%"; Hit description =Expressed protein
  Pfam annotation: Domain name=DUF1723; Domain location=113-162; Score =75.8; E_value=1.4e-19; Accession=PF08330.1; Description=Protein of unknown function (DUF1723)
MDESLLSIMEVREDLMVSPIGDSEPALRSAYFLKPIAKSLDGPVSKVLSSSMTMSLPPVFEPKDWPLVIHFDWRRHTKKKWVEWVDALQLRYKSVWKKVGIFEAIMSIKCSIAKDQNLCFGIAEKWCAETNTLLFPWGEATITLEDVMVLGGYPVVGDPVFAPLQSHEMREAEKKLILAREQHFKAMK

SEQ ID NO: 124624 - protein, 203 aa, Glycine max
  Coding DNA Sequence Number=SeqID_7846
  Homolog annotation: Hit_ID=Q2QUQ6; Match level="QueryCoverage=99%, HitCoverage=18%, E-value=1e-22, Identity=36%"; Hit description =Expressed protein
MDAFVNSGSEVEHEAFLATWLSMIGFSSKGLVSTLVFPIAVHLARGNPIALGPAVLASIYKDLTLLKNSIVGMTKQLVLGDKLELEVTLQSPFYLVQIWVWERFKNLQPQPRLINHEDPMMFRWHKVKALKIDNVRLALESAMEHFCWRPYVQYADLDKEPTGLLVSFATCLRVSLLVGIQSTIKKYLPHRVAMQFGMDQDVP

SEQ ID NO: 124625 - protein, 536 aa, Glycine max
  Coding DNA Sequence Number=SeqID_7847
  Gene Ontology: Mol. function=transferase activity
  Homolog annotation: Hit_ID=Q1SPY9; Match level="QueryCoverage=64%, HitCoverage=47%, E-value=1e-102, Identity=56%"; Hit description =Ankyrin
  Subcellular localization annotation: CTP_CleavageSite=55; ConfidenceScore=5.60e-01
MILNQSSITIAPQTLSPPSTPNSQPLTTTTSNPQIRFKKQIMDLNNNNICNRRERDAARHKVHGGGGDKPLLNTTEEVAEEPCWTCGLQVLCWLKSKLGTPLESSIGTLPLTPSSSYVATSLKNFYTCQNLVGYLSNTPMRHIVVGGAASSGQQENNRVESAAKNEEKETFVAVAKAGIVELVNELHNKVPSTFHDTNSPEKENLLIVAMKNIKYKIGEHHVDKKETAFLAAAKYGIVEIVFALQSKIPSAVHETNSNNENVLLVAVKNRQTKVVEVLRKHMDKELFDSLILEVDNRENTVLHLAAGTGTTSNSERTWQIAGAAMQMMWDIKWYQYIRALVPEHFVFRTNKDDKTAGEIFKQKHKDLVKESSEWLKETSNSCSVVAALIAGVSFATSSSVPGGTEKGKPELEGQPAFDVFAIASLIGLCFSVTALIMFLAILTSRKQAPDFRKSLPLKLLFGLSSLFVSIGSMLVSFCAAHFFVLKDKYKNILFPVYIATCLPVTFYAVVQFPLYADLLKAIFKKVPQPSITSSQF

SEQ ID NO: 124626 - protein, 184 aa, Glycine max
  Coding DNA Sequence Number=SeqID_7848
MEMKGSACGTPGCILREMLPHARYAKWWKKTVPSHQDFAKNIVQSGGSPKSPHSAPHVSKANTNGNDADFPPGFLPKPVSTVYFGKSGKDHSNARKGNSDADAPSGFLKSLKTATSGNSYQDGLKDKEKIDTNGDVPTICKNLSNQSSSASTAVYENIKRKSPLTKLVSKDTVEPLMGVWRKIL

SEQ ID NO: 124627 - protein, 105 aa, Glycine max
  Coding DNA Sequence Number=SeqID_7849
  Gene Ontology: Mol. function=double-stranded RNA binding; Cellular component=intracellular
  Homolog annotation: Hit_ID=Q5N8Z0; Match level="QueryCoverage=59%, HitCoverage=14%, E-value=9e-09, Identity=52%"; Hit description =Putative dsRNA-binding protein ODB1
  Pfam annotation: Domain name=dsrm; Domain location=2-67; Score=62.3; E_value=1.6e-15; Accession=PF00035.15; Description=Double-stranded RNA binding motif
MYKAKLQELCHQRKWGLPRYSAMKDGPDHMPSFKASVYVNRVTFTSGAFRSLKEAKNHAAMLAFFSFSSGSSTQTSEHDINEQIGEVKPRDVPIPAQSSVIIDGE

SEQ ID NO: 124628 - protein, 238 aa, Glycine max
  Coding DNA Sequence Number=SeqID_7850
  Gene Ontology: Mol. function=double-stranded RNA binding; Cellular component=intracellular
  Homolog annotation: Hit_ID=Q1SYE6; Match level="QueryCoverage=54%, HitCoverage=26%, E-value=5e-16, Identity=32%"; Hit description =Double-stranded RNA binding
  Pfam annotation: Domain name=dsrm; Domain location=79-144; Score =45.3; E_value=2.1e-10; Accession=PF00035.15; Description=Double -stranded RNA binding motif
MDRYCKNQPQNNAQKNNLDPPVFTCKTEDLPPTNEQSVESPDFFNTIKEVDQAAAKLDLMSLSPDNFEKASILGDSGSFKTSLLRLSERQDFHKPTYKTMQAGSPHMPTFFSTVEVEGVEFHGKGGRSKKQAEEDAAKIAYIALKECGLNMYAAFSPSQIENKAVQSIHNLDELLDLDLNEILLANVKVRNEVHNPSFLQSPEEDMINNRNSSSCEPVISSSPKSSPLSHIDVSCLSI

SEQ ID NO: 124629 - protein, 118 aa, Glycine max
  Coding DNA Sequence Number=SeqID_7851
MQCVRLLDYSTTYILTVCNESVHFFVYNGGNEVRNLPQIDSVHASITKGKLNQHFEDNETVAKVYRNADNDTDTTVYKNLENETEITVQRITKAQGSMGKNARQTQEPMSERRRMYQH

SEQ ID NO: 124630 - protein, 92 aa, Glycine max
  Coding DNA Sequence Number=SeqID_7852
MGSGRSRRRLHSERSRKYLRSTRLRQEKGLRTIGRFELAYGRVEVKAARFLDLAQFLTKLHKISSTSSNEDNRSKEQLCACKVYVAGHLALG

SEQ ID NO: 124631 - protein, 136 aa, Glycine max
  Coding DNA Sequence Number=SeqID_7853
  Gene Ontology: Mol. function=transporter activity; Cellular component= integral to membrane; Biological process=iron ion transport
  Homolog annotation: Hit_ID=P23876; Match level="QueryCoverage=86%, HitCoverage=35%, E-value=1e-17, Identity=39%"; Hit description =Ferric enterobactin transport system permease protein fepD
VADDGLQRRAAGGDADDGDWRDGRRARQSGASDAGRRGAGGGTGGFNLRPVAAQSGHLRSPALLAKRLAGYPRFQRVAHPEPGGAGRCGAGAGAGAIAEQPEHGRRYGGGAGHARVAHSTAGPAGDCLTERRGDRR

SEQ ID NO: 124632 - protein, 76 aa, Glycine max
  Coding DNA Sequence Number=SeqID_7854
MSSWHRDCARKTPSGPEEGQQGLGVASSDYGPPSVLRSARRPNKVVRPRINRAFIKKYCAPRRAQGEAPQQHWDGR

SEQ ID NO: 124633 - protein, 498 aa, Glycine max
  Coding DNA Sequence Number=SeqID_7855
  Gene Ontology: Mol. function=RNA-directed DNA polymerase activity; Cellular component=chromatin; Biological process=chromatin assembly or disassembly
MVDWPLPHIASELCGFLGLTGFYRHFICQYAAITRPLTTLLCKDQFYWSDEATHSFLHLKEAMIQAPVLVLPDFSLPFVLETDASATAMGAILQQRSHPIAFYSKVFCPRLQHASTYIRELHAITSAVRKWRHYLLGYPFIIITDHKSLKDLMSQVLQTPEQQHYLSKLLRFDYSIQYRPGSKNVAADALSWVPVSGTTHFSLSMVNFEILEQLRLSLQDNHDFQELSSRITVDPDGHADFAVCRGLIFHKQKIWLPPAHPFIPLLLEEFHSTPVKYETTKLAGLLHPLPIPSTIWEDLSMDFITGLPPSQGFSVILVVVDRFTKGAHFGALPSSYSAHKVASLFIDIVCKLHEFPRSIVTDRDQWSYNTSVHSATGVSPFEATFGKPPPSLPSYLAASQTQLHAVLQCRLAKAQAAMKKQADSHRRDVQFNVRDWVFVRLRPYRQTSLQPHYTKLFKHFYGPFCIQEHIGLAPEDTSWEDWSSICTTYNLGDKVVPP

SEQ ID NO: 124634 - protein, 85 aa, Glycine max
  Coding DNA Sequence Number=SeqID_7856
  Homolog annotation: Hit_ID=Q00M75; Match level="QueryCoverage=31%, HitCoverage=4%, E-value=1e-07, Identity=100%"; Hit description=PPR -repeat containing protein
KYLGAFQLVSELVDGVLEMATYNKVHLKVVGAAVKLCLGDLLVMGSNPETASLHMQGNTAGIPEVLTRLDAAPSILGDSSPEYES

SEQ ID NO: 124635 - protein, 336 aa, Glycine max
  Coding DNA Sequence Number=SeqID_7857
  Gene Ontology: Mol. function=RNA-directed DNA polymerase activity; Cellular component=chromatin; Biological process=chromatin assembly or disassembly
MQQKVVLSESFENCLQMFKMCLQGGAIDENIVEEGCNKPTDERLKQLIHGCLNCCRCVGKTEGNHFVFVMSLVSAECGLMDVGGCHGDLMEALTKFVNGWHWKTILDGDRVQCPVINTTPPATILLLDHQHWGRKGVVTYLDQPGLKHIGYLAFELRFLVVWVSAVVVEGWMVPGRDGHIGGGWVIWQEPAELVDRGRSREEGNICRELDWGAQPGEGHRPRDLLAYECAAITYHDTEGGDVGGGQREEMGQPSLYEIMGATIIYQDRMPERALRLNCGVFGSETKGSSPSEGGGEVCSDDRQPIFRHTDNRGCGLCERLTLQVRSTAQRVWSEVG

SEQ ID NO: 124636 - protein, 61 aa, Glycine max
  Coding DNA Sequence Number=SeqID_7858
MKEEYVEGVFVTPTIIEERVPEQLKGALGQAANALQQLPAPIRDPVASGLKVPLNVHCYII

SEQ ID NO: 124637 - protein, 162 aa, Glycine max
  Coding DNA Sequence Number=SeqID_7859
MENNEAVQEYVVLNYNAGGYCNLEGDASDGSDDDASDEGEVFNIDGFLDIAKFDMNNIRSGDVGRYQFADLELTYRYFIYDSPFGKAYFRAPGSPRLASGSLGLPNSLVAEEEVGPSVLREIGEKSKRRRRKKRKMRPRLYRIATVTDFYIVLRSVFFVCHP

SEQ ID NO: 124638 - protein, 107 aa, Glycine max
  Coding DNA Sequence Number=SeqID_7860
  Gene Ontology: Cellular component=plastoglobule
MVGLLRRFKTGWGFEALVSGKTTEWQKIDVNERITGLERLNPTPRPTTSPFLEGRWNFEWFGSGSPGLFAARIFPSTLANLSKMDFVIKDGNAKITANMRLLNSVYL

SEQ ID NO: 124639 - protein, 144 aa, Glycine max
  Coding DNA Sequence Number=SeqID_7861
MSLAFVGCPTISVILTLESCDKQKYPSGYPYKLFAICKTQSMIARRDLRRLLRLLSSRGGEPDDTREPFGPALSFAIYKTQSMIARRDLRHLLRLLSSRGGGPDDMREPFGPTPFAIYKTQSMIARRDLRRLLRLLVIQRRRAR

SEQ ID NO: 124640 - protein, 83 aa, Glycine max
  Coding DNA Sequence Number=SeqID_7862
MDIATTGVQHVTKKSSDELLRKFAEVGDSNNAPKKKKTKRTAEDGSGTAVVERRSLLLRAHLRARDLTHFRTKSLLGTIEKDA

SEQ ID NO: 124641 - protein, 171 aa, Glycine max
  Coding DNA Sequence Number=SeqID_7863
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=1e-11, Identity=23%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=48; ConfidenceScore=5.66e-01
PLMARTCSPLKVRACGPLKVRACSPTKARASSPLKARTCSPLEVRACSPMMVRTCSPLKARTCSPLNGEGRAALCWRGRVVLPRRGRVVLTTVRVTSTQGRSPLKARTFSPLKVRACSPTLARACSPLKVRTCSPLKVRTRSPLKVRTHSPLKVRACSPLLARTCSPLKTR

SEQ ID NO: 124642 - protein, 73 aa, Glycine max
  Coding DNA Sequence Number=SeqID_7864
  Homolog annotation: Hit_ID=Q8H0H3; Match level="QueryCoverage=54%, HitCoverage=13%, E-value=3e-07, Identity=80%"; Hit description =Hypothetical protein B25
MHGKKEQEEYIRKGPSEAEEDEVHEPREEVCSQRLELHSIQRSSSKSKSCHLRCVNKLRPNLKNCNIEEVASH

SEQ ID NO: 124643 - protein, 68 aa, Glycine max
  Coding DNA Sequence Number=SeqID_7865
  Gene Ontology: Mol. function=nucleic acid binding
  Homolog annotation: Hit_ID=Q8S5F1; Match level="QueryCoverage=86%, HitCoverage=7%, E-value=2e-09, Identity=40%"; Hit description =Putative retroelement
MKDFLKKSWYIDNGCSIHMTGDASKFTHISRKKSGYVTYGDNNKDLVIGLPKLKFEKDRLCDACQKGK

SEQ ID NO: 124644 - protein, 122 aa, Glycine max
  Coding DNA Sequence Number=SeqID_7866
MPFLTQERVVPSTQYHHPSQVKVSDFDKYKGTTCPKNHLKMYCRKMGAYTKDEELLIHFFQKSLTGVAVTWYTNLEPSRVHSWKDLMVAFVRQYQYNSDMATDRIQLQNMCKKGHRSFKEYT

SEQ ID NO: 124645 - protein, 44 aa, Glycine max
  Coding DNA Sequence Number=SeqID_7867
MSRVYVGNLDSGVTERDLEDEFRVFGVIRRYYVPGSLVKVQIHF

SEQ ID NO: 124646 - protein, 159 aa, Glycine max
  Coding DNA Sequence Number=SeqID_7868
  Gene Ontology: Mol. function=protein binding; Cellular component =integral to membrane; Biological process=protein amino acid phosphorylation
  Homolog annotation: Hit_ID=Q1T2W9; Match level="QueryCoverage=43%, HitCoverage=6%, E-value=7e-21, Identity=76%"; Hit description =Leucine-rich repeat; Leucine-rich repeat, cysteine-containing type
  Pfam annotation: Domain name=LRR_1; Domain location=34-56; Score=8.2; E_value=8.3; Accession=PF00560.23; Description=Leucine Rich Repeat
  Pfam annotation: Domain name=LRR_1; Domain location=58-81; Score =10.0; E_value=3.9; Accession=PF00560.23; Description=Leucine Rich Repeat
  Pfam annotation: Domain name=LRR_1; Domain location=9-32; Score=2.6; E_value=95; Accession=PF00560.23; Description=Leucine Rich Repeat
  Pfam module annotation: Pfam domain module=LRR_1::LRR_1::LRR_1; Domain location=34-56::58-81::9-32
MELVKILTIFTSIDLSSSNHFEGPIPDDLMDLKILHIFNLSNNDLSGEIPSSINNLKQLESLDLSQNSLSVNLKLKSFEKWNAPEENCREGRRGRLKFFSEKENQETQQPHPREEPSLCRRGVAREGRRGPSISFVVVVLSEHKPVEAARHRVEKTMKW

SEQ ID NO: 124647 - protein, 122 aa, Glycine max
  Coding DNA Sequence Number=SeqID_7869
  Gene Ontology: Mol. function=nucleic acid binding
MAQPPPRERTLREMAAPDFTYESLCIQYPGEGVPYVLKTGLIHLLPKFHGLAGVAKDWLYYLAPRSIFSWDDLKRVFLEKLFPASRTITIKKDISGIMKLSGESLYEYWERFKKLSASCPHH

SEQ ID NO: 124648 - protein, 44 aa, Glycine max
  Coding DNA Sequence Number=SeqID_7870
MAWEAQKLSKLEAGEQWWDIDFSNDIMETTINRAVKWVTYINGP

SEQ ID NO: 124649 - protein, 226 aa, Glycine max
  Coding DNA Sequence Number=SeqID_7871
  Gene Ontology: Mol. function=nucleic acid binding; Cellular component= nucleus; Biological process=protein complex assembly
  Homolog annotation: Hit_ID=Q2VCH8; Match level="QueryCoverage=88%, HitCoverage=85%, E-value=5e-71, Identity=67%"; Hit description=RNA binding protein-like protein
  Pfam annotation: Domain name=RRM_1; Domain location=56-139; Score =43.6; E_value=6.7e-10; Accession=PF00076.12; Description=RNA recognition motif. (a.k.a. RRM, R
MGKKAKKAMKKNLKRASFNKNPSEDADFLPLEGGPARKLAGQQKPPPPPENTATVLYVGRIPHGFYEKEMEGYFGQFGTIKRLRIARNKKGKECTYKCIWKKSGKSRHFGFIEFESPEVAKIVADTMHNYLLFEHLLQVYVIPPEHVHPRIWRGFNYHYKPLDSVQIERKRHDKDRTLEEHKKLVEKVLKHDQKRRKRIEAAGIDYECPEIVGNIQPAPKKIKFED

SEQ ID NO: 124650 - protein, 90 aa, Glycine max
  Coding DNA Sequence Number=SeqID_7872
MSQVQALCIQLKPNSSLEHSTQAELKPSKAWLSLAHFHPYWQANTLLTVSRYISIAPASSHIHTTFLDAIESACVVDNLVDDFVVVAIVN

SEQ ID NO: 124651 - protein, 78 aa, Glycine max
  Coding DNA Sequence Number=SeqID_7873
MSAESQRGQATVPYEEISTFCRVGLPRSLSRIGHVRSLKEVDAGLASVCPQVLEYSNGSLGNHPPTIGCPRGDPRLPD

SEQ ID NO: 124652 - protein, 106 aa, Glycine max
  Coding DNA Sequence Number=SeqID_7874
MVWNENDDMTGRLLAATVVASFGYRKDMDGQWARKQDLPPTAPNERTLLPPPQRDPSFSLLHDVLSELQDLRAFVGDHFDAMDSRIMRLENDMNFIGRCFDPPVDP

SEQ ID NO: 124653 - protein, 115 aa, Glycine max
  Coding DNA Sequence Number=SeqID_7875
MAKDHLTLTKGSSYRGMLKCWRKRVTSWGYRRAKFCKLQIYKSFPGCQDISCDISFLLPLSPCSYCCEAVHCGILQVASRFQDVKTSHVISAFCSPCLHAPTAVKQFTAASSISY

SEQ ID NO: 124654 - protein, 110 aa, Glycine max
  Coding DNA Sequence Number=SeqID_7876
  Homolog annotation: Hit_ID=Q1SKD7; Match level="QueryCoverage=99%, HitCoverage=29%, E-value=2e-09, Identity=32%"; Hit description =Ankyrin
MAPKKLPAKRSRRDAAAEGTSAAPEFDSHHFRSAEHHQRFEAIKGWSFHRERRVQLREDEYTYFQEEIARRHWTSLVTPMAKFDPEVVLEFYANAWPTKEGVRDMRSWVR

SEQ ID NO: 124655 - protein, 141 aa, Glycine max
  Coding DNA Sequence Number=SeqID_7877
  Gene Ontology: Mol. function=transferase activity
  Homolog annotation: Hit_ID=Q1SX29; Match level="QueryCoverage=90%, HitCoverage=93%, E-value=1e-12, Identity=27%"; Hit description =Polynucleotidyl transferase, Ribonuclease H fold
EIGSQFGLKQPPKVKRFLWRISKGVLPMRLKLQQKGIMCPSVCQQCKAVLKIAGTLSWILLKLDNDGSSWVYTCGVRNRLIWESIEVEGAQDRREKLHSETHWKKPRNRFVKCNMDVTFCKGKKSMGINIYVRDANGAFDA

SEQ ID NO: 124656 - protein, 181 aa, Glycine max
  Coding DNA Sequence Number=SeqID_7878
  Subcellular localization annotation: CTP_CleavageSite=20; ConfidenceScore=5.26e-01
MSWVLKVPLRLKGSTLCGCPVESGGNSWRKRRLPLSKTFVLSTISPHVGIALSKLVSLRELFPMDGIKLSELVSPSEPFNKSPRRWSLYDAKGNRHRVSVNLIGEQPFMTQDWFELRIFYNLTWDQSIMFRYVIHSRFHITIYRDPLCAVRRPTHAAERFQCASFFASINKFFMAEVMVVN

SEQ ID NO: 124657 - protein, 83 aa, Glycine max
  Coding DNA Sequence Number=SeqID_7879
MDEHWPQVMVFAQCNEKGLRRGKLCIAGVEGKLLFSKGEWKVTLVHMWHVKWPFFLNPLPNSYSCIKGLWLLPRRQGPFDTPK

SEQ ID NO: 124658 - protein, 472 aa, Glycine max
  Coding DNA Sequence Number=SeqID_7880
  Gene Ontology: Mol. function=protein phosphatase type 2C activity; Cellular component=protein serine/threonine phosphatase complex; Biological process=protein amino acid dephosphorylation
  Homolog annotation: Hit_ID=Q8LFQ7; Match level="QueryCoverage=98%, HitCoverage=98%, E-value=1e-109, Identity=68%"; Hit description =Protein phosphatase 2C-like
  Pfam annotation: Domain name=PP2C; Domain location=34-409; Score =72.9; E_value=9.9e-19; Accession=PF00481.12; Description=Protein phosphatase 2C
MFSWLARIVSACLRPVRRYARMSKDGDVDDVSTIGDALVWGKDLEKHSCGEFSYAVVQANEVIEDHSQVETGSDAVFVGVYDGHGGAEASRFINDHLFLNLIKIQGFFLTIIIPILWVPLRASPGAAVKLCLVTCWSWVRIRKQPLCICKGKAAYNIPPPYLRIAKSLWAMGFTCFCGYGNCGKFNLLSGVAQENGSMSEDIIRSAVSATEDGFLTLVRRSYGIKPLIAAMGSCCLVGVVWKGTLYIANLGDSRAVIGSVGRSNKIIAEQLTKEHNASKEEVRRELRSLHPEDSQIVVMKQGTWRIKGIIQVSRSIGDAYLKRPEFSFDPSFPRFHLPEPIRRPVLTAEPSICSRVLKPNDKFIIFASDGLWEHLTNQEAAEIVHNNPRIGIARRLLKAALNEAARKREMRYKDLQKIGKGIRRFFHDDITVVVVFIDHELRGKNVTVPDLSIKGFIDTVGPSNFRNLRGLE

SEQ ID NO: 124659 - protein, 100 aa, Glycine max
  Coding DNA Sequence Number=SeqID_7881
MKCLRFSQIRACWVAIELGGLDLGVPDSGIKCLKARKLADKLPPLDLRALVSMVLSVRFSFLLVWSLCLDCVELQGVLAFAKRNTHWLSARKNLEEEELY

SEQ ID NO: 124660 - protein, 35 aa, Glycine max
  Coding DNA Sequence Number=SeqID_7882
LILDDPKSALVPCGSISFGNQSSGSRINTSFAGNI

SEQ ID NO: 124661 - protein, 433 aa, Glycine max
  Coding DNA Sequence Number=SeqID_7883
  Gene Ontology: Cellular component=nucleus; Biological process =regulation of transcription, DNA-dependent
  Homolog annotation: Hit_ID=Q6H972; Match level="QueryCoverage=96%, HitCoverage=43%, E-value=1e-104, Identity=51%"; Hit description =SEU3A protein
  Subcellular localization annotation: CTP_CleavageSite=31; ConfidenceScore=5.79e-01
MLGAQGGPMPPQSSFPSLVSPRTQFNNMNILGNMSNVTSILNQSFPNGVPNPGLSGPGSSQRGAIDTGAETDPLSSVGNGMSFNNSSSTFVQSSIVNAASSGQGQGQQFSNPSSNQLLPDQQHSQQLEPQNFQHGQQSMQQFSAPLNTQQPPQPQPHFQSIRGGIGGMGPVKLEQVSNDQLGQQQQQQLQSLRNLASVKLEPQQMQTMRTLGPVKMEPQHSDQPLFLQQQQQQQQQQFLHMSSQSSQAAAAQINLLRHHRLLQLQQQHQQQQLLKAMPQQRSQLPQQFQQQNMSMRSPAKPAYEPGMCARRLTHYMYQQQHRPEDNNIEFWRKFVAEYFAPNAKKKWCVSMYGSGRQTTGVFPQCIRIWVTIFLNVATPSLWFMDVWHCEICNRKPGRGFEATVEVLPRLFKIKYVLGNFVLGAMRNSYPGDC

SEQ ID NO: 124662 - protein, 409 aa, Glycine max
  Coding DNA Sequence Number=SeqID_7884
  Gene Ontology: Cellular component=nucleus; Biological process =regulation of transcription, DNA-dependent
  Homolog annotation: Hit_ID=Q6H972; Match level="QueryCoverage=93%, HitCoverage=42%, E-value=7e-55, Identity=40%"; Hit description=SEU3A protein
MADLFLKIALRIKMSHKCPGILRIGLGQSSFLQFVASARQLVKALEVPLVNDLGYTKRYVRCLQISEVVNSMKDLIDYSRETGTGPMESLAKFPRRTSGSAGPRGQAQQHEEQLQQQQQQQMVAHNSNGDQNSVRAAAMQIASSNGMVSVNNSVNPASTSTTTSTIVGLLHQNSMNSRQQNSMNNASSPYGGSSVQIPSPGSSSTVPQGQPNSSPFQSPTPSSSNNPPQTSHPALTSANHTSTTNSPANISMQQQQSSISGEPDPSDAQSSVQKIIHEMMMSSQINGNGGMVGVGSLGNDVKNVSGILPVSANTGLNGGNGLVGNGPMNSNSGVGVGNYGTMGLGQSAMPNGIRTAMVNNSIMNGRGGMASLARDQAMNHQQDLSNQLLSGLGAVGGFNNLQFDWKPSP

SEQ ID NO: 124663 - protein, 121 aa, Glycine max
  Coding DNA Sequence Number=SeqID_7885
MTNQDLSTANAAEKLPTAMLSRSARDAGERSWLKKKSLEPQMSWSGLVRTERRKQKKAKHSKSHSQQHRLREKMQAGEKKVIEEAPAEKKIAVLMKEPFLHKESNSLNSNGANLERTNSYL

SEQ ID NO: 124664 - protein, 331 aa, Glycine max
  Coding DNA Sequence Number=SeqID_7886
  Homolog annotation: Hit_ID=Q27IN9; Match level="QueryCoverage=42%, HitCoverage=40%, E-value=4e-56, Identity=75%"; Hit description=R2R3 -MYB transcription factor MYB3
  Pfam annotation: Domain name=Myb_DNA-binding; Domain location=15-61; Score=54.7; E_value=3.1e-13; Accession=PF00249.21; Description=Myb -like DNA-binding domain
  Pfam annotation: Domain name=Myb_DNA-binding; Domain location=67-112; Score=59.6; E_value=9.9e-15; Accession=PF00249.21; Description=Myb -like DNA-binding domain
  Pfam module annotation: Pfam domain module=Myb_DNA-binding::Myb_DNA -binding; Domain location=15-61::67-112
MEDSSAGEDTKTCPRGHWRPAEDEKLRQLVEQYGAQNWNSIAEKLQGRSGKSCRLRWFNQLDPRINRRPFTEEEEERLLAAHRIHGNKWALIARLFPGRTDNAVKNHWHVIMARKQREQSKLCGKRSFQDVYNDSNNTFLEKRTTPQSHHQDMLFSTRFGLENGIFFDFRSLDKNKDDSNNNNHRIVSDTPSSNSLASWNFGSVPTTTTKGARDNFNNTSCSSSVYLSECSRSSDRSFLYRIYPNPAFSLPNYKRVVPTSPLISTFLGSSDHDGRIKKDLMSFCDNNTNSSSTFTKLKASTEKDQQQTNEDETNNIKPKEVPFIDFLGVGV

SEQ ID NO: 124665 - protein, 216 aa, Glycine max
  Coding DNA Sequence Number=SeqID_7887
  Homolog annotation: Hit_ID=Q9AVH2; Match level="QueryCoverage=63%, HitCoverage=71%, E-value=7e-50, Identity=58%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCESKRAFTLLVPHEISVLGELILGHLRYLLTDVPAPSQTSHLTMSSARIDRPKPTL

SEQ ID NO: 124666 - protein, 52 aa, Glycine max
  Coding DNA Sequence Number=SeqID_7888
MVSLATKGQQGNNGSRILIEMVVARGYERWWQWCFGDGHFCVGKGGTKRFLG

SEQ ID NO: 124667 - protein, 82 aa, Glycine max
  Coding DNA Sequence Number=SeqID_7889
MGKVHCGRFDRGESITDVRRQVVVVVVVGVVVNKVVETTSIVAMEVEDGGGMTENIEQRKKKKQGATAALYNHKVGGRVFKI

SEQ ID NO: 124668 - protein, 198 aa, Glycine max
  Coding DNA Sequence Number=SeqID_7890
  Gene Ontology: Mol. function=manganese ion binding; Cellular component=chloroplast; Biological process=isoprenoid biosynthetic process
  Homolog annotation: Hit_ID=P93740; Match level="QueryCoverage=91%, HitCoverage=65%, E-value=7e-83, Identity=79%"; Hit description=Nudix hydrolase 23, chloroplast precursor
  Pfam annotation: Domain name=NUDIX; Domain location=43-163; Score =71.7; E_value=2.4e-18; Accession=PF00293.18; Description=NUDIX domain
MGDVQNVKFCQWCGGPTKHEIPEGEERLRAICTSCGKITYQNPKMVVGCLIEHDNKVLLCKRKIEPSYGLWTLPAGYLEIGESAMEGAIRETREEANADVEVISPFAQLDIPLIGQTYIIFLARLKKPHFSPGPESSECLLFSLNEIPFSSLSFSSMVVTLSLYVEDMKAGGKPKFHYGTINKRCCLLQELLIASFWH

SEQ ID NO: 124669 - protein, 189 aa, Glycine max
  Coding DNA Sequence Number=SeqID_7891
  Gene Ontology: Mol. function=heat shock protein binding; Cellular component=integral to membrane; Biological process=protein folding
  Homolog annotation: Hit_ID=Q1SQA8; Match level="QueryCoverage=88%, HitCoverage=51%, E-value=5e-14, Identity=32%"; Hit description=Heat shock protein DnaJ, N-terminal
  Pfam annotation: Domain name=DnaJ; Domain location=142-189; Score= -4.8; E_value=0.013; Accession=PF00226.21; Description=DnaJ domain
MMMRMVHLPVKAPHGNHEFCKDDFDVETVFWSVFGGNRSYYWSFINEENPQWRSGGFSNHEKSWNWRRRSENEYNGTSTEPESDCSHSDLISDRLALGLGASGPLKLEDVKNVQVLLQFLFNVILNYFLSSFSLPLQCDIVQFYETRYRICALKWHPDRHHGSFKVIAEEKLKHCSAAYRPLSDKLALD

SEQ ID NO: 124670 - protein, 90 aa, Glycine max
  Coding DNA Sequence Number=SeqID_7892
  Gene Ontology: Mol. function=ribonuclease H activity; Biological process=DNA integration
  Homolog annotation: Hit_ID=Q1SYR3; Match level="QueryCoverage=96%, HitCoverage=3%, E-value=2e-30, Identity=70%"; Hit description=RNase H, putative
MAMSHGHLYQRRIKHALDKKVRPRKFNKGDHVLKKMSHAVKDNRGKWTPNYEGPFVVKRAFSGGALILTNMDGEELPSPVNSDVVKRYYA

SEQ ID NO: 124671 - protein, 37 aa, Glycine max
  Coding DNA Sequence Number=SeqID_7893
MGTQFVKDGCNYEAPHDNCHATFDILTVQLYDEVGSK

SEQ ID NO: 124672 - protein, 162 aa, Glycine max
  Coding DNA Sequence Number=SeqID_7894
  Subcellular localization annotation: CTP_CleavageSite=55; ConfidenceScore=5.21e-01
MRDTLWLPAPFINQGANEPVDARRLTSSYAPFVVLTREVRLTSSSAPLFILTMKSGDMRGNIMVTRTFRQPGENEPVDARRLTSSSAPFVVLTREVRGNEPVEAWRPTSSSSPFVVLTRETDIVFCNFCRPDPSSQVTCGVTLWLPAPFVNQGKTSPLMLED

SEQ ID NO: 124673 - protein, 192 aa, Glycine max
  Coding DNA Sequence Number=SeqID_7895
MESKMESEMDPRWTRDGVRDGPRRSPRWTRDGVRDGPRRSPRWTKTEPEMESEMESEVETETGTETETKTETGTETGTETETEAKAETEPEPESESESESKSESKSESESESESESKSESEFESERVKAQSVRFPDPGGFGELQKYSKGEDCSGASLARKGQFGPGRPDPVLGDELTTGKSKTRVNTDQQVG

SEQ ID NO: 124674 - protein, 199 aa, Glycine max
  Coding DNA Sequence Number=SeqID_7896
MDPPVDSTCLQESSELVEATIHINAKQADHAPLDAAHTTESILSTYPTDGDQAPLDPHEAAPAAELVVSSFPTDSTCAQLSDYVPLEPPYTALAACSVMSTLPTEAPAEMACDHTPSEPPHATVEPVVPESTAEMACAHMPSDAIDPTLQRRVFPPFMFPRPKPSQRPSGAPFANIVDESRRRYCIVFDLNGVLFSYER

SEQ ID NO: 124675 - protein, 113 aa, Glycine max
  Coding DNA Sequence Number=SeqID_7897
MSKRDKGFRRRIRRGDVWETLQVCVSEEKSCYPSSSFPKGCKCNYYKLQSSDSEPECWKIPYNSGSALFQIPNPNKPQPHPRHTLDLSPHSDELKNINGFFSRLIISNSEKAV

SEQ ID NO: 124676 - protein, 85 aa, Glycine max
  Coding DNA Sequence Number=SeqID_7898
MRVGLIKGEKSITGRETRETGIRETARKPRQDFSVSKPHIFRSSLSLSLTLLFFLPHSPLKLHTKLQPLAIISAPNRERRAFSRP

SEQ ID NO: 124677 - protein, 509 aa, Glycine max
  Coding DNA Sequence Number=SeqID_7899
  Gene Ontology: Mol. function=drug transporter activity; Cellular component=membrane; Biological process=multidrug transport
  Homolog annotation: Hit_ID=Q84M81; Match level="QueryCoverage=91%, HitCoverage=95%, E-value=1e-113, Identity=47%"; Hit description =Putative MatE efflux family protein
  Pfam annotation: Domain name=MatE; Domain location=277-440; Score =123.9; E_value=4.4e-34; Accession=PF01554.9; Description=MatE
  Pfam annotation: Domain name=MatE; Domain location=54-214; Score =114.6; E_value=2.8e-31; Accession=PF01554.9; Description=MatE
  Pfam module annotation: Pfam domain module=MatE::MatE; Domain location=277-440::54-214
  Subcellular localization annotation: CTP_CleavageSite=42; ConfidenceScore=5.08e-01
MSATSKEGENLSTNDRANRHPSTPSSHTKKCPLNANFVKMVVEELRVQRGIALPLVAMNLAWFAKLAITTAFLGHLGELNLAGGALGFSFANVSGFAVLNGLSGAMEPICGQAHGAKNVRLLHKTLLMTTLLLLLVTLPLSFLWLNVDKILILFGQQQEISIVAKTYVSYLIPDLFIKALLCPLKAYLSSQCMTLPTMFSSAVALAFHIPVNILLSKTMGLRGVSIAVWVTDLIVMVMLAIYVVVLERRNGSMLWKEGGWWDQNMMDWSRLIKLSGSCCLNTCLEWWCYEILLFLTGHLANAKQAVGVLAIVLNFDYLLYAVMLSLATSVSTRVSNELGANRAGQAYKSARVSLAVSVISGCIGGSIMVAARGVWGNLFSHQKGVVKGVEKAMLLMALVEVFNFPVTVCGGIVRGTGRPWLSMYASLGGFYFLTLPLGVVFAFKLRFGLGGLLIGLLIGIAACLVLLLTFIVRINWVEEATKAQTFVCNAQVHEQVSRNEVNELTENPE

SEQ ID NO: 124678 - protein, 121 aa, Glycine max
  Coding DNA Sequence Number=SeqID_7900
MYANIGGFYFLALPLGAVFAFKLRLGLAGLIIGFLIGVVASLILLLTFIVRINWVEEAIYQGTNVIMYRTDDSLPIFLLSSFTVRLTLYFPPMYNMLSPFSNSLVFVIVGKYQVPHRCLTP

SEQ ID NO: 124679 - protein, 491 aa, Glycine max
  Coding DNA Sequence Number=SeqID_7901
  Gene Ontology: Mol. function=microtubule motor activity; Cellular component=microtubule associated complex; Biological process =microtubule-based movement
  Homolog annotation: Hit_ID=Q5VQ09; Match level="QueryCoverage=96%, HitCoverage=53%, E-value=1e-147, Identity=56%"; Hit description =Putative kinesin
  Pfam annotation: Domain name=Arm; Domain location=187-227; Score=2.1; E_value=6.7; Accession=PF00514.13; Description=Armadillobeta-catenin -like repeat
  Pfam annotation: Domain name=Arm; Domain location=238-279; Score =35.3; E_value=2.1e-07; Accession=PF00514.13; Description =Armadillobeta-catenin-like repeat
  Pfam annotation: Domain name=Arm; Domain location=280-321; Score =21.3; E_value=0.0034; Accession=PF00514.13; Description =Armadillobeta-catenin-like repeat
  Pfam annotation: Domain name=Arm; Domain location=347-387; Score=9.5; E_value=0.8; Accession=PF00514.13; Description=Armadillobeta-catenin -like repeat
  Pfam annotation: Domain name=Arm; Domain location=397-437; Score=9.6; E_value=0.77; Accession=PF00514.13; Description=Armadillobeta-catenin- like repeat
  Pfam module annotation: Pfam domain module=Arm::Arm::Arm::Arm::Arm; Domain location=187-227::238-279::280-321::347-387::397-437
MKEESMVKVKEEIDYKSLCRRLDRELDKLTMEYERQQKVFEDDIERLTTEAQHCILEAQQNYSDSLEKERLKYQKDYKESIKRLEEKAFVPAEEVVILKKILQRETLLRNAAEGEINHLKNQMAELKMLEASRESDILKLRKMLEDEAHQKEKFKGEIARLQSQLLQLGFEVGKTKQQQQASGNGEKASVAKLFEQGRGLQKILSLLEAEATDARINAVKIVANLSSEAITSLNPDVAETNQKKIVEAGGLTSLLTLLKNSQDETTQRVAASAIANLAMNETNQDLIVAQGGINILSMTAANAEDPQTLRMVAGAIANLCGNDWDSNCGSDNAFNLTITLIFNLMLKYKLQIKLRGEDGIKALLGMVRCRHPDVHIQIARGIANFAKCESKASTQGTQVGRSLLIEDGVLPWIVQNANNEVSLVRRHIELALCHLAQHEANARDMISGGAILELVRISRDCSREDIRILARRTLISSPAFQAEIKRLKIDY

SEQ ID NO: 124680 - protein, 164 aa, Glycine max
  Coding DNA Sequence Number=SeqID_7902
  Gene Ontology: Mol. function=nucleic acid binding; Biological process= DNA integration
  Homolog annotation: Hit_ID=Q1S6N9; Match level="QueryCoverage=100%, HitCoverage=12%, E-value=5e-62, Identity=67%"; Hit description =Integrase, catalytic region; Zinc finger, CCHC-type; Peptidase aspartic, catalytic
MESETSFTTIFVPVFDGLNYQMWAVKMEAYLDANDVWETVEEDYEVPPLPNNPTVAQMKSHKERRLRKSKAKSILFTAVSPIIFNRIMTMKTAHKIWNFLKEEYEGSEKIKGMQALNLIQELEMQRMKDSETIKDYADKLLGIANKIRILGTEIPDSQIVQKIL

SEQ ID NO: 124681 - protein, 253 aa, Glycine max
  Coding DNA Sequence Number=SeqID_7903
  Gene Ontology: Mol. function=DNA binding; Cellular component =chromatin; Biological process=chromosome organization and biogenesis (sensu Eukaryota)
  Homolog annotation: Hit_ID=Q9SZ70; Match level="QueryCoverage=95%, HitCoverage=73%, E-value=2e-55, Identity=47%"; Hit description =Putative DNA-binding protein
  Pfam annotation: Domain name=DUF296; Domain location=67-184; Score =212.9; E_value=7.4e-61; Accession=PF03479.5; Description=Domain of unknown function (DUF296)
FQSLNQATEDENSGSSGAQKREREENSNNNEGAGEAEITRRPRGRPAGSKNKPKPPIIITRDSANAMRTHMMEVADGCDIVESVSEFARKRQRGVCIMSGTGTVNNVTLRQPASSGSVVTLHGRFEILSLSGSFLPPPAPPAASGLTIYLAGGQGQVVGGSVVGTLVASGPVVIMAASFSNAAYERLPLEDEDPSLQMQGGSIGSPGASGVGQSQLLGGDATAPLFHGLPPNLLNSVQMPSEPFWAASARPPF

SEQ ID NO: 124682 - protein, 957 aa, Glycine max
  Coding DNA Sequence Number=SeqID_7904
  Gene Ontology: Mol. function=nucleic acid binding; Cellular component= beta-galactosidase complex; Biological process=DNA integration
  Homolog annotation: Hit_ID=Q1S4N1; Match level="QueryCoverage=99%, HitCoverage=73%, E-value=0.0, Identity=60%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=175-338; Score =182.8; E_value=8.3e-52; Accession=PF00665.16; Description=Integrase core domain
  Pfam module annotation: Pfam domain module=RVT_2::rve; Domain location=466-722::175-338
MTYDQELFKDLDATYNTNVRIGNGEKIAVKGKGTIVIEGCTGLKLIPDVLYVPEINQNLLSVGQLLENGYKVLFEDKSCMIKDSDNKELFRVQMKGKSFALNLIDEEQLVVHKVEDNTLVWHKRMGHFHHGALLYLRKNDLVQGLPELEDKSPVCVACQYGKQTRLSFPKGKSWRATSKLQLVHTDVGGPQKTPSLNGSKYYIAFIDDFSRMCWIYFMKNKTEVASIFYKFKAWVENQSERKMQILRSDNGTEYTSDKFSKFCEDAGIEHQLKTPYTPQQNGVVERKNRTILEKERCLLHDKDLSKKFWAEAASTSVFLLNRLPTKALSKSTPFEAWYGFKPKLMNLKVFGCLCFSYIPQVKRDKLDKKAEAGIFVGYSSTSKAYRIFLPQSNKVIVSRDVLFFEEEKWSKESEKLQVQEESEEDVDDQSVRGTRSLSDIYQRCNVAVMEPVDYNGAATDSKWVSAMKEEFDMIEKHQTWELTEKPKDKNVIGVKWVYRTKLNADGSVNKHKARLVVKGYAQMFGVDFSETFSPAARLDTIRLLLALAAQKGWIIHHMDVKSAFLNGHLEEEIFVEQPEGFVVHGQEEKVYRLKKALYGLKQAPRSWYGRIDAHLISLGFEKCLSEFTLYVKKTDVGIVIVSLYVDDLLMTKSSKELIEEFKGGMKKAFEMTDLGKMSFFLGMQVQQDRGEVFVSQEKYAKEILRKFKMEECKPIATPMNQKEKFSNEDGAEKVDEKLYKSLIGCLMYLTATRPDITYAVSLLSRYMHYASEIHFKTAKRILRYIKGTIGYGVKFQPVKDFSLYGYSDSDWAGSNDDMKSTSGYCFTFGSGVFSWCSKKQDVIAQSTAEAEYVAAVAVANQAIWLRKLMADLHMEQKESTQVLVDNQAAISISKNPVFHGKTKHFKIKLYFLREVQTQGDVQLLYCKTENQLADFLTKSLPQARFEYLRQKLGVCCR

SEQ ID NO: 124683 - protein, 123 aa, Glycine max
  Coding DNA Sequence Number=SeqID_7905
  Gene Ontology: Mol. function=metal ion binding; Cellular component =cellular_component; Biological process=biological_process
  Homolog annotation: Hit_ID=Q6NNI8; Match level="QueryCoverage=96%, HitCoverage=91%, E-value=9e-33, Identity=48%"; Hit description=Zinc finger A20 and AN1 domains-containing protein At1g12440
  Pfam annotation: Domain name=zf-A20; Domain location=5-29; Score =25.4; E_value=0.0002; Accession=PF01754.7; Description=A20-like zinc finger
  Pfam annotation: Domain name=zf-AN1; Domain location=64-104; Score =68.9; E_value=1.7e-17; Accession=PF01428.7; Description=AN1-like Zinc finger
  Pfam module annotation: Pfam domain module=zf-A20::zf-AN1; Domain location=5-29::64-104
MGSQQKPCANNCGFFGTSEKRNLCSKCYKDLCLEEELAAMKSVLCSPAPPSPGTAGQSKPANRCGTCNKKVGLTGFACKCGSTFCGVHRYPEKHECTYDFKGEAREAISKANPVVKGDKVDRF

SEQ ID NO: 124684 - protein, 354 aa, Glycine max
  Coding DNA Sequence Number=SeqID_7906
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=98%, E-value=7e-36, Identity=31%"; Hit description =UPI00006A17C9 related cluster
GLHVLQFRGLDLISFTGLHVLAFRGLHALAFRGLQILAIRGLHALTFRGLHDPTFRGLHDPHLQRTTRSHLQRAARPRLQRTTRTRLQRAARPRLSSPSEDHMSSPLEDYASSPSEGCRLPRSEDYMSSPSEDKTPPASEGGLHALAFRGLHVLPFRGLDLLPFRGLHILAFRGLHVHAFRGLHVLHFKGLHVLAIKGLHLLTFRGLQVLTFRGLHALAFRGLHALAIRGLHALTFRGLHVLTFGGLHTLAFRGLQVLVFKGLHVLAFRGLHVLAFKGLHALAFLTFRGLHVLALIGLYALARPHLQRTTCPHLQRTTRPYLQRDACPRLQRTKRPRLQRATHPRPQRTTCPPL

SEQ ID NO: 124685 - protein, 171 aa, Glycine max
  Coding DNA Sequence Number=SeqID_7907
  Gene Ontology: Mol. function=transcription regulator activity; Cellular component=nucleus; Biological process=regulation of transcription
  Homolog annotation: Hit_ID=Q1SXB5; Match level="QueryCoverage=97%, HitCoverage=83%, E-value=4e-76, Identity=81%"; Hit description =Lissencephaly type-1-like homology motif; WD40 associated region in TFIID subunit
  Pfam annotation: Domain name=TFIID_90kDa; Domain location=51-168; Score=74.5; E_value=3.2e-19; Accession=PF04494.6; Description=WD40 associated region in TFIID subunit
MEDEKIVGYVTAFLKKKGFTQTEKIFQEEFQHNKSNTSNSVLEPDIANHLLAFSQYFSTSADVLETGPARFHDGYSRLRTWTYSSLDLYKHELLRVLYPVFIHCFMDLVAKGHVQEARNFFNTFREDHEMMHLRDLQKLEGVLSPNHLKEMEFAHSLRKSKFNIKICEVMP

SEQ ID NO: 124686 - protein, 128 aa, Glycine max
  Coding DNA Sequence Number=SeqID_7908
MAARKGIVNKIFKHRCPNSKVTSHLKCCSSVLREAESAGCRAHRKGRGNLSARGQFELNVMGMKMVDDKCPKVTVIACIMGIMHYCEVDSNSVFSSQLSHCNDSMATLEFTRSGLTQRKWDILMIFST

SEQ ID NO: 124687 - protein, 137 aa, Glycine max
  Coding DNA Sequence Number=SeqID_7909
MRCKSDYILMLEPVHAISGEVVAWELLTRFADDADTNNKRNPDRDAGFFSRLSADEKWQLFLHQVEKLIQLYHAGFEQVISVNVDRDIVSGIFKDAEIQRKLAALTRSRLEISAFFTARFNSADLLILKGVAKITPA

SEQ ID NO: 124688 - protein, 168 aa, Glycine max
  Coding DNA Sequence Number=SeqID_7910
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=98%, E-value=2e-10, Identity=27%"; Hit description =UPI00006A17C9 related cluster
  Subcellular localization annotation: CTP_CleavageSite=24; ConfidenceScore=5.22e-01
PLKVRTRSPLKARACSPLKFRTCRLSKARECSPMMARTCNPLKVRACSPTKVKAHDPLTVMMCSPLKLKVHDPLKARTCSPLKVKARTYSPLEVRACSPLVVRTCSPLKARTCSPLNGEGRVVLSRRGRVVLSTVRVTSTQEVRACSPLMVRTCSPLNARTCSPLNGE

SEQ ID NO: 124689 - protein, 134 aa, Glycine max
  Coding DNA Sequence Number=SeqID_7911
ASQRLAWVSQGSEKVQNVLIALPFEYFLHSFPKCQKTLQIARQLALSSSIRLARIKMLAKMMTKAQDNEFKIESRTLQESRGNLISRFKNQVSRFKFSRIKNNQDQDSRLKIQESRKGSIKISTKKFFKTLSST

SEQ ID NO: 124690 - protein, 110 aa, Glycine max
  Coding DNA Sequence Number=SeqID_7912
MEWFFRISHPFMIPTQAGDQPRDAPAADPEEYIQPPNPQVPVAFDPPRHAVDDYDGYEAIAQRLERVLNLGMVTADTELYEIMQDCLTIARGGASADGSVRVRQRHRREH

SEQ ID NO: 124691 - protein, 383 aa, Glycine max
  Coding DNA Sequence Number=SeqID_7913
  Gene Ontology: Mol. function=chitin binding; Cellular component =extracellular region; Biological process=chitin metabolic process
  Homolog annotation: Hit_ID=UPI000044A8F0; Match level="QueryCoverage =59%, HitCoverage=99%, E-value=6e-40, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VDPWVLEPIAFRGLHVLAFRGLHALTIRGLHVLAFRGLRVLAIGGLHILAIRGLHALTFRGLHVLAFRGLHALTFRGLHVLTFRGLHVLPIRGLQVLTFRGLQVLTFRGLHVLGFRGLHVLTFRGLHVLAFRGLHALAFRGLHVLAFRGLHILAFRGLHVLAFRGLHVLAFRGLYVLTFRGLHALTFRELHVLAIIGLHALTFRGLHVLTFRGLHVLTFRGLHVLAFRGLHVLTFSGLHSHTLREFKEKDIVQPLCILGQDFTRVVTKRQVRIMRTNMTTLTHIWMTLLLSNILPNDRNADLPLRKDRAHKTPSGPGEVQQSPGVSCTGYGPLSVLQGARPPQQGIAPARHPVDPEKSNRVLGFLALITGLCQFYEAPVAPNK

SEQ ID NO: 124692 - protein, 38 aa, Glycine max
  Coding DNA Sequence Number=SeqID_7914
MGRVNLGLNVRMVVMTCGKAWAEQMRKMSDKGESKSHL

SEQ ID NO: 124693 - protein, 303 aa, Glycine max
  Coding DNA Sequence Number=SeqID_7915
  Gene Ontology: Mol. function=hydrolase activity
  Homolog annotation: Hit_ID=UPI00005FAA28; Match level="QueryCoverage =81%, HitCoverage=93%, E-value=8e-94, Identity=75%"; Hit description =COG3228: Uncharacterized protein conserved in bacteria
  Pfam annotation: Domain name=DUF980; Domain location=47-294; Score =330.0; E_value=4e-96; Accession=PF06167.2; Description=Protein of unknown function (DUF980)
MRRFFGALVCFSAMLFCKGIVSAGYASLKRISHTAERSSDEFTSNLMIKWPWKATQPSQSQADIEAQWQDALAIPLLSPLNEQERQRLVAVAGQILQQKRIVPLQGLQLTSQMQARIALLFALPVLELGAECLDGFNEILLYPTPFVVEDEWQDEIGLVHSGPVVQSGQSWEQGPIVLNWQDVQDSFDLSGFNLVIHEAVHKLDMRNGGVATGVPPIPLREVAAWEHDLHAAMESLQDEIDMVGEEAASMDAYAATDAAECFARPRAAGRTLSGAVSALLPLLPPGSAGAPAARPGGKRRAMG

SEQ ID NO: 124694 - protein, 83 aa, Glycine max
  Coding DNA Sequence Number=SeqID_7916
MKRRLGPRPGYPLQKLLNGRNGSWRSYKYGREISWPRPRPPSPSDSNCQIIRTTTVLPDVGQVNDRAQSLKSEAVRDNPSGST

SEQ ID NO: 124695 - protein, 85 aa, Glycine max
  Coding DNA Sequence Number=SeqID_7917
MSKYCLNVNIVGRYCLNSGGNIAASSKILSPRWCVVLCLYDGDFRGGGAVLRCRDGALLSGFCVSVAEVQNSKSQDRIKVNENDK

SEQ ID NO: 124696 - protein, 96 aa, Glycine max
  Coding DNA Sequence Number=SeqID_7918
MTKGAECVSAHLPPNLLFLNDKGRIICPCAFITKFAKSKWQRAQNSSMHVYHSTRCSWTIKGAEFVSACLSLIERADNSMSSGPPPLDDKWCRRRR

SEQ ID NO: 124697 - protein, 59 aa, Glycine max
  Coding DNA Sequence Number=SeqID_7919
MANEQPGRVTLEDYSKRNLFHGLPNEDPYAHLARYIEICNIVKIAGVLFATGKCTRPHK

SEQ ID NO: 124698 - protein, 105 aa, Glycine max
  Coding DNA Sequence Number=SeqID_7920
  Gene Ontology: Mol. function=nucleic acid binding; Biological process= DNA integration
MPLYAKFLKDMLTKNNRYIHSDRIVVEGHYSAMIQRILPPKHKDPGVVTIPCSIGEVVVGKALIDLGATDFVVIDIEEDADIPLILGRPFMSTASFIMDMGKKIL

SEQ ID NO: 124699 - protein, 61 aa, Glycine max
  Coding DNA Sequence Number=SeqID_7921
MKILKWYTKNLHCPEASVVERYSFYTKLQDDKNLKKFAYQNKPFIMAELAKQVFLLDKWPQ

SEQ ID NO: 124700 - protein, 244 aa, Glycine max
  Coding DNA Sequence Number=SeqID_7922
MMTLAQTWSVLSYYDLAPTSHTSDVNLDRARLIYGLVSRMDMDVGSFISQQISQIVQSSTSRLGFPALITALCDIQGVVSDTLIFESLSPAINLAYVKKNCWNPADPSITFPGPRRTRTRASASAPEAPLPTQSPSQPSQRPRHPPASTSASMDMHGQMLRSLHVGQQLIMENMHRLSLHLQMDPPLTTPEAYRQRVAWPGDQPSTDRGEEPSGAAEDPAVDKDLIADLATADWGPWADLGGGS

SEQ ID NO: 124701 - protein, 372 aa, Glycine max
  Coding DNA Sequence Number=SeqID_7923
  Gene Ontology: Mol. function=oxidoreductase activity; Cellular component=glycerol-3-phosphate dehydrogenase complex; Biological process=electron transport
  Homolog annotation: Hit_ID=Q7M0I4; Match level="QueryCoverage=94%, HitCoverage=94%, E-value=1e-119, Identity=60%"; Hit description =Fructosyl-amino acid oxidase
  Pfam annotation: Domain name=DAO; Domain location=9-353; Score=167.2; E_value=4.3e-47; Accession=PF01266.14; Description=FAD dependent oxidoreductase
  Pfam annotation: Domain name=FAD_binding_2; Domain location=9-333; Score=-137.6; E_value=0.023; Accession=PF00890.14; Description=FAD binding domain
  Pfam module annotation: Pfam domain module=DAO::FAD_binding_2; Domain location=9-353::9-333
MSDKTVAKTVIVLGGGILGVSTAWQLAQAGAQVTLVTEAALCSGATGRSLSWLNSAGERSQPYHALRMAGIDRYRTLFARHPQLDWLRFDGAIYWAADDDAGTKARHHYEKAQGYDSKLINRATVGDVDAQVNPASLSQVAIANPGEGWVSLPHLVEHLVQALRALGGEIVENAGKASVITKDGRASGIRSEKRGELLADRVLVACGPWTPEVVAPLGVHIPNGSPVSMLVTSQPGDHRLQVVMNTPRAAVRPNPGNTIAVDHDWYEEHIVAQADGQYSIDTAVINQLMAEAGNLIADGAPLQASSWKIGLKPIPGDGEPVVGELQQVPGCFVVFTHSGATLALILGEILTQEMLTGVKHPMLATFRPERFS

SEQ ID NO: 124702 - protein, 50 aa, Glycine max
  Coding DNA Sequence Number=SeqID_7924
RTLILSGPGGCHRKRNRQYADIRPAGKRKGRVDEAMGSGKVAVCDRQQGV

SEQ ID NO: 124703 - protein, 285 aa, Glycine max
  Coding DNA Sequence Number=SeqID_7925
  Gene Ontology: Mol. function=peptidase activity
  Homolog annotation: Hit_ID=Q26ML1; Match level="QueryCoverage=88%, HitCoverage=54%, E-value=3e-11, Identity=27%"; Hit description =Similar to Uncharacterized conserved protein
VGNLCRQRGEKTAGAIVNLSGQQQTRQLVRLRIDLLLRIKADVAALAKAQCRVAGTKVPFTINHADVTVNHIALRLLTDFRLRLPDVDTERKCRGDRRKAGLLPRPEPRDMTMAATKPRQQRNGLTRRQALPLAPDAPHRQAERQQQQHQPAAQQQAGMQVVIEKQHHAEHHLAAAQHKMSHPALAPNQRRAQAAKQAVKQQADFHHRQQQFLQLPFVTVPQRASQQRADKNQGKQQIEPALQRHLAAQQHVRHDHAGQQHAAQRQAINQQTITHQQLASGQQQQ

SEQ ID NO: 124704 - protein, 206 aa, Glycine max
  Coding DNA Sequence Number=SeqID_7926
MKDSIQEEVGVIMSIETMSREEHKKKLAEDATLKVLAGKVFEEIPEEITLKSLKTLFVEEVQRKVAEEATMFDVDASLNVSEDNIIEIDLVVKPIRSKQVSIVDERQIDVVLSEVVSEDNIRYQQQAIKWLLPSRSVPPPPSSKNILIKPYVNIGTHALDPQMQKLELEKLNLLKLWKEGFLGTDHFSYQSWDTLPKEEKHVLGVY

SEQ ID NO: 124705 - protein, 65 aa, Glycine max
  Coding DNA Sequence Number=SeqID_7927
MEGTKPMKAPMHASNPLSKDESGKPVDQIIYRGTYHQWADIITKPLSEECFVYIREHLNMVSLSK

SEQ ID NO: 124706 - protein, 153 aa, Glycine max
  Coding DNA Sequence Number=SeqID_7928
  Gene Ontology: Mol. function=transporter activity; Cellular component= outer membrane; Biological process=transport
  Homolog annotation: Hit_ID=Q33RE0; Match level="QueryCoverage=99%, HitCoverage=20%, E-value=3e-29, Identity=46%"; Hit description=TonB -dependent receptor precursor
MIDGIPQSSPLRNNDREIRSIDPSVLERIEVVKGATSIYGNGAEGGIINYITQKNTKSKPFSGKTVLGFTSHDLFNSNMFKSDGGAGYRVSQSFFGNLRKWDYLINGTITQNGVKIDGDDLVQNPRYGLGETSVGNIFGKVGYNIDDDNRVEL

SEQ ID NO: 124707 - protein, 176 aa, Glycine max
  Coding DNA Sequence Number=SeqID_7929
  Gene Ontology: Mol. function=RNA-directed DNA polymerase activity; Biological process=RNA-dependent DNA replication
EVFISLSLELGVVVGDNGLREAISAREGEISTSRYLTALGAFGSGPNMFSPHMEKGQGELILWRLLGGVRGIVHHFGGKGASPGVKTTDPFMKFSHDVVCLLVIQSFEQGVYGGSLERLLDDSLEVLNIFGADYLREQVCSGVVLPGDIVKAFEDDSCSVPLHVGRTTNVEAPLVW

SEQ ID NO: 124708 - protein, 136 aa, Glycine max
  Coding DNA Sequence Number=SeqID_7930
  Gene Ontology: Mol. function=zinc ion binding
  Homolog annotation: Hit_ID=Q1S818; Match level="QueryCoverage=63%, HitCoverage=88%, E-value=2e-12, Identity=41%"; Hit description=Zinc finger, GRF-type
  Pfam annotation: Domain name=zf-GRF; Domain location=38-80; Score =33.8; E_value=6e-07; Accession=PF06839.3; Description=GRF zinc finger
  Subcellular localization annotation: CTP_CleavageSite=45; ConfidenceScore=5.17e-01
MRLRPPGHRSSKPVLFIGASSASLPRRPGEAFGVVPKTHCLGVVQAPLVTSWTEDNPGRHFYGCGLCRKRCNYFEWHDPVTNIRQKRIIVALMKKVDELKLREKDLQTKISDMKMKGNFLGIGLVFSWIVIVEWLC

SEQ ID NO: 124709 - protein, 131 aa, Glycine max
  Coding DNA Sequence Number=SeqID_7931
MVGYTPSSFTDLVFAGERIKVGLKRGKFNHPACMNEKTGANEEGEDEGETHVVTAIPIRPSFPPTRQCHYLANNNPSPYLPPSYPQRSSLNQPQNPPSTQPMLNTTLSENQKGIFQQKKPIGFTPNSGVLC

SEQ ID NO: 124710 - protein, 165 aa, Glycine max
  Coding DNA Sequence Number=SeqID_7932
MVGHGCQCTDPDCRASRSPGGACRATPGGHARGMDTCAARGRGRSGEVPGHPGPGLVDARRPGRDCPDAGALRPAIAGQRLCAPVCQLRPGPGGAPAGQLPQRAAIPPGPGMARLPGSEPATRDWREGIQSAELQLQTTPGSQQAFGSGAGSAQMLRYLSGPEQP

SEQ ID NO: 124711 - protein, 56 aa, Glycine max
  Coding DNA Sequence Number=SeqID_7933
VGMKPDEVVLPEPIVPVIHKTLEARESQLRQEAATPERTPQTSKDPLSPRMDLSFA

SEQ ID NO: 124712 - protein, 184 aa, Glycine max
  Coding DNA Sequence Number=SeqID_7934
MGLIDEGRTEIGRVRREEGEVFMQSSDTNLGKPKPLEIDFTRDVTTQVPQGFQPAVVRTPSPFPYKSDKAVPWRYGIQGSDGRQDVSVMRVGDSIPTAKVTNIFGMSGMMHSGHIFAPPELPTKSNDKGKAREDMVEKEKIGLVTNNEAPVKKPMEEENIFGKKEISAEEATEFLRIIQQSEFK

SEQ ID NO: 124713 - protein, 127 aa, Glycine max
  Coding DNA Sequence Number=SeqID_7935
MSHYSICKSIGSRPTSQYDTRRFHSLDAWNRYTDNVLGRNILPERKVELYHTEFDDFKTELERHNLHKCLTNLVDGSIDVALVKEFYANLYSSEGPSPKQARVRGHLVYISCLLSQHISFTFHCQTA

SEQ ID NO: 124714 - protein, 222 aa, Glycine max
  Coding DNA Sequence Number=SeqID_7936
MGEVEEVQEQMEADMEAMKEQMATMMEAMMSVKKIVKANAVAVAATRAVAKAHEIPHHNLADFEPCLRYVTEGQAVGGIPLQNPLEGPQYHPQLHLLHSTTSKNPHAMAEIGKLDHLEERLRAIEGGEDYAFANLEELFLVPNIITPPKFKVLDFDKYKGTTCPKNHLKMYYRKMRAYKKDEELLIHSFQESLTGVAVTWYTNLEPSRVHSWKDLVVAFVRQ

SEQ ID NO: 124715 - protein, 229 aa, Glycine max
  Coding DNA Sequence Number=SeqID_7937
  Gene Ontology: Mol. function=transcription factor activity; Cellular component=intracellular; Biological process=regulation of transcription, DNA-dependent
  Homolog annotation: Hit_ID=Q1M3T8; Match level="QueryCoverage=98%, HitCoverage=95%, E-value=7e-94, Identity=74%"; Hit description =Putative GntR family transcriptional regulator
  Pfam annotation: Domain name=FCD; Domain location=76-205; Score=28.2; E_value=2.9e-05; Accession=PF07729.2; Description=FCD domain
  Pfam annotation: Domain name=GntR; Domain location=4-66; Score=55.9; E_value=1.3e-13; Accession=PF00392.11; Description=Bacterial regulatory proteins, gntR f
  Pfam module annotation: Pfam domain module=FCD::GntR; Domain location= 76-205::4-66
MRTGKTALYEDLKRLILTMELDPDELLDEASLTAQYGLSRTPVREVFQRLAGEGYLEIVEKRGVRVIPMSHATLRNFFLVAPMIYAATGRLAAQHYKPAQLKALKETQKRFRKAVQSHDVEALALENNRFHEIMGEMAANPYLQPSLGRLLIDHCRIGHTFFRPRNDDMERRLQLAADHHDAFIVALEAHDEQAVVDLVFEHWELSRENMEIFIAPQGLKADERIQSPE

SEQ ID NO: 124716 - protein, 116 aa, Glycine max
  Coding DNA Sequence Number=SeqID_7938
  Gene Ontology: Mol. function=DNA binding; Biological process=DNA integration
MTTCNFFMDQAGEERKLQLSELDEICLEAYESAKFYKEKTKKFHDSMIIKKDFMVGQKVLLYNSRLGLMSVEIKSDSTNKSFKVNGHRLKSFLTNPSLVDIVVEETSLLHPTLPPP

SEQ ID NO: 124717 - protein, 130 aa, Glycine max
  Coding DNA Sequence Number=SeqID_7939
  Gene Ontology: Mol. function=nucleic acid binding; Biological process= transport
  Homolog annotation: Hit_ID=Q8H6Q8; Match level="QueryCoverage=99%, HitCoverage=42%, E-value=1e-14, Identity=42%"; Hit description=CTV.20
MVATAYQTSHECSEETIIDILVAGFSGQLKGCAVKTDLNGKVITNDDDKEIPDAVNTLIFTIAQHFIGDPSLWKDRSVELLSNLKCRTLADFRWYRDTFLTRVYTREDSQQPFLERKISSRSSQIIRRQG

SEQ ID NO: 124718 - protein, 81 aa, Glycine max
  Coding DNA Sequence Number=SeqID_7940
MLQPYGISIGLKEHSNPMTPKAYTPKSPSGPLPPDSGNLHFLFNTVHLHFSQDNTGRVIVQFIAYNTSNFTSSVNYTLIHN

SEQ ID NO: 124719 - protein, 38 aa, Glycine max
  Coding DNA Sequence Number=SeqID_7941
MVHNAIDRQWDMVYIWCQKRIIDRRERISRSISGKESM

SEQ ID NO: 124720 - protein, 146 aa, Glycine max
  Coding DNA Sequence Number=SeqID_7942
MERSMIDAASDGALGDMTPTETRNLIEKMASNSQQFSARNDAIVIRGVHEVATNSSSSVETKKLEGKLDALVNLVTQLAMNKKSAPVARLCGLCSSTDHHTNLCPSVQQSVAIEQPKVYAANIYNRPPQPQQQNQPQQNNYDLSAT

SEQ ID NO: 124721 - protein, 96 aa, Glycine max
  Coding DNA Sequence Number=SeqID_7943
MSYANLLPYLLDNAMVVISPSNIPQPPFPRGYNSNVTCAYHGGVSGHSIEHCITLKHKVQTLIDACTMHELQANLGADKKSSPDRLKTQKGGLGKS

SEQ ID NO: 124722 - protein, 105 aa, Glycine max
  Coding DNA Sequence Number=SeqID_7944
MELAFTEFGREAVGSGYMRLEFWEGWADDRNVLVINIYIKLIDTVDLEGGPVGKPVVPAALMNRPTRGERRFAYWALAECILAYYVGTDEGVSEVLHVAGEKRLH

SEQ ID NO: 124723 - protein, 169 aa, Glycine max
  Coding DNA Sequence Number=SeqID_7945
  Gene Ontology: Mol. function=ATP-dependent helicase activity; Cellular component=membrane; Biological process=cobalt ion transport
  Homolog annotation: Hit_ID=Q0S338; Match level="QueryCoverage=87%, HitCoverage=9%, E-value=5e-45, Identity=65%"; Hit description =Probable ATP-dependent helicase
  Pfam annotation: Domain name=Helicase_C; Domain location=95-167; Score=53.6; E_value=6.5e-13; Accession=PF00271.21; Description =Helicase conserved C-terminal domain
MDDMTNPPPPPGAPPEAPGVDAEYTEVTGSVWPHVEEAIVDRILQNNWTIVFANSRRLAERLTGRLNEIYSERIGVALPEATVPAAMMAQAGATAGADPVLAKAHHGSVSKEQRAQVEEELKSGVLRCVVATSSLELGIDMGAVDLVIQVEAPPSAASGLQRVGRAGHQ

SEQ ID NO: 124724 - protein, 80 aa, Glycine max
  Coding DNA Sequence Number=SeqID_7946
MVELATGQGTDVSQSVRPPNIGDNQINFPSWVHNNLNHNQFKGACTEDPMLISQDFYNYAYRIMGKEEERLEMPLQGEDE

SEQ ID NO: 124725 - protein, 57 aa, Glycine max
  Coding DNA Sequence Number=SeqID_7947
MEAPNFPYTWWSGPLKNDLYSLKGFDASEYLFLAPTKNKELISYKLNPHPTTPLLEE

SEQ ID NO: 124726 - protein, 55 aa, Glycine max
  Coding DNA Sequence Number=SeqID_7948
MEEFDTQVAWPGAQPSPSGREGGCFYRPYPRAIPTPIRDDATPSAPAPELEQPIS

SEQ ID NO: 124727 - protein, 260 aa, Glycine max
  Coding DNA Sequence Number=SeqID_7949
  Gene Ontology: Mol. function=lyase activity; Cellular component =membrane; Biological process=ubiquinone biosynthetic process
  Homolog annotation: Hit_ID=Q8FX00; Match level="QueryCoverage=100%, HitCoverage=51%, E-value=1e-133, Identity=86%"; Hit description=3 -octaprenyl-4-hydroxybenzoate carboxy-lyase
  Pfam annotation: Domain name=UbiD; Domain location=1-259; Score =136.9; E_value=5.4e-38; Accession=PF01977.7; Description=3 -octaprenyl-4-hydroxybenzoate carboxy-lyase
MRPRQVRRASVQATILEGEAVNLDLLPIQWCWPGEPAPLVTWPLVITRAPDDPSDVNVGIYRMQKLGRDKLIMRWLAHRGGARHHRMWQKRGEDMPVAVAIGADPATILAAVMPLPEGMSELAFSGLLAERRPSVVDAHTVPLSVPANAEIILEGRVSASVTAPEGPYGDHTGYYNSVEEFPVMQVAAMTMRKNPVYLSTYTGRPPDEPSRLGEVMNELFVPIVRKQFPEIADLWLPPAACSYRAIVVSIDKRYPGQARR

SEQ ID NO: 124728 - protein, 53 aa, Glycine max
  Coding DNA Sequence Number=SeqID_7950
MCLLGKESLLMKHWARQNRRISLEVYQSHMSHADEGTHGLPMSNNKANREECN

SEQ ID NO: 124729 - protein, 178 aa, Glycine max
  Coding DNA Sequence Number=SeqID_7951
MVHLELRGPSWEDLRKDLTTLAQVWSVLSYSNLAPTSHTSDLTVDRARLIFGLVSCLDMNIRALISGQMTSIAQSNTSRLGFPALITALCRARGIVSDSLTFERSSPVINLAYIKKNCWNPEDLTISIRGARRARARPAELPSTSVAPTPASTSAAPSIPSQTDSQCFEAMLQSIHQG

SEQ ID NO: 124730 - protein, 92 aa, Glycine max
  Coding DNA Sequence Number=SeqID_7952
MGAKYLEVVKRGSHPNNEWSPNEIRAQNDHNLSLRSFWTRSSLGGKAQNDHNLSLHATKHDRLWMAKRYEKERLKEKKIQKISKISRNLKKI

SEQ ID NO: 124731 - protein, 88 aa, Glycine max
  Coding DNA Sequence Number=SeqID_7953
MSGFTRNSPQISASPHQLDLAPYASEPYHAQWNAPGLLRDKHTLRSSRILGEMEVDEPWLGLWLPLNYHVDMGSSGVCHGKCGRQTLW

SEQ ID NO: 124732 - protein, 245 aa, Glycine max
  Coding DNA Sequence Number=SeqID_7954
  Gene Ontology: Mol. function=amidase activity; Biological process =cell wall catabolic process
  Homolog annotation: Hit_ID=Q8CJS1; Match level="QueryCoverage=34%, HitCoverage=26%, E-value=8e-19, Identity=56%"; Hit description =Putative membrane protein
  Pfam annotation: Domain name=LysM; Domain location=31-74; Score=59.0; E_value=1.6e-14; Accession=PF01476.10; Description=LysM domain
  Pfam annotation: Domain name=LysM; Domain location=98-141; Score =59.7; E_value=9.3e-15; Accession=PF01476.10; Description=LysM domain
  Pfam module annotation: Pfam domain module=LysM::LysM; Domain location=31-74::98-141
  Subcellular localization annotation: CTP_CleavageSite=54; ConfidenceScore=5.48e-01
MIYPGQTLTLRSPAAPPSTPATAPAPTATSHTVVAGDTVFAIARAYATTVDAVLAANKLTRSSVIYPGQRLVVSGSAAVPNAAPAATAAPAPSAAATHAVVAGDTIFGIAAKYGTTTQSLFALNGLSSSSIIYPGQKLVVRAAPAPAAAAASTGGQRTATLTAEQAGNAALIIRIGRELGVSDRAIALALATAMVESELRNLDWGDRDSLGIFQQRPSTGWGTPAQIMDAERSTRVFYGGPHDPN

SEQ ID NO: 124733 - protein, 207 aa, Glycine max
  Coding DNA Sequence Number=SeqID_7955
LEEAAQSGSVDGVIDTSFLVRRHVKWKMARTKKTREMTTEAIKEIDSFEEQASQGSFIPHGRQDVLIAAIGPTDPANQGPARGVDHRKSDSTAPGIIKLDAVPVSVPDAISGSCTASGASGWSLRNYPETGDSDKCGLYIEAQVGVEEVKDPDVPVPVPTDETVVSLEKPPQNPDPEVDNLLYLMTLTIPELFLRPYQVTWDVPVFR

SEQ ID NO: 124734 - protein, 182 aa, Glycine max
  Coding DNA Sequence Number=SeqID_7956
NCDILITVWEDYAIQLHDAIDKNLLLQEPLVVMLTLGKIKDATDKYPLSVQNIKFGSKLYVNADITEIHEFRQSLSMPFYSGGMINDKDGSQSQSSQSNVDCYCLTVGTVDEIIIDAPWSCDSCPNCTTTFDPSKGGSACRSCHTSVVDTVPRLAMIIFCTDYLFTRFAVLANFPEISMDVK

SEQ ID NO: 124735 - protein, 109 aa, Glycine max
  Coding DNA Sequence Number=SeqID_7957
MYYGTQSDIRVKSYCRLKLPRASTFNFERLDALRDSIRHASKTLLSFELAQSFRIQFRSSRYITGLNQISESKVIVLRISSEVQNSISSVSIDYGTQSDIRAKSYCHLN

SEQ ID NO: 124736 - protein, 106 aa, Glycine max
  Coding DNA Sequence Number=SeqID_7958
MARKCFPNECMIAQDSLLNASMCIMLNILPICISVSETMKVCMEMAPRKLASKRSRKDKAAEGTSSAPEYDSHRFRSAEHQQRFEAIKGWSFLPGATRPAQGRRVY

SEQ ID NO: 124737 - protein, 118 aa, Glycine max
  Coding DNA Sequence Number=SeqID_7959
MNLRVEDAGKNGGSLVTVSLPEDPLGVLPEDFRKKGSSRGNETTSGRTGLPESSRNTSSGMFPENVLLPETFQKRVLPDDILPRKGPITRTMSKRLQEDWARAAEEGPRVLMNLRVDF

SEQ ID NO: 124738 - protein, 127 aa, Glycine max
  Coding DNA Sequence Number=SeqID_7960
GKDKGRLELSIKVEKIFFDLFEAMKHPDMGDAYFEEEEVEQEITLSTATMVLQSPLEKEPGYGRDCLACDEELDDSKDSCVDQVVFEELEKLRPAEKPKAELKTLPAHLKYVFLEEDETNLLSLATL

SEQ ID NO: 124739 - protein, 95 aa, Glycine max
  Coding DNA Sequence Number=SeqID_7961
MRRRSRVETLQGEDGTWVSDGESLKSMVTQYYQNLFVDDQCVDEFPVTRIWEHLRLLALMASMQFFLLKSMEYSGGCSCQVGSKRVSGSVIGASD

SEQ ID NO: 124740 - protein, 459 aa, Glycine max
  Coding DNA Sequence Number=SeqID_7962
  Gene Ontology: Mol. function=nucleic acid binding
  Homolog annotation: Hit_ID=Q1T6D0; Match level="QueryCoverage=39%, HitCoverage=40%, E-value=2e-13, Identity=31%"; Hit description=Zinc finger, CCHC-type; Lipocalin
GVESSTRVSSESSKEEDDIQRSTRKVNRKPNEEGDGNSEMELDKDKEAEQGVPDGTYREKLLKNGGPMAFSTFDGRCFGYLDQKIPPTPISKEDFERFPEVPISDKEFSDWCKPWKGVLDGHGDGEEIGFPKFPIELFNDQFLWRLGSTPGVMLKIDRVMTIQARGCFTRICVEIDLFKPLQPKIIARGYLLNLQYEGLHLIYFNCGRYGYKDANSVEMKADVVDIQSQQKPRDEKTVLFNGVGLANHTKIVAQGCEDRNNKSFGSKFIALNEAREERLVSRVKRNANGPSTSGPKGVQKQNRGVVFKEMKTNYVVEEGKTGPTKNTGPVLRKPKEKQIKGNTKMGIANKGKASKKGKQEVVPTDPSIVGEAQIKGGRSNASFKNENDDMVVCQEGSQGHVKAIHDWVVEEVVGHSSGICCLWDSSLWKVQMLGNSRYHVHLKGMWDVLRELACEIDKS

SEQ ID NO: 124741 - protein, 56 aa, Glycine max
  Coding DNA Sequence Number=SeqID_7963
MKNNEEQTMNGGPIALAFPRLFVAEQGIWAEGSSPRRADNFILKQLACLGELVTSS

SEQ ID NO: 124742 - protein, 120 aa, Glycine max
  Coding DNA Sequence Number=SeqID_7964
MTVPQEGTILLKHLLSLTRSFTLHKREPQRPLTLTLSLFPFQIPLSLIVVFGAAQPKPDIQIPLSLSDLNAYRPSHGFKAHPQGAQGLVERPTNFLQHRYPFFSGYGASLSSFILSTSNP

SEQ ID NO: 124743 - protein, 159 aa, Glycine max
  Coding DNA Sequence Number=SeqID_7965
  Gene Ontology: Mol. function=cysteine-type endopeptidase activity; Cellular component=vacuole; Biological process=proteolysis
  Homolog annotation: Hit_ID=P49045; Match level="QueryCoverage=76%, HitCoverage=26%, E-value=3e-50, Identity=77%"; Hit description =Vacuolar-processing enzyme precursor
  Pfam annotation: Domain name=Peptidase_C13; Domain location=55-159; Score=-280.5; E_value=0.049; Accession=PF01650.8; Description =Peptidase C13 family
MALHRSIISKTTWYNVLLWMMVVLVRVHGAAARLNRKEWDSVIKLPTEPVDADSDEVGTRWAVLMASSNGYGNYRHQLLIKGGLKEENIVVFMYNDIATNELNPRHGVIINHPEGEDLWILLPGGDEAGPTKPICLSQDEIKPCTTGTPLVAHTYNVVA

SEQ ID NO: 124744 - protein, 144 aa, Glycine max
  Coding DNA Sequence Number=SeqID_7966
  Homolog annotation: Hit_ID=Q1SWQ8; Match level="QueryCoverage=94%, HitCoverage=60%, E-value=5e-08, Identity=26%"; Hit description =Nucleic acid-binding, OB-fold; TonB box, N-terminal
MDLKENCTYVMHNFKVLKNNGQYRVCDHQFKLVFIGVTIVADQFKPGLLVDVIGVVEEVVFRQVSGKGRRVVFKLKDLSQQLLSCILWDDYCSQFLKFLDDYEGDGPIYSSIEPLILSYIDQQFFQGFKLIINQPVMEIQEFNE

SEQ ID NO: 124745 - protein, 156 aa, Glycine max
  Coding DNA Sequence Number=SeqID_7967
  Pfam annotation: Domain name=Transposase_23; Domain location=2-57; Score=-1.4; E_value=0.0016; Accession=PF03017.5; Description =TNP1ENSPM transposase
MLLLVAGGKVFGVGGTIHTVAYGDDVVRVCVETVYDAEAIVPLPTSEIQYVRDAMNSFIGWPIHLVKPLSYDSDLNVRKPIEHSSDAKLAGESDPLGELMKILFYVYQNPMEVPWEAHQFGLPEIGAKFYITHADLAEIISGDKCLNIAILQLWAM

SEQ ID NO: 124746 - protein, 54 aa, Glycine max
  Coding DNA Sequence Number=SeqID_7968
  Homolog annotation: Hit_ID=Q10NT0; Match level="QueryCoverage=96%, HitCoverage=5%, E-value=2e-16, Identity=83%"; Hit description =Expressed protein
  Pfam annotation: Domain name=DUF593; Domain location=2-54; Score =35.3; E_value=3.8e-08; Accession=PF04576.6; Description=Protein of unknown function, DUF593
MKKKALSTLYAELEEDRSAYAIAANQTMAMINRLPEEKATMQMEALQYQRMMEE

SEQ ID NO: 124747 - protein, 431 aa, Glycine max
  Coding DNA Sequence Number=SeqID_7969
  Gene Ontology: Mol. function=copper ion binding; Cellular component =periplasmic space; Biological process=electron transport
  Homolog annotation: Hit_ID=Q9C6V9; Match level="QueryCoverage=96%, HitCoverage=99%, E-value=1e-170, Identity=65%"; Hit description =Copper amine oxidase, putative
  Pfam annotation: Domain name=Cu_amine_oxid; Domain location=2-421; Score=677.1; E_value=1.3e-200; Accession=PF01179.10; Description =Copper amine oxidase, enzyme domain
MTNLKRFSKICIFSHPHHWANWNFHVGFDIRAGPIISLASIYDLQKQRHRRVLYKGFIPELFVPYQDPTEEWYYTTYFDSGEYGFGQSMSSLQPLNDCPPNAAFIDAYYAGSDGTPVKIANAFCIFEKYAGDIMWRHTEISIPNEVITEARSDVSLVVRIVSTVGNYDYVIDWEFKPNGCIKIGVGLTGILGLKAGTYTNTDQIKEDIYGTLIADNTIGIYHDHFFTYYLDLDIDGEANSFVKSNLETVRVKDDTTPRKSYWTVVSETAKTEADAKINLGSKPSELLVVNPNKKTKQGNKIGYRLLPGPVAHPLLLNDDYPQIRAAFTNYNVWVTPYNKSEKWVGGSYVDRSRGDDTIAIWSLRDREIENKDIVLWYTMGFHHVPSQEDYPIMPTLSGGFELRPTNFFERNPVLKTKSPKPVHFPNCTSQH

SEQ ID NO: 124748 - protein, 677 aa, Glycine max
  Coding DNA Sequence Number=SeqID_7970
  Gene Ontology: Mol. function=oxidoreductase activity; Cellular component=periplasmic space; Biological process=electron transport
  Homolog annotation: Hit_ID=Q43077; Match level="QueryCoverage=99%, HitCoverage=99%, E-value=0.0, Identity=55%"; Hit description=Amine oxidase [copper-containing] precursor
  Pfam annotation: Domain name=Cu_amine_oxid; Domain location=241-667; Score=742.1; E_value=3.5e-220; Accession=PF01179.10; Description =Copper amine oxidase, enzyme domain
  Pfam annotation: Domain name=Cu_amine_oxidN2; Domain location=27-120; Score=108.6; E_value=1.8e-29; Accession=PF02727.6; Description=Copper amine oxidase, N2 domain
  Pfam annotation: Domain name=Cu_amine_oxidN3; Domain location=126 -223; Score=117.2; E_value=4.7e-32; Accession=PF02728.6; Description =Copper amine oxidase, N3 domain
  Pfam module annotation: Pfam domain module=Cu_amine_oxid::Cu_amine _oxidN2::Cu_amine_oxidN3; Domain location=241-667::27-120::126-223
MDTTMKVMLSFILMLLWSCVECKNHPHPQDPLTPSEFNDVRTIVQNAYPTSHNLTFHYVALDEPNKSELLSWLSSNPKTKPTPSSPPPPRRAFAIVRSQKQSHEITVDLSTRSIVSTKVYEGNGYPMLTLGEIAVATRLPFSYEPFKESVTKRGLNISLVRCNAYSFGWFGEAKTVRSVKIKCHYRNGTTNFYARPLEGVAVLVDFDNMKIVGYNDRYVVPVPKAEGTEYRASKLEPPFGPKLKGIAFKQDGGPGFTIDGHSVSWANWVFHVGFDIRAGLVISQASIYDLQKQKYRPVLYKGFVSELFVPYQDPSEEWYYATFFDSGEYGLGQYMSSLQPLTDCPPNAEFIDAYYASSDGTPVKISNAFCIFEKYAGDIMWRHTEVGIPDEVITEVRSDVSLVVRMVSTVANYDYVIDWEFKPSGSIKSVVGLTGILGLKAGTYTNTDQIKEDIYGTLIADNTIGIYHDHFFTYYLDLDIDGEANSFVKSNLETVRVKDDTTPRKSYWTVVSETAKTEADAKINLGSKPSQLLVVNPNKKSKQGNKIGYRLLPGPAARPLLLNDDYPQIRAAFTNYDVWVTPYNKSEKWVGGLYVDRSRGDDTLAVWSRRNRKIENKDIVLWYTMGFHHVPCQEDFPVMPTLSGGFELRPTNFFESNPVLKTLSPKLVGWPNCTSQH

SEQ ID NO: 124749 - protein, 662 aa, Glycine max
  Coding DNA Sequence Number=SeqID_7971
  Gene Ontology: Mol. function=oxidoreductase activity; Cellular component=periplasmic space; Biological process=electron transport
  Homolog annotation: Hit_ID=O48552; Match level="QueryCoverage=98%, HitCoverage=96%, E-value=0.0, Identity=61%"; Hit description=Copper amine oxidase precursor
  Pfam annotation: Domain name=Cu_amine_oxid; Domain location=252-662; Score=598.8; E_value=4.9e-177; Accession=PF01179.10; Description =Copper amine oxidase, enzyme domain
  Pfam annotation: Domain name=Cu_amine_oxidN2; Domain location=32-121; Score=105.5; E_value=1.5e-28; Accession=PF02727.6; Description=Copper amine oxidase, N2 domain
  Pfam annotation: Domain name=Cu_amine_oxidN3; Domain location=127 -224; Score=146.3; E_value=8.4e-41; Accession=PF02728.6; Description =Copper amine oxidase, N3 domain
  Pfam module annotation: Pfam domain module=Cu_amine_oxid::Cu_amine _oxidN2::Cu_amine_oxidN3; Domain location=252-662::32-121::127-224
MIRRFDKAVPMIVQCLILVLFLKFNSVNSLAHPLDPLSPAEINKTRDIVQGSYLGAIPNITYHFVDVEEPDKKNVLEWLSSNTKDKPIIPRQATVVVRVKGETHELVVDLTKRSIVSDKIYTGHGYPPFTFNELFQASKLPLTYPKFKSSIAKRGLNLSEVSCVPFTIGWYGEKITRRALKVSCFYRGGSVNVWARPIEGITVLVDVDSMQITMYNDRYIAPLPKAEGTDFQSSSSNSNSRPKASSASCNGSDITGFTIKGHEVKWANWVFHVGFNARAGMIISTASIFDARTQKYRRVLYRGHVSETFVPYMDPTEEWYFRTFMDAGEFGFGRAADTLQPKVDCPSNAVYMDGYMAGPNGEVQQVPRAICIFERNSGSLAWRHMEINNPQNLIRNGEPEITLVVRMVATVGNYDYVLDWEFLRSGSIKVGVDLTGIMEMKAVPYRQKSEIKERVFGTLVAENTIANYHDHHITYYLDLDIDDSSNSFINAKLQRARATGFRTPRKSYWTVVREIAKREAEGRIRLGLEPAELLIVNPNKRTKLGNEVGYRLISAHPITSLLSDDDYPQRRASYTKYQLWVTAYNRSERWAGGFYADRSRGDDGLAVWSQRNREIENTDIVLWHTIGIHHVPYQEDFAAMPAIHGGFELRPANFFESSPLLE

SEQ ID NO: 124750 - protein, 303 aa, Glycine max
  Coding DNA Sequence Number=SeqID_7972
  Homolog annotation: Hit_ID=Q47522; Match level="QueryCoverage=19%, HitCoverage=77%, E-value=5e-19, Identity=74%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDGMPKVLVMQCKVSHSHVRLYTLGVDVDRRRLMDKGREGVERGFFLFEILRLWMYSLERFEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 124751 - protein, 484 aa, Glycine max
  Coding DNA Sequence Number=SeqID_7973
  Homolog annotation: Hit_ID=Q10PW5; Match level="QueryCoverage=75%, HitCoverage=87%, E-value=1e-112, Identity=57%"; Hit description =CRAL/TRIO domain containing protein, expressed
  Pfam annotation: Domain name=CRAL_TRIO; Domain location=88-233; Score= -37.2; E_value=0.014; Accession=PF00650.10; Description=CRALTRIO domain
MGKKTELKDHKEIAKVETVLELLRKQTPLTVKQEKFCNYACVKRFLKAKGDSVKKASKQLKACLAWRESVIADHLIADDFSAELADGLAYLAGHDDESRPVMIFRLKQDYQKLHSQKMFTRLLAFTIEVAISTMPKNVEQFVMLFDASFYRSASAFMNLLLPALKIVAEYYPGRLCKAFVIDPPSLFAYLWKGVRPFVELSSWTTVVSSLDFEESLDFNDFAAYPRASSLRFDSASVKSTAKIGSCSSSRFSFTVSHHLDSLKPWYLSLADTSASKVGPTSPSAALISPLNARSLSFASPVARTPRGPPATRKGLFPSTPLPQRVTAPPRTSFLQSPATFFRRDSHVAAKGERCRESFLPYVKFYRRPYDEMAILEVIAWEEGSVVETTSTRSAHWWEIEYVSGLVVRVRSQNLLGVSEVLLAYKFSPPYDVAAGSQQQQGVMSDALRNRILIHHLMYIQMFGAGKGYNLARECSVVGSEQRNK

SEQ ID NO: 124752 - protein, 189 aa, Glycine max
  Coding DNA Sequence Number=SeqID_7974
  Gene Ontology: Mol. function=catalytic activity; Biological process =metabolic process
  Subcellular localization annotation: CTP_CleavageSite=58; ConfidenceScore=5.28e-01
MTSFYVPQMPLQSKASLKLIRLTSGLGAYTTSRTHNNASWLLFWERHMKRLSQSIQILSNLAPELLFKSNNSAILLPSSATLPIWQPTVQMLVNDSVCKVLPIALKERNDCEELAITTLVSGNLEELNACDTFSEERMSKILDVHVHVETYVPPTFGIWGNGVHLAVVGYGRNVAAAKYSDWVRSVYAI

SEQ ID NO: 124753 - protein, 189 aa, Glycine max
  Coding DNA Sequence Number=SeqID_7975
MSKVEGSKYEELRMQRISENQAKIEALGLSKLVTIFKDKIQKAKKKDKKKANDDVEDYVMKSSILSSKRVYNDSSIHHSLDKEVKESLPNNASHASEFTNVEQVESNAGEHVIKKGRGHTINAKFQKKKENLMAKGKNIDIQFPPPFYKICKKHAKYFKSEAQVCIRQKAPLQVNGWSEISKDDVDEMW

SEQ ID NO: 124754 - protein, 116 aa, Glycine max
  Coding DNA Sequence Number=SeqID_7976
  Gene Ontology: Mol. function=oxidoreductase activity; Biological process=electron transport
  Homolog annotation: Hit_ID=Q69QN3; Match level="QueryCoverage=85%, HitCoverage=42%, E-value=1e-13, Identity=35%"; Hit description =Putative oxidoreductase, FAD-binding
MVLEEGRVLEADSMAHSIVLEAREPGSITLHALFLSYYSSKRGKSLDPEVYPPHTGRVIGEVPGVKGCYVATGHNWDNILNGPATGVVAELVIDGHSNIVNLKRFSPTRFLGRRKA

SEQ ID NO: 124755 - protein, 192 aa, Glycine max
  Coding DNA Sequence Number=SeqID_7977
MSEIEEVQEQMKADMEAMKDQMAAMMEAMLSMKKIMESNAVAVATTSVTTESKHSFPGLPPNYAPPNVAHTHDENVDNFMPPYPLRAKNPNLIMHIVPPAMVEREKFNQREERLRAIEGGGDHAFANMAELYLVPNVVIPPKFKVSDFDKYKGTTCPKNHLKIYCRKMGAYAKDEKLLMHFFQESLTEIVVT

SEQ ID NO: 124756 - protein, 97 aa, Glycine max
  Coding DNA Sequence Number=SeqID_7978
MYCRRMGAYAKDEELLIHSFQESLTGVAVTCEEDEKEGETYAVTAILIRPSFPPTQQYHYSANNNPSHYPPPSHPQRSSLKSTTKPTYRTSNDKHHL

SEQ ID NO: 124757 - protein, 68 aa, Glycine max
  Coding DNA Sequence Number=SeqID_7979
MSDYEYTINWISSIILQRPTPTAGMPNKGPLHHHHNITYVEVLDGYHYELRKSPYNIKECRRGHATSL

SEQ ID NO: 124758 - protein, 66 aa, Glycine max
  Coding DNA Sequence Number=SeqID_7980
MALFSTIEPKNIDEALNEDSWVTTMEEELNLFTKNKTAQVSFRRSKILQLTIVDYLVPRNKEKLSI

SEQ ID NO: 124759 - protein, 299 aa, Glycine max
  Coding DNA Sequence Number=SeqID_7981
  Gene Ontology: Mol. function=protein histidine kinase activity; Cellular component=integral to membrane; Biological process=two -component signal transduction system (phosphorelay)
  Homolog annotation: Hit_ID=Q1H0K4; Match level="QueryCoverage=76%, HitCoverage=39%, E-value=5e-67, Identity=55%"; Hit description=Multi- sensor signal transduction histidine kinase
  Pfam annotation: Domain name=HAMP; Domain location=1-67; Score=39.0; E_value=1.6e-08; Accession=PF00672.15; Description=HAMP domain
  Pfam annotation: Domain name=HATPase_c; Domain location=194-289; Score=75.7; E_value=1.5e-19; Accession=PF02518.16; Description =Histidine kinase-, DNA gyrase B-, and HSP90-like ATPase
  Pfam annotation: Domain name=HisKA_3; Domain location=88-155; Score =48.7; E_value=2e-11; Accession=PF07730.3; Description=Histidine kinase
  Pfam module annotation: Pfam domain module=HAMP::HATPase_c::HisKA_3; Domain location=1-67::194-289::88-155
MGIGFFVLLNLLVYGLLSHALRPVRHILHAISRIEQGDLTTRLERFSVPEFDKIGLSLNQMAVSLDAERQLEQNRQLTQLIQQHIEDERRSLARELHDELGQYVTAIKTFAVAIVNKTKENAPDIAASAQTIVAAANHIYDGMHNIIRQLRPAAMDNMGLVETLSDMVSGYQGQHPELSIQLHLSGQFQPLGENVNINIYRIVQEAVNNAIKHAHAQSINVHLLTAAEGLRLMVCDDGVGMRVESVDQTQHFGLLGMRERVQALHGQFKVISQPDAGRGTTLEIRLPIQSAEEKRERNA

SEQ ID NO: 124760 - protein, 97 aa, Glycine max
  Coding DNA Sequence Number=SeqID_7982
MELYLQHLVRQQVANHRGQVQIHECLYWFGLSQQGQGSTPFAFPTPEQFGAEVAWPGDWPEAQAGEEPAGFPGEADESHMDEDMTDLLGFLGGSGAA

SEQ ID NO: 124761 - protein, 56 aa, Glycine max
  Coding DNA Sequence Number=SeqID_7983
  Homolog annotation: Hit_ID=Q00NU9; Match level="QueryCoverage=91%, HitCoverage=7%, E-value=6e-08, Identity=55%"; Hit description=Heat shock protein 90
VEDVDEEKEKEEKKKKKIKEVSHECSLVNKHKPIWMRKPEEMTKEEYSAIMKESHQ

SEQ ID NO: 124762 - protein, 121 aa, Glycine max
  Coding DNA Sequence Number=SeqID_7984
  Homolog annotation: Hit_ID=Q94C77; Match level="QueryCoverage=51%, HitCoverage=8%, E-value=1e-18, Identity=66%"; Hit description =Receptor protein kinase-like protein At4g34220 precursor
  Pfam annotation: Domain name=LRRNT_2; Domain location=33-74; Score =61.3; E_value=3.2e-15; Accession=PF08263.3; Description=Leucine rich repeat N-terminal domain
MSLNSQNLHLWWRLLSFLLLLLQFVTSQFVTPLNSDGIHLLKFKYSILSDPLSVLKNWNYDDVTPCSWHGVACSEIGAPGTPDFFRSGCCKPAEECQFSYVNPTTWMKPTNVTNQSNPTDS

SEQ ID NO: 124763 - protein, 63 aa, Glycine max
  Coding DNA Sequence Number=SeqID_7985
MLYGIEAVILVEIGELTFRIANMNLSMNEGNHRIELNLIEERREVVVIKDATLKRKIVASLNY

SEQ ID NO: 124764 - protein, 86 aa, Glycine max
  Coding DNA Sequence Number=SeqID_7986
MAQGLCCYLSLQEMKQATKNFDESNVIGVGGFGKVYKGVIDNGFKVSIKRSNPQSRRHQLTEKSDVYSFGVVLFEALYFRKVALDT

SEQ ID NO: 124765 - protein, 328 aa, Glycine max
  Coding DNA Sequence Number=SeqID_7987
  Gene Ontology: Mol. function=imidazoleglycerol-phosphate dehydratase activity; Cellular component=cytoplasm; Biological process=amino acid biosynthetic process
  Homolog annotation: Hit_ID=Q43072; Match level="QueryCoverage=75%, HitCoverage=89%, E-value=1e-108, Identity=80%"; Hit description =Imidazoleglycerol-phosphate dehydratase
  Pfam annotation: Domain name=IGPD; Domain location=111-255; Score =361.2; E_value=1.7e-105; Accession=PF00475.9; Description =Imidazoleglycerol-phosphate dehydratase
  Subcellular localization annotation: CTP_CleavageSite=60; ConfidenceScore=5.70e-01
MELSAPSSPSLLRCPSSLLLNSRVRVFHTIPNPTRPPFQASIFSLNQRNLTPMDLPRNVSSAALVGDNASATTTLPIDSDARIGEVKRVTKETNVSVKINLDGSGVADSSTGIPFLDHMLDQLASHGLLDVHVKATGDIHIDDHHTNEDVALAIGTALLHALGDRKGINRFGNFSAPLDEALIHVSLDLSGRPHLSYNLDIPTQRVGTYDTQLVEHFFQSLVNTSGMTLHIQQLAGKNSHHIIEATFKAFARALRQATEYDPRRRGTIPRYVRKGFCPVANIFLAVDLHGSTITVLRCCVMDKCLCGGTLSMTNVILFCGGIEEEHME

SEQ ID NO: 124766 - protein, 703 aa, Glycine max
  Coding DNA Sequence Number=SeqID_7988
  Gene Ontology: Mol. function=protein serine/threonine kinase activity; Cellular component=cytoplasm; Biological process=protein amino acid phosphorylation
  Homolog annotation: Hit_ID=O81637; Match level="QueryCoverage=84%, HitCoverage=92%, E-value=1e-168, Identity=52%"; Hit description =Mitogen activated protein kinase kinase
  Pfam annotation: Domain name=Pkinase; Domain location=19-254; Score =158.1; E_value=2.4e-44; Accession=PF00069.15; Description=Protein kinase domain
  Pfam annotation: Domain name=Pkinase_Tyr; Domain location=31-252; Score=-2.8; E_value=2.7e-12; Accession=PF07714.7; Description =Protein tyrosine kinase
  Pfam module annotation: Pfam domain module=Pkinase::Pkinase_Tyr; Domain location=19-254::31-252
MVLHVLRQSAVSLWKLIPREDMEDYRAFDEYEGIENPEDLERLYSEIHLLKTLKHKNIMKLYTSWVDTANRHINFVTEMFTSGTLRQYRLKHRRVNIRAVKHWCRQILEGLLYLHSHDPPVIHRDLKCDNIFINGNQGEVKIGDLGLAAILRKSNAARCVGTPEFMAPEVYEEDYNELVDIYSFGMCILEMVTFEYPYSECNHPAQIYKKVVSGKKPEALYKVDNPEVRQFVEKCLATVSLRLSARELLEDPFLQIDDYGFDSKVLQYQRDCYEVTPLIRQPVNGICIINNNLMSGDTDNIGGYGPVSELDYHQDDFEATEIGLFDCEEDDNLAEVDTTIKGRREDDGIFLRLRIADKEGRIRNIYFPFDIETDTALSVANEMVAELDINDQDVTNLASMIDNEIARLVPEWKTGPRIEEKSECSSASVCLNCAANGSLFDYVSSNNPCGKNLQFLHCSKTGCAAVHGRFEEITYQVEGSENSAREGALDESSQSNGIQYTDIWAQRDEPDLCHEELKEMHCDQAHEASNSSNIKEDRKTVNVDEQSDLNTKKSSSNPAPNCVFLDYENEIRQELRWLKAKYQMQLRELRDQQLGRKPKFTSISPDPEKLEHLKDGILRLSDTPNLKIQNNKPLLRTIVSGKHFHVESEKCNTLADQMVQNVDEICQSNSPEQMITARDFFTGVLLPHSLQRATSLPVDAVDV

SEQ ID NO: 124767 - protein, 174 aa, Glycine max
  Coding DNA Sequence Number=SeqID_7989
  Gene Ontology: Mol. function=catalytic activity; Biological process =metabolic process
IRKSLEKLRPPSVTELLLSNDGDQILEGCVTNFFVVCCKERNSNDEKALCDYGNKYSFEVQTAPISDGVLPGTIRQLVLEICRSEGIPFREVAPSWSECEIWEEAFITNSLRLLQHVDSIQVPTEWQSAHSKTWKDISWTKKQFQVGGPGMITTIIQVEDPTELLICWDETDNS

SEQ ID NO: 124768 - protein, 203 aa, Glycine max
  Coding DNA Sequence Number=SeqID_7990
MVSGNRLPKECNRLPGLKTRQHVVEASGNRLPGCVINYTEEHATGNRLPVMCNRLHSAFLQIVMAAQLIHDRVEMECLEGAWETLEGYMRCRFRGTIRFTATSLVHPDEPARTLQHTVEWILPTPTPYRLVEPVQVIEVTSSEEDLEELPPEPAVDALDFLEGDEDPLPEVDSPEDVVSASEAHSTEDSGPGEMAISGGSSSK

SEQ ID NO: 124769 - protein, 208 aa, Glycine max
  Coding DNA Sequence Number=SeqID_7991
  Homolog annotation: Hit_ID=Q9LUV5; Match level="QueryCoverage=91%, HitCoverage=97%, E-value=6e-64, Identity=61%"; Hit description =Arabidopsis thaliana genomic DNA, chromosome 3, P1 clone: MCB17
  Pfam annotation: Domain name=XS; Domain location=64-162; Score=119.3; E_value=1.1e-32; Accession=PF03468.5; Description=XS domain
SAKDFPDMHALIMHTYNPDNADSRIDHLGLHKALCVLMRWNYSKPPDNSKAYQFLPADEAAANQDDLIMWPPLVIIHNTNTGKNRDGRMEELGFVGGKSKSLYGRDGHLGITLVKFAGDQSGFKEAIRLAEHFEKENHGRKDWDRVQSQTLGKDDENNANLVKVDEKKVDKRRVLYGYLGTAFDLDKVDFDTRKKAFIESRREYKPPM

SEQ ID NO: 124770 - protein, 92 aa, Glycine max
  Coding DNA Sequence Number=SeqID_7992
MFSGMPQSNAARAPQHRPLQPLYFSVGRLPSSMEEREKLDLIEERLRVIEGIDDYLFADMVELCLVPDVVIPPKFKVPNFDKYKGTTCPMNH

SEQ ID NO: 124771 - protein, 822 aa, Glycine max
  Coding DNA Sequence Number=SeqID_7993
  Gene Ontology: Mol. function=methyltransferase activity; Cellular component=intracellular; Biological process=protein kinase C activation
  Homolog annotation: Hit_ID=Q1SVE9; Match level="QueryCoverage=85%, HitCoverage=96%, E-value=1e-152, Identity=41%"; Hit description =Tetratricopeptide-like helical
  Pfam annotation: Domain name=PPR; Domain location=180-214; Score =15.6; E_value=0.11; Accession=PF01535.11; Description=PPR repeat
  Pfam annotation: Domain name=PPR; Domain location=282-316; Score =48.9; E_value=1.7e-11; Accession=PF01535.11; Description=PPR repeat
  Pfam annotation: Domain name=PPR; Domain location=352-386; Score =17.3; E_value=0.055; Accession=PF01535.11; Description=PPR repeat
  Pfam annotation: Domain name=PPR; Domain location=414-448; Score =25.8; E_value=0.00015; Accession=PF01535.11; Description=PPR repeat
  Pfam annotation: Domain name=PPR; Domain location=516-550; Score =33.3; E_value=8.5e-07; Accession=PF01535.11; Description=PPR repeat
  Pfam annotation: Domain name=PPR; Domain location=551-585; Score =13.0; E_value=0.22; Accession=PF01535.11; Description=PPR repeat
  Pfam annotation: Domain name=PPR; Domain location=619-652; Score=8.1; E_value=0.81; Accession=PF01535.11; Description=PPR repeat
  Pfam annotation: Domain name=PPR; Domain location=653-687; Score=9.9; E_value=0.5; Accession=PF01535.11; Description=PPR repeat
  Pfam module annotation: Pfam domain module=PPR::PPR::PPR::PPR::PPR::PP R::PPR::PPR; Domain location=180-214::282-316::352-386::414-448::516 -550::551-585::619-652::653-687
  Subcellular localization annotation: CTP_CleavageSite=41; ConfidenceScore=5.72e-01
MGLVTVLQLQLQPSLSFSLDFGGRFSCSSTSNSTLLRVSVKCSALSTPLSLGDFLVAINMQKLQIRIFSSFNILTGENTCSSKWGSEFRVSFIGQIAMNCTEAVKGEKGNEVESTNILEFIDQCTNTMQLKQIHAHMLRTSRFCDPYTASKLLTAYAISSCSCLIYAKNVFNQIPQPNLYCWNTLIRGYASSSDPTQSFLIFLHMLHSCSEFPNKFTFPFLFKAASRLKVLHLGSVLHGMVIKASLSSDLFILNSLINFYGSSGAPDLAHRVFTNMPGKDVVSWNAMINAFALGGLPDKALLLFQEMEMKDVKPNVITMVSVLSACAKKIDLEFGRWICSYIENNGFTEHLILNNAMLDMYVKCGCINDAKDLFNKMSEKDIVSWTTMLDGHAKLGNYDEAHCIFDAMPHKWTAAWNALISAYEQNGKPRVALSLFHEMQLSKDAKPDEVTLICALCASAQLGAIDFGHWIHVYIKKHDINLNCHLATSLLDMYAKCGNLNKAMEVFHAVERKDVYVWSAMIGALAMYGQGKAALDLFSSMLEAYIKPNAVTFTNILCACNHAGLVNEGEQLFEQMEPLYGIVPQIQHYVCVVDIFGRAGLLEKAASFIEKMPIPPTAAVWGALLGACSRHGNVELAELAYQNLLELEPCNHGAFVLLSNIYAKAGDWEKVSNLRKLMRDSDVKKEPWCSSIDVNGIVHEFLVGDNSHPFSQKIYSKLDEISEKFKPIGYKPDMSNLLQLSEEDNLMEQSLNVHSEKLAIAFGLISTASSQPIRIVKNIRICGDCHAFAKLVSQLYDRDILLRDRYRFHHFRGGKCSCLDYW

SEQ ID NO: 124772 - protein, 73 aa, Glycine max
  Coding DNA Sequence Number=SeqID_7994
MESTAAVLLWKQHLYRFGEVTNDIIQSYAKVMPSPDPKMESLLVEAKFSYVAKLGQVKIDDTLVTALVEKVET

SEQ ID NO: 124773 - protein, 58 aa, Glycine max
  Coding DNA Sequence Number=SeqID_7995
MWGGGDKDYKEVPPPPLFKPAGRHINQAMTFNRSYYKVQIIGQLCTYYNLNSHPQGLG

SEQ ID NO: 124774 - protein, 200 aa, Glycine max
  Coding DNA Sequence Number=SeqID_7996
  Gene Ontology: Mol. function=RNA-directed DNA polymerase activity; Biological process=RNA-dependent DNA replication
MNRVLEQALATEVKVMRKRASAPFKVNPLKHYRYHRNQGHSIEEYTTLKDKIEDLIKKGCLKDFIHKSQSTEHQSSDRYGEHDRGYRLDRNRSRRDKRVEMYNITFTSVDFKGLDLEQDDPMVITIEVANCFLNVPELMLQPCDDLFFGFPGERVPTRGSIELMTRFNTKKSGYKDIVVKYVVIHASTSYNILLGRPLIT

SEQ ID NO: 124775 - protein, 118 aa, Glycine max
  Coding DNA Sequence Number=SeqID_7997
MAIYREKAILRRLKFAQAKVDKLKEPMSRAEEEIEKGRNEYQILARGAHEKVFKKQKARFDKAIWQDVHEGVLMSIKDIPKKTLCASLTPTPLTNTLLTNFDLGEEEERQIDEVEFNN

SEQ ID NO: 124776 - protein, 771 aa, Glycine max
  Coding DNA Sequence Number=SeqID_7998
  Gene Ontology: Mol. function=DNA binding; Cellular component=beta -galactosidase complex; Biological process=DNA integration
  Homolog annotation: Hit_ID=Q1SS72; Match level="QueryCoverage=98%, HitCoverage=98%, E-value=1e-175, Identity=53%"; Hit description =Integrase, catalytic region
MGCYSSNPDLSNPYYLHPNDNPSLVLVSPPLDGKNYHSWARSMKLSLISKNKLKFVDCSLSQPSLLDLFYGAWERIYVIGSHQGDLTVTDYFTKLKTIWDELENFRPLPFCKCVIACSCGAVSMIKKYRDEDYVIRFLKSLNEQYSHVKSQVLMLEPLPPLTKVFSMVVQQERQMNTTVIPDSISNLNLALNAVANQFQKENYGKEPLLAKVKAEASLHSRNSKNNDSSINSVASSVDVSTDLGHKSAIVHASNMVQSSTSNYVLENSHMMPSDCWISAMKAELGALEMNNTWTIVDLPPGKHPIGCKWVYKIKYHANGKVERYKARLVAKGYTQIEGKDYFQTYSPVAKMTTVRTVLALAAINDWHLEQLDVNNAFLHGDLNEEGYMCLPPGIATYSSNKICKLNKSLYGLKQARMVLQAISKLLLLSVFLNLQQIILFVKKLNNSFTAISIYVDDIVLARNDLNGIQLVTAFLDSQFRIKDLGNLRYFLGLEIARSKKGIVVNQRKYTPELLADCGLLAAKGVSIPMDPSIKLPGYDGKPYHDEPGYRRLIGKLIYLTSTRPDIAFVMQQLSQFMSQPMDSHMNAAQKVLKYLKSAPAKGLFFSATSTLKISAFSNSDWASCLDTRRSVSGYCVLIVSSLISWKSKKQSTVSRSSSEAEYRALAALTCELQWLYFLFKNLQAAITTRALVYCDNRFAIHIAHNPIFHERTKHIANDCHVLWEKLQSGLIHLLPIPSSKQPADIFTKALHSSSFHTNIHKLGLLNIMAPT

SEQ ID NO: 124777 - protein, 71 aa, Glycine max
  Coding DNA Sequence Number=SeqID_7999
MVGAFSQNIVTLTGLPMILLSESDLTNPWCGVSCYVPLSASGWFFTDMMNRWMTMKNLMLEDTGTQRSDRM

SEQ ID NO: 124778 - protein, 79 aa, Glycine max
  Coding DNA Sequence Number=SeqID_8000
MPSDVFGKINKYAHDHISCTNKCIVQLFTVTGFNIGGEHHLPNYRFDTTVQGCGSGADPDGNTEEDMRDMSLHLVRNHA

SEQ ID NO: 124779 - protein, 282 aa, Glycine max
  Coding DNA Sequence Number=SeqID_8001
MDEIEEVKEWMKADMEAMKEKMAIMMEAMMSMKKIMKVNAAAVAVTSAVAEVDLTPPSTLNQINHPTSDMVGQGGKELGNTGGPHFVQVQSKHAFPPYDLPPNYTPLNVAHTLDENVDNSAPIPIESQQPQFDNAHVSQPMGETHEAPRDHNLADFKPHLEYVIEGKAIGSVPLPNTLEGPQFCPQPQPLHFAVGRVPLAMVERGKFDHIEERLRAIEGGEDYAFADMAELCLMLAVVIPPKFKMPDFDKYKGTTCPKNHLKMYWRKMEAYSKDEKLLIHFF

SEQ ID NO: 124780 - protein, 170 aa, Glycine max
  Coding DNA Sequence Number=SeqID_8002
MASDRMQLQSMCKKEHESFKEYAQWWKDLAAPVAPSTIENEMITMIVDTLLVFYYEKMVGYTPSSFADLVFAGERIEVGLRRGKFDYLALINKKPGANGENKKEGVTHVVTTIPTWKNFPPAQQCHYSANIYLSHYPPPYQPRTPNQPQRPTPKSATKTAYRTSNTKRHP

SEQ ID NO: 124781 - protein, 72 aa, Glycine max
  Coding DNA Sequence Number=SeqID_8003
MRCSTQMLTSPLANVIMEHIYWDKNDEANELAPHVSGYKKIEGEMMNYHIKELEIMQVNGLDSLQQELANHL

SEQ ID NO: 124782 - protein, 196 aa, Glycine max
  Coding DNA Sequence Number=SeqID_8004
MPNQNIKEPTKEEFDIKTQLSQKKLPTLSRRLGGSNKRPISKDTYCCSSVPTNHMVQNARGYSDRVTTPPYTYTTYIHLNDIISSQCHQHHKRYNDRLNLTRRRHKNRSYLKETVKGGSGALFSTESTSWVLKVPLCAVVQRLVVAARGGCRWPWVEEEVGLGFGEKRGRKSCFLVGGHIYNLQDSLSELVSLSEI

SEQ ID NO: 124783 - protein, 45 aa, Glycine max
  Coding DNA Sequence Number=SeqID_8005
MTKIVDTLGPKSRSVEVTSACLKARMPVNDEGRHHFYWSLLVHRK

SEQ ID NO: 124784 - protein, 126 aa, Glycine max
  Coding DNA Sequence Number=SeqID_8006
MEKVVVEVEAILMSSTSMFLSGKYSLVVIDVCDKGDKDALFGKKIVEVDDLAAADTDVVASDGERGKWVDEERDCELEVERFEGLHFEEEEGESERKSEERETVNMRVRKKSGFIEICISLMTVCH

SEQ ID NO: 124785 - protein, 317 aa, Glycine max
  Coding DNA Sequence Number=SeqID_8007
  Homolog annotation: Hit_ID=Q6ZQQ8; Match level="QueryCoverage=86%, HitCoverage=46%, E-value=6e-11, Identity=25%"; Hit description=CDNA FLJ46160 fis, clone TESTI4002141
MSSGSPPLDDNRCRMTIICLCVPPDWIVSGWQKCVWMTKICLRMSSGSMPLDDKRCRMTIICLCVPPDSIVSGWRKGVRMTIICLRMSSGSPPLDDKRCRMTIIFLCVPPDSIVSGWHKGVRITINFLRMSSGSAPLDDKRCRMTIFFVCVPPDSIVSGWDKGVRITIICLRMSSGMPPLHDKRYRMTIICLCVALDSIVSGWRKGVRITIIFLHMSSGSPPLDDKRYRMTIICLCVPSDSIVSVCRKGVRITIICLRMSSGSPPLDDKRCIITIICLCVPSDSIVSGCQKGSLPLMDKKVPNDHNLSLRATGLDRP

SEQ ID NO: 124786 - protein, 67 aa, Glycine max
  Coding DNA Sequence Number=SeqID_8008
  Homolog annotation: Hit_ID=Q2QXR8; Match level="QueryCoverage=46%, HitCoverage=5%, E-value=3e-07, Identity=83%"; Hit description =Pyruvate kinase family protein, expressed
MMRIPAEMLINCHLLDSMTTRVVDSMTDNLRPTRAEATNVANAILDGHRNLSNAPVQCCKCLCEKYN

SEQ ID NO: 124787 - protein, 95 aa, Glycine max
  Coding DNA Sequence Number=SeqID_8009
MSPHKKLLQHLSNSSQIVRNKKVDCITYEVNDEDMTKSKGKDPLEGLGGHMTRARARKAKEALQQVLSILFEYKPKFQGEKSKVVSCIMAQMEED

SEQ ID NO: 124788 - protein, 86 aa, Glycine max
  Coding DNA Sequence Number=SeqID_8010
MTFRNMPEIKRKHYYAICEKENKYRYGKRISKKRQGLYSVNRGVKIATRPTWAFQDVPQEGGAFWKKQPSSPGRAGWQAPPSFSYK

SEQ ID NO: 124789 - protein, 42 aa, Glycine max
  Coding DNA Sequence Number=SeqID_8011
MGDMSKLSRDTLAWENVVNNKQPGICDPGDAWTTSLAVMIQL

SEQ ID NO: 124790 - protein, 95 aa, Glycine max
  Coding DNA Sequence Number=SeqID_8012
MEQQYYLAKLLGYDYKIQYKSGSSNVVIDALSRLGEMLEAHYLLLNTPQFAFMDQIRASLTDVAPCGACRPWIFFINGVLCFLKINSNGMEKEQR

SEQ ID NO: 124791 - protein, 307 aa, Glycine max
  Coding DNA Sequence Number=SeqID_8013
  Homolog annotation: Hit_ID=Q47522; Match level="QueryCoverage=15%, HitCoverage=59%, E-value=2e-21, Identity=97%"; Hit description=LacZ protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLNSIVLPVSRLRSQLLLCASAVGVVFLLFEGHAIGYSGWNWQWSEYLFGALSDGQPAFGADQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 124792 - protein, 175 aa, Glycine max
  Coding DNA Sequence Number=SeqID_8014
METHLGQLQGIKFITELTAYAQKIRQEWITEGDVNQNLHITNTMRTMCIRCRREIWIVKGCKLVIRMTTPPPSPTQFEIPSDGMSRKTRQATRLRRLTARTLEQARATVSVNPATGRGSGPHKDQFHSYLGVVARDKIPIVHASWNDVPETLKNMIWDDILAKFDIPEGDSAKKK

SEQ ID NO: 124793 - protein, 244 aa, Glycine max
  Coding DNA Sequence Number=SeqID_8015
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=9e-40, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MCSSSKDNTSSPSEGYTLSPSNDYTSLPLEGYTPSPSEDYTFSPSEGNTPSPSEDYASLPTEGYTSSPSEDYIGLHALAFRGLQVLAFRGLHTLAFRGLHALTFRGLHVLTFRGLHVLTFRELHAVTFRGLHVLAFRELHALTFTGLHVLTFRGLHVLAIRGMHAIAFRGLHVLAFKGLHILTFRGLHALAFKGIHILALRGLHVLTFRGLHVPHFRGLHLLAFRGLHSLAFRGLHVLAVRGLH

SEQ ID NO: 124794 - protein, 940 aa, Glycine max
  Coding DNA Sequence Number=SeqID_8016
  Homolog annotation: Hit_ID=Q10NJ8; Match level="QueryCoverage=92%, HitCoverage=91%, E-value=2e-37, Identity=29%"; Hit description =Expressed protein
MGFGLSLGKKSSKQQSRSKTDKESSDLPQPNPCSKDSLKLKSKSNVDQANSDPCHKAKHDVKGKAQLLDSAKGSSTQPDELVKYMSNLPGFLKHSDGGASIQGKALNVGVLDWSQLEKWKNKQTHTKAEASYFTSFDSSEEISSRAATTSSATSGGHNKKLDGRKGSSSSRSKGSYKEDRPRSSKMSSQNVKQYQHSETEIKTIGDVLGMSPSEFGKTQSDKSLQRVKVNDYDEITSVVGSSASKSRHHMVALVPNENSSGRGVEDKKRMEGLQQHSLKKKERSLKSSSDKGFSSLESKNKGVSFDPQKKMSSGSSEAKKKMDQWQESDVDAGYKQSHRMPRNIVLLRPRVLQLHSEDYSQHSQSRTSSDEDFLESSRSSLSYMCIPEEVYTEDVHSEIPHSSVLPSVTELASSSEKLQHSINTELDIDRSSVVSEKPACSNNISNLQSEYTCIEKDVLHIKLKSQCAFSNVLESLDRETVELTPQNPSSNRRLSLSLSRIGRSFSFKEGSISKLSSSYVAAKSGPVTPESSAYLDSHSKDRVKGHNRTMSSPFLRLLDPILKRKASNIQFSDEQSVTSKGSMDSISLRSINLPDEKSKESSIQALLQLTIRNGVPLFKFVLNSERKVLAATMKSLALPEKDDVDCYFTFYHVNEIKKKSGKWMSHWSKEKNCGYVYNIVGQMKVSSSKTTESSNEETKIESVVKEYVLMGVEVDQLDQEPTNFFMSKELAAVVFEIPCENINHEGLLCSHNLIRKRCLKCLADEKCFCSSQENEIYGNMTVILPGGVHSSPNTGQPSPLIRRWKLGGTCDCGGWDVGCKLLVLSNQNLSSNIPRSSKSYLERFHLFVQEGADQNTPLFTLVPLKDGFYSVEFSSEINHLQAFFISVAVLSSQNLPSSLEMNNMQEAINKEFNSKNNNELQGKAPLYYNPIPPYSPADRV

SEQ ID NO: 124795 - protein, 300 aa, Glycine max
  Coding DNA Sequence Number=SeqID_8017
  Homolog annotation: Hit_ID=Q1SP02; Match level="QueryCoverage=84%, HitCoverage=54%, E-value=5e-15, Identity=29%"; Hit description=IMP dehydrogenase/GMP reductase
MAGIFLKEQNSLEVMSDQKEMTPNRVANWPFRTLYHYLGIPHSAPVDSLLCWIYEHFLSVSECNADPDYDEVSPRVCRWIVTKKTVKKVSTVTYRQCLDCLRILDVCWMPYAEHRPIQDFHLISCFSGQLHWGPVVVRYRPEKVMRQFGYVQCIPAHPVHSWVSYDDVNDTWTHYSDYLATAGDLCIVSGQCAPDYIDWFFVILHPFMTVPQTDPPQDAYATHPSHIPHEAAPTSTHADPDADEPKHAVEACHAIAEALEQHLNAPSTSTHEEVIQKCLRIARGVTEDVRSQRRRRTDHQ

SEQ ID NO: 124796 - protein, 118 aa, Glycine max
  Coding DNA Sequence Number=SeqID_8018
  Subcellular localization annotation: CTP_CleavageSite=56; ConfidenceScore=5.26e-01
MRVHCNQASRRPSMITDSPPLLIFPQTWIKWPNSQKTVPSGVANCRNLPFGRRAMRDSRVRDPRKEYARSRHQRLFEENVRKTGKAVIYELKRKVRELYLRTGKVLAPHKSVTRDNNL

SEQ ID NO: 124797 - protein, 85 aa, Glycine max
  Coding DNA Sequence Number=SeqID_8019
MFLQKAVASGGSNLARLSELGGKLLPYFPINKGRSEGEKCSALLVFRDHLKLVKKIVSVKKIQAEIFNRSSTFFIRSSSFFGLQP

SEQ ID NO: 124798 - protein, 179 aa, Glycine max
  Coding DNA Sequence Number=SeqID_8020
  Homolog annotation: Hit_ID=Q8TGM5; Match level="QueryCoverage=22%, HitCoverage=61%, E-value=7e-08, Identity=70%"; Hit description =Uncharacterized protein ART3
SGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPGR

SEQ ID NO: 124799 - protein, 275 aa, Glycine max
  Coding DNA Sequence Number=SeqID_8021
  Gene Ontology: Mol. function=inositol or phosphatidylinositol phosphatase activity; Cellular component=cytoplasm; Biological process=carbohydrate metabolic process
  Homolog annotation: Hit_ID=Q1MG14; Match level="QueryCoverage=99%, HitCoverage=100%, E-value=1e-109, Identity=68%"; Hit description =Putative inositol-1-monophosphatase
  Pfam annotation: Domain name=Inositol_P; Domain location=7-274; Score= 142.5; E_value=1.1e-39; Accession=PF00459.15; Description=Inositol monophosphatase family
MTLSDKDIDFLVATVAAAGTDEIMPRFRNLSAGAISEKTSAVDLVTEADVLAEKLITAALLERFPKAHIVGEEAYDADHSVIPALADAPLAFVIDPIDGTFNYASGFPAFGTLLAVTVKGETVAGLIHDPVMGDTIIGLKGEGAYLHRKNGSQAKLKVADPAPLSDMVGLFSWGHSHPDRRPVIAANMAKIKMALSLNCSAHEYWLASAGNLHFIGHEKLMPWDHLAGVLIHQEAGGYTARFDNTPYRPGQTTGGILSAPDKESWKMLRREIVAL

SEQ ID NO: 124800 - protein, 240 aa, Glycine max
  Coding DNA Sequence Number=SeqID_8022
  Homolog annotation: Hit_ID=Q1T132; Match level="QueryCoverage=60%, HitCoverage=20%, E-value=2e-18, Identity=37%"; Hit description=IMP dehydrogenase/GMP reductase
MFANKSATNVHVVYLEALRDLSMIERYAWGVAALCWIYEHFPSVAESTTDQDYDEASPRACRWIATKKTVKSIRTPAYTERLDRLRILDVCWIPYGEHREVQDFHVRSCYSGLLRWGPVAVYYRSERVVRQFGYTQTIPASPVDSWVSYDDIHDRWMHYEDHIVPADEVCVVPGACSSDFLDWFFRISHPFMTPGHTLDPLPHGHALQPRVVPQAPQTDIPHVPEPGALSTSTEEPRHAV

SEQ ID NO: 124801 - protein, 133 aa, Glycine max
  Coding DNA Sequence Number=SeqID_8023
MGIAPTKTPSEPEEVQQGPGVSSSGYGPLSVLQGARTPPARSRHHSSTEYLSPPARASGPLLIELSSRSTAPQTGAGRNTTTALGWSAAGNRRTAITSRVHLCSSTKRFEYCLHTWPTSRRPSPKPKDAPSCS

SEQ ID NO: 124802 - protein, 84 aa, Glycine max
  Coding DNA Sequence Number=SeqID_8024
MAVRLFPAADHPNAVVVFRPAPVWGAVLLDESSISRGPDALAGGLIEARNQSWKPQGPVGLLQVHWVSLWGEIGIAVAGQNVAK

SEQ ID NO: 124803 - protein, 64 aa, Glycine max
  Coding DNA Sequence Number=SeqID_8025
MQCMNMCPMCAVKKVIWTFRLPVSKDKTNIQRVHDDMMQMRKSVTGGCTQHGNIHKISIQQRRT

SEQ ID NO: 124804 - protein, 204 aa, Glycine max
  Coding DNA Sequence Number=SeqID_8026
ANEPVDTRRFTSSSMLSVILTREVSQGMYGDTQAVICTNGFHHPESQRYPSGYPYKHSFAIRQTQSPSGDVDIPQAVIRANGFCHPDPEYLMVIHTFRQPGANEPVDADNKSGDMRGIPYGYPHLSSIRGKRAYSHAETNIVFCTFCHPDPRSQDDVGRPIPIILKIFAGFYSRRPETFKLDHAQDSSLLGGGRSSSMAWGSVV

SEQ ID NO: 124805 - protein, 72 aa, Glycine max
  Coding DNA Sequence Number=SeqID_8027
MDVARKATGAGRRWVALLEMSHRTETREGGFAVEEQGREEGKGGKMGRLAFLSSLKGGKSILLFKTLKTTQF

SEQ ID NO: 124806 - protein, 64 aa, Glycine max
  Coding DNA Sequence Number=SeqID_8028
MGAKHLTRTKEWSHVIEQRSQELPRLLAKAKAMTDTYSAPKEIHGLLGYCQHMIDLMAHIIRNR

SEQ ID NO: 124807 - protein, 368 aa, Glycine max
  Coding DNA Sequence Number=SeqID_8029
  Gene Ontology: Mol. function=ATPase activity, coupled to transmembrane movement of substances; Cellular component=outer membrane-bounded periplasmic space; Biological process=transport
  Homolog annotation: Hit_ID=P31550; Match level="QueryCoverage=82%, HitCoverage=93%, E-value=1e-146, Identity=81%"; Hit description =Thiamine-binding periplasmic protein precursor
  Pfam annotation: Domain name=SBP_bac_1; Domain location=44-314; Score= 30.4; E_value=6.2e-06; Accession=PF01547.15; Description=Bacterial extracellular solute-binding protein
MRGVRLNTLGWFDFKSAWDLRCSALRSFATQPYLLLKERKVLNKVLPLLLLIAAPALAAKPVLTVYTYDSFAADWGPGPAVKKAFEARCGCELNYVALEDGVSLLNRLRMEGKNSKADVVLGLDNNLIQAAEKTGLFSKSTVDTRALQLPDGWHNDTFIPFDYGYFAFVYDKNKLKNPPHSLKELVESPEKWRVIYEDPRTSTPGLGLLLWMQKVYGDEAPAAWQKLASKTVTVTKGWSEAYGLFLKGESDLVLSYTTSPAYHIIEEKKDNYAAAPFSEGHYLQVEVGAQLASSKQPQLAQQFMQFMVSPAFQSTIPTGNWMYPVIKSDLPAGYQALPVPANALQYTPTEVADHRAAWISAWQRAVSR

SEQ ID NO: 124808 - protein, 406 aa, Glycine max
  Coding DNA Sequence Number=SeqID_8030
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=UPI00005FA92A; Match level="QueryCoverage =96%, HitCoverage=36%, E-value=1e-138, Identity=61%"; Hit description= COG0834: ABC-type amino acid transport/signal transduction systems, periplasmic component/domain
  Pfam annotation: Domain name=SBP_bac_3; Domain location=15-231; Score= -39.0; E_value=1.7e-05; Accession=PF00497.10; Description=Bacterial extracellular solute-binding proteins, family 3
MLIVGEKNPWRDRTLRVGIVSENTSPYNIIVDDDLYGLNADYLGYIQQVTGIRFAIYGFADLTQLEQALHDGKIDLLYGIPQSEALHGLAISQPYYVSNLRVLRDRSNDRPVMLNSANARVAIGALTDMQSGGALQAVASQIQRYDNNLQAVYSLLNGSSDYFIADEASASFIIDQLQLGQLYQIESNENLGNLSFVFAADDSRLIDTLDTAIADAPMELMNALQGRWSKKIPSYLDTGNADLTTMEKNWVASHRVVYYAAIENNFPFAYRGSDGQPRGYAIDILNIIAQNTGLRFAPLWARNAEQADLLVQSGQASFRAALPLARGVKARYGASMPIHRSLWGVYVGQHANGISTWSDLAGKRIGVLQGDLAQGLVPEQEQTISFADSKSMYDALANGPVGCAGG

SEQ ID NO: 124809 - protein, 140 aa, Glycine max
  Coding DNA Sequence Number=SeqID_8031
  Homolog annotation: Hit_ID=UPI00005FA92A; Match level="QueryCoverage =98%, HitCoverage=13%, E-value=1e-29, Identity=50%"; Hit description =COG0834: ABC-type amino acid transport/signal transduction systems, periplasmic component/domain
MADGGEEFALHAVFRFGAAARVLEFFAFAFFTALQHETAQRQRQQQHGGGGQQRQQPGGLRRHAVVVHRVDQVAAIDDPLVAQRLQGVRRDLHQVLIKDRQQKRLIAAHAEGHRIGNVVGGEGQLDGTGIARQRQKVGGE

SEQ ID NO: 124810 - protein, 91 aa, Glycine max
  Coding DNA Sequence Number=SeqID_8032
MRETHEAPQNHDLADFEPHLGYATKGKSPFCYGGMGKFDHIEERLRVIEGGGDYAFADMAELCLVPDVINRPKFKVPNFDKYKGTTCPKNH

SEQ ID NO: 124811 - protein, 125 aa, Glycine max
  Coding DNA Sequence Number=SeqID_8033
MKISQLSPTTHDAYMETQYGGQNDTQFYNVVRGIIFHGTILNVISPFQQLELELKTLNNRFGRSPRTKTILKKNWSLKVVFIKMASRAWCCVAKCNGGSSLQDTVIGLNVGSFMPNLCYFRKLSV

SEQ ID NO: 124812 - protein, 135 aa, Glycine max
  Coding DNA Sequence Number=SeqID_8034
  Subcellular localization annotation: CTP_CleavageSite=78; ConfidenceScore=5.04e-01
MTYDKSAFKDLKPINVLKIKIGNVYSSKRKRNYIDCNNFRKFQQLSFLPPRCFFSSSSPPLLPPLKLQIPLHFYPKLQGKAIFGVLEPTPTSWGFKFQGLIMMVCDICMLKNIDRKLVERMGRVNLESNVRMVVL

SEQ ID NO: 124813 - protein, 1061 aa, Glycine max
  Coding DNA Sequence Number=SeqID_8035
  Gene Ontology: Mol. function=protein binding; Cellular component =integral to membrane; Biological process=defense response to fungus
  Homolog annotation: Hit_ID=Q1T2W9; Match level="QueryCoverage=99%, HitCoverage=100%, E-value=0.0, Identity=54%"; Hit description =Leucine-rich repeat; Leucine-rich repeat, cysteine-containing type
  Pfam annotation: Domain name=LRRNT_2; Domain location=31-76; Score =42.0; E_value=2e-09; Accession=PF08263.3; Description=Leucine rich repeat N-terminal domain
  Pfam annotation: Domain name=LRR_1; Domain location=106-128; Score =11.2; E_value=2.3; Accession=PF00560.23; Description=Leucine Rich Repeat
  Pfam annotation: Domain name=LRR_1; Domain location=130-152; Score =8.4; E_value=7.6; Accession=PF00560.23; Description=Leucine Rich Repeat
  Pfam annotation: Domain name=LRR_1; Domain location=154-181; Score =1.2; E_value=1.7e+02; Accession=PF00560.23; Description=Leucine Rich Repeat
  Pfam annotation: Domain name=LRR_1; Domain location=187-209; Score =3.4; E_value=66; Accession=PF00560.23; Description=Leucine Rich Repeat
  Pfam annotation: Domain name=LRR_1; Domain location=214-236; Score =9.8; E_value=4.1; Accession=PF00560.23; Description=Leucine Rich Repeat
  Pfam annotation: Domain name=LRR_1; Domain location=238-260; Score =4.6; E_value=40; Accession=PF00560.23; Description=Leucine Rich Repeat
  Pfam annotation: Domain name=LRR_1; Domain location=262-284; Score =9.8; E_value=4.2; Accession=PF00560.23; Description=Leucine Rich Repeat
  Pfam annotation: Domain name=LRR_1; Domain location=286-308; Score =4.2; E_value=47; Accession=PF00560.23; Description=Leucine Rich Repeat
  Pfam annotation: Domain name=LRR_1; Domain location=310-332; Score =7.1; E_value=13; Accession=PF00560.23; Description=Leucine Rich Repeat
  Pfam annotation: Domain name=LRR_1; Domain location=334-356; Score =17.3; E_value=0.056; Accession=PF00560.23; Description=Leucine Rich Repeat
  Pfam annotation: Domain name=LRR_1; Domain location=358-379; Score =6.1; E_value=20; Accession=PF00560.23; Description=Leucine Rich Repeat
  Pfam annotation: Domain name=LRR_1; Domain location=381-404; Score =20.5; E_value=0.0061; Accession=PF00560.23; Description=Leucine Rich Repeat
  Pfam annotation: Domain name=LRR_1; Domain location=406-428; Score =17.4; E_value=0.053; Accession=PF00560.23; Description=Leucine Rich Repeat
  Pfam annotation: Domain name=LRR_1; Domain location=430-450; Score =5.4; E_value=28; Accession=PF00560.23; Description=Leucine Rich Repeat
  Pfam annotation: Domain name=LRR_1; Domain location=454-476; Score =6.9; E_value=14; Accession=PF00560.23; Description=Leucine Rich Repeat
  Pfam annotation: Domain name=LRR_1; Domain location=478-501; Score =11.5; E_value=2; Accession=PF00560.23; Description=Leucine Rich Repeat
  Pfam annotation: Domain name=LRR_1; Domain location=503-523; Score =8.7; E_value=6.6; Accession=PF00560.23; Description=Leucine Rich Repeat
  Pfam annotation: Domain name=LRR_1; Domain location=527-548; Score =9.1; E_value=5.6; Accession=PF00560.23; Description=Leucine Rich Repeat
  Pfam annotation: Domain name=LRR_1; Domain location=550-570; Score =6.9; E_value=14; Accession=PF00560.23; Description=Leucine Rich Repeat
  Pfam annotation: Domain name=LRR_1; Domain location=571-592; Score =8.9; E_value=6; Accession=PF00560.23; Description=Leucine Rich Repeat
  Pfam annotation: Domain name=LRR_1; Domain location=595-614; Score =7.6; E_value=11; Accession=PF00560.23; Description=Leucine Rich Repeat
  Pfam annotation: Domain name=LRR_1; Domain location=616-638; Score =5.4; E_value=27; Accession=PF00560.23; Description=Leucine Rich Repeat
  Pfam annotation: Domain name=LRR_1; Domain location=641-663; Score =8.0; E_value=9.2; Accession=PF00560.23; Description=Leucine Rich Repeat
  Pfam annotation: Domain name=LRR_1; Domain location=665-684; Score =9.6; E_value=4.5; Accession=PF00560.23; Description=Leucine Rich Repeat
  Pfam annotation: Domain name=LRR_1; Domain location=690-712; Score =10.3; E_value=3.4; Accession=PF00560.23; Description=Leucine Rich Repeat
  Pfam annotation: Domain name=LRR_1; Domain location=714-736; Score =8.3; E_value=7.9; Accession=PF00560.23; Description=Leucine Rich Repeat
  Pfam annotation: Domain name=LRR_1; Domain location=738-757; Score =9.0; E_value=5.8; Accession=PF00560.23; Description=Leucine Rich Repeat
  Pfam annotation: Domain name=LRR_1; Domain location=788-811; Score =9.0; E_value=5.9; Accession=PF00560.23; Description=Leucine Rich Repeat
  Pfam annotation: Domain name=LRR_1; Domain location=859-881; Score =2.4; E_value=1e+02; Accession=PF00560.23; Description=Leucine Rich Repeat
  Pfam annotation: Domain name=LRR_1; Domain location=883-905; Score =16.1; E_value=0.13; Accession=PF00560.23; Description=Leucine Rich Repeat
  Pfam annotation: Domain name=LRR_1; Domain location=907-929; Score =14.3; E_value=0.45; Accession=PF00560.23; Description=Leucine Rich Repeat
  Pfam annotation: Domain name=LRR_1; Domain location=931-952; Score =9.5; E_value=4.7; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::LRR_1; Domain location=31-76::106-128::130 -152::154-181::187-209::214-236::238-260::262-284::286-308::310 -332::334-356::358-379:...
  Pfam module annotation: Domain location=:381-404::406-428::430 -450::454-476::478-501::503-523::527-548::550-570::571-592::595 -614::616-638::641-663::665-684::690-712::714-736::738-757::788 -811::859-881::883-905::907-929::931-952
MKIELVSSVVVVSFYWIWLCNNILVVSGLCLDNQKSLLLEFKNNLTFVDTVDRNSSRLNSWKASNDCCKWMGVTCDEDGHVIGLDLSGELISGGFDNSTSLFGLQHLQNLNLAANYFFSEIPSGFNKLEKLTHLNLSEASFMGQIPIEISQLIRLVTLDISSLSFLNGKRPKLENPNLQKLVQNLTNIRQLYLDGVSISVAGHEWCSALSSMLDLQEIRMSKCNLSGPLDSSLARLENLSVIVLDMNYLSSPVPETFAHLKNLTILRLSECGLTGTFPQKIFSIETLSVIDISLNQNLNGFFPNFPLSRSLQTLKVRNTSFSGAFPHSIGIMRHLSELDLSDCRFNGTLPGSLSNLTELSYMDLSFNNFTGPMTSFGMAKNLTHLDLSHNDLSGIISSSHFEGLQNLVNIDLSYNSFTGSIPSSLFPLPLLQQIQLSNNQFSQLDEFINVSSSILDTLDLRSNNLSGPFPTSIFYLSSLSILQLSSNKFTGSVQLNKFFELKNLTALDLSYNSLSLNENFDPSFSSKIRILKLASCNLKTFPGFLRNLSTLATLDLSNNQIQGMVPNWIWKLDNLNISRNLLTGFEGPLQNFTSNFVFLDLHHNKLEGPIPVFPNYAVYLDFSSNKFSSFIPHDIGNYLSSTFFLSLSNNTLNGSIPDSLCKASLLQMLDLSINNFSGTIPSCLMMMSDTLVVLNLKNNNLTGQIPDTIPISCGLWTLNLHRNQLDGPIPKSLAHCSKLEVLDLGSNQIIGGFPCFLKEISILRILILRNNGFQGSLRCSEANETWEMLQILDVAFNNFSGKLPERYFTTWKRNIMHNKHEVEAKFIERLDISSGLYYQGSVTVISKGLQMELVKILTIFTSIDFSSNHFEGPIPEVLMDFKELYILNLSNNALSGEIPSSIGNLRQLESLDLSQNALSGGIPMQIASLSFLSYLNLSFNHLVGKIPTGTQLQSFSASSFEGNDGLYGPPLTENPHGKRPGVLLQRECERLVCTIDWNFISVELGLIFGHGIVFGPLLIWKRWRIWYWQVVHKILCWIFPQMYLEYVTHRGQVFTTLRWWH

SEQ ID NO: 124814 - protein, 36 aa, Glycine max
  Coding DNA Sequence Number=SeqID_8036
MPYRLHEVFACLRRARLLEEIEFGGEGNIKSVFFKE

SEQ ID NO: 124815 - protein, 104 aa, Glycine max
  Coding DNA Sequence Number=SeqID_8037
CKDCLEEGKGQEEISLEETSNKEKVLDKSDALSARKLGHIKTDYLFLRKDFKWNDSRKKAMMATWDDLDLHMIGDKGKFLSLEKRNNGGFAAFGDTRKALIKGV

SEQ ID NO: 124816 - protein, 123 aa, Glycine max
  Coding DNA Sequence Number=SeqID_8038
  Subcellular localization annotation: CTP_CleavageSite=37; ConfidenceScore=5.38e-01
MCKQNTSIFMPFPSLLMGMHGTSYVHCQRIVSLRGTSAQMQAVSLKKTLMRAQAQVLNTTPSFLTCDKCGIVHGPRECTIDGKLVVAKDEINFIKGVNNYYNQYPDNFNQGQGFRQSRGMFRS

SEQ ID NO: 124817 - protein, 155 aa, Glycine max
  Coding DNA Sequence Number=SeqID_8039
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=P27066; Match level="QueryCoverage=99%, HitCoverage=37%, E-value=9e-84, Identity=86%"; Hit description =Ribulose bisphosphate carboxylase large chain precursor
  Pfam annotation: Domain name=RuBisCO_large; Domain location=1-142; Score=118.2; E_value=2.4e-32; Accession=PF00016.10; Description =Ribulose bisphosphate carboxylase large chain, catalytic domain
MHAVIDRQKNHGMHFRVLAKALRLSGGDHVHAGTVVDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 124818 - protein, 470 aa, Glycine max
  Coding DNA Sequence Number=SeqID_8040
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=5e-50, Identity=31%"; Hit description= UPI00006A17C9 related cluster
VLAIRGLHALAFRGLHALACKGLHVLAIRGLHSLAIRGLHILTFSGLHVLTFQGLHVLAFRGLPALTFRGLPALAFRGLHVLAFRGLHALAFRGLHVLAFGGLHVHTFRGVHVLAFRWLHTLAFKGQHVLTFTLLHVLAFRGQYALLFRGLHALPIKGLHVLDFRGLHAFTFRGLHALAFRGLHILVFRGLHSITFKGLHVIAFRWLHALSFRELHALSFRELHALSYRGLHVLAFRGLHVHALRGLHALAFKGLHILTIRGLHVLAIRGLHVQAFQGQHPLAFRGLQVLTFSTLDTLTLRGLHVLAFRGLHVPTFRGLHVLPFRGLHALAFRGVHVLAFRGLHVHTFRGVHVLALRWLHALAFRGQHVLTFRLLHGYMPSPSKGYTSSPSEDYTSSSSEDYTPSPSEAYTPSPSEDYTSSSLEGCTPSPSEDYMSSPSEGCTPSPLEAYTPFPSEDYTSSPLEDYMSMP

SEQ ID NO: 124819 - protein, 300 aa, Glycine max
  Coding DNA Sequence Number=SeqID_8041
  Gene Ontology: Mol. function=cation transporter activity; Cellular component=integral to membrane; Biological process=cation transport
  Homolog annotation: Hit_ID=Q1H0T7; Match level="QueryCoverage=99%, HitCoverage=28%, E-value=6e-98, Identity=63%"; Hit description =Acriflavin resistance protein
  Pfam annotation: Domain name=SecD_SecF; Domain location=81-274; Score= -102.0; E_value=0.064; Accession=PF02355.7; Description=Protein export membrane protein
YIQNDNQRIILNTQGQTTTPQQLANITLVRKLGRTIRIRDVAEVSEGPAPSISAAAINGQPAVYLSVQGQLGANVYALTKQLELKLAEIKPSLEKQKVTLHEGLFRPANFIEIAIQSLRSDILIGSVLVILVLFIFLFNVRTAIISATAIPLSLLTAIVVLYQSGVGLNIMVLGGLAIALGEVVDDAIIDTENIFRRLRENRLLSVPLPVTKVVFQASMEVRSSVVYATIIVALVFLPLLTLSGVAGKLFAPLGYAYISAILASLVVALTLTPALCYVLLARAPLKDEDSPLLKWLKKRY

SEQ ID NO: 124820 - protein, 379 aa, Glycine max
  Coding DNA Sequence Number=SeqID_8042
  Homolog annotation: Hit_ID=Q1SXA8; Match level="QueryCoverage=13%, HitCoverage=3%, E-value=6e-13, Identity=65%"; Hit description=Zinc finger, CCHC-type; Polynucleotidyl transferase, Ribonuclease H fold
MATLMHPSVVIDEDEKEWKSTNGTCQFLGKPMVSWSYKKESTIALSTLEVEYVSVASCSSQIIWINETSQSPYPKNQNKGKAKTIHISSRLDSEATITITPPRAKWIMTGSPKRRSYVKAESPWFIQDKKLQEKFEASWINKKVVNGRVSFDSELVRDDVLSWGAKNVIALKLSPQPSIEKENHFEPAQNKETKEESSQKEVEGHGEDLSKELLDYGTYHDGSKHFFEVDKKEAKVHFGHQNEVEAKDVHNPIFPEPIQDDLNMEIIADVLAKIRTVDSSLEQENSEKEEKKEEPSEKGREAEAIPDIENMQNLINSPIFDTFVKVAYGLGPILGESSSFSIPIPPLSTKYVNIEPLKVSEDILSIHIPLLQNMIRLSF

SEQ ID NO: 124821 - protein, 117 aa, Glycine max
  Coding DNA Sequence Number=SeqID_8043
  Subcellular localization annotation: CTP_CleavageSite=35; ConfidenceScore=5.05e-01
MYPLLELIHKRCTLSCSQSTTQVDVPSTCTTKDVPSNVLRQRSQREFAKRNLQWLNARKNPEEDELSSSLSAPLQVIKCTTPAHPLSETSALSQNPLMRAKRSRSALSARARTRPPI

SEQ ID NO: 124822 - protein, 122 aa, Glycine max
  Coding DNA Sequence Number=SeqID_8044
  Gene Ontology: Mol. function=DNA binding; Biological process=DNA integration
  Homolog annotation: Hit_ID=Q1SKG1; Match level="QueryCoverage=60%, HitCoverage=5%, E-value=2e-16, Identity=56%"; Hit description =Integrase, catalytic region; Zinc finger, CCHC-type
MSCFYPFGCQCFILNAKDNLGMFDFKCDNGILLGYSKTSKAYREYISRTLVLEESIHVKFNDAKPDRKISELDEFIGDLRLDDGIGPLTTTNQPIEAYVSNQTLNNLNKSGKQLDEYLERII

SEQ ID NO: 124823 - protein, 84 aa, Glycine max
  Coding DNA Sequence Number=SeqID_8045
MACVSLGCALQGQCDDGIYDIKVGRETSNGSLELKGLRASLNAILVRSDGKRVSKPISELVTTVRSGGNNRFKIILTEENALHN

SEQ ID NO: 124824 - protein, 674 aa, Glycine max
  Coding DNA Sequence Number=SeqID_8046
  Gene Ontology: Mol. function=protein dimerization activity; Cellular component=nucleus; Biological process=regulation of transcription, DNA-dependent
  Homolog annotation: Hit_ID=Q1SYN6; Match level="QueryCoverage=72%, HitCoverage=73%, E-value=1e-72, Identity=31%"; Hit description=Zinc finger, BED-type predicted
  Pfam annotation: Domain name=hATC; Domain location=523-606; Score =106.3; E_value=9.1e-29; Accession=PF05699.5; Description=hAT family dimerisation domain
MSSPLEISEPITSTHTNDNEVNVQVPADSTQVEANNEENEHQEPVVRRKRKKTLVVWNDFDEMEISPGVKKVVFCIQKKAKTTAESRQPTIPFQPSNSNNPFMIPSVRYSNEKMREIIAIAIMVHEYPFSVVEDSIWMWAFQYANPNFHKITHKTARNDCLALFEMEKKTLKKLLESVSKISLTTDMWKSSHQVVEYMIITGHFIDAGWNLQKRVLCFVKVPAPRRGIDVADAIFKCLKTWGIENKVFSISVDNASYNDSCIRCLKENISLSMQDDLSTIKDIIFNIRESVKYINHNDARLKAFCDVVEQKRLKERKLVIDCPTRWNSTFNMLSTALKFKTAFASYKEREPHYNYAPLLEEWNQVEKVCKLLEVFNLATHVISEVWKVKKILDKEIEDEDLFMREMVGPMKKKFDKYWGECNMLMAIASVLDPRCEFHMVSICFPLIYSKEVVDENIKKVKSSFEELYDEYVGLCLQESTSSVVNLDDNISSSSQFNTSVVTSFDEIMSMLREKEVVSPIKSELQDYLDEGIYVPNTNSFSALDWWRNNNMKYKILSKMAADILVIPISTVASESTFSAGGRVIDEFHSKLNEESVEALICGGDWFRQKYNVKKKSKTWMMLPQLPTVLLSLLDVAPCGACRPWIFFINGFLYFLRSDCSGMEKEKDEWRRHFK

SEQ ID NO: 124825 - protein, 398 aa, Glycine max
  Coding DNA Sequence Number=SeqID_8047
  Gene Ontology: Mol. function=carboxypeptidase activity; Cellular component=membrane; Biological process=auxin mediated signaling pathway
  Homolog annotation: Hit_ID=O24091; Match level="QueryCoverage=94%, HitCoverage=94%, E-value=1e-147, Identity=71%"; Hit description =MtN21 protein
  Pfam annotation: Domain name=DUF6; Domain location=206-336; Score =51.1; E_value=3.6e-12; Accession=PF00892.11; Description=Integral membrane protein DUF6
  Pfam annotation: Domain name=DUF6; Domain location=27-160; Score =47.6; E_value=4.2e-11; Accession=PF00892.11; Description=Integral membrane protein DUF6
  Pfam annotation: Domain name=DUF914; Domain location=78-367; Score= -217.9; E_value=0.097; Accession=PF06027.3; Description=Eukaryotic protein of unknown function (DUF914)
  Pfam annotation: Domain name=TPT; Domain location=197-336; Score= -25.3; E_value=0.017; Accession=PF03151.7; Description=Triose -phosphate Transporter family
  Pfam module annotation: Pfam domain module=DUF6::DUF6::DUF914::TPT; Domain location=206-336::27-160::78-367::197-336
MATEKLRSGANFLENSKPYFAMIALQFGYAGMNIITKVSLNRGMSHYVLVVYRHAFATAVVAPFAFILERKAQPRIKFPIFMQIFFLALLGPVIDQNFYYAGLKLTSPTFSCAMSNVLPAMTFVMAVLCRMEKINMKKVRCQAKVVGTLVTVAGTMLMTLYKGPRVEMVWTKHAPHHGQINNATYTTTYSDKDWFIGSILLIIATLAWASLFVLQAKAIETYKNHQLSLTSLICFIGTLQAIAVTFIMEHKPSVWTIGWDMNLLAAAYAGIVTSSISYYVQGLVIKKKGPVFATAFSPLMMIIVAIMGSFILAEQIFLGGVLGAILIVLGLYSVLWGKHKEQVEKNVADDIPLPLKGAQLDGNPESLIDSTDLKSDSNKVSSHMINETIPEPPMKSNN

SEQ ID NO: 124826 - protein, 123 aa, Glycine max
  Coding DNA Sequence Number=SeqID_8048
MDPSDHEPRRRSRTPTAVMNPSDDNGVEETMVTGLRDSSRSSIEVDLLERGMSMSPPYDYVLGLKLKIKKQAVQASTILSSSPKLSQDPKKKMIVTRDKWCGNEVLRKCRTTLGSRFQVLIGP

SEQ ID NO: 124827 - protein, 70 aa, Glycine max
  Coding DNA Sequence Number=SeqID_8049
MVVILPKENLVVWFCSLHNRSYNYLKGIINSALKGLHDTSQPKSKAAASWIVVKCNRQKGSIECGYYVMH

SEQ ID NO: 124828 - protein, 175 aa, Glycine max
  Coding DNA Sequence Number=SeqID_8050
  Homolog annotation: Hit_ID=Q5CEG7; Match level="QueryCoverage=60%, HitCoverage=99%, E-value=1e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWDL

SEQ ID NO: 124829 - protein, 33 aa, Glycine max
  Coding DNA Sequence Number=SeqID_8051
DIGHCSFDRQVRQKRQANDVKEALPGRQPSFKL

SEQ ID NO: 124830 - protein, 91 aa, Glycine max
  Coding DNA Sequence Number=SeqID_8052
MSIKGGAGGASRISTSGEAGGSTTSGRDSAGAGSVLVDAALDEREKEMIWFMQNSLAIPTLSTCHCAEVTLNQCFFRCSRLVKRSLSGRVV

SEQ ID NO: 124831 - protein, 205 aa, Glycine max
  Coding DNA Sequence Number=SeqID_8053
  Gene Ontology: Mol. function=chitin binding; Cellular component =extracellular region; Biological process=chitin metabolic process
  Homolog annotation: Hit_ID=UPI000044A8F0; Match level="QueryCoverage =71%, HitCoverage=99%, E-value=1e-16, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MNVLSGATLFCKITLTPNIFMVCVHRDPLGRELHALAISGHILTFRGLHVLAFGGLHVLTFRGLRVLPFRRLHNRTFRGLHVLAFRGINVLNFRGLHALAFGGLHTLSFSGLHVLPFRGLHVLTFRGLHVLPFRGLHVLAFRGLHVVAFREQHVLSFRGLHVFTFRGLHALAFRGLHVVPLEDYTSSLSEYFTASPLEVSQPTLR

SEQ ID NO: 124832 - protein, 130 aa, Glycine max
  Coding DNA Sequence Number=SeqID_8054
MGERKKRKEGKKAPGQGSKEDRRNVQRGLWTGQYLNNTELSPNEQKRRKGNHDLKYGENTETFSSLTSYPELCRSEFLIGGYVGARASLLSTTPPFVAMTQELVARGDTLRLSAPRHSVTPSVIHEQRPI

SEQ ID NO: 124833 - protein, 115 aa, Glycine max
  Coding DNA Sequence Number=SeqID_8055
  Homolog annotation: Hit_ID=Q8LLX2; Match level="QueryCoverage=43%, HitCoverage=6%, E-value=3e-07, Identity=49%"; Hit description =Putative retroelement
MVFVVLMICSEARFGNVFFNHQNLMETLTKVQLGEPGSLAKVEEGLWGEKDGGKFGNELLDFGYGVGWFLARVWSGGGLEGQMEKGGGGSIVDHLSDLFCRSIERPKHNVSAQLH

SEQ ID NO: 124834 - protein, 90 aa, Glycine max
  Coding DNA Sequence Number=SeqID_8056
MARTKKIGEIMIEAAKEIAEKIDSFEEQARHRDPSSPMDVRMFSLLLLDVQSTLDMSVLLEPVSPSSSTSDQLHGRPAALPRCLLKNCSS

SEQ ID NO: 124835 - protein, 207 aa, Glycine max
  Coding DNA Sequence Number=SeqID_8057
  Gene Ontology: Mol. function=RNA-directed DNA polymerase activity; Biological process=RNA-dependent DNA replication
MGETHEVPRDHTLADSKPCLGYATEGQEFGGVPLPNTLEGPQCHPQPQPLHFAMEERVPPAMVEREIFDHIEERLRAIEGGRDYAFADLAKLCLVPNVVIPPKFKVSNFDKYKGTTCPKNHLKMYNRKMGAYSKNEKLLMHFFQESLTGAVVTWYTNLEPSRVHSWKDLMVFFIMQYQYNFDMALDRMQLQNMCKKEHESFKEYAQR

SEQ ID NO: 124836 - protein, 68 aa, Glycine max
  Coding DNA Sequence Number=SeqID_8058
MKNGSLDHILSYIIDNQNFYSLDYGVEPSTCFYGKVHQVKVKHGSNQLAKVGAEDGSSYIASLPTTNT

SEQ ID NO: 124837 - protein, 141 aa, Glycine max
  Coding DNA Sequence Number=SeqID_8059
  Gene Ontology: Mol. function=RNA-directed DNA polymerase activity; Biological process=RNA-dependent DNA replication
  Homolog annotation: Hit_ID=Q1SYP9; Match level="QueryCoverage=92%, HitCoverage=13%, E-value=2e-08, Identity=25%"; Hit description=Myb, DNA-binding
MNLRGRQVEISDPMCLLCNNSEEVAAHLFFNCSKVLPLWWESLSWVNSVGAFPKEQKDHFMQHNRRDATRTKDIRWSYWWIALTRTIWQHRNKVVFDNQTFNASKLMDEVLLLVWSWLKAMEKDFDTHFNQWSSNLTDAFV

SEQ ID NO: 124838 - protein, 103 aa, Glycine max
  Coding DNA Sequence Number=SeqID_8060
  Gene Ontology: Mol. function=sequence-specific DNA binding; Cellular component=nucleus; Biological process=regulation of transcription, DNA-dependent
  Homolog annotation: Hit_ID=Q56NI2; Match level="QueryCoverage=75%, HitCoverage=38%, E-value=4e-24, Identity=64%"; Hit description=MADS box protein M8
  Pfam annotation: Domain name=K-box; Domain location=1-50; Score=-5.8; E_value=0.0014; Accession=PF01486.8; Description=K-box region
HILGEALSSLSLKELKNLESRLEKGLSRVRSRKEIELQNHNNFLRAKIAEHEKAQQRQQDMIPGNVCESTIPPQSYDRNFFPVNLIDSNNQYSNQDQTALQLV

SEQ ID NO: 124839 - protein, 100 aa, Glycine max
  Coding DNA Sequence Number=SeqID_8061
  Gene Ontology: Mol. function=sequence-specific DNA binding; Cellular component=nucleus; Biological process=regulation of transcription, DNA-dependent
  Homolog annotation: Hit_ID=Q7X926; Match level="QueryCoverage=85%, HitCoverage=38%, E-value=3e-32, Identity=78%"; Hit description =AGAMOUS-like protein
  Pfam annotation: Domain name=SRF-TF; Domain location=25-75; Score =118.8; E_value=1.6e-32; Accession=PF00319.9; Description=SRF-type transcription factor (DNA-binding and dimerisation domain)
MEFPNEAIPEGCSQKKTGRGKIEIKRIENTTNRQVTFCKRRNGLLKKAYELSVLCDAEVALVVFSSRGRLYEYANNRFKYSFTTNSTPYFFYPSISFHIL

SEQ ID NO: 124840 - protein, 1552 aa, Glycine max
  Coding DNA Sequence Number=SeqID_8062
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=98%, E-value=0.0, Identity=60%"; Hit description=Chromo
  Pfam annotation: Domain name=Chromo; Domain location=1441-1495; Score= 53.7; E_value=6.1e-13; Accession=PF00385.14; Description='chromo' (CHRromatin Organisation MOdifier
  Pfam annotation: Domain name=RnaseH; Domain location=891-1010; Score=- 12.4; E_value=0.00082; Accession=PF00075.14; Description=RNase H
  Pfam annotation: Domain name=rve; Domain location=1138-1294; Score =93.2; E_value=8e-25; Accession=PF00665.16; Description=Integrase core domain
  Pfam annotation: Domain name=zf-H2C2; Domain location=1079-1120; Score=13.0; E_value=0.0067; Accession=PF09337.1; Description=His(2) -Cys(2) zinc finger
  Pfam module annotation: Pfam domain module=Chromo::RVT_1::Retrotrans _gag::RnaseH::rve::zf-H2C2; Domain location=1441-1495::631-800::133 -223::891-1010::1138-1294::1079-1120
MADNTRMKEVYAELKKNADAITRVSDDLQNHIERLEATNHAQMEKIEVMQSTNDSQFSQLNAVMSQVLQRLQNIPMSSHGASNSQKEQQRSSFQVRSVKLDFPRFDGKNVMDWIFKAEQFFDYYATPDADRLIIASVHLDQDVVPWYQMLQKTEPFSSWQAFTRALELDFGPSAYDCPRATLFKLNQSATVNEYYMQFTALVNRVDGLSAEAILDCFVSGLQEEISRDVKAMEPRTLTKAVALAKLFEEKYTSPPKTKTFSNLARNFTSNTSATQKYPPTNQKNDNPKPNLPPLLPTPSTKPFNLRNQNIKKISPAEIQLRREKNLCYFCDEKFSPAHKCPNRQVMLLQLEETDEDQTDEQVMVTEEANMDDDTHHLSLNAMRGSNGVGTIRFTGQVGGIAVKILVDGGSSDNFIQPRVAQVLKLPVEPAPNLRVLVGNGQILSAEGIVQQLPLHIQGQEVKVPVYLLQISGADVILGSTWLATLGPHVADYAALTLKFFQNDKFITLQGEGNSEATQAQLHHFRRLQNTKSIEECFAIQLIQKEVPEDTLKDLPTNIDPELAILLHTYAQVFAVPASLPPQREQDHAIPLKQGSGPVKVRPYRYPHTQKDQIEKMIQEMLVQGIIQPSNSPFSSPILLVKKKDGSWRFCTDYRALNAITVKDSFPMPTVDELLDELHGAQYFSKLDLRSGYHQILVQPEDREKTAFRTHHGHYEWLVMPFGLTNAPATFQCLMNKIFQFALRKFVLVFFDDILIYSASWKDHLKHLESVLQTLKQHQLFARLSKCSFGDTEVDYLGHKVSGLGVSMENTKVQAVLDWPTPNNVKQLRGFLGLTGYYRRFIKSYANIAGPLTDLLQKDSFLWNNEAEAAFVKLKKAMTEAPVLSLPDFSQPFILETDASGIGVGAVLGQNGHPIAYFSKKLAPRMQKQSAYTRELLAITEALSKFRHYLLGNKFIIRTDQRSLKSLMDQSLQTPEQQAWLHKFLGYDFKIEYKPGKDNQAADALSRMFMLAWSEPHSIFLEELRARLISDPHLKQLMETYKQGADASHYTVREGLLYWKDRVVIPAEEEIVNKILQEYHSSPIGGHAGITRTLARLKAQFYWPKMQEDVKAYIQKCLICQQAKSNNTLPAGLLQPLPIPQQVWEDVAMDFITGLPNSFGLSVIMVVIDRLTKYAHFIPLKADYNSKVVAEAFMSHIVKLHGIPRSIVSDRDRVFTSTFWQHLFKLQGTTLAMSSAYHPQSDGQSEVLNKCLEMYLRCFTYEHPKGWVKALPWAEFWYNTAYHMSLGMTPFRALYGREPPTLTRQACSIDDPAEVREQLTDRDALLAKLKINLTRAQQVMKRQADKKRLDVSFQIGDEVLVKLQPYRQHSAVLRKNQKLSMRYFGPFKVLAKIGDVAYKLELPSAARIHPVFHVSQLKPFNGTAQDPYLPLPLTVTEMGPVMQPVKILASRIIIRGHNQIEQILVQWENGLQDEATWEDIEDIKASYPTFNLEDKVVFKGEGNVTNGMSRGEKVNKTAESSSERGLHNKLADFEELGRGKREKKPSWKITESH

SEQ ID NO: 124841 - protein, 123 aa, Glycine max
  Coding DNA Sequence Number=SeqID_8063
  Gene Ontology: Mol. function=RNA-directed DNA polymerase activity; Biological process=RNA-dependent DNA replication
MDATGLSEIDSSGEFFTWTNKQADNPIYSRIDRILANIDWFQTHSDANLTVLPPPPPHVSDHSILYLSKPLHVRKRNQFRFNNYWVDAVGFYSIVERSWNQPARGTLRQRLCKRKVGPGSTGP

SEQ ID NO: 124842 - protein, 191 aa, Glycine max
  Coding DNA Sequence Number=SeqID_8064
  Gene Ontology: Mol. function=RNA-directed DNA polymerase activity; Biological process=RNA-dependent DNA replication
  Pfam annotation: Domain name=AT_hook; Domain location=164-176; Score =14.9; E_value=0.061; Accession=PF02178.9; Description=AT hook motif
PHGFRLSRSKSEYMECKFNKRRRVSNSEDDGEIDGDVNHRIQAGWMKWRKASGVLCDAKVPIKLKGKFYRTAVRPAILYGTECWAVKSQHENKVGVAEMRMLRWMCGKTRHDKIRNEAIRERVGVAPIVEKMVENRLRWFGHVERRPVDSVVRRVDQMERRQTIRGRGRPKKTIREVIKKDLEINGLDRSM

SEQ ID NO: 124843 - protein, 65 aa, Glycine max
  Coding DNA Sequence Number=SeqID_8065
  Gene Ontology: Mol. function=structural constituent of ribosome; Cellular component=intracellular; Biological process=translation
  Homolog annotation: Hit_ID=Q1SGY5; Match level="QueryCoverage=66%, HitCoverage=63%, E-value=8e-13, Identity=81%"; Hit description =Ribosomal L38e protein
  Pfam annotation: Domain name=Ribosomal_L38e; Domain location=1-47; Score=47.6; E_value=4.2e-11; Accession=PF01781.8; Description =Ribosomal L38e protein family
MKIMRSRDVVKFKVRCSKYLYTLYVFDPEKADKLKQSLPPGYPVLTPCIPNANGDISITIAKNLD

SEQ ID NO: 124844 - protein, 64 aa, Glycine max
  Coding DNA Sequence Number=SeqID_8066
EEHARIGADSSSATSNKCENYKEEARNAAQKHKVKRVESVNADVEAFGDHWKVQIALCILKLKH

SEQ ID NO: 124845 - protein, 36 aa, Glycine max
  Coding DNA Sequence Number=SeqID_8067
MEKAEEIAALIPNPLPPIDAIQLFWPFNSKIDGTLQ

SEQ ID NO: 124846 - protein, 114 aa, Glycine max
  Coding DNA Sequence Number=SeqID_8068
  Gene Ontology: Cellular component=chloroplast
  Homolog annotation: Hit_ID=P03938; Match level="QueryCoverage=57%, HitCoverage=50%, E-value=2e-11, Identity=78%"; Hit description =Hypothetical 14 kDa protein ycf68
MGAGHARSRYLNRKEGDAEGRASDWSEVVTRRIDGAIQVRSNVDPTFSSLVGSGRSGGDHHGSSLLENSYIPYQYMDSYLSSTGLGLASMEKNGAPNNVSSQTKNYEIAPFILG

SEQ ID NO: 124847 - protein, 266 aa, Glycine max
  Coding DNA Sequence Number=SeqID_8069
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=Q8HSU4; Match level="QueryCoverage=91%, HitCoverage=69%, E-value=1e-115, Identity=84%"; Hit description =Ribulose-1,5-bisphosphate carboxylase/oxygenase large subunit
  Pfam annotation: Domain name=RuBisCO_large; Domain location=39-253; Score=430.4; E_value=2.4e-126; Accession=PF00016.10; Description =Ribulose bisphosphate carboxylase large chain, catalytic domain
MFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAAKALRLSGGDHVHAGTVVDRSRGIYFTQDWVSLPGVLPVDSGGIHVWHMPALTEIFGDDSVLQFGGGTLGHPWGHAPGAVANRVALEACVQARNEGRDLAREGNEIIREASKWSPELAAACEVWKEIKFEFEAMDTL

SEQ ID NO: 124848 - protein, 41 aa, Glycine max
  Coding DNA Sequence Number=SeqID_8070
MAPLQDTGLPCSDVFCLSSVGKGRRSVGRDPILHLHLSLST

SEQ ID NO: 124849 - protein, 64 aa, Glycine max
  Coding DNA Sequence Number=SeqID_8071
MEAKAQKWWPRGENLQNPWVLHFLNEGGEFWVERNSPSPRFCVSSCASRLSGARHGMMIHRSWA

SEQ ID NO: 124850 - protein, 36 aa, Glycine max
  Coding DNA Sequence Number=SeqID_8072
VPCYKVMTKDNDCTSKPYTRATKGTMQKPQANLGAD

SEQ ID NO: 124851 - protein, 72 aa, Glycine max
  Coding DNA Sequence Number=SeqID_8073
MEKLNVHIITRGTPKAHPGELKLSVEAMSLPRRAGFFTMKLFGGPGEPKLFRIVTGVQHRKSTSKDQKINER

SEQ ID NO: 124852 - protein, 115 aa, Glycine max
  Coding DNA Sequence Number=SeqID_8074
MSKDEGSKYEELRMIEFKKLRKKDKKNANDNDEDYVPEYEGGLGSNSSSENYENDKRDEFGATNDLESQKRKMMKSWILNSKRVYNDPFIHQSLDKEVNESLPNNASHVSELTNV

SEQ ID NO: 124853 - protein, 354 aa, Glycine max
  Coding DNA Sequence Number=SeqID_8075
  Gene Ontology: Mol. function=helicase activity
  Homolog annotation: Hit_ID=Q1SN45; Match level="QueryCoverage=45%, HitCoverage=11%, E-value=5e-25, Identity=35%"; Hit description=AAA ATPase
MDPSQLTMIPCTQKGSQICSSSLYFVGYHFLHNAHVKCFDEISQVKKEKVFYPRDIQEALGRVLGKRLAFRLKVVPGNTCHSVSQLSQDEALFSSTLAKLPSFDLQDEVELSISSVHENNDAIDSQCFSDIVEFNPHLPGSIIAAKHNLSLSHTQLDGISFEDLSSIQLSSARPTVTESMFTSWLLTNSISHEGKHLTYVQFITKFTCVAKDKRRKPGKGGYTIGRLNWMPLSTGELYYLRMMLVVEYTKALREAYRWGSCQFLRRLFVTILVSNSIERPDHVWYETREYLIDGILHHQRRITNITDLELAIEELQNLALLQIEEILQSNKKSLKDYPNMPFSRHVVRSHTLLL

SEQ ID NO: 124854 - protein, 95 aa, Glycine max
  Coding DNA Sequence Number=SeqID_8076
MAKRCGMTIICLCMSSGSPPLDDKRRRMTIICLYVPSDTIVSEWRKDSPPLDDKRRRMTIICLCEPSDSIVSGWQKGVRNDHNLSPHVIGLAALG

SEQ ID NO: 124855 - protein, 59 aa, Glycine max
  Coding DNA Sequence Number=SeqID_8077
MAEEHDQRIALEDYSREAKRWLHSFKGNSLKTWEEVVEKFLKKYFPESKTAEGKVAISE

SEQ ID NO: 124856 - protein, 70 aa, Glycine max
  Coding DNA Sequence Number=SeqID_8078
MKKILGLQAPMELTSIGAGGSEVATRDHSGVVAVVSPASSPITNGSWMVALDDSSSTCCSTWTVGPSSSL

SEQ ID NO: 124857 - protein, 111 aa, Glycine max
  Coding DNA Sequence Number=SeqID_8079
VAGSTWTTSLSALGGLVHKDRRREALRVRFTTDDEVDASERGEGGGGGGEAGGEAMIHYTSSKFGYVYSFVNMLEAWEDQKELFCDQMPEARRSLGAATYIGVPNKLDRTY

SEQ ID NO: 124858 - protein, 103 aa, Glycine max
  Coding DNA Sequence Number=SeqID_8080
  Gene Ontology: Mol. function=transition metal ion binding
NTGVRTDDIGFTLVDLKKLGYHNDPFIMAEQARQVFYVQDPYDERWCVVLPGKTIGVNVEDDDSYMDTYEVVAEVVQKLQPREASTLFVEVKSEHLRSIYPIL

SEQ ID NO: 124859 - protein, 106 aa, Glycine max
  Coding DNA Sequence Number=SeqID_8081
MLKRKDVPQLISGRDELSKDELHNVLTVMAGQGSLRQKQTQAEGERRRTIGFKRVGYRSNGHHHIDNFSGQDCVYSNMNSRIFGKHSDAHSDVNNVSVGFLTRIVG

SEQ ID NO: 124860 - protein, 47 aa, Glycine max
  Coding DNA Sequence Number=SeqID_8082
MVGVLPKRKILMQHGKSRENQDTTTCSSTCPPTSTPDRYFTNLDGVS

SEQ ID NO: 124861 - protein, 58 aa, Glycine max
  Coding DNA Sequence Number=SeqID_8083
MEYEGGENNHIGFNLTSNSNRPQWSRTPTVITNPSDDDGVEETTVTGLRGEGERYFCF

SEQ ID NO: 124862 - protein, 63 aa, Glycine max
  Coding DNA Sequence Number=SeqID_8084
  Gene Ontology: Mol. function=phosphotransferase activity, alcohol group as acceptor; Cellular component=cytoplasm; Biological process =carbohydrate phosphorylation
  Homolog annotation: Hit_ID=Q1SWC0; Match level="QueryCoverage=96%, HitCoverage=13%, E-value=2e-11, Identity=56%"; Hit description =Mevalonate and galactokinase
MAKLEDLPIPNHDTLEAVYGELEETRRRFDVLWSKFVDLFGDSPEVIGRSPGRVNLIANENDT

SEQ ID NO: 124863 - protein, 929 aa, Glycine max
  Coding DNA Sequence Number=SeqID_8085
  Gene Ontology: Mol. function=caspase activity; Biological process =proteolysis
  Homolog annotation: Hit_ID=O80935; Match level="QueryCoverage=99%, HitCoverage=99%, E-value=0.0, Identity=49%"; Hit description =Putative WD-40 repeat protein
  Pfam annotation: Domain name=WD40; Domain location=392-430; Score =39.2; E_value=1.4e-08; Accession=PF00400.22; Description=WD domain, G-beta repeat
  Pfam annotation: Domain name=WD40; Domain location=487-524; Score =41.3; E_value=3.2e-09; Accession=PF00400.22; Description=WD domain, G-beta repeat
  Pfam annotation: Domain name=WD40; Domain location=527-566; Score =37.8; E_value=3.8e-08; Accession=PF00400.22; Description=WD domain, G-beta repeat
  Pfam annotation: Domain name=WD40; Domain location=570-607; Score =3.4; E_value=14; Accession=PF00400.22; Description=WD domain, G-beta repeat
  Pfam annotation: Domain name=WD40; Domain location=619-658; Score =6.9; E_value=5.6; Accession=PF00400.22; Description=WD domain, G -beta repeat
  Pfam annotation: Domain name=WD40; Domain location=660-700; Score =20.1; E_value=0.0079; Accession=PF00400.22; Description=WD domain, G- beta repeat
  Pfam module annotation: Pfam domain module=WD40::WD40::WD40::WD40::WD4 0::WD40; Domain location=392-430::487-524::527-566::570-607::619 -658::660-700
MATMERRKTMTMNWDGLGDDDDDDHFFETYNRLSTAVPQDLADDDDGNFEDSRLSFASTISSTLTIKPRTSHFSANFTGKPNYEIWMAAPGSISERRRRLLCSMGLDENKELLQATSKAIARAMTKKFENNNDINNNNDNNNNKYAANSIAVRVEKQKPSSSPVFVLVRSRSEGDIDSFSMEKSRKEEIIGKVSKQRLTRTVTEVAQRRHARVENNRVVVKDAAAGDSLVHVDARVNRQVITPVMGVAGVSAFFLIKNLDTGKEFIVNEYGEDGTWNRLSDLQTGKQLTMEEFEKTVGHSAVVKEVMRRANVARGEKKLSSNSYISRSLRLSKRRGASLLRNIKGVASGFVGEREREAVVPPQAAEPAEPKGKNKWVRVRQSGKSQKELSALHLCQEFEAHEGCVWTIKFSLDGRYLASAGEDKVIHVWEVQEWEVMSLRPEEGNLTPIHPSLLSSMTKGKNGSRRGGAGAIPEYVHVPETVFTLSEKPYCSFTGHLDEVLDLSWSRSQLLLSSSMDKTVRLWDLETKSCLKFFAHNDYVTCVQFNPMDEDYFITGSLDAKVRMWNIPARLVVDWIDIHEMVTAVSYTPDGQGVLVGTQKGNCRTYSIEDYKLTQSDTIELRNKKKSQLKKVTGFQFAPNNPSEVLVTSADSRIRIVDGSQVVQKFKGFRNASSQMAASFTTSGRYIISASEDSQVYVWKHEETRNPSSGKARNLIVNQSHEHFPCKDVSVAIPWPCTIRGDPPPVPMQNPKKNSKRSQEDSAANSKRMLPPLPKKSNNHTTESAPGSPEHDPAAISHTESGIGDSFGNSKRRLPPLPNKSSNHATESGDYKPIEEELEAISRTHTGLGDSFASSYGDPASISAAATPSNASSSSNYSSYDGCNGASSIHPSAWGLVIVTAGFGGEIRCYQNFGLPRRMRQTNIFLGPT

SEQ ID NO: 124864 - protein, 456 aa, Glycine max
  Coding DNA Sequence Number=SeqID_8086
  Gene Ontology: Mol. function=nucleobase transporter activity; Cellular component=membrane; Biological process=nucleobase, nucleoside, nucleotide and nucleic acid transport
  Homolog annotation: Hit_ID=UPI00005FA403; Match level="QueryCoverage =77%, HitCoverage=96%, E-value=1e-137, Identity=68%"; Hit description= COG1457: Purine-cytosine permease and related proteins
RKLGDQLPDLALRDGQIARLRDHRNGGRVLVALGGQRLVEQLQFFQIVVFDLFTGDTEEIGDPIHGGLLNVVHSSVKNFVESRARQAAAIGKGKPWFHRGRFLRPAEGQFEHPIQQAGGHQRVDGRHAPFGRQANGAADDAGDDRRPADGRRFARQLAGTAALVQDLAVAAQQVIVHQHDADNRREDHAKHRQEVDKAVKNAQHRQRGAKNADHQRGVGVLQLFAGDAFHRVDDAQRRRVQDRQAVHHELAGDDGEERDAEHVLAVFGVTSQVGGHQAGHDGAADDDGDAGADGQRFTRRRQLDDLLQVMAGKRGHRNIGHQHDEHRHRDTGGDAQRLEAECHQDGQQRAREPGGQAEAQLIAEREVERLGENGVLNAEPTQQADGHHHADQHRAQTAEAAPARQQAAGNAFAHARQPQAVGHHAEDQAADENGGEGVNQRHGVAEHGAEHELVQR

SEQ ID NO: 124865 - protein, 207 aa, Glycine max
  Coding DNA Sequence Number=SeqID_8087
  Gene Ontology: Mol. function=oxidoreductase activity; Cellular component=integral to membrane; Biological process=electron transport
  Homolog annotation: Hit_ID=Q69LJ7; Match level="QueryCoverage=89%, HitCoverage=18%, E-value=1e-22, Identity=34%"; Hit description =Putative respiratory burst oxidase protein E
  Pfam annotation: Domain name=NADPH_Ox; Domain location=149-206; Score= 35.1; E_value=3.8e-09; Accession=PF08414.1; Description=Respiratory burst NADPH oxidase
MRTSSFRRCSTGEFDLQENFDASSPVTGGHAYGAMLPVFLNELRSNHHKELVEITLELENDAVVLCNVAPAPSSAPNASPSSSTTGGDGNGGGGGGGVARSLSITSRIRRKFPWLRSMSSASAESVTAASAAVEDPLVTARNARKMRVKLERTRSSAQRALKGLRFISKSGEATEELWRKVEERFNVLAKDGLLAREDFGECIGEEI

SEQ ID NO: 124866 - protein, 692 aa, Glycine max
  Coding DNA Sequence Number=SeqID_8088
  Gene Ontology: Mol. function=DNA binding; Cellular component =intracellular; Biological process=DNA integration
  Pfam annotation: Domain name=rve; Domain location=123-273; Score =58.5; E_value=2.2e-14; Accession=PF00665.16; Description=Integrase core domain
  Pfam module annotation: Pfam domain module=RVT_2::rve; Domain location=459-610::123-273
MVEGMSLISNDCKREGHTKKYYPGRQKTNGGSDRQKYLGDAAIVHDNYETSKVLVSNSDSLETEWIMDSRYFCEQAEGFVLFGDNKSCKIAEVRYVPDLKRNLISVGELDKKGYLFKGENSELLVVKGSVVVIRGIKKKGLYSLDGDVVIGTTTSAFEKLSQKTEIWHKRLGHTGRKVKRFRTNNGLEFCSEAFIDFCKANAIARHKIVVGTPQQNGLAERFNRTSLERVRCMLLSAYLPKTFWAETATTTTYLINRCLSTTLDMETPEEIWSNHPPKLDQLKVFGCVAYAHIRQDKLDPSVVKCMFLGYPEGVKGYKLWCLELGHKKCLISRDVVLNENIIAYQDKFDLTKPSTSDTYKTKSERVNFEVEQISKGGQATKNYLLSDKDDDESEQQTSELDNYQLARDRVRRETKAPERYGYADLIALALTFASEVLEEEPKSYEEVLASKEKGKWLRTMNEEIKSLHDNNTWELIRKPPDSKLPEGFIVKGKEDYVCKLKKSLYDLKQSPRQWNKRLPVVGTFVILLLYVDDILIANNSKSEINKAKGELNREFEMKDLGAISKILGMEIKRNRRKGTLKLSQESYLKKVLEKFGMTKLKLVITSLSQQFKLSANQVPKTTKEVNYMDNVQYANLVGLLCMLWFMSNPGRAHWQALKWILRYIKGCLDLRKSLTGYIFAAFGTIINWKACL

SEQ ID NO: 124867 - protein, 277 aa, Glycine max
  Coding DNA Sequence Number=SeqID_8089
  Gene Ontology: Mol. function=oxidoreductase activity; Cellular component=integral to membrane; Biological process=electron transport
  Homolog annotation: Hit_ID=O81211; Match level="QueryCoverage=97%, HitCoverage=28%, E-value=2e-91, Identity=58%"; Hit description =Respiratory burst oxidase protein E
  Pfam annotation: Domain name=Ferric_reduct; Domain location=92-248; Score=149.0; E_value=1.2e-41; Accession=PF01794.9; Description =Ferric reductase like transmembrane component
MLLLEKDRYMNYSRQLSTASVNWSQNMTDLRPKNEIQRFCRTLQCLALEYWRRGWILLLWLVTTAFLFAWKFYQYRNRSTFQVMSYCIPIAKGAAETLKLNMALILLPVCRNTLTWLRSTGARKFVPFDDNINFHKIIAFAIAVGIAVHAGNHLACDFPLLVNSSPEKFSLISSDFHNKRPTYKSLLTGVEGVTGISMVVLMAISFTLATHHFRRNALRLPSPFNRLTGFNAFWYSHHLFGLVYVLLLVHGTFLYLTHRWYQKTVRISIAIYNEGHV

SEQ ID NO: 124868 - protein, 114 aa, Glycine max
  Coding DNA Sequence Number=SeqID_8090
  Gene Ontology: Mol. function=oxidoreductase activity; Cellular component=integral to membrane; Biological process=electron transport
  Homolog annotation: Hit_ID=UPI0000162E08; Match level="QueryCoverage =93%, HitCoverage=11%, E-value=2e-42, Identity=75%"; Hit description =calcium ion binding / oxidoreductase
  Pfam annotation: Domain name=NADPH_Ox; Domain location=1-45; Score =2.6; E_value=6.6e-06; Accession=PF08414.1; Description=Respiratory burst NADPH oxidase
  Pfam annotation: Domain name=efhand; Domain location=46-74; Score =23.1; E_value=0.001; Accession=PF00036.22; Description=EF hand
  Pfam module annotation: Pfam domain module=NADPH_Ox::efhand; Domain location=1-45::46-74
MEDSKEFAVCIFDALVRRKERRVSSINREELHEFWLQISDQSFDARLQIFFDMADSNEDGRITREEVQELIMLSASANKLSKLKEQADGYAALIMEELDPENLGYIEVKMGRRE

SEQ ID NO: 124869 - protein, 309 aa, Glycine max
  Coding DNA Sequence Number=SeqID_8091
  Gene Ontology: Mol. function=chitin binding; Cellular component =extracellular region; Biological process=chitin metabolic process
  Homolog annotation: Hit_ID=UPI000044A8F0; Match level="QueryCoverage =80%, HitCoverage=99%, E-value=7e-35, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGVATNVYLRKTSEKPERYDLRTLSVKGSEVVFTHGEGISTPRICHKGRQPLIDPLKVRTRSPLKSRTCQPLQVRASSPLKARACSPLKKRVCSPLKARTCNPLKVRTCSPLKMRACSHLKAMTCSLLMARTCSPLKARACSPLKERVFSPLKARTWNPLKVRTCSPLKARACSPLKARTCSPLKVRMCSPLKAKACSPLMARTCSPLKVSTCSPRKVRTRSPLKARACSPLMARTCSPLMARMCSPRKVSACSPLKACSPLMVRTCSPLKLRACSPLKSSEGEGVQPLKVRACSALKVRVCSPRKVK

SEQ ID NO: 124870 - protein, 319 aa, Glycine max
  Coding DNA Sequence Number=SeqID_8092
  Gene Ontology: Mol. function=chromatin binding; Cellular component =chromatin; Biological process=chromatin assembly or disassembly
  Homolog annotation: Hit_ID=Q1SAV4; Match level="QueryCoverage=90%, HitCoverage=98%, E-value=1e-41, Identity=46%"; Hit description =Integrase, catalytic region
  Pfam annotation: Domain name=Chromo; Domain location=239-292; Score =30.2; E_value=7e-06; Accession=PF00385.14; Description='chromo' (CHRromatin Organisation MOdifier
MKQDVKLFISSCIVCQQTKNNHRKSSGLLCPLPMPARKARGVHRFTSGALHCCHCGQDIYGDCWQNPWHATQPHPRPRSPVRESPLARTIQAKRYQTQDEHGVSPPYGWPDRGDESRNRATPPSFCPPKTDNMGTFPPMAGVVVQHIHPLRYRQKKKESADKQRRDVQFEEGAQVLVKLRPRRQSTATGSQYSKLAKRVITHTSSISLLTTQAIYSIHHPAGGPPLSLPASSEEHQPLISPLAILDTKWTQSEKDSELLVLVQWAGLLPEDTSWEPWAQLKADYNLEDKWSRECPGSIAPDGSGAPKDPLLAESNPLGL

SEQ ID NO: 124871 - protein, 130 aa, Glycine max
  Coding DNA Sequence Number=SeqID_8093
  Gene Ontology: Mol. function=RNA-directed DNA polymerase activity; Cellular component=chromatin; Biological process=chromatin assembly or disassembly
METLGKPYATILKDEVVADGAVRVFGRIGLNLLTKFEEGGVVEELLFNSLRLRWSVRMVKGLPNKYCLPFFNGGGDGGEFPDIRGCMKKLRAKRFTKEGYWMVLLGQDCSHADVGGVSLDAEWDGEVWQA

SEQ ID NO: 124872 - protein, 189 aa, Glycine max
  Coding DNA Sequence Number=SeqID_8094
  Gene Ontology: Mol. function=protein kinase activity; Cellular component=integral to membrane; Biological process=protein amino acid phosphorylation
  Homolog annotation: Hit_ID=Q949V3; Match level="QueryCoverage=68%, HitCoverage=22%, E-value=1e-25, Identity=56%"; Hit description =Putative receptor protein kinase
MLLYLSTLTLNQQTCLQPWIRRNRCGLCSRLGVVAAVAVSEVAVETTSEVAEVGGGCASCHAGGGGDVVVEGGYNRGFGGGGEEQAHDLLRASMEVLGKGSVGTSYKAVLEEGTTVVVKRPKDVVVTKKEFEMQMKVLGKIKHENVVLLKAFYFSKDEKLLVYDYMSAGSLSALLHGTMLLKSLIHLSV

SEQ ID NO: 124873 - protein, 111 aa, Glycine max
  Coding DNA Sequence Number=SeqID_8095
MIQRVSSSLLKPAKREGALGIRECLESQGHHSTLSPMTKKDLILGYMGDGCLFTLSKGCDSLSIWNLFISQGIQPIHESLSFGHVLMHNDFIRSLKVLLPFNRHNHKNWYI

SEQ ID NO: 124874 - protein, 101 aa, Glycine max
  Coding DNA Sequence Number=SeqID_8096
MEGRQDIRTTLGTPKVNKGLKLLFMLMVVVKAIQILLVMKDIGIADIVKAELMALFQGLNVAWEFGYADILCLGIIAFVNSPLYLHGLLVADAMKIPILRE

SEQ ID NO: 124875 - protein, 241 aa, Glycine max
  Coding DNA Sequence Number=SeqID_8097
  Gene Ontology: Mol. function=transporter activity; Cellular component= integral to membrane; Biological process=transport
  Homolog annotation: Hit_ID=Q6ZF47; Match level="QueryCoverage=91%, HitCoverage=37%, E-value=9e-46, Identity=47%"; Hit description =Putative organic cation transporter
MAGRDKNPTYPHDKQVNMDEKLNRVTYSKTKEANDANLGAPPSPNELRGQHKRGGPNGSTSKATEKLEGRIDGDVGRKSDEKGSDGHDEAGEEQHVLAAERRISQRGQQEAAKQTASEEHRSGKARDGGVGALQAPVRHHGGLCGPVPGPRAFWEVADCVGVGSLACIAGLLGAAPRRRGVGEDADEGLLGVKDPREGDEDRLEELGPVELAYAEFDCGPQRGMLLVSWRWWWLWFLCVRR

SEQ ID NO: 124876 - protein, 283 aa, Glycine max
  Coding DNA Sequence Number=SeqID_8098
  Gene Ontology: Mol. function=transporter activity; Cellular component= integral to membrane; Biological process=transport
  Homolog annotation: Hit_ID=Q6ZF47; Match level="QueryCoverage=88%, HitCoverage=51%, E-value=1e-45, Identity=39%"; Hit description =Putative organic cation transporter
MLYCILVKLFVTESPRWLLVRGKTEEAVETLKCITSITQSNLNLAINNMSHEEETCDVDIFSALKILLQNKWSSRRLSSIMAMGIGIGLVYYGMPLGLQNLSFNLYLSVIFNALSELPSALIVLFFIDKFNRRITLLLFTILSGLFSVMSTVQVSKSSSSWNNNVQIVFELVSFFSACTSFNVYLIYTTELFPTCVRNSALSMARLAVVLGGMFSPLLGLVGSLEYSCPRQKGGHSVIQWMKKKTKRKTWLVACCWLEFCGFRKWKKKTSGECGWWIYPNWQV

SEQ ID NO: 124877 - protein, 93 aa, Glycine max
  Coding DNA Sequence Number=SeqID_8099
MASSGTQGKEALAELLGILLEEATARNQTEGNKDLNHNEKDYLLPKVVEFSEENRHGGKDTSKVELSANEGLNSNKAYRNKSLMTEKWNLGTR

SEQ ID NO: 124878 - protein, 147 aa, Glycine max
  Coding DNA Sequence Number=SeqID_8100
MSVYDLPPKILCRVINFMLKRPALNFLCFSITKFENEFVFDVMVEPDTNEVFAQVTLLPEPNVELCDEDEFVVLACDGIWYSSYRFSFVTTPMVFHSRHMVVSFEENKVYVYNSRSPASVVPSKLVGHVRFGGAVLAKNQKLPTPLF

SEQ ID NO: 124879 - protein, 150 aa, Glycine max
  Coding DNA Sequence Number=SeqID_8101
  Gene Ontology: Mol. function=cobyrinic acid a,c-diamide synthase activity; Biological process=selection of site for barrier septum formation
  Homolog annotation: Hit_ID=Q45RR8; Match level="QueryCoverage=72%, HitCoverage=31%, E-value=1e-09, Identity=38%"; Hit description =Plastid division regulator MinD
MSPEDLHTHATTPCTPEETALPFNHSFSLFFAFVSLSLFIVIEDLDEGVVDTVLEAEVAEADINVDGNHREAHDDEEEVDVSDVDDLVHTAFVEGTDCNAQDGAEELDRACGSNYGGQWGVWVWLFSGLGFWMGGEGNGGRGEERAQGGM

SEQ ID NO: 124880 - protein, 91 aa, Glycine max
  Coding DNA Sequence Number=SeqID_8102
MSGQRNFRTSKFTESEINDLMLRLQALLPQLNQTRNSRASESLMKIMKETCSHINRLQNEVKDLGERLAELIDSVDLSDIDEECLTRLLQQ

SEQ ID NO: 124881 - protein, 335 aa, Glycine max
  Coding DNA Sequence Number=SeqID_8103
  Gene Ontology: Mol. function=structural constituent of ribosome; Cellular component=ribonucleoprotein complex; Biological process =translation
  Homolog annotation: Hit_ID=Q9FLF0; Match level="QueryCoverage=50%, HitCoverage=86%, E-value=3e-86, Identity=92%"; Hit description=40S ribosomal protein S9-2
  Pfam annotation: Domain name=Ribosomal_S4; Domain location=145-246; Score=126.2; E_value=9.2e-35; Accession=PF00163.9; Description =Ribosomal protein S4S9 N-terminal domain
  Pfam annotation: Domain name=S4; Domain location=247-294; Score=52.8; E_value=1.1e-12; Accession=PF01479.15; Description=S4 domain
  Pfam module annotation: Pfam domain module=Ribosomal_S4::S4; Domain location=145-246::247-294
MYGRTSSVESYGRTSSVCSIWKNFFRMKSFFPKKLNEEHFINDKKINEHPIPWSSQNENSTFQLHNNTNPLTASKNHTLTQQQDQTGKKTLKRCSPRLGPGPVTEAQLHTWQALRIRQSRKIPSSQAQSRAAQKRENGTAAVEENNHDGKTFKKPRRPYEKERLDAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIKQRHIRVGRQVVNIPSFLVRVDSQKHIDFSLTSPLGGGRPGRVKRRNQRAAAKKAAGGDGDEEDED

SEQ ID NO: 124882 - protein, 120 aa, Glycine max
  Coding DNA Sequence Number=SeqID_8104
  Homolog annotation: Hit_ID=Q9LQ89; Match level="QueryCoverage=61%, HitCoverage=14%, E-value=8e-08, Identity=44%"; Hit description=Rop guanine nucleotide exchange factor 2
MDSSSNFDDNSDVGYQPSPSSVDQNDHSITETVGYSPLLSGESFAYCRSNSEVSNFSEPIDDNSFASDQPSPSLWTTMKHGASQASLSRLGMKQHRNSLDEKSDDLDLLETDNLLGCVAR

SEQ ID NO: 124883 - protein, 43 aa, Glycine max
  Coding DNA Sequence Number=SeqID_8105
MALLCCWTYLQPTTLAQGVTFRPHSRRRVGCDRWRLHWRLFES

SEQ ID NO: 124884 - protein, 51 aa, Glycine max
  Coding DNA Sequence Number=SeqID_8106
MVKTLLENLIQRSMRLFFLEKDSALEDDIKPEELEQRKEISIRMPKEFPRE

SEQ ID NO: 124885 - protein, 227 aa, Glycine max
  Coding DNA Sequence Number=SeqID_8107
  Gene Ontology: Mol. function=DNA binding; Cellular component =endoplasmic reticulum membrane; Biological process=DNA integration
MSMMEELNFFLGLQVKQMKHGTFLSQTKYCTKLIRKFGMEKCKEASTPMATSTYHDLDEKGKSVDESRYRGMIGSLFYLNQWSVYLCARYQTNPKESHLTSIKKIIKYLKDTTNVGLRWLATPSELKRRPSPPRRSNESTLRLFSSGLIHVKNVRIPKFLDLEWFSHQGFNFPNLLEAQGLSKFVQMKGTFYPELVKVFYTYVAPIWKKWLSMLVWKAVARLDIGGV

SEQ ID NO: 124886 - protein, 190 aa, Glycine max
  Coding DNA Sequence Number=SeqID_8108
  Homolog annotation: Hit_ID=Q2HS44; Match level="QueryCoverage=44%, HitCoverage=35%, E-value=2e-10, Identity=33%"; Hit description =Hemopexin
MDGLKVLSACLNLVPKFSSQLAAPLIHLVRAIIELRDDVSKERFGPTRMDNFFKVKFKKPSIFKVDFFGKRSSFGCIKIKKDWRVVRAVFGVVQLLFEKVVGDDPHVAVTHREKGTVSNGTYVRSSPSLIAPRISIFLSKLHGHPLSTHSASSKLSSNSLSSSYKLRSSMVGSSIVAGKDVKAWEKARTY

SEQ ID NO: 124887 - protein, 286 aa, Glycine max
  Coding DNA Sequence Number=SeqID_8109
  Gene Ontology: Mol. function=RNA-directed DNA polymerase activity; Cellular component=extracellular region; Biological process=RNA -dependent DNA replication
MNQWGCKLRTKFWDQIETCRQNLEAIHHLKGPANVAHYTKIQEKLNLLIAKEESYWRQRSKVFWLREGDINSKFFHSSTKARKTVNKISSLSRDDGVMVHSHKDMSDVVVSYFSNFFQANDNCIDILPIINNFPHSVSFYNNDILLSPFTLEEFRVALFHMNSQKSLDPSGLKTTFYKIFWHLCGPEVFYSSITWLETGSFPPERGLRQDDPLSPYLFIICTEGLSSLIKYHERRGDIHGVKASGQLINFQKSETEKYLGLPSIIGRRKKAIFGFRKDRLWNDINL

SEQ ID NO: 124888 - protein, 59 aa, Glycine max
  Coding DNA Sequence Number=SeqID_8110
MDILTLGQGFGFGQRFGDKGDVSHYFHDTHATMMIRKFYAKLVMHEPMWALKHQVFMVM

SEQ ID NO: 124889 - protein, 163 aa, Glycine max
  Coding DNA Sequence Number=SeqID_8111
MERTSFVLQLELQVEHTSTWWFKENKGGYIPCGSFLVKGSKTNASDKNDDKIKLPPKLPKNKDHIEDVNVVDLSSSQGPSNPAYDKNEETHDTLVSLNAKSVNKDKNEIKEPIVVNQANLSMGVVVATSIALQQYAKPPSLPLDVVQYNANHIDVDPFSFIDV

SEQ ID NO: 124890 - protein, 97 aa, Glycine max
  Coding DNA Sequence Number=SeqID_8112
MARRMKGKMNSNYKARDHRREKEWRVKKNEGCRNLPFGGRATCDSRVRLPRKEYARSRHQRLFEENVEKTGKDVVYELQVKGSRVVFTHGEGNKATC

SEQ ID NO: 124891 - protein, 178 aa, Glycine max
  Coding DNA Sequence Number=SeqID_8113
MKRDVILEMQHKNAARLPFFDRISEGLPPGFEKKMSTKDREEKEMITESFKFGFGRTIEDLIPHNIVVSYFYGKPSNLEGVVCLDISVGSRRRPMVFLNEDGKLIMVGGDQSSYGICVAFASEADQAMARTTPFEIEDSFYVNNILGDEKDQFFYWDTNKGFLLINKVVEKTTKVEEP

SEQ ID NO: 124892 - protein, 74 aa, Glycine max
  Coding DNA Sequence Number=SeqID_8114
MEISPDIRVNLLKNFGSFMRNQMTWGGAGAESFLEVDVKLNLTLEIYTQPFTMMPTSAVEGPGNMLCTPHGQVL

SEQ ID NO: 124893 - protein, 75 aa, Glycine max
  Coding DNA Sequence Number=SeqID_8115
MYKITGGKENELDCWAKVHERRNTNAVRCKEGKWWESVTQCTHEGNVLERGRGEGGGGEEREGNVNKERANNGVA

SEQ ID NO: 124894 - protein, 72 aa, Glycine max
  Coding DNA Sequence Number=SeqID_8116
MLTVIDSFKVYNDVIFKDGPPPSLKVIFDRCKKAFFSSVIVISEGTYEGCGSIIEVEERTKGVMFCFFAVRG

SEQ ID NO: 124895 - protein, 284 aa, Glycine max
  Coding DNA Sequence Number=SeqID_8117
  Homolog annotation: Hit_ID=Q1SKD7; Match level="QueryCoverage=34%, HitCoverage=26%, E-value=6e-09, Identity=33%"; Hit description =Ankyrin
MAPKKLSTKRCRRDATRDGSSTTPEFDSHRFRSAEHQQRFEAIRGWSFHRERRVQLREDEYTDFQEEIARRRWTPLVTPMAKFDPEIVLEFYANAWPMEEGVRDMRSWASSVSSAKGGIGLTGSTRKPLPSCYAHRGRISPGPLQGGMPPTRHPLDPDKSNRALGFPALITGLCQSFGVPVTPSRRHAATTSAGRSRWITRHGALSIALGSPAGGQPPLSQQGQGSAPFACPTPEQFGAEVAWPRDWPEAQAGEEPAGSPGEAEEARMDEDMTDLLDFLGGSGA

SEQ ID NO: 124896 - protein, 89 aa, Glycine max
  Coding DNA Sequence Number=SeqID_8118
  Subcellular localization annotation: CTP_CleavageSite=57; ConfidenceScore=5.18e-01
MKEIVTVQVGDFANFVGSHFWNFQVIPSYTPRLLSINLRAVQVAVKRRQLFPNNILRSMEEEYEEDMERVMFNWLVNAEQHVLSLGCFL

SEQ ID NO: 124897 - protein, 444 aa, Glycine max
  Coding DNA Sequence Number=SeqID_8119
  Homolog annotation: Hit_ID=Q3B724; Match level="QueryCoverage=15%, HitCoverage=4%, E-value=8e-20, Identity=64%"; Hit description =Callose synthase
MKTLTTSLEGKDDQPVPRWIEPKIIEAARDVQENTEIYAPFIILPLDSIGASQSIMQIEENTRGLSWPTSFEQHRQRTGHLDLVDSLRYILKSGPGGIKSEGSSELTNTGVHAMLTSEQGMSLHGEHIAEHRVLAKGSNRGNTQEEPTSSPNTLIKSKVSRAPRTGSASALESSNIQPSSTTFPSWPPKNSRSRRVKVVSPASRNIEVQVSSEVDDISSAFGLSESEESGAGENKIKKKVMNGSDFAMAVDKGGASVFQMKNNKISTDESGDTSENVPTMKPVQDMKPNDKSRTPWLFGSIFASISLDDASYLKQQVNIAEEFDKKSLSPMFGIDHDLLGVVINNKSTQGSEERKRSHCDEESTKFDALGGKKDMERLDKLTPLFQRLLCALIEQDESQESYDQVMQRIYLDNVLVIILTMVLVIKLILNPKIEIEWILKLNQR

SEQ ID NO: 124898 - protein, 496 aa, Glycine max
  Coding DNA Sequence Number=SeqID_8120
  Gene Ontology: Mol. function=DNA binding; Biological process=DNA integration
MDKSKEVATPMTTNCYLSADEKGKLIDQTCIESHLSTSKRVIKYLRGTLDVGLWYPKGHGLVSWNSKKQACVALSTAEAKYIAARSCCAQILSLKQILSNFGLHLEHIPLRCDNSSAISLTKYLIMHSRIKHIEIRHHFIRDHIHKDLFLKKVSLLSFQPSKHLNLSFYPHPQPPSMPKKKNKRIKNIGHKPTVPRTKKEKEPTKGGPSGRRKRVTCSPLPPTTPKGTPWFSEEHYEASYKFSYAKKEMIQPKYVNLVWLRSEGFPFLELIEHHGLKKLVEMKGTYYTDLVKVFYTTTHIDGDTEFLCVEVKGQQIVMTPKVWFGIVGLSSKGVMANQLGLKEARFSFNKVEKYKSMMNNPSTYDVVVTKSKGKECFGTRPLMLQHRLLAYVVAWIITPRGRNHAQLIEEDLLLISLMQGKLKINWVNIIFDIMLKTKRIGFFKYPYAILVSRILDYFGVDTQEESKETGIGWTEKSREDQAEQEEAEEKPISPFE

SEQ ID NO: 124899 - protein, 135 aa, Glycine max
  Coding DNA Sequence Number=SeqID_8121
MMSMRKMMEVNTTAVATTSATIEVDPTHPPGLNQVNCPASDMVQSKHSFPLYGLPINYTPPNVVHAPDENIDNSAPILIESQQPQSGQAQVPQPMGETHEVPRDRPLADSKPRLRYATEGQAFGGIPLPNTLGGP

SEQ ID NO: 124900 - protein, 216 aa, Glycine max
  Coding DNA Sequence Number=SeqID_8122
  Subcellular localization annotation: CTP_CleavageSite=25; ConfidenceScore=5.34e-01
MVDVDRRPTGPNPAHAAGLRRLLARAASVSAASTVRNRNSLHSFSALSEKVITHLRNSGIQLHASHAAEFARSDSDPILRKQRSVSENHSSAANKCPAPGFSRHSLDAAVERRRRSKWVEGYVGMMGSVLREGGWSESDISEMVSGSGSVSVLLDNEEVFDAERFSDSLKKSGWSSEEVKDVLGLYLRPEKKGRKPPKKVATQMVKRIGKLVESAS

SEQ ID NO: 124901 - protein, 131 aa, Glycine max
  Coding DNA Sequence Number=SeqID_8123
MTSKSTKIDKTEQRIRHKCMHGSEALGRRYARSVSDVGAAIDTGGKLEPPVPMAVRWVPLVPVAGHVLSRREGVVPPVLLAGHLQLAIPPLELAGQASHAHGTEARAREENRALYWIGKSEITCMYGSLKS

SEQ ID NO: 124902 - protein, 77 aa, Glycine max
  Coding DNA Sequence Number=SeqID_8124
MGWESKKQNENNKPLAYGLKETSDSATHLRHVVTGKMKEGVSIAREVQEARSARPQRERSTPTYLEGYDRSHAEWNA

SEQ ID NO: 124903 - protein, 1405 aa, Glycine max
  Coding DNA Sequence Number=SeqID_8125
  Gene Ontology: Mol. function=RNA-directed DNA polymerase activity; Cellular component=chromatin; Biological process=chromatin assembly or disassembly
  Pfam annotation: Domain name=Chromo; Domain location=1303-1360; Score= 33.5; E_value=7.4e-07; Accession=PF00385.14; Description='chromo' (CHRromatin Organisation MOdifier
  Pfam annotation: Domain name=Peptidase_A3; Domain location=275-439; Score=-95.4; E_value=0.085; Accession=PF02160.6; Description =Cauliflower mosaic virus peptidase (A3)
  Pfam annotation: Domain name=RVP_2; Domain location=265-388; Score= -38.2; E_value=0.00094; Accession=PF08284.2; Description=Retroviral aspartyl protease
  Pfam annotation: Domain name=RnaseH; Domain location=770-891; Score= -27.8; E_value=0.022; Accession=PF00075.14; Description=RNase H
  Pfam annotation: Domain name=rve; Domain location=999-1155; Score =102.1; E_value=1.7e-27; Accession=PF00665.16; Description=Integrase core domain
  Pfam module annotation: Pfam domain module=Chromo::Peptidase_A3::RVP _2::RVT_1::RnaseH::rve; Domain location=1303-1360::275-439::265 -388::512-681::770-891::999-1155
MADGTRSKASSERLEDAIAKLTTSQLAMNSKIDDLLHRMSQLEANQQQPQSPSSSFAGHMSPSQSPFHRMKLDVPRFDSSDPTGTSACVVLVDASKRTTIIVRSSVSAYLSEFESLANKIVGLSAPFVLSCFISGLNPTIRREVQEEKLLDARRPPPYRSLVSTGSSNTRSSSSNSTQSLLPTPVRTPSSIPFKRLTPEELATRREKGLCFHCDEKFSRGHKCASSLFLLVMEDEDTTIEGDSLRDYTPTQELLPESSLAQLSLHALSGHLAPETLRLKGFINDHSINILIDGGSTHNFLHNRVVLNLGLKSTKTAPLRVTVGNGEEIHCNQLCTAVQVHIQQHSFTIDFHVLPLCGVDVVLGVQWLKTLGPVLTDYGALTMKFITGGKLIELHGDREKGIEQVSPSQLRRFVHTNPTTAFFHIRVETTTTHNSSSNHPLPAINTLITKYASLFQPPTTLPPSRSTDHTINLLPNSTPVNVRPYRYPYFQKKEIEEQVATMLAKGFIQPSSSPFSSPVLLVRKKDGSWRFCVDYRALNAITVRDRFPIPTVDELLDELGGARWFSKLDLMQGYHQILMSTSDICKTAFRTHQGHYEFRVMPFGLCNAPSSFQATMNQLFQPYLRKYIIVFFDDILIYRMTIHDHLLHLETAFQVLVAGQFSLKLSKCTFAQEQLEYLGHMVSSSRVTPVPEKIQAVSQWPIPRTPRALRGFLGLTGFYKRFIRGYAALASPLTKLLCHCQFEWSQEAETAFQNLKNALTAAPVLALPDFTTPFVVETDASGSGMGAVLTQKGHPLAYYSKQFCPKLLNSSTYVRELAAITVAVKKWHQYLLGHHFVILTDHQSLRELMDQTIQTPEQHRYLARLLGFDYSIQYHAGKANVVADALSRSQEDHTASLFLLSMPRFVFLDDLRKELAPLATFQDLRNRIQENLASYLEYTLTEGLIMYKKRIWLPSNSSFIKHLLEEFHQSPTGGHMGSRRLYNVCKTILPGLQSRKTLAIPTLPWEDLSMDFITGLPSYHGHTCIFVIVDHFSKGLHLGMLPIQHTAHTVALLFIDMVGRLHGMPKSIVSDRDPLFISKFWRELFTMNGTKLRLSSSYHPQSDGQTEVANRIVEQYLRAFVHEKPSTWGRYLPWAEWSYNMSCHSTTGMTPIEITFGRKPPTYPHYIAGTSNTEVVDSMLSQREAVFAMLRRKLLKAQSRMMANANCHRRDQEFQVGDWVLVKLRPQRQVSVTGTTCSKLSKRYYGPFQITERMGKVAYRLQLPDHSRIHPVFHVSLLKPYTTTPTTATVMDLPPLASDNHPIITPLAIVASKVIPSETGPKHMVLVQWQGLPPEETSWEDWSSLKNIHHLEDKVLLEGQGSVTGKMKEGVSIAREVQEARSARPRRERSTPTYLEGYVRSHAEWN

SEQ ID NO: 124904 - protein, 67 aa, Glycine max
  Coding DNA Sequence Number=SeqID_8126
MSPRPVFPESRVSPRVDLVDLVSKDEGEELEEDTPFKEDPWMDEENPVTGSEFMEEDSLEDSSHESC

SEQ ID NO: 124905 - protein, 470 aa, Glycine max
  Coding DNA Sequence Number=SeqID_8127
  Gene Ontology: Mol. function=protein dimerization activity; Cellular component=nucleus; Biological process=regulation of transcription, DNA-dependent
  Homolog annotation: Hit_ID=Q1SR56; Match level="QueryCoverage=99%, HitCoverage=99%, E-value=6e-62, Identity=67%"; Hit description=HAT dimerisation
  Pfam annotation: Domain name=hATC; Domain location=364-447; Score =101.2; E_value=3.1e-27; Accession=PF05699.5; Description=hAT family dimerisation domain
MREIITTVIMVHEYPFSVVKDSIWMWAFQYANPDFHKVTHKTARNDCLALFEMENKTLKKLLESVSKISLTIDMWKSSHQVVEYMVITGHFIDVGWNLQKRVLSFVKVPTPRRVQDGLSTIKDIIFNIHESVKYINHNDARLKAFCDVVEQKRLKERKLVIDCPTRWNSTFNMLSTALKFKTAFASYKERESHYNYAPSLEEWNQVEKVCKLLEVFNLATHVISKVWKVKQILDKEIEDEDLFMREMVGPMKKKFDKYWGECNMLMAIASVLDPRCKFNMVSICFPLIYSKEVVDENIKKVKSSFEELYDEYVGLCLQESTSSVVNLDDNISSSSQLNTSVVTGFDEIMSMLREKEVVSPIKSELQDYLDEGIYVLNTNSYSALDWWRNNSMKYKILSKMVVDILAIPISTVASESTFSAGGRVIDEFRSKLNEEFVEALIYGGDWFHEKYNVKKKSKAEKEEIQITLKF

SEQ ID NO: 124906 - protein, 258 aa, Glycine max
  Coding DNA Sequence Number=SeqID_8128
MAICRLFFRSKKIMAQIVPAPKRAKVAKPTPTPKEAIILSTIPRRMKTRATKANPKISDKECFISFTSNKESVASSSSSSESTKDAYVSLLRNPLFSSSLSEDVRGEPIIRESITVQAPEWTKHGYVNTLSEAFKVFIRSHSSSRAPSVDTSNVVSSNQDEVEPPKSEFQKKVNLKTPIAKLLPIHPIDLDLTSTNYSMLGGLHAQMYFHNQATSYPLGLHISKATEIKVANKMCPHLTIWGVAKNKGFKLHYNEEMP

SEQ ID NO: 124907 - protein, 71 aa, Glycine max
  Coding DNA Sequence Number=SeqID_8129
SFFSGGIEWAFRALNGAAETAAFNGGRRWRWWAFLEEHGSCGRVWVVMEWQCCLSGTVERLEIFVKGVTSD

SEQ ID NO: 124908 - protein, 82 aa, Glycine max
  Coding DNA Sequence Number=SeqID_8130
  Gene Ontology: Mol. function=transition metal ion binding; Biological process=RNA-dependent DNA replication
MPYFGVIEEILEVNYVKFRVCVFNYKWVHSNIGVQTDDFGFTLVDLKKLAYQNQPFIMTEQAKHVYKLSVQKERKSRKRNDV

SEQ ID NO: 124909 - protein, 101 aa, Glycine max
  Coding DNA Sequence Number=SeqID_8131
NEDKGYVGVRELNLKMGNWGWDVRWGAIAQNQAWLISTQPGHSQSVRTCDVPKQASSWQSTNKRTKTTKQGGLCGGLKNGDRKLRWPLVIDYQGCVIDYKA

SEQ ID NO: 124910 - protein, 227 aa, Glycine max
  Coding DNA Sequence Number=SeqID_8132
  Gene Ontology: Mol. function=transition metal ion binding; Cellular component=cytoplasm; Biological process=proteolysis
  Pfam annotation: Domain name=Transposase_21; Domain location=160-227; Score=-112.7; E_value=5.5e-05; Accession=PF02992.5; Description =Transposase family tnp2
MATSCYLDPVEKCKYVDESRYRDMIDPLLYLTASHLDIRHSGASISLVGYSDLDYARRKVDRKSTSGTFHLFGSALVSWHSKKQVCVALSIVEVVQDMLPEENTLPKRYYQAKKILCPMGMEYKKIHACANDCILYINEFEEMHNYPRFKHLFANANDAKDFTWHADGRKCDGLLYQPTDSSQWMKINSLYLDFGKETRNLRLGLASDGMNAYGSLSTQHSSWPILL

SEQ ID NO: 124911 - protein, 91 aa, Glycine max
  Coding DNA Sequence Number=SeqID_8133
MCDHENKTQESKNDLDDDCVENLEGSSNLEETRPLNMMKQNVDTSQGSTKELAKEWRTSRDLSLDNIISDINKGFLDLVSQEEPKSTKKSF

SEQ ID NO: 124912 - protein, 366 aa, Glycine max
  Coding DNA Sequence Number=SeqID_8134
  Homolog annotation: Hit_ID=Q1SMI5; Match level="QueryCoverage=26%, HitCoverage=11%, E-value=2e-35, Identity=59%"; Hit description =Prefoldin; tRNA-binding arm; t-snare; Protein kinase PKN/PRK1, effector
  Pfam annotation: Domain name=zf-XS; Domain location=141-181; Score =9.1; E_value=0.015; Accession=PF03470.5; Description=XS zinc finger domain
MEVIPNYWLTSLAVESHESLVSGAEWESESPKAGFSSTALGWPSFDDIKSSSLTYSLSAEEKATMAVLQLQHRALEACQKFLVGDAGSDSDEDDEEAEDDELLDNDSKESEEYKFFEKVFAEDGDLRRYYENNHKEGDFYCLVCGGIGKKVWKRFKDCIGLIQHSTAILRTRRKRAHRAYAQVICKVVGWDIDQMPAIVLKDLDSSLAGSRKLFVEPKNPAVGCIDDTNSNDVLPKFARRGLNFFETQEESNEQNSGSNNTLSESERVTKAETEILALKKAIAKLEDETEAGLLQYQQSLEKMSNLELEVSTAQENSQKLDERASKAEAEVQALKEAQIKLQAESEASLLQYQEKVKKQRTLIFKE

SEQ ID NO: 124913 - protein, 121 aa, Glycine max
  Coding DNA Sequence Number=SeqID_8135
MGLYVQQQHTTVLVALAKICEGGSSIHNVTYADDVVRAGSSKIHCMANKSSEKVSHEESDTSPKKLPETDERGTNDFDHDPLRQLIKSLYFMYDTPVELKWDGSKFGLSNVDASFFLTFSD

SEQ ID NO: 124914 - protein, 285 aa, Glycine max
  Coding DNA Sequence Number=SeqID_8136
  Gene Ontology: Cellular component=nucleus; Biological process=cell division
  Homolog annotation: Hit_ID=Q9LME2; Match level="QueryCoverage=67%, HitCoverage=21%, E-value=2e-51, Identity=48%"; Hit description =Synaptonemal complex protein 1
  Pfam annotation: Domain name=MutS_V; Domain location=10-120; Score= -165.8; E_value=0.0055; Accession=PF00488.12; Description=MutS domain V
MISTKPVDRYTRPEFTENGPLAIDFGRHPILESIHNDFVKTWQRLKTSNILHDAIPHTHERIGHPMHIKNLSLLTAAKSKLSEAKKQYDQMVENKQLELSRHLKEISQRNDQAINHIKRKYELENMEIVNKEKEKVRYDFLADKAIAEIEAKCGQKIEECKEEQRQQLMRIQDEHTLLVTQMKQEHDKRQASLIAEHNEQLKRTQLQAENELREKTMFMRNDHEAQIKALRCELEDECQKLEEELHLQKSKEDRQRALLQLQWKVMSDKPKEDQEVNSKQAQLGK

SEQ ID NO: 124915 - protein, 365 aa, Glycine max
  Coding DNA Sequence Number=SeqID_8137
  Gene Ontology: Cellular component=nucleus; Biological process=red or far red light signaling pathway
  Homolog annotation: Hit_ID=Q9ZNU6; Match level="QueryCoverage=53%, HitCoverage=34%, E-value=3e-66, Identity=64%"; Hit description=Light- mediated development protein DET1
MALSDKNKQLQLPGNHIENHLHQGQPNLGNSFLSGIKQRLLSFIFQGLWNEERDDTLAVHVWEMEMHWRIQRLRKKFYFHFQDYVDLIIWKVQFLDRHHLLIKFGSVDGGVSRNADHHPTFVVVYNMDTTEIVSFYQNSPDELYLLFEQFCDHFHATSRNSMYMNFISSHSNNIHALEQLWSIKDKASSSAQFVKNIFESRFIGRLLMKMYFMHVFLLLPALNNALLLRLELMASWIFHEEHFVKPVKCNLSWNAAYHICVLKAFGVTFTAINNIANNYREDFKLPNLKLTYKNRQGFHFVIPQKNIQGKLPSKFIQVVKHGNNIRCSSLELASFDEIMVKLTPLSHEENDYSDQEWIIPCDIFS

SEQ ID NO: 124916 - protein, 77 aa, Glycine max
  Coding DNA Sequence Number=SeqID_8138
MSYPNFFWGLSFVDLLILASRLTVLNANYNSKKGEQKGLFLGFLDPSSPRLASCLPEPPNDFKVKKPALWASLLLHD

SEQ ID NO: 124917 - protein, 101 aa, Glycine max
  Coding DNA Sequence Number=SeqID_8139
MAGFKPTVELTSRAKEYGNLNTTYNNNKEHIPEKDKVPTDGNSMPKKEGDKNKEILTSPQGHTMLNGMPRNSSMIMLHSRCILAKMEVEESLLGLWLPLHY

SEQ ID NO: 124918 - protein, 70 aa, Glycine max
  Coding DNA Sequence Number=SeqID_8140
MGEICEGVDGIAGREGAGREDCRSKGASLGYPVTMKRVWCGWHCGERRCWVEEGVGDNAEREHKITIASI

SEQ ID NO: 124919 - protein, 179 aa, Glycine max
  Coding DNA Sequence Number=SeqID_8141
  Gene Ontology: Mol. function=nucleic acid binding
KTTSLTLDPEIENTFQKLKGEASRGKKQIFEEGSFSSSSTEATKIDNEGMAEVEQTMAELATGQGTNMSQPIRPPNTRDNQINFPSWVHNNLKHNQFMGATTKDSHAHLTRFLQLCISIRLSGGGATDWFNSHPHHSPTTWEEVKDKFLNRFFPESKVKAIKERIVNFKQASTESLFDA

SEQ ID NO: 124920 - protein, 142 aa, Glycine max
  Coding DNA Sequence Number=SeqID_8142
MDEQEKRAQEEEFGVAATTKEQVVTIQAKAFVKAVDDNIVCKQSTTSNEATSRENDAPDVIIVYSKNSGPTPLTYATPIVLIRDQVQEMIENYVKSYAALAPIAPTPPTLVHQLPLLEPTQPSPPPSSPPPTQPPPPPQVQD

SEQ ID NO: 124921 - protein, 62 aa, Glycine max
  Coding DNA Sequence Number=SeqID_8143
MGVQIATRPTWALQKAVASGGGHLARLGELGGKNLPHFPINRGRSEEEVRSALLKIRAEALP

SEQ ID NO: 124922 - protein, 163 aa, Glycine max
  Coding DNA Sequence Number=SeqID_8144
  Subcellular localization annotation: CTP_CleavageSite=52; ConfidenceScore=5.38e-01
MAYASMTTLGPLEKGTMKSSKRLSSWGLAGAASHCRRHRRRASSTSSGAPASCATLKSNDVGWGASDIFPVCCGGDGEIQKVDHIKHRIGIEIAWHHIKHGLSSIINFFEPPGVREEVERLEGDEIVMVVVVMVVAEASEGLAKMMESGERNKSLFRFLLIFI

SEQ ID NO: 124923 - protein, 68 aa, Glycine max
  Coding DNA Sequence Number=SeqID_8145
MADPCLLLSLLTAPCLPSIPPSLVGRVCIKVGGITDITFVPNDDTGKIECFTEMLKQMKLRGHRVCYY

SEQ ID NO: 124924 - protein, 89 aa, Glycine max
  Coding DNA Sequence Number=SeqID_8146
  Gene Ontology: Mol. function=transition metal ion binding; Cellular component=chloroplast; Biological process=iron ion homeostasis
  Homolog annotation: Hit_ID=Q948P6; Match level="QueryCoverage=67%, HitCoverage=23%, E-value=1e-26, Identity=95%"; Hit description =Ferritin-3, chloroplast precursor
MEVAMELALLLEKLTNEKLLNLHSVASKSNDAQLSDFIESEFLGEQVEAIKKISEYVAQLRRVGKGHGVWHFDQMLLHEEGVAFHFRCI

SEQ ID NO: 124925 - protein, 302 aa, Glycine max
  Coding DNA Sequence Number=SeqID_8147
  Homolog annotation: Hit_ID=Q00M66; Match level="QueryCoverage=95%, HitCoverage=49%, E-value=3e-29, Identity=33%"; Hit description =Remorin
  Subcellular localization annotation: CTP_CleavageSite=38; ConfidenceScore=5.60e-01
MKKSSSSSFQNLGSFPSPGAPYYRERSIGSQKGWCSERVSKPSSSSGSISRRHTMAGLTPFCGGRTMPSKWDEAERWICSPVSAYAESRSSHSQLQRRPKSISGPIVPPGVAAFYSNYSPVLPLRQGLVVRNLVVGSPFSTGVLAPVAVSVHHFDAHDGTVFGYDLDSGMQFSSPVINENGMVFSPLSTAAPTCSELPCNQSSPISEDEKHDGTMEGENVASHSSRCDKGTQMSPGEIENDSHSSPKSCATSIVDQQQCHSSKLEVRDVEVDSQATIVRWSKRHATKLAKKDHSTQQRFKRD

SEQ ID NO: 124926 - protein, 133 aa, Glycine max
  Coding DNA Sequence Number=SeqID_8148
MACLLLGFICEMMWLWLDSIYEIMRPYFVIPDRLSMVHVVSVDKPNVMPITINHRRYSYIPWGFTSCRQLEWFEDISFYLGMEVPHDAQEFEVTPVRFDVTEDRGDHTNMTPEGEEVYRELLRDLELSSEEED

SEQ ID NO: 124927 - protein, 91 aa, Glycine max
  Coding DNA Sequence Number=SeqID_8149
  Homolog annotation: Hit_ID=Q93ZR8; Match level="QueryCoverage=88%, HitCoverage=15%, E-value=2e-20, Identity=62%"; Hit description =Putative auxin-independent growth promoter
MMPSKLNALRFTTQIEELGRMMVKVLREKRPFLALHLRYEMDMLAFSACAHDCYSKEEEELTRMRAYDRAVIKFRGVDADIKRKSTFLKCQ

SEQ ID NO: 124928 - protein, 134 aa, Glycine max
  Coding DNA Sequence Number=SeqID_8150
MTTSGPHEPSLLIAEPPHGEECFNWIGILRIHLKDSVENKPSILSFVASLREKGDTKEFRRLVLRSFGKGRRETQKEFRRLVLGEFFLAKGEEMKRMNSTSFQGLENQKTLESFWHKEEEEVQRNSRLVKDCMK

SEQ ID NO: 124929 - protein, 75 aa, Glycine max
  Coding DNA Sequence Number=SeqID_8151
  Gene Ontology: Mol. function=nucleic acid binding; Biological process= DNA integration
  Homolog annotation: Hit_ID=Q1S0G2; Match level="QueryCoverage=82%, HitCoverage=9%, E-value=2e-13, Identity=44%"; Hit description =Peptidase S8 and S53, subtilisin, kexin, sedolisin; Polynucleotidyl transferase, Ribonuclease H fold
MVQDDTSNEAYDDDDDPISYEEAIVWILVKAPKDIKPIACKWIYKKKIVVDGKVETYKALLVAKGYRQKKDIDYE

SEQ ID NO: 124930 - protein, 60 aa, Glycine max
  Coding DNA Sequence Number=SeqID_8152
MVTITKALGIKEFYKNKWEVEMKYMGIGSTASGRSSRINIINDYSRRDPSALGNEFELYE

SEQ ID NO: 124931 - protein, 243 aa, Glycine max
  Coding DNA Sequence Number=SeqID_8153
  Homolog annotation: Hit_ID=Q9FI79; Match level="QueryCoverage=29%, HitCoverage=36%, E-value=2e-11, Identity=44%"; Hit description =Arabidopsis thaliana genomic DNA, chromosome 5, TAC clone:K19E20
  Subcellular localization annotation: CTP_CleavageSite=17; ConfidenceScore=5.57e-01
MASTQPNNYFPTFPPPSPSHPFNPPPPPSQSFYPPPPPSHFNPPPPPPHSFSPPPPPFRTSPPSPPRPFSPPPPKVRPPPPPPRPIHPSPPPPPRPVRPPPLPPAPLPPSPSPNNPTVIIVVVVSLGGLLFLSMLAFALFCCIQRRKKKTQETEVLHFDEHQTVKETIVPGPFGRNTVVVTVEDDVHIDEEIKTEKVGHGLHAKSSSPHEADRVTSGSIVEVATPLRALEHHDAHHHHPENKP

SEQ ID NO: 124932 - protein, 233 aa, Glycine max
  Coding DNA Sequence Number=SeqID_8154
  Gene Ontology: Mol. function=calpain activity; Cellular component =intracellular; Biological process=proteolysis
  Homolog annotation: Hit_ID=Q1T2S6; Match level="QueryCoverage=91%, HitCoverage=49%, E-value=2e-21, Identity=36%"; Hit description =Cyclin-like F-box; F-box protein interaction domain
  Pfam annotation: Domain name=F-box; Domain location=7-54; Score=39.4; E_value=1.3e-08; Accession=PF00646.23; Description=F-box domain
MNRMATLPPPMLPDDLIVNILSRLRVRSLMRSKCVCKSWLSLISDPQFVKSHSGLAEATPTHLLLKSSNNPQFNCIDIEASLHDDGDSTKVIFNIPPPSSASGPVSRVDIVGSCRGFILLAYVYADFFYFVIWNPPTGFHKRIDNVSSTGDCVERVFRIGYDNFALLFGIGYDSSTDDYVVVIVTVSLPLPLRITSRRWSAKVFCFSLRTNLWSFTEGTAQPYIGMQSSPGCS

SEQ ID NO: 124933 - protein, 89 aa, Glycine max
  Coding DNA Sequence Number=SeqID_8155
MELTEGVETNQVVRLVALERICARKCFRYFRKFRDLRYLGHIKQLRLRQFWDFRMLKVFGNSETLGSSGTFGGGGSSGLGSCGTSGFDN

SEQ ID NO: 124934 - protein, 88 aa, Glycine max
  Coding DNA Sequence Number=SeqID_8156
CSYRREIIISCGGRIGVDTHKDLDLILSRSRKYSQLSAFQIPPVVSINKAIDLICMLNNSAIVQDPLWTIRQVPICIYKLGHGDSRSG

SEQ ID NO: 124935 - protein, 378 aa, Glycine max
  Coding DNA Sequence Number=SeqID_8157
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q1T009; Match level="QueryCoverage=74%, HitCoverage=100%, E-value=1e-145, Identity=90%"; Hit description =Protein phosphatase 2C
  Pfam annotation: Domain name=PP2C; Domain location=84-338; Score =320.3; E_value=3.4e-93; Accession=PF00481.12; Description=Protein phosphatase 2C
MPVGMDFPPPFTMLEDKDSAFVVDDQKSGDIKPMTKGKPPRHASGLRHSVSTTRLLAVADLSLDVGVTGSKSSSEEKTEFLPIFRSGSCAERGPKQYMEDEHICIDNLIQHIGPASTIPLPGAFYGVFDGHGGTDAALFIRNNILRFIVEDSHFPTCVGEAITSAFLKADFAFADSSSLDISSGTTALTALVFGRTMIVANAGDCRAVLGRRGRAIEMSKDQKPDCISERLRIEKLGGVVYDGYLNGQLSVSRALGDWHMKGSKGSACPLSAEPELQEINLTEDDEFLIMGCDGLWDVMSNQCAVTMARKELMIHNDPQRCSRELVREALKRNSCDNLTVIVICFSPDPPPRIETPPSRVRRSISAEGLNLLKDVLDC

SEQ ID NO: 124936 - protein, 72 aa, Glycine max
  Coding DNA Sequence Number=SeqID_8158
MIQILQFAELIKKGSVKVGGVSKVLCQDLSKHCSQMRLYVLKIILLFIDCEHSNMLLAFTEVTFLLAYPPSI

SEQ ID NO: 124937 - protein, 120 aa, Glycine max
  Coding DNA Sequence Number=SeqID_8159
MVPTRHPLDPDKSNRALGFPALITGLCKSCGVPVTPSKVIRPPITRGFIEKCCTPRQVQGDAHQATDAPPPPRQDDPAGSLGVSVIYSIWFASKRPTTWQCRYMTVSTVQPQSAGQGSTP

SEQ ID NO: 124938 - protein, 915 aa, Glycine max
  Coding DNA Sequence Number=SeqID_8160
  Gene Ontology: Mol. function=metabotropic glutamate, GABA-B-like receptor activity; Cellular component=membrane; Biological process =ion transport
  Homolog annotation: Hit_ID=Q1T013; Match level="QueryCoverage=96%, HitCoverage=96%, E-value=0.0, Identity=73%"; Hit description =Ionotropic glutamate receptor; Extracellular ligand-binding receptor
  Pfam annotation: Domain name=ANF_receptor; Domain location=35-393; Score=327.2; E_value=2.8e-95; Accession=PF01094.18; Description =Receptor family ligand binding region
  Pfam annotation: Domain name=Lig_chan; Domain location=575-830; Score= 239.7; E_value=6.1e-69; Accession=PF00060.17; Description=Ligand -gated ion channel
  Pfam annotation: Domain name=SBP_bac_3; Domain location=461-789; Score=-61.8; E_value=0.00055; Accession=PF00497.10; Description =Bacterial extracellular solute-binding proteins, family 3
  Pfam module annotation: Pfam domain module=ANF_receptor::Lig _chan::SBP_bac_3; Domain location=35-393::575-830::461-789
SSVTPFVAAANVSSSRPAVVHIGAIFNIDSVLGKVAKITLEEAVKDVNADKTILHGTQLVLTMQNSNHSGFIGMVQALRFMETDVIAIIGPQSSVTAHIISHVANELRVPLVSFAATDPTLSSLQFPFFVRTTQSDLYQMKAVAEIIDYYGWKEVIAIYVDDDYGRNGVAALDDELAARRCRISFKEGIKSGTEVDRGEITSLLVKVALMQSRVIVLHAQTDSGFMVFNLARYLGMTGNGYVWIVTDWLSSFLDSSYLPSETMDVLQGVLVLRHHTPDSDRKRAFLSRWKKLTGGSLGLHSYGLYAYDSVLLVARAIDAFFSQGGIVSFTNYTSLGGDKGGGLNLDVMSIFDNGTLLLKNILQSDFVGLSGRMKFEPDRSLVHPAYEVLNVVGNGLRRVGYWSNYSGLSIVTPEILYAKPPNRSSANQKLYSVIWPGETLSKPRGWVFPNNGRQLRIGVPIRVSYREFVAPVQGTEMFKGFCVDVFTAAVNLLPYAVPYRFVPFGDGHKNPSYTQLVNLITTGQYFDGAIGDIAIVTNRTRIVDFTQPYAASGLVVVAPFKKINSGGWSFLQPFTPLMWIVTACFFLFIGIVIWILEHRINDEFRGENTMSSLGRLVMLIWLFVVLILTSSYTASLTSILTVQQLYSPISGIESLKASDEPIGFQVGSFAEHYMTQDLGIAKSRLIPLGSPEEYANALQLGPKRGGVAAIVDERPYVEIFLSSQCTFRIVGQEFTRSGWGFVSISSSLPFRSIISGIKDSPLAVDMSTAILQLSETGDLQRIHDKWMTRSSCSLENAEIDSDRLQLKSFWGLFLICGIACFIALVLHFLQLMFQLRQSPPSEPASSASSISGRFHRFLTLIDEKEDPSKRKGRKRNGDERSLEDQLGRQPKRATLRPWETYPIPAKPIELIGLLG

SEQ ID NO: 124939 - protein, 90 aa, Glycine max
  Coding DNA Sequence Number=SeqID_8161
MDNLLRRNIVVEENQMQCSFCGEMTERVNHILFTCRCVDEIWKFFINKLAILLVLPLTTEQHFWQHVLVACIGGGPSWSTGHRITKAQGY

SEQ ID NO: 124940 - protein, 362 aa, Glycine max
  Coding DNA Sequence Number=SeqID_8162
  Gene Ontology: Mol. function=calmodulin binding; Cellular component =integral to membrane; Biological process=cell death
  Homolog annotation: Hit_ID=Q1T017; Match level="QueryCoverage=99%, HitCoverage=74%, E-value=1e-161, Identity=74%"; Hit description=Mlo -related protein
  Pfam annotation: Domain name=Mlo; Domain location=1-310; Score=376.7; E_value=3.6e-110; Accession=PF03094.6; Description=Mlo family
  Subcellular localization annotation: CTP_CleavageSite=35; ConfidenceScore=5.07e-01
MKKWKAWEAETSSLEYQFTNDPSRFRFAHQTSFVRRHSGWSRMPGIRWIVAFFRQFFGSVSKVDYMTMRHGFINAHFAPDSKFDFQKYIKRSMKDDFKVVVGISIPLWVFAIVFMLVNVYKWYTLTWLSLAPLVILLLVGTKLELIIMEMAQQIQDRATIVRGVPIVEPNNKYFWFNRPQWIIFLIHFTLFENAFQIAFFLWTWYEFKITSCFHESLPLILTRVVLGIALQVVCSYITFPLYSLVIQMGSHMKKAIFEEQTAKALKKWQKAAKDKRKLRKAGIDMSGETTPSQGTSPLHLLQKYKPSHTDTDSVLYSPRSYQSDTDLSETEGSSHQLNEITQTHQAPRNGETHNIDFSFVKP

SEQ ID NO: 124941 - protein, 35 aa, Glycine max
  Coding DNA Sequence Number=SeqID_8163
MLRRRRETEPGEKRVKVAAVGDGSKGDEAKRVRAN

SEQ ID NO: 124942 - protein, 305 aa, Glycine max
  Coding DNA Sequence Number=SeqID_8164
  Gene Ontology: Mol. function=nucleic acid binding
  Homolog annotation: Hit_ID=Q10S20; Match level="QueryCoverage=100%, HitCoverage=31%, E-value=2e-29, Identity=30%"; Hit description=RNA recognition motif family protein, expressed
MKLGGEVLTVLQAMPDASPLENAGESLSYGVPEHAKPLLRKPTQVLEINNVFAADTILSLSDMAIEEILDDVRLECARFGTIKSINVVKHSSGENLATKLEECKVINKVDAKEVSQDTNCITNNTESSFSDKATYPDFEGTNGMEIHDNNEMEEVKVDEGSCVYVDKNAEVFDYKSCREHVDDSAVEDVGDKGIPCSIIQECPDQQDTPNDGPEFYDKMVANDIDVNIENNMESKDTVCAFQEGFSEWDISAELVSPQKSIDTEEDIYGHVFKPGSVLVEYGRAEACCSAAHSLHGRFFDGRIVT

SEQ ID NO: 124943 - protein, 583 aa, Glycine max
  Coding DNA Sequence Number=SeqID_8165
  Gene Ontology: Mol. function=nucleic acid binding; Cellular component= nucleus; Biological process=mRNA processing
  Homolog annotation: Hit_ID=Q10S20; Match level="QueryCoverage=95%, HitCoverage=56%, E-value=3e-50, Identity=30%"; Hit description=RNA recognition motif family protein, expressed
  Pfam annotation: Domain name=DUF1777; Domain location=296-494; Score=- 87.3; E_value=0.026; Accession=PF08648.2; Description=Protein of unknown function (DUF1777)
  Pfam annotation: Domain name=RRM_1; Domain location=496-572; Score =5.4; E_value=0.046; Accession=PF00076.12; Description=RNA recognition motif. (a.k.a. RRM, R
  Pfam module annotation: Pfam domain module=DUF1777::RRM_1; Domain location=296-494::496-572
MSKSNRSKEKHGKSNWLSEHNCDEESAARTRPFSFEEIMLRRRNKELLGNSPKEKELLENVKDPAHGCSSEKITDHFKSARIYKHDKSLSFGMEKHVSEELVKVTSRKKVESAIVKEDDLTEGKRRANHILETKSSAGLNNKARITKEKTEKEMSGYKKNERVHDSSEYRAGNKHSRDSVYKDSYVETNRPKSEREIKKKNHIGGDENHNMYVTEKRHDKDRDNRWKLKKRLSNDSEEVPEKKHYRESDKDKHAGGRAKYERETKRKYKNGDDETQDRNTSRKQDAVKHHNMHIYERKERRVKVKSHNEELTAKRRCSRSREREDRRSPSFSPREQKRTYQDGERKELSMHSLKDSSRTKNPDIDRNRVSTNGSSGHHHRHGVSTSGLGGYSPRKRKSEAAAKTPSPSKHSLEKKRAGWDLPPAGTNNPSAVVSSSFPVSNCAVLSNMHDVVSTSSLDLALVKPLPVSFPSDVSTGKNTNIDSVQLTQATRPIRRLYLENLPASASEKAVMDCFNNLLLSARVNHIQQAQPCICCILHKDKGQALVEFLTADDASAALSFDGSMLFGSIVKIRRPKDYIEVAS

SEQ ID NO: 124944 - protein, 512 aa, Glycine max
  Coding DNA Sequence Number=SeqID_8166
  Gene Ontology: Mol. function=calmodulin binding; Cellular component =integral to membrane; Biological process=cell death
  Homolog annotation: Hit_ID=Q1T019; Match level="QueryCoverage=99%, HitCoverage=100%, E-value=1e-178, Identity=63%"; Hit description=Mlo- related protein
  Pfam annotation: Domain name=Mlo; Domain location=8-493; Score=756.8; E_value=1.4e-224; Accession=PF03094.6; Description=Mlo family
MAGGGEGGDSRQLDLTPTWAVAAVCAIIVIISILLEKIIHKFAKVFEERKKHALLEALEKIKAELMVLGFISLLLTFGQNYISKMCIPAKYARTMLPCLPLEERHGGAPATEHGAQTEEGGGGGGEAEGGGHHRRLLSYERRFLAAEGGGQSCNPGYTPLISVSGLHQLHIFIFFLAVFHVIYSAITMTLGRAKIRGWKEWEEDHIVDQDALNDPRRFRLTHETSFVRDHNSIWTKTPVSFYFVHLAPGSKFDFQKYIKRSLEDDFKVVVGISNLASWSHVVKSPLLWGSVVLFLLVNVHVKFLVIANLFSGWHAAFWVSFLPLVVILAVGTKLQAIITRMALDISERHAVVQGIPLVQVSDKYFWFAWPQLVLYLIHYVLFQYEFGWASCFYEDDSLMIFRVALGLGAQVVCSYVTLPLYALVTQMGSTMKKSIFDEQTSKALKQWHKNALKKKVSKGRTETRTLGEAVGPGDHSPEQSPRSTGAGETEMAEQSATIVTTPYDNRDLLSEP

SEQ ID NO: 124945 - protein, 594 aa, Glycine max
  Coding DNA Sequence Number=SeqID_8167
  Gene Ontology: Mol. function=dolichyl-diphosphooligosaccharide -protein glycotransferase activity; Cellular component=endoplasmic reticulum; Biological process=protein amino acid glycosylation
  Homolog annotation: Hit_ID=Q1T021; Match level="QueryCoverage=95%, HitCoverage=91%, E-value=0.0, Identity=80%"; Hit description =Ribophorin I
  Pfam annotation: Domain name=Ribophorin_I; Domain location=12-436; Score=774.6; E_value=5.9e-230; Accession=PF04597.5; Description =Ribophorin I
VCFFFLPSFPCALQIDLTSQIVRITTSLKVQNTGSDVVSEILLSFPENQASNLAYLKATLGDGKGKSKPSSGVGLPVEVVRPKDVPPSLTIYSVSLPKGLGKGDSLTLDVLAVFTHSLQPFPEKINQADIQLLLFQESAHYLSPYAVKVQSLTVKLPDARIESYTKLENAKLQGSELKYGPYENLPPFSYLPIVIHFENNQPFAVAKELVREIEISHWGNVQITEHYDIIHAGSQSKGEFSRLDYQTRPFLRGASAFRRLVAKLPPRAHSVYYRDEIGNISTSSLWGDSKKTELEIEPRYPMFGGWKTAFTIGYGLPLGDFLFGSDGKRFLNISFGAPINELVIDTLFVKVVLPEGSKDISVSVPFPVKQSEETKLSHLDIVGRPVVVLEKNNVVPEHNEHFQVYYKFNSLSMLREPLMLISGFFFLFLACIVYTHADISISKSSASYLAKLQLDEVQATIQQVHGIISRCLTAHDKLEMSLHDLSRTGDIQACKATRKSVDSLLKELSKELKQPLAILQSSPQAAQILPKVEELVTKERELQDKLLVKHSTVVDGYEKKSAGREIENRIASQQLKITALRREIDDLMDLIDEI

SEQ ID NO: 124946 - protein, 120 aa, Glycine max
  Coding DNA Sequence Number=SeqID_8168
  Gene Ontology: Cellular component=mitochondrion
  Homolog annotation: Hit_ID=Q8H656; Match level="QueryCoverage=76%, HitCoverage=40%, E-value=1e-30, Identity=70%"; Hit description =Putative plastid protein
MLVFSEEEAKKKIYNVSCERYFAFGCDIDEETSNKLEGLPGVLFVLPDSYVDPEHKDYGGELFVNGEIVQRPPERQRRVEPQPQRQQDRPRYNDRTRKSVATNVVYASYPIYQQRKRKEN

SEQ ID NO: 124947 - protein, 185 aa, Glycine max
  Coding DNA Sequence Number=SeqID_8169
  Homolog annotation: Hit_ID=Q9SM57; Match level="QueryCoverage=84%, HitCoverage=86%, E-value=6e-45, Identity=72%"; Hit description =Chloroplast channel forming outer membrane protein
METSLRYGEDSKALRIHAKQKLRIDSNTYFQLRGELDTRLGQPSSSSALIRHFYPSLSATLGVGVRYDKRDKLRYTVSAKKTFPVTVDGLLNFKIKGGCDVDKDFKEVKIRHFGFHILLFSRGSPEEPPSFHGTCSIFRRTKMLDLGLATKYLIRSPIDNNDFELNGVSSLLIYIAVEGRIASEV

SEQ ID NO: 124948 - protein, 64 aa, Glycine max
  Coding DNA Sequence Number=SeqID_8170
  Pfam annotation: Domain name=Cyanate_lyase; Domain location=31-61; Score=-18.4; E_value=0.033; Accession=PF02560.5; Description=Cyanate lyase C-terminal domain
MGNRKFWFSYVPLLMIKLLWSKHTFVVLSLVQWPNGLNEAVMHFGESIKEIINEEFGDGIFKAN

SEQ ID NO: 124949 - protein, 98 aa, Glycine max
  Coding DNA Sequence Number=SeqID_8171
MNKLMVKFGNGIDGIVFELLGARAPIGDSISDANAISSGSATAIATNSELNERLTRRERERKCSVQTDAMGNGGGNGNSNEGFRFHFPFSISSNPTSS

SEQ ID NO: 124950 - protein, 172 aa, Glycine max
  Coding DNA Sequence Number=SeqID_8172
  Homolog annotation: Hit_ID=UPI0000E450AF; Match level="QueryCoverage =40%, HitCoverage=30%, E-value=1e-08, Identity=49%"; Hit description =putative capsule O-acetyl transferase
VCSRLAHGIYHCPSIAFRSIYYCHLSRFVPRRNKRIERKKENYVVSRKRISKDDKSVETKIHSESKVIQRCFDDNNDDDKGDDKKLKDQSMNNSRVQESIILFKTQEESLESRIKIQGSRSQESRSRFKNQESRLKISRIKIKIQESRIKTQDLKNQESRLKISRIKIKIQE

SEQ ID NO: 124951 - protein, 189 aa, Glycine max
  Coding DNA Sequence Number=SeqID_8173
MQECFKESEKHGMRCKGRIKSLEEAAMVLLEVPEESEEVQALKAELERTQVVKEKFKPTTIRVRKECDELRDVNMAIAEALEQETKRARKEEWGRNKVERDKSRVEGMILEDKLKACQRSKRNLTKQLSRTEENMWAIIDQYKEKQNLAITREQRLEDEHAKVSVLQVEKGSKGESDRFITQRSYDVDG

SEQ ID NO: 124952 - protein, 545 aa, Glycine max
  Coding DNA Sequence Number=SeqID_8174
  Gene Ontology: Mol. function=transporter activity; Cellular component= membrane; Biological process=oligopeptide transport
  Homolog annotation: Hit_ID=Q9FRU4; Match level="QueryCoverage=91%, HitCoverage=87%, E-value=0.0, Identity=68%"; Hit description =Putative nitrate transporter NRT1-3
  Pfam annotation: Domain name=MFS_1; Domain location=5-471; Score= -3.4; E_value=0.00045; Accession=PF07690.6; Description=Major Facilitator Superfamily
  Pfam annotation: Domain name=PTR2; Domain location=54-455; Score =455.8; E_value=5.4e-134; Accession=PF00854.12; Description=POT family
  Pfam module annotation: Pfam domain module=MFS_1::PTR2; Domain location=5-471::54-455
MAYYGISSNLILYLTRKLHQGTVTSSNNVTNWVGTIWITPILGAYVADAHLGRFWTFLIASVIYLLGMSLLTLSVSLPSLKPPECHELDVTKCEKASTLHLAVFYGALYTLALGTGGTKPNISTIGADQFDDFDSKEKKLKLSFFNWWMFSIFIGTLFANSVLVYIQDNVGWTLGYALPTLGLAISIIIFLAGTPFYRHKLPTGSPFTKMAKVIVAAIRKWKVHIPSDTKELYELDLEEYAKRGRVRIDSTPTLRFLNKACVNTDSSTSGWKLSPVTHVEETKQMLRMIPILAATLIPSAMVAQIGTLFVKQGITLDRGIGSFNIPPASLATFVTLSMLVCVVLYDRFFVKIMQRFTKNPRGITLLQRIGIGLIIHIVIMVIASLTERYRLRVAKEHGLLENGGQVPLSIFILLPQYVLMGAADAFVEVAKIEFFYDQAPESMKSLGTSYSMTTLGIGNFLSTFLLTTISHVTKKHGHRGWVLNNLNASHLDYYYALLAILNLVNFVFFMVVTKFYVYRAEISDSIKVLEEELKEKTSNQVIPRD

SEQ ID NO: 124953 - protein, 141 aa, Glycine max
  Coding DNA Sequence Number=SeqID_8175
MGSSLFTYSLHKRFSSRAHQIYMYRELCTDLMRHSVWSRQWYPNYPNYVLFDYEGDKHFIKLHKYGNRFYVGNGLKELRRTHGIHESVLMRFVGRNKNTTFSVDVVGPLHQRAAPTIRHHVFTIDVSEDMIQQNYQLVGVS

SEQ ID NO: 124954 - protein, 427 aa, Glycine max
  Coding DNA Sequence Number=SeqID_8176
  Gene Ontology: Mol. function=DNA binding; Biological process =regulation of transcription
  Homolog annotation: Hit_ID=Q1SXV2; Match level="QueryCoverage=83%, HitCoverage=93%, E-value=1e-98, Identity=58%"; Hit description=No apical meristem (NAM) protein
  Pfam annotation: Domain name=NAM; Domain location=19-155; Score =261.9; E_value=1.3e-75; Accession=PF02365.6; Description=No apical meristem (NAM) protein
MEELLYELSDHERRNEQGLPPGFRFHPTDEELVTFYLASKVFNGTFSNVKFAEVDLNRCEPWELPVLCDCEEADVAKMGEREWYLFSLRDRKYPTGLRTNRATGAGYWKATGKDKEVYSASSGTLLGMKKTLVFYKGRAPRGEKTKWVMHEYRLVLDAHFSLPHTHPSKEEWVICRIFHKSGEKRSPVLQVHGHSDASSSPRESALPPLLASPSCFTFDPESQSQSSSHSQRDFQSPVLIHHQDQNGHSHNPRLFPLEITNARNHPSSFSDLFFKPLQQNCTLKTNEQTILPKVTKTEDATFYDQYHQLLDDHNNMRWVNKLNQNPSNLLNTFPFEVDAGLMAFSGAANAQVKDISTSTPFNRNYQLIRHGKGTLKLERESKNHSARNCDIPASLPKGIQYKHYQGTAIMPAQPVRSPVGRLLIHQS

SEQ ID NO: 124955 - protein, 92 aa, Glycine max
  Coding DNA Sequence Number=SeqID_8177
MKSLDLLFQSSLKKACPQTTLMRRSQQQISEQASKAQKLRDLKETKDVGPLIILRKHKVKQERKKKFGRKFMPPKESIKIPSSNGSSSSESE

SEQ ID NO: 124956 - protein, 92 aa, Glycine max
  Coding DNA Sequence Number=SeqID_8178
MTGGILKQMYIPDQATAYPSKLHISRCIDIKMVRDRTYPRLPIYDEGKKGFKLYFNKEIPNKGQKKPIFQGQKLIKELDVDDVDFMESNHVE

SEQ ID NO: 124957 - protein, 158 aa, Glycine max
  Coding DNA Sequence Number=SeqID_8179
  Gene Ontology: Cellular component=chloroplast
  Homolog annotation: Hit_ID=Q9S720; Match level="QueryCoverage=85%, HitCoverage=62%, E-value=4e-47, Identity=60%"; Hit description =Unknown thylakoid lumen protein, chloroplast precursor
VSEDVRVYTDDENKFKIEIPEEWQVGTGDGESSGFKSITAFYPTQASNSNVSVVITGLGPDFTRMESFGKVDEFAQTLVSGLDRSWRKPPGVAAKLIDCKSSNAIGMASNGWYNRLYTVTGQYVEEDTDKYASKVQKNKGYDDPRYLAYAIMTRRSMK

SEQ ID NO: 124958 - protein, 72 aa, Glycine max
  Coding DNA Sequence Number=SeqID_8180
MMRSRGNATVRRSHSTTAVRKSGVASRVRNVIIDDEKESGCAIGSNNMGTKRRRGTARGCSAIGEEVSVPQM

SEQ ID NO: 124959 - protein, 371 aa, Glycine max
  Coding DNA Sequence Number=SeqID_8181
  Gene Ontology: Mol. function=nucleic acid binding
  Homolog annotation: Hit_ID=Q1SXU5; Match level="QueryCoverage=83%, HitCoverage=100%, E-value=1e-105, Identity=66%"; Hit description=RNA- binding region RNP-1
  Pfam annotation: Domain name=RRM_1; Domain location=34-104; Score =71.6; E_value=2.6e-18; Accession=PF00076.12; Description=RNA recognition motif. (a.k.a. RRM, R
  Subcellular localization annotation: CTP_CleavageSite=36; ConfidenceScore=5.50e-01
MAYQAIQVPSSGSSSSSGFQLLNSPFGDTTYTKVFVGGLAWETQSETMRRYFDQFGEILEAVVITDKNTGRSKGYGFVTFRDPEAARRACADPTPVIDGRRANCNLASLGRPRPPLPYGRIRPASPYVGSLQPARGAYVGGFGYQQQPVSYSYQQGLVYPPYGYTTYGPEYIYPQSLYNPYMGQQYLQIYGVPGAVNTTVYPYGQVGQAIPSGHGYSAIQGYTVPGHQIVPYGGSNVNAITTSPMPAIQASYPSGMNNEALKNPCCISWLLLASERKTSLGIAAPVPGQPQFIVPAHSPQFMQGSGPDQTAGMNLCFESIMLQVICSHAHQVVSESLQMAKETGMCRLLFHLDIYTSVFIPNATCTQEELQ

SEQ ID NO: 124960 - protein, 91 aa, Glycine max
  Coding DNA Sequence Number=SeqID_8182
MNTQIQIGWFLRHQKRRKEELCVWSEKSIWGYLVLVVVDSSSSSSSSSSSSSSQLWEGIEKEGKGDKIEKGFWFGVDDGGGGEWESFILSE

SEQ ID NO: 124961 - protein, 263 aa, Glycine max
  Coding DNA Sequence Number=SeqID_8183
  Gene Ontology: Mol. function=DNA binding; Cellular component =chromatin; Biological process=chromosome organization and biogenesis (sensu Eukaryota)
  Homolog annotation: Hit_ID=Q9S7C9; Match level="QueryCoverage=62%, HitCoverage=56%, E-value=6e-36, Identity=47%"; Hit description =Putative DNA-binding protein ESCAROLA
  Pfam annotation: Domain name=DUF296; Domain location=71-186; Score =172.5; E_value=1.1e-48; Accession=PF03479.5; Description=Domain of unknown function (DUF296)
MAANYNNNIISAAAAAAAFMTPAALHLQPQSDDDDGEGPFSTQRRPRGRPMGSKNKPKPPVIVTRDSPNVLRSHVLEVSSGADVVESLSNYARRRGRGVSVLSGSGTVANVVLRQPAGSVLTLHGRFEIVSMTGTVLPPPAPPGSDGLSVYLSGAQGQVVGGVVVAPLVASSHVVLVAASFANAMFERLPLPLNQHDDDDQVLQEAPRGVMGTEQVADGRNYPFSASLQAPSRTNTDNACLSQHRKRSPSSCYLQYLNIGKRC

SEQ ID NO: 124962 - protein, 759 aa, Glycine max
  Coding DNA Sequence Number=SeqID_8184
  Gene Ontology: Mol. function=phosphotransferase activity, alcohol group as acceptor; Cellular component=Golgi-associated vesicle; Biological process=phosphatidylinositol biosynthetic process
  Homolog annotation: Hit_ID=Q1SXT4; Match level="QueryCoverage=96%, HitCoverage=51%, E-value=0.0, Identity=79%"; Hit description=Protein kinase-like
  Pfam annotation: Domain name=PI3Ka; Domain location=216-388; Score =30.1; E_value=5e-09; Accession=PF00613.10; Description =Phosphoinositide 3-kinase family, accessory domain (PIK domain)
  Pfam annotation: Domain name=PI3_PI4_kinase; Domain location=477-687; Score=151.4; E_value=2.3e-42; Accession=PF00454.17; Description =Phosphatidylinositol 3- and 4-kinase
  Pfam module annotation: Pfam domain module=PI3Ka::PI3_PI4_kinase; Domain location=216-388::477-687
MKGEDEEASLGWFAFEPEWYDTNYTNFAHCEAQSVSLFVQYLSNMKGDTVQVGSKGNGQENGNTLADASDHYHPVWGQMENYSVGREKRRQLLLMLCQHEADRLDVWAQPTNTKESSSRPKISADKWIEYTRTAFSVDPRLALSLASSGKVVTCWSWVRIRKQPLCICKGKAAYNIPPPYLRIAKSLWAMGGKYSILCLIYLAAATNFGLFTSIVSYTFGLDEDGKLKLKANIVDVRNIPEALPYFITPKAVDDSSVLLQQLPHWAPCSITQALEFLSPAYKGHPRVMAYVLRVLESYPPERVTFFMPQLVQSLRHDEGKLVEGYLLRAAQRSDIFAHILIWHLQGETVPETGKDPNSGKNNSFLELLPAVRQRIIDGFNPKALDIFKREFDFFDKVTSISGVLFPLPKEERRAGIRRELEKIEMDGEDLYLPTAPNKLVRGIRVDSGIPLQSAAKVPIMITFNVIDRDGDENDVKPQACIFKVGDDCRQDVLALQVIALLRDLFEAIGLNLYLFPYGVLPTGPERGIIEVVPNTRSRSQMGETTDGGLFEIFQQDYGPVGSASFEAARQNFIISSAGYAVASLLLQPKDRHNGNLLFDNVGRLVHIDFGFILETSPGGNMRFESAHFKLSHEMTQLLDPSGVMKSDTWNQFLSLCVKGYLAARRRMDGIITTVALMLDSGLPCFSRGDPIGNLRKRFHPEMSEREAANFMTHVCKDAYNKWTTAGYDLIQYLQQGIEKDGSKRSTGSGSPQFVKNPLN

SEQ ID NO: 124963 - protein, 48 aa, Glycine max
  Coding DNA Sequence Number=SeqID_8185
  Homolog annotation: Hit_ID=Q1SXT4; Match level="QueryCoverage=85%, HitCoverage=5%, E-value=3e-10, Identity=52%"; Hit description =Protein kinase-like
QFDTKVSSNSCFLDSSTALASFRAICKNFKWGFSCWKIGFIGEHECLL

SEQ ID NO: 124964 - protein, 310 aa, Glycine max
  Coding DNA Sequence Number=SeqID_8186
  Gene Ontology: Mol. function=DNA binding; Cellular component =intracellular; Biological process=regulation of transcription
  Homolog annotation: Hit_ID=Q1SXT9; Match level="QueryCoverage=78%, HitCoverage=89%, E-value=1e-87, Identity=55%"; Hit description=AT -rich interaction region; Heat shock protein Hsp20
  Pfam annotation: Domain name=HSP20; Domain location=225-310; Score= -15.3; E_value=0.015; Accession=PF00011.11; Description=Hsp20alpha crystallin family
MEDGEKPSHGIADMDVVDATLQSHRVASDQVMVLQGHDIKNGDSDPAHVPATSAISNNQFELEDAKTVSHQELITPKPKEKNVREMKNVLNDTEMTDYDEYGTPLDRETFMKELETFYRERSLEFKPPKFYGEPLNCLKLWRAVIRLGGYDVPAVYQTPGSGRARRDAAARAMQGWHAQRLLGYGEVAEPVIKDKNFSSTPKREKNLKSIAVVDVGPPADWVKINVRESKDCFEVYALVPGLLREEVRVQSDPVGRLVITGVPEHIDNPWGITPFKKVVNLPARIDSLQTSAVVSLHGRLFVRVPFEQGA

SEQ ID NO: 124965 - protein, 155 aa, Glycine max
  Coding DNA Sequence Number=SeqID_8187
MGAKYLEVVKRGSHPNNRWSPDEIRAPNDHNLSLRATGHGRLWMEKRAQNDHNLSLRVYHSSSLKGSKSVRMTVIGLGMSSGPPPPDDKRKKVRDQMVPACHWVRRLWMTKVKSVGPNGSKHVIEPAASGLKKVKSAGPNGSRMSSGPPPLDDKR

SEQ ID NO: 124966 - protein, 81 aa, Glycine max
  Coding DNA Sequence Number=SeqID_8188
  Gene Ontology: Mol. function=transferase activity; Cellular component= cytosol; Biological process=glutamine metabolic process
  Homolog annotation: Hit_ID=Q6QND2; Match level="QueryCoverage=70%, HitCoverage=23%, E-value=7e-14, Identity=67%"; Hit description =Putative pyridoxine biosynthesis protein
LRRLGVKGVEIRKPEQLNTISSLIIPGGESTTMAKLAEYHNLVAFFTSFVFIFMSLFGNTVIRAGTPRYLHKLRPFRPAIN

SEQ ID NO: 124967 - protein, 120 aa, Glycine max
  Coding DNA Sequence Number=SeqID_8189
  Gene Ontology: Mol. function=RNA-directed DNA polymerase activity; Cellular component=riboflavin synthase complex; Biological process =RNA-dependent DNA replication
MMNEEEEEDVLSPELERLIAQEKWTGEERKEVKVGTSMTTPIRQGLITLLEEYQDIFAWSYQDMPGLDSDIVQHKLPLNPGSSPVKQKLRRMRPDMSLKIKEQVRKQFDAGFLAVVRYPE

SEQ ID NO: 124968 - protein, 80 aa, Glycine max
  Coding DNA Sequence Number=SeqID_8190
MGVGSVKRGGNRVRLQGMGPESHIGSMGFECRVYKSLGSATTMAGFSAMCLDMERSVIQVKDLMSLTKDVGRFKKSEYGT

SEQ ID NO: 124969 - protein, 446 aa, Glycine max
  Coding DNA Sequence Number=SeqID_8191
  Gene Ontology: Mol. function=phosphotransferase activity, alcohol group as acceptor
  Homolog annotation: Hit_ID=Q1SXT4; Match level="QueryCoverage=95%, HitCoverage=32%, E-value=0.0, Identity=82%"; Hit description=Protein kinase-like
MIYVKGTFNPAEDRVSEIGHEAETRDSILTMHTCFLIKSLSQREDHIRDIAENLLNQLRDKFPQVLWDSSCIDSLLFSFNGDSSTAVINDPAWTATVRTLYQRIVREWIIKSVSSAPCTSQGLLQDKLCKANTWQRAQPTIDVVLLLSEIRIGTGKNDNWPIQTANIPAVMAAAAAASGANLKASESFNLDVISSGKCNQAAATVKCNHAGEIAGMRRLYNSIGGFQSSTAPPGLGLGAGLQRIISGAFPQQPQAEDDSFNGMLLNKFVRLLQQFVNIAEKGGEVVRSEFRDTCSQATVLLLSHLSSGSKSNVEGFSQLLRLLCWCPAYISTHDAMETGVFIWTWLVSAAPELGALVLAELVDAWLWTIDTKRGLFASEARYSGPAAKLRPHLSPGEPELQPEIDPVEQIIAHRLWLGFLIDRFEVRHWSPYDLHFLIWPLYLNII

SEQ ID NO: 124970 - protein, 529 aa, Glycine max
  Coding DNA Sequence Number=SeqID_8192
  Gene Ontology: Mol. function=1-phosphatidylinositol 4-kinase activity
  Homolog annotation: Hit_ID=Q1SXT3; Match level="QueryCoverage=86%, HitCoverage=58%, E-value=0.0, Identity=78%"; Hit description=1 -phosphatidylinositol 4-kinase (EC 2.7.1.67) [validated]-Arabidopsis thaliana-related
EESVEFLERQEIAFKLIAHVLEKVHVEPVLLEQVRLIGKKQIQSMSVFLKIRKRDWHEQGSLLKARINTKLSVYKAAVNLKIKSLSALDSDSRSVKRLVYEAVAILIDAAEACLLSGWRKLRSCEELFSSLLLGVAHIAIARGGQPLRILLIRLKPIVLNVCAQPDTWSNTHGGMFESVMKASCQIIESCWNKERAPVDTYIMGLATSIRERNDYEEQLFGCLRNPVLPQDNQEKPEVPFVQLNVIRLFAELSAAVNKSELLLDAVSRMASLGFEKSYRETVVLMTRSYLNKLSSVGSAESKTEATEATTERVETLPAGFLVIASGLTSDRLRSDFRHRLLSLCSDVGLAAEAKSGRSGADFLGPLLPAVAAICSDFDPTLNVEPSLLKLFRNLWFYVALFGLAPPIQKTPVNTKSVSSTLNSVGSMGAISLQAVNGPYMWNVEWSSAIQRISQGTPPLVVSSVKWLEDELELNALHNPGSRQGSGNEKAALAQRAALSAALGGRVDVTAMTTISGGLHLLYFSNSLSI

SEQ ID NO: 124971 - protein, 119 aa, Glycine max
  Coding DNA Sequence Number=SeqID_8193
VRQGQGDILIARFPDPNYGVKTGSSRCGFSMENNDGLWWLMVAVGDGESAWNFRNGFGRKKEEEMTFFLSYTKTKTETKFRKHPTVNEGWTAFLPRQLHVAFSRSFIKRLPPEASSWLL

SEQ ID NO: 124972 - protein, 129 aa, Glycine max
  Coding DNA Sequence Number=SeqID_8194
  Homolog annotation: Hit_ID=Q1SGW5; Match level="QueryCoverage=93%, HitCoverage=49%, E-value=2e-20, Identity=49%"; Hit description=ZIM
  Pfam annotation: Domain name=Zim; Domain location=3-38; Score=62.6; E_ value=1.3e-15; Accession=PF06200.4; Description=ZIM motif
MEKEHKAAQLTIFYNGQVVVFDDFPADKVQEMMSLALATKGISQSQNSSAYAHTHNQQGNNHPSTIPNIIPQAPSTPIANDMPIGRKASLHRFLEKRKDRIAAKAPYQTNRPISAPNKPAESLDAKSHT

SEQ ID NO: 124973 - protein, 150 aa, Glycine max
  Coding DNA Sequence Number=SeqID_8195
  Gene Ontology: Mol. function=1-phosphatidylinositol 4-kinase activity
  Homolog annotation: Hit_ID=Q1SXT3; Match level="QueryCoverage=99%, HitCoverage=18%, E-value=3e-66, Identity=82%"; Hit description=1 -phosphatidylinositol 4-kinase (EC 2.7.1.67) [validated]-Arabidopsis thaliana-related
RNWKKVLRESGQESPSNAGALFADRGNHYLAGEGGELLGEIRRGLRGLGDVAGEIEEERGDGIEAERVGPEGLSEGMGNGAEELEDDGLWAQIGGIGAVGEEARDGEDGIELRARNPRRARREVLRQRAFVAYPRELIGELRGILRNEVA

SEQ ID NO: 124974 - protein, 171 aa, Glycine max
  Coding DNA Sequence Number=SeqID_8196
  Homolog annotation: Hit_ID=Q9LUK5; Match level="QueryCoverage=61%, HitCoverage=52%, E-value=3e-10, Identity=33%"; Hit description =Arabidopsis thaliana genomic DNA, chromosome 5, P1 clone:MSD23
MPTWRCIQLFIYFLAWASLICSPTSSSLADSISSPVHAKPFSPVNKFLMQSYYDRYINLHDLDFEKFMSQEVPYGSCDNLNFVLRLSDLKRTLIGEEFSDIAVFGDTNLELPSFLSNRSAVEIHLLVDPNILQEPTDINMELPLHARYQLVTTIIASTRYQDDDYMQHHRG

SEQ ID NO: 124975 - protein, 1155 aa, Glycine max
  Coding DNA Sequence Number=SeqID_8197
  Gene Ontology: Mol. function=protein binding; Cellular component =membrane; Biological process=defense response
  Homolog annotation: Hit_ID=Q2YE87; Match level="QueryCoverage=96%, HitCoverage=92%, E-value=0.0, Identity=62%"; Hit description=NBS-LRR type disease resistance protein Rps1-k-2
  Pfam annotation: Domain name=LRR_1; Domain location=1002-1025; Score =8.5; E_value=7.2; Accession=PF00560.23; Description=Leucine Rich Repeat
  Pfam annotation: Domain name=LRR_1; Domain location=1026-1048; Score =4.1; E_value=49; Accession=PF00560.23; Description=Leucine Rich Repeat
  Pfam annotation: Domain name=LRR_1; Domain location=1051-1074; Score =9.1; E_value=5.6; Accession=PF00560.23; Description=Leucine Rich Repeat
  Pfam annotation: Domain name=LRR_1; Domain location=557-578; Score =13.3; E_value=0.9; Accession=PF00560.23; Description=Leucine Rich Repeat
  Pfam annotation: Domain name=LRR_1; Domain location=580-602; Score =16.2; E_value=0.12; Accession=PF00560.23; Description=Leucine Rich Repeat
  Pfam annotation: Domain name=LRR_1; Domain location=604-625; Score =9.8; E_value=4.1; Accession=PF00560.23; Description=Leucine Rich Repeat
  Pfam annotation: Domain name=LRR_1; Domain location=739-760; Score =3.6; E_value=61; Accession=PF00560.23; Description=Leucine Rich Repeat
  Pfam annotation: Domain name=LRR_1; Domain location=762-784; Score =0.6; E_value=2.2e+02; Accession=PF00560.23; Description=Leucine Rich Repeat
  Pfam annotation: Domain name=LRR_1; Domain location=820-843; Score =6.3; E_value=19; Accession=PF00560.23; Description=Leucine Rich Repeat
  Pfam annotation: Domain name=LRR_1; Domain location=909-936; Score =5.6; E_value=26; Accession=PF00560.23; Description=Leucine Rich Repeat
  Pfam annotation: Domain name=LRR_1; Domain location=954-978; Score =2.1; E_value=1.2e+02; Accession=PF00560.23; Description=Leucine Rich Repeat
  Pfam annotation: Domain name=NACHT; Domain location=154-303; Score= -37.0; E_value=0.044; Accession=PF05729.3; Description=NACHT domain
  Pfam annotation: Domain name=NB-ARC; Domain location=115-413; Score =253.1; E_value=5.7e-73; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::NACHT::NB-ARC; Domain location=1002-1025::1026-1048::1051-1074::557-578::580 -602::604-625::739-760::...
  Pfam module annotation: Domain location=762-784::820-843::909 -936::954-978::154-303::115-413
MDFDKLVGSASLYAFLQIVLDKLASTEVVNLIRGEKKLLQKLKTTLIKVSAVLDDAEKKQITDDSRVKDWLNDLKDAVYKADDLLDELSTKAVTQKQENLGLKEVEMEKNSYWPDEKTIPTTSLEARHIYGRDKDKEAIINLLLEDTSDGKEVAVILIVGVGGVGKTTLAQSVYNDDNLCDWFDFRAWVCVSDKFDIFNITKSVMENVTGKRCEINDLNLLQLGLMEKLAGKRFLIVFDDVWTEDCFSWSLLTYQHGARGSKILVTARNENIATIIDTVKVYRLDQLSNEDCWFVFAEHACLSVESNEDTTALEKIGWEIVKKCNGLPLAAISLGGLLRTKHHVWEWNDVLNNVLWGLSESVFPALEISYHYLSPHLKQCFVYCSLYPIDYEFWKEELILLWMAEGLLNPQRNGKTLEETGDDYFDDLVSRSFFQPSTSWPQHKCFVMHQLMRDLAISFGGEFYFRSEEPREEIKIGVYTRHLSFTKFGDIVLDNFKTFDKVKFLRTFLPINFKDAPFNNENAPCIIMSKLKYLRVLSFCGFQSLNALPGAIGKLIHLRYLNLSYTCIETLPESVCSLYNLQTLKLSNCRKLTMLPTGMQNLVNLRHLSIHCTSIKEMPRGMGKLNNLQHLDSFIVGQHQENGIRELGGLLNLRGPLSIIQLENVTKSDEALKARIMDKKHINSLSLEWSERHNNSLDFQIEVDVLSKLQPHQDLVFLSISGYKGTRFPDWVGNFSYYNMTHLSLCNCNDCCMLPSLGQLPSLKDLYISCLNSVKIIGASLYKTEDCSFVKPFSSLESLTIHNMPCWEAWISFDLDAFPLLKDLEIGRCPNLRGGLPNHLPALESLTIKDCKLLVSSLPTAPALRRLKIRGSKKVRLHEIPILVESLEVEGSPMVTSMIEAISNIKPSCLQSLTLSDCSSAISFSGGGLPASLKSLNIWGLKKLEFPTQHKHELLESLEIYDSCDSLISLPLIIFPNLKRLVLVKCENMESLLVSLSESSNNLSYFEIRDCPNFVSFPREGLPAPNLIRFTVENCDKLNSLPEQMSTLLPKLQYLHIDNCSEIESFPEGGMPPNLRLVGIANCEKLLRGIAWPSMDMLTSLYVQGPCYGIKSFPKEAYMNALCCKSDATRSTKKFGLKFPIFMALLLAVGVSDRA

SEQ ID NO: 124976 - protein, 153 aa, Glycine max
  Coding DNA Sequence Number=SeqID_8198
MESVLANHCESTQEPGRLQGFIRLMIALSDLNGSQVHSWDETPITTKLRVSVSPSICKGKAAYNIPPPYLYIVKSLRTMGYEVFYLGGTIFLLGLSVVSLLVLHSLSWKLEEYTADVTFSSASHSDTQVSKPSIFIIHLLVGCIRDQLRTPDY

SEQ ID NO: 124977 - protein, 270 aa, Glycine max
  Coding DNA Sequence Number=SeqID_8199
  Gene Ontology: Mol. function=protein binding; Cellular component =membrane; Biological process=defense response
  Homolog annotation: Hit_ID=Q2YE87; Match level="QueryCoverage=99%, HitCoverage=25%, E-value=1e-72, Identity=50%"; Hit description=NBS -LRR type disease resistance protein Rps1-k-2
MEIKGSSMVESMIEVIANFQPTCLQSLTLSTCESAISFPGGRLPASLKTLNILGLRRLEFQTQNKHELLGSVSIWGCDSLTSFPLVTFPNLKCLTIENCENMEFLLVSVSESPKNLSSSEIHNCPNFVLFASEGLSAPSLTCFIVENCSKLKSLPDQMSSLLPKLEHLGIYECPDIESFPEDHVMASRRECCLFPFHLSLFGFSSMVTLDCKCLLHFTSLQKLEIPSCQKLPDSLIKLSILSCPLLQKRLMRRHIWPIISHISGIYVDGK

SEQ ID NO: 124978 - protein, 177 aa, Glycine max
  Coding DNA Sequence Number=SeqID_8200
  Homolog annotation: Hit_ID=Q1SDG1; Match level="QueryCoverage=59%, HitCoverage=9%, E-value=3e-09, Identity=33%"; Hit description =Integrase, catalytic region; Zinc finger, CCHC-type
MVTWDESDNEKSSSSNDEQANIYLMANKNDKVEIQTLEESLSQASKTDETSTIEKLREEVACLTNDFGQFLESSKTLTDFFEILAWAFKREQHPPSHSLFQTSVTFVIEESLNHKSQTKDWKFVNHHPQDQIIGDQIEGVKTISSFKDLASCALLSEIEPQTIEATLTDDDWIIVME

SEQ ID NO: 124979 - protein, 301 aa, Glycine max
  Coding DNA Sequence Number=SeqID_8201
  Homolog annotation: Hit_ID=Q2QVB3; Match level="QueryCoverage=49%, HitCoverage=35%, E-value=2e-27, Identity=40%"; Hit description =Expressed protein
MDNFFRAPGMKNAMDLEDHEHDLTLSLRCGSPERITIQSSPITTLPQTNISLVELQMSYPNYLVSSSNYNINPFLVSCSNHSITPNWLGSSSNHNPNPYPNFPSGGGAANNNYVVDVNAAPTSVLTRRSRRGSSQRWSQGKSETVPAPFPWATDRRATVHNRKYLLQNNVVAISGRFECKRCEKEFEVTLDLEEKVNELRKFIEKESGSMHDRAPAAWVNPVLSKCVHCGKENSAKPILGDKKRAINWLFLLLGQILGFCNLGQLKYFCKHTNNHRTGAKDRLLYLAYMTISKQLVPEWFD

SEQ ID NO: 124980 - protein, 35 aa, Glycine max
  Coding DNA Sequence Number=SeqID_8202
MEDAKLMKTLMHASNPPSKDKSDFILILENHILRM

SEQ ID NO: 124981 - protein, 131 aa, Glycine max
  Coding DNA Sequence Number=SeqID_8203
MAREPTTGNVEEMEEDDEAKAQHEPAPQWTPFYFLGHSVHFFQVYFKKSFYSKAFPYALNGFGKNTLIDKNRNLIDYFFEIIDYIVSQRALRGRARARLTGALSKGGKMRGVATNVYLWETSEKPKETGQK

SEQ ID NO: 124982 - protein, 393 aa, Glycine max
  Coding DNA Sequence Number=SeqID_8204
  Homolog annotation: Hit_ID=Q39448; Match level="QueryCoverage=99%, HitCoverage=91%, E-value=1e-101, Identity=51%"; Hit description =Specific tissue protein 2
MNTRDHQMPKKFKALLNQNFEIQSEKILKTKEQILEGSKHDCEKSLVKNTHTTILEDFEPISSVPIYRNDDIYAKEENKVVKNFEPRPNVSAYGDNDVDAKPKKNVIKDFEPRPNVSAYGDNDVDAKPKKNVMKDFEPRPNVSAYGDNDVDVKPKKNVMKDFEPRPNVSAYGGNDVDAKPKKNVMKDFEPRPNVSAYGGNDVDAKPKKSVTKDFDPRPNVSSYNDNDIEAVEEKKIMKDFEPIPKVSTYGDDDVNTKEKKKVMKDFKPRPNVSAYGDNNVSAKEKKKVMKDFEPRPNVSAYGDNNVGAEKKKKIMKDFEPRPNVSAYGGNNVDEEAKKKVTKDFESRPNISAYGNNGVDAKKKKKVVDNDNIDAQGKPPEDFEPRPNISTYDE

SEQ ID NO: 124983 - protein, 90 aa, Glycine max
  Coding DNA Sequence Number=SeqID_8205
MKTRVCELKKLGLTHSFKCMKVRTQAPPRKKESIGIPTINNVGDVTQAFPEGWFIPAKWINFQSLKEEGFDVKGLFDRFGWTSFLEKFST

SEQ ID NO: 124984 - protein, 62 aa, Glycine max
  Coding DNA Sequence Number=SeqID_8206
MKKIELQKLNLVKLWKIDQQQLLGLMATFNIVLPWNCAKFGESFYIEDIYLEDPKMSPTFSD

SEQ ID NO: 124985 - protein, 70 aa, Glycine max
  Coding DNA Sequence Number=SeqID_8207
  Gene Ontology: Mol. function=signal transducer activity; Biological process=signal transduction
  Homolog annotation: Hit_ID=P93397; Match level="QueryCoverage=54%, HitCoverage=10%, E-value=9e-14, Identity=84%"; Hit description =Guanine nucleotide-binding protein subunit beta 1
  Pfam annotation: Domain name=WD40; Domain location=24-62; Score=25.9; E_value=0.00014; Accession=PF00400.22; Description=WD domain, G-beta repeat
MAPYVTQLGLVIMNVSILDLLVVLNLGSLQNTHEDRISCLGLSADGSALCTGSWDTNIKIWAFGGYRRVV

SEQ ID NO: 124986 - protein, 272 aa, Glycine max
  Coding DNA Sequence Number=SeqID_8208
  Gene Ontology: Mol. function=nucleic acid binding; Cellular component= chromatin; Biological process=RNA-dependent DNA replication
  Homolog annotation: Hit_ID=Q1SY57; Match level="QueryCoverage=54%, HitCoverage=45%, E-value=7e-17, Identity=25%"; Hit description=Zinc finger, CCHC-type; Peptidase aspartic, active site
  Pfam annotation: Domain name=zf-CCHC; Domain location=123-139; Score =14.1; E_value=0.0046; Accession=PF00098.13; Description=Zinc knuckle
TTLAQPEATRVTAQAAQATIPLEFQGLAKFRKNDPSQFSGDSNLDIVDHWIRELEKIFRAIARPENIKPLLKLGSAENLKFEVKKMVVLMVVKEFPALVEKAKIVECLEGNSRVIITHGAQGIKCFRCGGPHLMTYCPQKEMCTEPEKPKVAGRVFVMSGVEASKFDDLVQGLSACPLSFDLLVSTPIATSVVASLVCVRCPIMVNGHSYKGDIDFKLIDIIREFMEVFPEEVPGLPPQREIKFTINMVLGVGPVSITPNKIAPLELVELNK

SEQ ID NO: 124987 - protein, 865 aa, Glycine max
  Coding DNA Sequence Number=SeqID_8209
  Gene Ontology: Mol. function=structural molecule activity; Cellular component=coated pit; Biological process=ER to Golgi vesicle -mediated transport
  Homolog annotation: Hit_ID=Q1S9H2; Match level="QueryCoverage=99%, HitCoverage=100%, E-value=0.0, Identity=87%"; Hit description =Adaptin N terminal region, putative
  Pfam annotation: Domain name=Adaptin_N; Domain location=25-526; Score= 497.5; E_value=1.6e-146; Accession=PF01602.10; Description=Adaptin N terminal region
  Pfam annotation: Domain name=Gamma-COP; Domain location=597-863; Score=380.7; E_value=2.2e-111; Accession=PF08752.1; Description =Coatomer gamma subunit appendage doma
  Pfam module annotation: Pfam domain module=Adaptin_N::Gamma-COP; Domain location=25-526::597-863
MAQPLVKKDDDRDDEAEYSPFLGLEKGSVLQEARVFNDPQLDARRCSQVITKLLYLLNQGETFTKVEATEVFFAVTKLFQSKDMGLRRMVYLMIKEISPSADEVIIVTSSLMKDMNSKIDMYRANAIRVLCRITDGTLLSQIERYLKQAIVDKNPVVASAALVSGIHLLQTNPEIVKRWSNEVQEAVQSRAALVQFHALGLLHQIRQNDRLAVSKLVTSLTRGTVRSPLAQCLLIRYTSQVIHESGNTQSGERPFYDYLESCLRHKSDMVIFEAARAITELNGVTSRELTPAITVLQLFLSSTKPVLRFAAVRTLNKVAMTHPMAVTNCNIDMESLISDQNRSIATLAITTLLKTGNESSVDRLMKQITNFMSDIADEFKIVVVEAIRSLCLKFPLKYRSLMNFLSNILREEGGFDYKKAIVDSIVILIRDIPDAKEVGLLHLCEFIEDCEFTYLSTQILHFLGIEGPKTSDPSKYIRYIYNRVHLENAIVRASAVSTLAKFGAAVDVLKVRDRATLYLDTLGGDGSVVETDKDVKDFLFGPFDIPLVNLETSLKNYEPSEEGFDINSVPKEVKSQPLAEKKAPGKKPTGLGAPPSTADAYERMLSTISECANFGKLFKSSAPVELTEAETEYAVNVIKHIFDRHVVFQYNCTNTIPEQLLEHVIVTVDASDADEFSEVFSKPLRSLPYDSPGQTFVAFEKPEGVPTVGKFSNILKFIVKEVDPTTGEAEDDGVEDEYQLEDLEIVAADYVLKVGVSNFRNAWESLGPDFERVDEYGLGPRESLAEAVNTVINLLGLEPCEGTEEVPPNSRSHTCLLSGVFIGNVKVLVRLSFGLDGPKDVAMKLSVRSEDETVSDAIHEIVASG

SEQ ID NO: 124988 - protein, 76 aa, Glycine max
  Coding DNA Sequence Number=SeqID_8210
MNLSQVLAQQIQQTATILLGTIANQLFQPAPIQLAPAQFAHAQLAHVQHVPTQHALIEQVDDVEPAPLQQPPLPQE

SEQ ID NO: 124989 - protein, 439 aa, Glycine max
  Coding DNA Sequence Number=SeqID_8211
  Gene Ontology: Mol. function=protein serine/threonine kinase activity; Cellular component=membrane; Biological process=protein amino acid phosphorylation
  Homolog annotation: Hit_ID=Q1S9G6; Match level="QueryCoverage=76%, HitCoverage=73%, E-value=1e-164, Identity=83%"; Hit description =Protein tyrosine kinase, putative
  Pfam annotation: Domain name=Pkinase; Domain location=122-393; Score =144.9; E_value=2.2e-40; Accession=PF00069.15; Description=Protein kinase domain
  Pfam annotation: Domain name=Pkinase_Tyr; Domain location=122-393; Score=123.1; E_value=7.9e-34; Accession=PF07714.7; Description =Protein tyrosine kinase
  Pfam module annotation: Pfam domain module=Pkinase::Pkinase_Tyr; Domain location=122-393::122-393
MAPPATSTGGTLPELTNRTPFLGLKLYVLLLIAVLIVIATVILILVCVRRSRSSKKRKMRVKHSSGAIPLVSKEIVEVNTLELKIDEEVEIEIEESASAESPNIGWGRWYSLKELENATEGFAEVNVIGEGGYGIVYKGILMDGSVVAVKNLLNNKGQAEKEFKVEVEAIGKVKHKNLVGLVGYCAEGAQRMLVYEYVDNGTLEQWLHGDVGPVSPLPWDIRMKIAVGTAKGLAYLHEGLEPKVVHRDVKSSNILLDKKWNAKVSDFGLAKLLGSEKSYVTTRVMGTFGYVSPEYASTGMLNEGSDVYSFGILLMELITGRSPIDYSRPPGEMNLVDWFKVMVASRRGDELVDPLIDIQPYPRSLKRALLVCLRCIDLDVNKRPKMGQIVHMLEADDFPFRSEHRTNREKDPVHSKAAVSSKILYPTRHVEPADKSSWR

SEQ ID NO: 124990 - protein, 898 aa, Glycine max
  Coding DNA Sequence Number=SeqID_8212
  Gene Ontology: Mol. function=protein-tyrosine kinase activity; Cellular component=cellulose and pectin-containing cell wall; Biological process=protein amino acid phosphorylation
  Homolog annotation: Hit_ID=Q9SIX4; Match level="QueryCoverage=94%, HitCoverage=94%, E-value=0.0, Identity=50%"; Hit description =Putative LRR receptor protein kinase
  Pfam annotation: Domain name=LRRNT_2; Domain location=26-63; Score =11.1; E_value=0.06; Accession=PF08263.3; Description=Leucine rich repeat N-terminal domain
  Pfam annotation: Domain name=LRR_1; Domain location=122-144; Score =15.2; E_value=0.24; Accession=PF00560.23; Description=Leucine Rich Repeat
  Pfam annotation: Domain name=LRR_1; Domain location=146-168; Score =15.5; E_value=0.19; Accession=PF00560.23; Description=Leucine Rich Repeat
  Pfam annotation: Domain name=LRR_1; Domain location=170-192; Score =18.3; E_value=0.028; Accession=PF00560.23; Description=Leucine Rich Repeat
  Pfam annotation: Domain name=LRR_1; Domain location=194-216; Score =13.0; E_value=1.1; Accession=PF00560.23; Description=Leucine Rich Repeat
  Pfam annotation: Domain name=LRR_1; Domain location=218-239; Score =20.2; E_value=0.0077; Accession=PF00560.23; Description=Leucine Rich Repeat
  Pfam annotation: Domain name=LRR_1; Domain location=241-264; Score =12.2; E_value=1.5; Accession=PF00560.23; Description=Leucine Rich Repeat
  Pfam annotation: Domain name=LRR_1; Domain location=266-285; Score =4.7; E_value=37; Accession=PF00560.23; Description=Leucine Rich Repeat
  Pfam annotation: Domain name=LRR_1; Domain location=289-311; Score =14.9; E_value=0.3; Accession=PF00560.23; Description=Leucine Rich Repeat
  Pfam annotation: Domain name=LRR_1; Domain location=313-336; Score =7.8; E_value=9.9; Accession=PF00560.23; Description=Leucine Rich Repeat
  Pfam annotation: Domain name=LRR_1; Domain location=339-361; Score =3.9; E_value=54; Accession=PF00560.23; Description=Leucine Rich Repeat
  Pfam annotation: Domain name=Pkinase; Domain location=501-793; Score=- 29.0; E_value=7.8e-07; Accession=PF00069.15; Description=Protein kinase domain
  Pfam annotation: Domain name=Pkinase_Tyr; Domain location=513-793; Score=-69.3; E_value=3.2e-08; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::Pkinase::Pkinase _Tyr; Domain location=26-63::122-144::146-168::170-192::194-216::218 -239::241-264:...
  Pfam module annotation: Domain location=:266-285::289-311::313 -336::339-361::501-793::513-793
MGIVWLGLLLLVLSQVTLEQNEPLSSVEERESLLELRGSLGLRSKEWPRKPDPCLIWVGITCQNGRVVGINISGFRRTRLGRRNPQFAVDALANFTLLRSFNASNFPLPGSIPDWFGLSLPSLTVLDLRSCSIVDAIPSTLGNLTNLTSLYLSDNNLIGNVPGTLGQLLALSVLDLSRNSLTGSIPASFAFLGNLSSLDMSANFLSGAIPTGIGTLSRLQYLNLSNNGLSSLPAELGGLASLVDLDLSENSFVGGGLPPDFTRLRNLRRMILANSMLTGALPGRLFSDSLQFLVLRQNNFSGSLPVELWSLPRLSFLDVSANNFSGLLPNSTSAANNATAAVLNISHNKFYGGLTPALRRFGFVDLSRNYFEGKILDYMLNVSLDINCLQKATNQRSTMECASFYAERGLSFDNFGQPNTTKPPTAESSGKSNKTKIILAAVFGGVGLIALLVLLLVLLLLCARKRGNSNQRGNGVGPAPVGSSPPNPGVLVDFPNVGDSFTYHQLLQATGDFNDANLIKHGHTGDFFNGVLESGIPVVIKRIDMRSTKKEAYLSELDFFNKVSHQRFVPLLGHCLENENEKFLVYKRMTNGDLSNCLYYKNTSEDGTLQSLDWITRLKIATGAAEALSYLHHECVPPIVHRDIQASSILLDDKYEVRLGSLSESCAQEGDIHQSKITRFLRLPQSSEQGTSGSSTSICVYDVYCFGKVLLELVTGKLGMSAASDTEVKEWFDQILPCISMYDKELVTKIVDPSMVVDEDFLEEVWAISIVARSCLNPKPSRRPPMRYVLKALENPLKVVREENSSSARLRATSSRGSWNATLFGSWRQSSSDVTLTPAASGTKLERASSLKLSGTTGSQSQGSFHNGGEILSSRRRHSKEILPEPSGVHDVERLELE

SEQ ID NO: 124991 - protein, 717 aa, Glycine max
  Coding DNA Sequence Number=SeqID_8213
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q94G86; Match level="QueryCoverage=58%, HitCoverage=92%, E-value=1e-166, Identity=66%"; Hit description=Beta- 1,3-glucanase-like protein
  Pfam annotation: Domain name=Glyco_hydro_17; Domain location=31-350; Score=394.8; E_value=1.2e-115; Accession=PF00332.9; Description =Glycosyl hydrolases family 17
  Pfam annotation: Domain name=WD40; Domain location=564-602; Score =37.4; E_value=5e-08; Accession=PF00400.22; Description=WD domain, G -beta repeat
  Pfam annotation: Domain name=WD40; Domain location=606-644; Score =18.9; E_value=0.018; Accession=PF00400.22; Description=WD domain, G -beta repeat
  Pfam annotation: Domain name=WD40; Domain location=655-694; Score =35.3; E_value=2.2e-07; Accession=PF00400.22; Description=WD domain, G-beta repeat
  Pfam annotation: Domain name=X8; Domain location=370-457; Score =151.2; E_value=2.7e-42; Accession=PF07983.3; Description=X8 domain
  Pfam module annotation: Pfam domain module=Glyco_hydro_17::WD40::WD40: :WD40::X8; Domain location=31-350::564-602::606-644::655-694::370-457
MAITTPSNSSILLSLSLLLISLSLAESQSFIGVNYGQVADNLPAPEDTANLLKSTTIGKVRLYGADPAIIKALANSGIGIVIGAANGDIPSLAADPNAATQWVNANVLPYYPASNITLITVGNEILTLADQGLLSQLVPAMRNVQNALGAASLGGKIRVSTVHSMAVLTQSDPPSSGLFNPALQDTLKQLLALLKDNKSPFTINPYPFFAYQSDPRSETLAFCLFQPNSGRVDSGNGKLYTNMFDAQVDAVHSALSAMGFQDVEIVVAETGWPSRGDSNEVGPSVENAKAYNGNLIAHLRSLVGTPLMPGKSVDTYIFALYDEDLKPGPGSERAFGMFKTDRTVLYDVGLTKSSQQTPTTPVTPAPNTAGWCVAKAGVSDAQLQANIDYACSQGIDCGPIQPGGSCFEPNTIASHAAFAMNLYYQTSGKNQWNCDFSQSATLTSQNPKILEAKTQRELDDIDCFAVFSIISATNYSMIRCRPAVRISGFHPGDPDAYGKLMIQILQARTDYVVVMKERHLAATETINSLRERLKERRLSLLDTDIAGYARSQGRAPVTFGPTDLVCCRALQGHTGKVYSLDWTSEKNRIVSASQDGRLIVWNALTSQKTHAIKLPCAWVMTCAFSPTGQSVACGGLDSVCSIFNLNSPADRDGNLAVSQMLSGHKGYVSSCQYVPDEDTHLVTGSGDQTCVLWDITTGFRTSVFGGEFQSGHTADVL

SEQ ID NO: 124992 - protein, 167 aa, Glycine max
  Coding DNA Sequence Number=SeqID_8214
MTDLVSAEDDGAEDDISQCVLSGFSSYRQQKVYMDNHSGIYAPQRDSKVSMTDLVSAEDDQQKVYTDNHSGISARQRDSKVSMTDLVSAEDYKTTLVSCAMRLFGLQQPKVYTDNHSGISARQRDSKVTMTNLVSAKDDGGEDDISQCVLSGFSSYRLKKVYTDNHS

SEQ ID NO: 124993 - protein, 633 aa, Glycine max
  Coding DNA Sequence Number=SeqID_8215
  Gene Ontology: Mol. function=nucleoside-triphosphatase activity; Cellular component=membrane; Biological process=defense response
  Homolog annotation: Hit_ID=Q1RSP6; Match level="QueryCoverage=98%, HitCoverage=68%, E-value=0.0, Identity=49%"; Hit description=TIR; Disease resistance protein; AAA ATPase; Winged helix repressor DNA -binding
  Pfam annotation: Domain name=NACHT; Domain location=233-384; Score= -25.5; E_value=0.0056; Accession=PF05729.3; Description=NACHT domain
  Pfam annotation: Domain name=NB-ARC; Domain location=197-487; Score =139.1; E_value=1.2e-38; Accession=PF00931.13; Description=NB-ARC domain
  Pfam annotation: Domain name=TIR; Domain location=14-165; Score =155.7; E_value=1.2e-43; Accession=PF01582.10; Description=TIR domain
  Pfam module annotation: Pfam domain module=NACHT::NB-ARC::TIR; Domain location=233-384::197-487::14-165
MPTEIAMNNRRYEVFMSFRGEDTRATFTSHLYAALQNAGIIVFKDDESLPRGDQISDSLLLAIEQSQISVVVFSTNYADSRWCLQELEKIMNCKRTIGQVVLPVFYDVDPSQVRYQTGHFGESFQNLSNRILKDDDEKAVGEGESDKEYMMSRVLISRWRKVLREAASIAGVVVLNSRNESETIKNIVENVTRLLDKIELPLVDNPVGVESRVQDMIERLDLNHKQSNSNDVLLLGIWGMGGIGKTTIAKAIYNKIGRNFEGRSFLEQIGELWRQDAIRFQEQLLFDIYKTKRKIHNVELGKQALKERLCSKRVFLVLDDVNDVEQLSALCGSREWFGSGSRIIITTRDKHILRGDRVDKMYTMKEMDESESIELFSWHAFKQASPREGFTELSNDVIEYSGGLPLALTVLGCHLFDMKIIEWKTVLDKLKRIPHDQVQKKLKISYDGLSDDTERDIFLDIACFFIGMDRNDAMCILNGCGLFAENGIRVLVERSLVTVDDKNKLGMHDLLRDMGREIIRAKSPKDLEERSRLWFNEDVLDGTKTIEGLALKLPLTNSNCFSTEAFKEMKKLRLLQLAGVQLDGDFEYLSKDLRWLCWNGFPLKCIPKNFHQGSLVSIELENSNVKLVWKEAQ

SEQ ID NO: 124994 - protein, 147 aa, Glycine max
  Coding DNA Sequence Number=SeqID_8216
  Homolog annotation: Hit_ID=Q1S735; Match level="QueryCoverage=23%, HitCoverage=6%, E-value=9e-09, Identity=71%"; Hit description =Probable transposase [imported]-Arabidopsis thaliana-related
MALVVKVLHFVDDEKKWPWLFTIHKLIGWQMYASQAPYLQRLAIKILSQTCSASGCETNWSVFEQKRKEPASDGVTLSAAQTSKNTGSGHIFKKKQVAVQKNDKDVESKEEEVMITFEESDEEEGEGYASLLDDNNEEHYVRVEEED

SEQ ID NO: 124995 - protein, 46 aa, Glycine max
  Coding DNA Sequence Number=SeqID_8217
MIKPAAVVMGTRGRSLIQREVLLSPLLLLFQEKMMEMRQSSSGIVL

SEQ ID NO: 124996 - protein, 48 aa, Glycine max
  Coding DNA Sequence Number=SeqID_8218
MEEYSGNDSLGRRIEVVIGRRRRRNYTCIKKGWDSDLKHDKGGERPIK

SEQ ID NO: 124997 - protein, 319 aa, Glycine max
  Coding DNA Sequence Number=SeqID_8219
  Gene Ontology: Mol. function=transcriptional repressor activity; Biological process=regulation of nitrogen utilization
  Homolog annotation: Hit_ID=Q9SDZ0; Match level="QueryCoverage=99%, HitCoverage=100%, E-value=1e-156, Identity=89%"; Hit description =Isoflavone reductase homolog 2
  Pfam annotation: Domain name=Epimerase; Domain location=9-211; Score=- 35.7; E_value=0.00078; Accession=PF01370.11; Description=NAD dependent epimerasedehydratase family
  Pfam annotation: Domain name=NAD_binding_4; Domain location=11-213; Score=-104.8; E_value=0.076; Accession=PF07993.2; Description=Male sterility protein
  Pfam annotation: Domain name=NmrA; Domain location=9-310; Score =512.5; E_value=4.8e-151; Accession=PF05368.3; Description=NmrA-like family
  Pfam module annotation: Pfam domain module=Epimerase::NAD_binding _4::NmrA; Domain location=9-211::11-213::9-310
MAGDSKSKILFIGGTGYIGKFIVEASAKAGHPTFVLVRESSLSNPAKSSLILGVNFVFGDLYDHQSLVSAIKQVDVVISTLGHLQLADQDKIISAIKEMLGTDVNSQTASKDTSFSCKFYPSEFGNDVDRTHAVEPAKSAFATKANVRRAIEAQEIPFTYVSSNFFAGYFLPNLSQPGATAAPRDRVIILGDGNPKAVFNKEEDIGTYTINSVDDPRTLNKILYIRPPANTLSFNELVTLWEGKIGKTLERIYVPEEQLLKQIEESAPPVNVILSINHSSYVKGDQTNFEIESSFGVEASALYPDVKYTTVDEYLNQFV

SEQ ID NO: 124998 - protein, 143 aa, Glycine max
  Coding DNA Sequence Number=SeqID_8220
  Gene Ontology: Mol. function=nucleic acid binding; Cellular component= nucleus; Biological process=mRNA export from nucleus
  Homolog annotation: Hit_ID=Q1STD4; Match level="QueryCoverage=57%, HitCoverage=13%, E-value=4e-24, Identity=67%"; Hit description=RNA -binding region RNP-1
MDEISSRQPGEYVIGEKDGNILRVAKVDIIITERSPTGQVPANPNGYDLSQLVDQIIQLGVHDVWVEISDIKRRHDELISSNITTVGRKARRGKRDGCAADREWPPVETTMAREREGKLRESSGNKRGLFSPITYSSGCPEEI

SEQ ID NO: 124999 - protein, 92 aa, Glycine max
  Coding DNA Sequence Number=SeqID_8221
  Gene Ontology: Mol. function=molecular_function; Cellular component =integral to membrane; Biological process=retrograde vesicle-mediated transport, Golgi to ER
  Homolog annotation: Hit_ID=O48670; Match level="QueryCoverage=61%, HitCoverage=29%, E-value=2e-25, Identity=85%"; Hit description =Protein RER1A
  Pfam annotation: Domain name=Rer1; Domain location=1-80; Score=29.9; E_value=6.6e-16; Accession=PF03248.4; Description=Rer1 family
MVLPYEACNATAIQWYSFTKALCIAFVMTFFSMFDVPVFWPILLCYWVVLFVLTMRRQVAHMMKYKYIPFNLGKQKYSGKKSSASSSGSRAD

SEQ ID NO: 125000 - protein, 48 aa, Glycine max
  Coding DNA Sequence Number=SeqID_8222
  Gene Ontology: Mol. function=diacylglycerol kinase activity; Biological process=protein kinase C activation
  Homolog annotation: Hit_ID=Q9FHH4; Match level="QueryCoverage=100%, HitCoverage=9%, E-value=8e-16, Identity=75%"; Hit description =Diacylglycerol kinase-like protein
MHVKKFNCPEWEQVPVPTSVRAIVALNLHSYGSGRNPWGNLTPEYLEK

SEQ ID NO: 125001 - protein, 99 aa, Glycine max
  Coding DNA Sequence Number=SeqID_8223
MFRSSINRSNSLAINEFPRRWFHWRVFQQEKGRRNRCGGDNEWLEGYLNVEQISNFVDRPAFSANYGCWAPRTLAAASSFIGYGFGASALQNDVVIEVS

SEQ ID NO: 125002 - protein, 431 aa, Glycine max
  Coding DNA Sequence Number=SeqID_8224
  Gene Ontology: Mol. function=zinc ion binding; Biological process =fatty acid biosynthetic process
  Homolog annotation: Hit_ID=Q5VNT2; Match level="QueryCoverage=88%, HitCoverage=93%, E-value=6e-82, Identity=43%"; Hit description =Putative YZ1
  Pfam annotation: Domain name=CBS; Domain location=240-397; Score =13.1; E_value=0.0042; Accession=PF00571.18; Description=CBS domain
  Pfam annotation: Domain name=CBS; Domain location=58-219; Score=29.5; E_value=1.2e-05; Accession=PF00571.18; Description=CBS domain
  Pfam module annotation: Pfam domain module=CBS::CBS; Domain location =240-397::58-219
MQSRKIADVLNVSDGGRGLENKEKNLSSNLHNDHDNQNQHVQIDSGSALQQFLDHIPISAIAGIKNSPAGDSIRDAIHALYKKDIFSAAIVDTSDSHAGSIRFSDRYIGLIDFTSMVLWCLEEFDKIKNDTMENHLMDLENDGLFSILDQVPQIGLTKVSELAKSFLWEPFFPVNMDDTVLHALLLLSKHRVHVLPVIQEPQAGLIGYVTQNAVVQHLLQSSELEWFDSIADKNISDFRFESQENPSCVYGDQTVANALDLLWQNQTCAVAVVDRQTKKLVGNVRNGDVYNLVKNNDLLRNRSILTVKEFIHIETDKVVTEQAIEHDHGALLTAGSLRLKNSFIPRMDLPVANKETETLKQIMEHTTETNSSFSFLINDNEQVTGLLTLRDIILQFAPPNMNSSINGGGFFEFALEQSGCQVKNGTMVRNH

SEQ ID NO: 125003 - protein, 62 aa, Glycine max
  Coding DNA Sequence Number=SeqID_8225
MEADLVAERMDLQYNKRWVLCPSTLSLSHVIVKSWNGTMEVEAIYCSEDANKIENKCFRQAQ

SEQ ID NO: 125004 - protein, 169 aa, Glycine max
  Coding DNA Sequence Number=SeqID_8226
  Homolog annotation: Hit_ID=Q1S065; Match level="QueryCoverage=79%, HitCoverage=47%, E-value=2e-19, Identity=44%"; Hit description =Arabidopsis conserved protein
MEFIIRAAFLPADTRSTFNVQSNHLQVIDKVSHLRKISYSLTACPMHPTPFYHKSRSIAQVEGTEATTSSSSSISHRLNDLQDLQENTDKLLQLRIFQQALAQECSNKQIDELLGTVKDCLLQSKDNMRELVSVIRRKRDAETGFTNEGGKYLACRKNIKRQLRKPLET

SEQ ID NO: 125005 - protein, 107 aa, Glycine max
  Coding DNA Sequence Number=SeqID_8227
MFKSALHEGDDNGDVGSVSSDNGRDTSDGCDDSGVVMIAMSMVSMVMVVVVITTLMVVVAKMLLLVVAMTGGIGGGSDDGNDGGGGDSSNVSGDGSGCDDGDDDNDN

SEQ ID NO: 125006 - protein, 113 aa, Glycine max
  Coding DNA Sequence Number=SeqID_8228
  Gene Ontology: Mol. function=aminocarboxymuconate-semialdehyde decarboxylase activity; Biological process=metabolic process
  Homolog annotation: Hit_ID=Q8S4Q4; Match level="QueryCoverage=98%, HitCoverage=58%, E-value=6e-19, Identity=90%"; Hit description =Nodulin 6l
MDLHGQSIHLLKHMSQSITVTVAKEIHALKSIAAYYGGLEINLNVTKTDAEENLKEVLTNGAKNSREVVFSVLHDACTDGELSIPEAVEAAKDILARNAIRFYKISSTNITAP

SEQ ID NO: 125007 - protein, 200 aa, Glycine max
  Coding DNA Sequence Number=SeqID_8229
  Homolog annotation: Hit_ID=Q1S065; Match level="QueryCoverage=98%, HitCoverage=65%, E-value=7e-37, Identity=45%"; Hit description =Arabidopsis conserved protein
  Pfam annotation: Domain name=DUF241; Domain location=56-199; Score= -37.6; E_value=0.0011; Accession=PF03087.5; Description=Arabidopsis protein of unknown function
MAPVERNIKSSRHSRSNSLHSAPHPILSQVEEHLHRLKDSEATTSLSSASSSSISHRLNDLKDLQESADKLLQLTISQQALAQECSSKQIDELLDGSLRLLDISSTVKDCLLQSKESMRKLVSDIRRRRDAETGFTIEGGKYLTCRKKMKRAIAKALRDLKEIQNEFKVSSSNKDKETFSMLNILKEAERVTMSSLESVC

SEQ ID NO: 125008 - protein, 270 aa, Glycine max
  Coding DNA Sequence Number=SeqID_8230
  Homolog annotation: Hit_ID=Q1S060; Match level="QueryCoverage=99%, HitCoverage=100%, E-value=1e-80, Identity=57%"; Hit description =Arabidopsis conserved protein
  Pfam annotation: Domain name=DUF241; Domain location=50-267; Score =146.0; E_value=9.7e-41; Accession=PF03087.5; Description=Arabidopsis protein of unknown function
  Subcellular localization annotation: CTP_CleavageSite=44; ConfidenceScore=5.00e-01
MSASSWNNKFHNHARSNSLPSKPHPLILQCNEHLARLGANDTISSSLLRQNLSSLLDLQECIEKLVQLPLTQEALLQERQEKWVDDLLDGSLRLLDACTATKDALLHTKECTRELQSTIRRRRGGEVELAVEVKKFLTSRKVVRKAIFKALENLKGNNNANKGNLAITNYKDYQTMALVNLLKEAEVLMHNKRVATGYAQGADENEFAKVDAALQLFAFNMSTKSNDDISDLQKKLENLGTCIQDLEEGLESLFRRLIKIRVALLNILNH

SEQ ID NO: 125009 - protein, 70 aa, Glycine max
  Coding DNA Sequence Number=SeqID_8231
MLASSKKVQMTTLASACQSNLGSPNDEVRITERCLRMLPDSWVMRAKGGVVDKSEAFAPTYPPFVMKNSD

SEQ ID NO: 125010 - protein, 59 aa, Glycine max
  Coding DNA Sequence Number=SeqID_8232
EDPLVQSSILQGFSSSSADPLNWEIKRRSRDESRHRLITERARRMKSVSYLCFPLISDK

SEQ ID NO: 125011 - protein, 297 aa, Glycine max
  Coding DNA Sequence Number=SeqID_8233
DWLPSLRTAKREEVEAPEEDEEVQALRTELEQAQTVKERFKSVALRIRKENAELRDVNVATTKALEQETKRARREEHGRNKFRGALWGSNNELKLRREERDQSRVDSLILKDELKACSRSKRSLSQRLCETETNMLAIISKYQEELSLAMTHEHRVVDKYAQVYAEKEARGRVIDSLHQEATMWMDRFALTLNGSQDLPRLLAKAKANGGHLLRPRGDPQTSRLLKNAITKRAPRHPYRTRSKSKTMGDQEEIQEQMKVDMSALKEQMASMIDAMLGMRQLMENNVATAAAVSSATE

SEQ ID NO: 125012 - protein, 82 aa, Glycine max
  Coding DNA Sequence Number=SeqID_8234
  Homolog annotation: Hit_ID=Q1SRJ5; Match level="QueryCoverage=100%, HitCoverage=7%, E-value=1e-11, Identity=43%"; Hit description =Probable helicase [imported]-Arabidopsis thaliana-related
MHWECKNFPTCFWGRYISNDSSSTHILLKIESDVGENRRIPAIKILLNFILISKRSCDTVRTFVDVFEQIFNGCTLITPFHV

SEQ ID NO: 125013 - protein, 122 aa, Glycine max
  Coding DNA Sequence Number=SeqID_8235
MGYFMCLPHGLRDMCMIRLRQAILQEGVLVLNLHIMGVAHGGVGCGSNDFQDYFDDAKESRVKQVPKNQESKSFKNQVSKNQDSRTIKFQDSIKFQESRFKNNQDQDSRLKIQESREDSIKI

SEQ ID NO: 125014 - protein, 372 aa, Glycine max
  Coding DNA Sequence Number=SeqID_8236
  Homolog annotation: Hit_ID=Q6CQF2; Match level="QueryCoverage=19%, HitCoverage=91%, E-value=2e-17, Identity=63%"; Hit description =Kluyveromyces lactis strain NRRL Y-1140 chromosome D of strain NRRL Y- 1140 of Kluyveromyces lactis
  Subcellular localization annotation: CTP_CleavageSite=36; ConfidenceScore=5.26e-01
AQLGTVTQLPVHPASPVLLTKNGPLGALDSMARLNRAAAPSYLFKSFAPIPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISKHSLTLFSKYFSSFPRGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVI

SEQ ID NO: 125015 - protein, 132 aa, Glycine max
  Coding DNA Sequence Number=SeqID_8237
  Gene Ontology: Mol. function=methyltransferase activity; Cellular component=nematocyst; Biological process=pathogenesis
  Homolog annotation: Hit_ID=Q2HRW2; Match level="QueryCoverage=87%, HitCoverage=31%, E-value=3e-23, Identity=47%"; Hit description=SAM dependent carboxyl methyltransferase
  Pfam annotation: Domain name=Methyltransf_7; Domain location=1-123; Score=-220.6; E_value=0.093; Accession=PF03492.6; Description=SAM dependent carboxyl methyltransferase
MQSLIEEAKLECVNMPRYGLTAKKVKQLIGAEGSFTLEKLETFKSRWDDGLKENGNGDFVLDTNVRAKFIAKYVRATTEPFMTARFGEGIIDELFPKYRNKVAELLEEVILEHAYLVMGLPTVKNDEDEEEE

SEQ ID NO: 125016 - protein, 569 aa, Glycine max
  Coding DNA Sequence Number=SeqID_8238
  Gene Ontology: Mol. function=transporter activity; Cellular component= intracellular; Biological process=transport
  Homolog annotation: Hit_ID=Q1SKK1; Match level="QueryCoverage=97%, HitCoverage=97%, E-value=0.0, Identity=76%"; Hit description =Cellular retinaldehyde-binding/triple function, N-terminal
  Pfam annotation: Domain name=CRAL_TRIO; Domain location=148-334; Score=169.2; E_value=1e-47; Accession=PF00650.10; Description =CRALTRIO domain
  Pfam annotation: Domain name=CRAL_TRIO_N; Domain location=62-131; Score=51.6; E_value=2.5e-12; Accession=PF03765.5; Description =CRALTRIO, N-terminus
  Pfam module annotation: Pfam domain module=CRAL_TRIO::CRAL_TRIO_N; Domain location=148-334::62-131
MTDIMSAPVDPPMKLGHEIEYSEDERKKKLGSFKKVAISASSKFKHSFAKRGRKHSRVMSLSIEDDLDAEELQAVDAFRQALILEELLPSKHDDHHMMLRFLRARKFDIEKTKQMWTDMLKWRQEFGADTIMEDFEFNELEEVLKYYPQGHHGIDKDGRPVYIEKLGQVDSTKLMQVTTMERYLKYHVKEFERTFAVKLPACSIAAKKHIDQSTTILDVQGVGLKSLNKAARDLLQRLQKIDGDNYPESLNRMFIINAGSGFRLLWNTIKSFLDPKTTSKIHVLGNKYQSKLLEIIDASELPEFLGGTCTCADKGGCMLSDKGPWNDPDILKMVHNGEGKCKRKTLSGIEEKRIIEDGTANQNLGNKESFPERYDVDVQCLSPKKQCTVYKYDAFVPVLGKPVDSSWNTLTQKDKDALSKGADCFPSKTCDGYSNHFVGGIMAIVMGIVTMIRMTRNMPRKITEAALYGSSGYYDGTMMKAATFSCNDYMAMMKRMAELEEKVTILSMKPVIPPEKEEVLNNALGRVTTIEQDLVATKKALDDALARQVELQAQIDKKKKKKNKLIILL

SEQ ID NO: 125017 - protein, 531 aa, Glycine max
  Coding DNA Sequence Number=SeqID_8239
  Gene Ontology: Mol. function=dihydrofolate reductase activity; Cellular component=nucleus; Biological process=one-carbon compound metabolic process
  Homolog annotation: Hit_ID=P51820; Match level="QueryCoverage=99%, HitCoverage=100%, E-value=0.0, Identity=87%"; Hit description =Bifunctional dihydrofolate reductase-thymidylate synthase (DHFR-TS) [Includes: ...
  Homolog annotation: Hit description=Dihydrofolate reductase (EC 1.5.1.3); Thymidylate synthase (EC 2.1.1.45)]
  Pfam annotation: Domain name=DHFR_1; Domain location=26-203; Score =288.0; E_value=1.8e-83; Accession=PF00186.9; Description =Dihydrofolate reductase
  Pfam annotation: Domain name=Thymidylat_synt; Domain location=245 -531; Score=545.2; E_value=7e-161; Accession=PF00303.9; Description =Thymidylate synthase
  Pfam module annotation: Pfam domain module=DHFR_1::Thymidylat_synt; Domain location=26-203::245-531
MPSDSSVISNGHSNGSVNPLPNLQRTYQVVVAATQDWGIGKDGKLPWRLPTDLKFFKEITMKTSDPGKKNAIVMGRKTWESIPLEYRPLSGRLNVVLTRSGSFDIATAENVVICGSMSSALELLAASPYSLSIEKVFVIGGGQIFREALNVPGCEAIHLTEIQSSIECDTFMPPVDFTIFRPWYSSFPKVENNIRYSFTTYVRVRSSAAESAGQNIDPLLDNNSESMKFEVKDFSFLPKMISERHEEYLYLKLVQDIIAEGTTKGDRTGTGTLSKFGCQMRFNLRGNFPLLTTKAWEYLFVNFDREFDLISSIDCRKYFGEGLLKSFFGLSVAQQMPSVGLTEREEGDLGPVYGFQWRHFGARYTDMHHDYSGQGFDQLLDVINKIKRNPDDRRIILSAWNPVDLKLMALPPCHMFAQFYVAHGELSCQMYQRSADMGLGIPFNIASYALLTCMIAHVCDLIPGDFIHVIGDAHIYRNHVRPLQEQLHNQPKPFPTLKINPKKKDIDSFVAADFKLIGYDPHQKIDMKLSV

SEQ ID NO: 125018 - protein, 250 aa, Glycine max
  Coding DNA Sequence Number=SeqID_8240
  Homolog annotation: Hit_ID=Q6CQF3; Match level="QueryCoverage=22%, HitCoverage=59%, E-value=2e-08, Identity=72%"; Hit description =Kluyveromyces lactis strain NRRL Y-1140 chromosome D of strain NRRL Y- 1140 of Kluyveromyces lactis
MAARALGVPRHLRAPGVGLWAPHSARLETRTKESDMCASQRASKPSIPVGDPKDGELCLSGAKPEETLVEARSDTDVQIGSSGLGYRGERLIEPSSSWFPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 125019 - protein, 125 aa, Glycine max
  Coding DNA Sequence Number=SeqID_8241
  Gene Ontology: Mol. function=transcription factor binding; Cellular component=intracellular; Biological process=regulation of transcription, DNA-dependent
  Homolog annotation: Hit_ID=O49841; Match level="QueryCoverage=64%, HitCoverage=38%, E-value=9e-36, Identity=93%"; Hit description=GTP -binding protein
  Pfam annotation: Domain name=Arf; Domain location=1-122; Score=-85.2; E_value=0.0034; Accession=PF00025.11; Description=ADP-ribosylation factor family
  Pfam annotation: Domain name=Miro; Domain location=16-117; Score=5.8; E_value=0.0015; Accession=PF08477.3; Description=Miro-like protein
  Pfam annotation: Domain name=Ras; Domain location=16-125; Score=41.1; E_value=2.4e-12; Accession=PF00071.12; Description=Ras family
  Pfam module annotation: Pfam domain module=Arf::Miro::Ras; Domain location=1-122::16-117::16-125
MSSSSGQSSGYDLSFKILLIGDSAVGKSSLLVSFISNSAEDIAPTIGVDFKIKMLTVGGKRLKLTIWDTAGQERFRTLTSSYYRGAQGIILGMQNGLCAFFFSCIRGLTVVVPAQIELYFNSLIS

SEQ ID NO: 125020 - protein, 106 aa, Glycine max
  Coding DNA Sequence Number=SeqID_8242
  Gene Ontology: Mol. function=transcription factor binding; Cellular component=intracellular; Biological process=regulation of transcription, DNA-dependent
  Homolog annotation: Hit_ID=Q40206; Match level="QueryCoverage=73%, HitCoverage=37%, E-value=5e-21, Identity=65%"; Hit description=RAB1X
  Pfam annotation: Domain name=Ras; Domain location=2-73; Score=-72.3; E_value=0.00073; Accession=PF00071.12; Description=Ras family
MMHGCTLDKRKVSSGTFNESNPNLLLTDSERVVSKEEGLALAEELGCLFFECSAKTRENVERCFEELALKIMEVPSLLEEGSTAVKRNILKQQQQPQASEFGGCCS

SEQ ID NO: 125021 - protein, 79 aa, Glycine max
  Coding DNA Sequence Number=SeqID_8243
MKLGLGLLLPTRVHVPVYNGSTFLSPIQSRILIVVTVAVVVANDNGGGCNSDHGGDNNDDECHNDKDNGGDDDDNYSSG

SEQ ID NO: 125022 - protein, 118 aa, Glycine max
  Coding DNA Sequence Number=SeqID_8244
SNQRFGSDIRKGYRKSPKETSDEVHEQPKKVVVDDVVTDAEECPELKLSSHGRNVLKFDRSVPEIEGLMIAIGLNPLIACSLNTSDRELILAFAKRRGNYHPQQCGIVATSTDYRGLP

SEQ ID NO: 125023 - protein, 61 aa, Glycine max
  Coding DNA Sequence Number=SeqID_8245
MSALLLCTREQVPRARAKVFRASITRLGTENSELKVMRKGGWRASCNSKGCLLLDIGINAS

SEQ ID NO: 125024 - protein, 57 aa, Glycine max
  Coding DNA Sequence Number=SeqID_8246
MASEIQNGPSQTGRIATLKLNPMLEESVRVIFTLSRVFPSAVHYLTWRILANFINSN

SEQ ID NO: 125025 - protein, 100 aa, Glycine max
  Coding DNA Sequence Number=SeqID_8247
MERMLTKKFKFLLIYVTLLSTSFIIGESKLINNLLEDGNSIKKEPLNEEEVSTMEEMLLRANVRDYGRFDPPPRLVRPPGKGVPAAPGLNPPPPSISESK

SEQ ID NO: 125026 - protein, 654 aa, Glycine max
  Coding DNA Sequence Number=SeqID_8248
  Gene Ontology: Mol. function=RNA-directed DNA polymerase activity; Cellular component=membrane; Biological process=RNA-dependent DNA replication
MGQVTVEEVRQALFSMNPYKAPGPDSFQPIFYRNYWDIISADLWELVAHAFDSGSIIPGLAETLIVPIPKVDSPLSLRDFRPISLCNVTLKVIFKRSFIPKRGPSDNAIIAQEIAHHMRNKKGKIRYLTLKIDFEKTYDRVNWKFFKLTLNDFGFPQKIIDLIMSSTTETNLSLKWNNKVMEQFHPLRGLRQGDPTRSLERWMLRFENQFLYHRLDLRIDRYLGFPILIGSIQKPYFSFIIDKIQGKLAGWKQKLLNRAGRVTLANSVISAIPTYVMHNCWRPEGICDQIDQTVRGFIWGSSTSHWVPWETITQSRARGGLGVRKAREANISLLGKHIWEVIHNPDKLWVKLMTNKYLNHNSIVQSMSPRGATFTWSSILKATDFLKDGFFIRIGRGDVSLWYGKWLLEGYLCSKVLYVNYQDTHLRVKDLWNNGSWNFSMLATILPNDMKQHIRSIRINDIVDDIIIWAPSADGIYSASSVYKWLTSTPSTIDTSEVSWTWLWSLNIPENIRFFLWLSLHESLPTNMFRVYRHLSLDVNCCRCGLFQEDILHLLHWIQNNIQGDKGLLFSINCWFIWRSRNKDIFNDKVQPVWHFANQIYTLNDIIGKDVTQSLQQPSPMQVCWIAPPGEVMKLNTDGSAFGNPRDKQDLAES

SEQ ID NO: 125027 - protein, 123 aa, Glycine max
  Coding DNA Sequence Number=SeqID_8249
  Gene Ontology: Mol. function=diacylglycerol kinase activity; Biological process=protein kinase C activation
  Homolog annotation: Hit_ID=Q1SKJ6; Match level="QueryCoverage=96%, HitCoverage=21%, E-value=2e-50, Identity=77%"; Hit description =Pentatricopeptide repeat
MPIEPDAVLWRTLIWACKVHGDINRAERLMKRLEIQDTRADDSGSYILASNVYASAGKWCNKAEVTELMNKKGLVKPPGSSRIEVDGGVHEFVMGDYNHPEAEEIFVKLAEVVNMIRKEGLCL

SEQ ID NO: 125028 - protein, 121 aa, Glycine max
  Coding DNA Sequence Number=SeqID_8250
  Gene Ontology: Mol. function=zinc ion binding
  Homolog annotation: Hit_ID=Q1SKJ1; Match level="QueryCoverage=87%, HitCoverage=23%, E-value=7e-36, Identity=70%"; Hit description=Zinc finger, RING-type
MGAACCVAARDKTIQSGSTSDNLHRNVRCSPTWSFRWDHRGRVAGEDTSINWFSDGISRNDGSENKNESTYMSEDGSPLQNDQRKRCQKPSISQVTAAHRRNSTSGLEELYGYFKYDGTID

SEQ ID NO: 125029 - protein, 775 aa, Glycine max
  Coding DNA Sequence Number=SeqID_8251
  Gene Ontology: Mol. function=serine-type endopeptidase activity; Biological process=proteolysis
  Homolog annotation: Hit_ID=Q9FGD4; Match level="QueryCoverage=95%, HitCoverage=94%, E-value=0.0, Identity=68%"; Hit description =Protease-like
  Pfam annotation: Domain name=Peptidase_S15; Domain location=523-745; Score=-114.7; E_value=0.079; Accession=PF02129.9; Description=X-Pro dipeptidyl-peptidase (S15 family)
  Pfam annotation: Domain name=Peptidase_S9; Domain location=559-775; Score=138.4; E_value=1.9e-38; Accession=PF00326.11; Description =Prolyl oligopeptidase family
  Pfam annotation: Domain name=Peptidase_S9_N; Domain location=27-464; Score=33.4; E_value=3e-10; Accession=PF02897.5; Description=Prolyl oligopeptidase, N-terminal beta-propeller domain
  Pfam module annotation: Pfam domain module=Peptidase_S15::Peptidase _S9::Peptidase_S9_N; Domain location=523-745::559-775::27-464
MRPLFRFAQLARRHYKASPPPPPPTPPKPPKKPQKFSFHGATWEDPYSWMSQLNDKVAMRHMDVCMEQEEKYTEAVMSDSDNLLNKLHFEMASRMPFDLSTPPLRWGPWLYYRRAEEAKPYPVLCRRLAALYDDFISHKYPPAGFDFTTGKTIEQKLIDYNQEAERFGGYAYEELSEVSPNHQFLAYTMYDKENDYFKLSVRNLNSGSLCSKPQADRVSNLAWAKDGQALLYVVTDKKMRPYRIYYSLIGSTDEDVLLLEESDESVHVNIRHTKDFQFVTVNTFSTTSSKVFLINAADPLSGLKLVWECDVLAHCIIEHHRGYLYLFTDAPKGGRSVECHYLLCSPVDLSSTRKWEEVLVDDPGLIIEDIDFSDKYLALIVREGRKVQLCSVGLPLPFGKGAVKLRKLDLQYLSIPKHVCQIMPGPNYDFYSSVMRFIISSPVMPDAVVDYDLATGKWNIIQQQNMLHDRTRILYGKNSASISMEPSNSKHSSPVSVNLEDDHLWNDLSEFYACEQYEVPSFDGVLIPLTIVFARNNKTEAKKPGILHGHGAYGELLDKRWHSELKSLLDRGWVVAYADVRGGGGFGKKWHNDGRRAKKHNSINDYISCAKFLIEKDIVHENKLAGWGYSAGGLLVASAINRSPDLFRAAVLKVPFLDATNTLLYPILPLIAADYEEFGYPGDLNDFLAIREYSPYDNIQKDALYPAVLVTSSFNTRFGVWEAAKWVARVRDLSIYDPKRPILLNLTTDLVEENRYLQSKESALEATFLMKMMES

SEQ ID NO: 125030 - protein, 895 aa, Glycine max
  Coding DNA Sequence Number=SeqID_8252
  Gene Ontology: Mol. function=signal transducer activity; Biological process=G-protein coupled receptor protein signaling pathway
  Homolog annotation: Hit_ID=O81225; Match level="QueryCoverage=97%, HitCoverage=98%, E-value=0.0, Identity=55%"; Hit description=Extra -large G-protein
  Pfam annotation: Domain name=G-alpha; Domain location=467-853; Score=- 5.0; E_value=3e-17; Accession=PF00503.10; Description=G-protein alpha subunit
MSPVRTMTVAAADVAVSSDGEAEYSFAVAYNGPPPAYDLPRAVPIAAGKIPAAVTLAQVPFSDALSLPMVQPLSKELKTPSSEPAVSPTSVIAFDRSHGGGSGRVTVSPTSVIAFEDAAAAAAAEANDASSENSFSDNLTTRRHSNCEKESSSFDFNDSSQRDYASTLSSDYPSSHNISPLKTNETEPEHDVKRAPVLRFEEEQEQHEAKERVKRENVKKVKKGSCYRCLKGNRLTEKEACLACDAKYCGNCVLRAMGSMPEGRKCVGCIGLPIDEAKRGSLGKCSRLLKRLLNHLEVRQVMKAERFCEVNQLPPEYVCVNGNELGFEELVTLQSCANPPKNLKPGNYWYDKVSGFWGKEGQKPCRIISPHLNVGGPIKPDASNGNTQVFINGREITKVELRMLQLAGVQCAGNPHFWVNEDGSYQEEGQKNTKGCIWGKAGTKLVCALLSLPVPSNSKCSSSCGFLSSNVATRPVPDHFEHGIVHKLLLLGYTGSGTSTLFKQAKILYKSTPFSEDERENIKLTIQTNVYAYLGILLEGRERFEEESFGNLKKNQSSVLDTTGTSPKLGDKTIYSIGTRLKAFSDWLLKTMVSGKLDAIFPAATREYAPLIEELWDDAAIKATYERRNEIELLPSVASYFLERAVEILRTEYEPSDLDILYAEGVTSSNGMASVEFSFPQPAPEETVDTADLHNSLVRYQLITIHARGLAENCKWLEMFEDVGLVIFCVSLSDYDQFSVDGNGRRTNKMISSRKLFEAIVTHPTFEQMDFLLILNKLDEFEEKIERIPLTKCDWLSDFRPVISQHRSGINSNSISNSPSLAQLASYYIGVKFKRLYSSLTGRNLYVSLVKGLEPDSVDEALQYAKEILKWNEERPNFSLSDNSMYSIEANSFSH

SEQ ID NO: 125031 - protein, 74 aa, Glycine max
  Coding DNA Sequence Number=SeqID_8253
  Gene Ontology: Mol. function=inositol or phosphatidylinositol phosphatase activity
  Homolog annotation: Hit_ID=Q1SKI8; Match level="QueryCoverage=89%, HitCoverage=20%, E-value=4e-29, Identity=91%"; Hit description =Inositol monophosphatase; Histidinol-phosphate phosphatase, putative, inositol monophosphatase
MVKIPLYGCDCYAYALLSSGFVDLVVESGLKPYDFLALIPVIEGAGGVITDWKGDKLFWEVSPLSIPTCMAPLL

SEQ ID NO: 125032 - protein, 439 aa, Glycine max
  Coding DNA Sequence Number=SeqID_8254
  Homolog annotation: Hit_ID=P17117; Match level="QueryCoverage=40%, HitCoverage=73%, E-value=1e-68, Identity=71%"; Hit description =Oxygen-insensitive NADPH nitroreductase
  Pfam annotation: Domain name=Nitroreductase; Domain location=240-381; Score=89.8; E_value=8.1e-24; Accession=PF00881.14; Description =Nitroreductase family
IGSGRDALYAGVYFCTSFLVRRRDAGGAWTAGTAAVSAAGHRDGAAAAGQSADRHTVDRAGRNAAGHDVGVAGDADDAQLAAGDGVEPECSILGGVRCAAGAPVAHYAGDADQLSEAKTGPQARQEDLRHGRNRFAGTRFQIGFGDAGRLDIDKLPVTLMRAVYTRSQCRTTVFGAGRAGSDWRAAAGQRLAGGTGIHGEKTAGNAAVFSRHCADAARSVADDVAHRQGDGTAVVQSHPQKEGIDDAQRSAIIAAAQAASTSSFLQCSSIVRITDRALREQLVQLTGGQPWVSAAAEFWVFCADFNRHQQICPEAQLGRAEQLLLGCVDTALMAQNAMIAAESLGLGGVFIGGIRNSIAQVTELLGLPKFVLPLFGFCIGHPDASPDVKPRMPQAMLVHENRYQPLDKAVLAQYDQQITAYYQQRDSNQRSETWSELIQ

SEQ ID NO: 125033 - protein, 270 aa, Glycine max
  Coding DNA Sequence Number=SeqID_8255
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=8e-42, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
PRLRGLHALAFRGLYALAFRGLNVLTFRRLYAVAFKGLHILASRGLHALAFRGLHVVAFRGLHVLAFRGLHALALRQMHALAFRGLHALAFRGLHVLAFRGLHALAFRGLHALAFRGLYALAFRGLHVLPFRGLHALAFRGLHVLTFKGLHALAFRRLCALTSRGLHGLAFRGLHILTFRGLHFLAIRRLHVLAFRGLHVLTFRGLHALAFRGLHVLAFIGLHALVIRGLPVFAFRGLHALVIKGMHALAFREPHTLAFIGLHALASEGY

SEQ ID NO: 125034 - protein, 121 aa, Glycine max
  Coding DNA Sequence Number=SeqID_8256
  Subcellular localization annotation: CTP_CleavageSite=40; ConfidenceScore=5.19e-01
MNSHHPYGTMAVQLQYPMKRFSTFCRVGLPRSLSRIGHVRSLKEVDAGLASVCPQVLEYSNGSLGNHPPTIGCPRVKRCILLKPEVTQNSYTASRRGYSLTKTGILVEGRAPQLLYPEVGT

SEQ ID NO: 125035 - protein, 83 aa, Glycine max
  Coding DNA Sequence Number=SeqID_8257
MSGFTRNSPQISASSHQLDLAPYASEPYNAQWNAPGLLRDKHTLRSSRILREMEVDEPWLGLWLPLNYQVVFVIGSAVDRLCG

SEQ ID NO: 125036 - protein, 153 aa, Glycine max
  Coding DNA Sequence Number=SeqID_8258
MLRSQSSEFRMTLQSGIYNMIVDLLFLGDMTLSLWAHFHNADLAISTNARHSRLEYSSLRFYSGSDDNTCGGHRDLVRFGFTRHIIVFFLRHAKVYVLADTIIFFIKHTELRTRATIQWRGFFKTLVEVNAHVVAPPVMDVRDGEIKEAPKML

SEQ ID NO: 125037 - protein, 48 aa, Glycine max
  Coding DNA Sequence Number=SeqID_8259
MRVGDLFGVRHSLLDNGNAFFDTRPPPQNDVVSRSTLSHSYSYSINEQ

SEQ ID NO: 125038 - protein, 597 aa, Glycine max
  Coding DNA Sequence Number=SeqID_8260
  Gene Ontology: Biological process=protein localization
MPLKTVIRRRLLSLFQPWLAEEPHLDLQLGFLRSLAVFSDLRFDASALNRLFHSPAFLFFKDLSVERLTLRFSTWFPPAFTVELHGVRIVQSFEKPEAEECAARLRNSKYDCEDYLRKNLSALDPEELSVRSKYVDKKCLLRGFLSSVFIPMKDSTLVLKGVGFRARLVGKDHTGNVLLSSDMQIDIKFRDLKLASCTLCFPELVFSFSPDGISVCLLFLKLVSNNYNQSRGARELWRIAASRIGHVTVTPRLSFHRLVGVIGQWIHYANAYENILLLIGYSTSHTWKKSISKLTRNKLILSSASRHWKLISDIEKKLPVEGISLARRIARHRAALKDSINCHEDFVESAPLTMSEEACTMDPLSSAKGNEKEGINHMESIMWVEPAKIFLLSEIDGGQAEDCCDSHIEIFMKKFSVNWKRICRKLNENEIEFSENPCILSKIEISSTNPDPKNPDFGFCECGLMLGKLNLVLTHSSVSSLSLILSQIQHALYWEDRREASIASNFVDKAEMDWVNKYDCYCKELIMTLLQKLPEKHIHFGVLVDGPAARFSHRREADLDGLDIDDIISLDNFDLTFNFCDIEVVVGSSSFGMAPLT

SEQ ID NO: 125039 - protein, 106 aa, Glycine max
  Coding DNA Sequence Number=SeqID_8261
MHDKYFGGIIGMIPFVDGKQAKDIINTLHNKLEGVGTPIRRPFGVPETLPLQLAPRYLNGCLLGVPLSRLKRKESSCSMISVIFIPMNYDEKWESYILMRMWKVIF

SEQ ID NO: 125040 - protein, 919 aa, Glycine max
  Coding DNA Sequence Number=SeqID_8262
  Gene Ontology: Mol. function=pyridoxal phosphate binding; Biological process=metabolic process
  Homolog annotation: Hit_ID=Q10EM3; Match level="QueryCoverage=99%, HitCoverage=88%, E-value=0.0, Identity=59%"; Hit description =Expressed protein
MHLSLWKPISHCAALIMDKKSRRKDESNVDMRRNPSMLRKLQENKLREALEEASEDGSLSKSQDIDQPDSAANQDDDGLGRSRSLARLHAQREFLRATALAAERIFESQEEIPSLREAFAKFLTMYPKYQSSEKVDQLRSDEYSHLSPKTIHYWESSTFSLSEITANLSNHALYGGAERGTVEHDIKTRIMDYLNIPENEYGLVFTVSRGSAFKLLADSYPFHTNKKLLTMFDHESQSIAWMAQSAREKGAKVHSAWFKWPTLKLCSTDLRKQISNKKKRKKDSATGLFVFPVQSRVTGAKYSYQWMALAQQNNWHVLLDAGSLGPKDMDSLGLSLFRPDFIVTSFYRVFGYDPTGFGCLLIKKSVMQSLQNQSGCTGSGMVKITPEFPMYLSDSVDGLDKLVGIEDDDEITGMGEKTSETRQGTQLPAFSGAFTSAQVRDVFETEMDQDSSERDGTSTIFEETESISVGEVIKSPVFSEDESSDNSFWIDLGQSPLGSDSAGQSNKHKIASPLPPFWFNGRRNQKQHSPKPTSKMYGSPMYNDREVNLGAHEDRHVLSFDAAVLMSQELDRVKEVPEEEHVEEVDHYSRNGNGSDHLHVNEILEEPGTSGVVNNGSWLDSTSLARHQSLENGSTSEICPDVKESAIRRETEGEFRLLGRREGNRYGGGRFFGLEENEANSRGRRVSFSMEDNRKEYLSQTLEPGDISATSFDDEEVTSDGEYGDGQDWGRREPEIICRHIDHVNMLGLNKTTLRLRFLVNWLVTSLLQLKLPGSDGGEKANLVQIYGPKIKYERGAAVAFNVRDRSRGLINPEIVQKLAEKEGISLGLGFLSHIQILDNSRQHRGAPNLEDTTLCRPMENGWRNGKGSFVRLEVVTASLGFLTNFEDVYKLWAFVAKFLNPTFIREGGLPTVQEGSEA

SEQ ID NO: 125041 - protein, 69 aa, Glycine max
  Coding DNA Sequence Number=SeqID_8263
MGNKAAQASPTTSNSTSRGVMKEANNTWEMAKGMGVNYEKEEIRMISRIKILEGRDKNNADVLGRGHGE

SEQ ID NO: 125042 - protein, 133 aa, Glycine max
  Coding DNA Sequence Number=SeqID_8264
  Subcellular localization annotation: CTP_CleavageSite=29; ConfidenceScore=5.26e-01
MVTQTPPKNTITAQICNLQTTGLSLYSLSLSLPRSNICPRVLTKLKRLEFYDTMPCCHVVIYVRKNKNNSSKSLVSYCTARIGYRAVTKRDLEGGGILIVLEKGGENLCLSNTWSGSLYSMFFVVLGLHPTST

SEQ ID NO: 125043 - protein, 109 aa, Glycine max
  Coding DNA Sequence Number=SeqID_8265
  Gene Ontology: Mol. function=RNA-directed DNA polymerase activity; Biological process=RNA-dependent DNA replication
MWCIIEDFNCVCKNSERVGASQRDQGSGVMREFTAWLKELEVEDVPCVGRDFTRYRPNGVAKNRLDRILVSHAWFAKWQGSAQYIMDRNFSDHCPVLLKINNVDWGPKS

SEQ ID NO: 125044 - protein, 556 aa, Glycine max
  Coding DNA Sequence Number=SeqID_8266
  Gene Ontology: Mol. function=sequence-specific DNA binding; Cellular component=nucleus; Biological process=regulation of transcription, DNA-dependent
  Homolog annotation: Hit_ID=Q8LLD8; Match level="QueryCoverage=85%, HitCoverage=72%, E-value=1e-125, Identity=52%"; Hit description=BEL1- related homeotic protein 30
  Pfam annotation: Domain name=Homeobox; Domain location=403-461; Score= 8.2; E_value=0.00069; Accession=PF00046.19; Description=Homeobox domain
  Pfam annotation: Domain name=POX; Domain location=206-353; Score =217.1; E_value=3.9e-62; Accession=PF07526.2; Description=Associated with HOX
  Pfam module annotation: Pfam domain module=Homeobox::POX; Domain location=403-461::206-353
MATYYTSSSNERDAVPMLCLREPLPDSYPETPILPSNMSLYMNSGSYSEALSGNSQPQNNCFVIPSPSVGASHSTPEQQEILANIGGFQTGVHDFSAWREGRSEMLVRQTMDGQNLQGQGLSLSLGTHIPSGIQMPSIHDRNHRPSFDSFLGTNPSSSGNEAAYQKGSSRDEGMRHSENLPPGLPEANQDLDKADFSIHRMSSVGRTVPSFKYLKAVQLLLDEVVDIRKAIKRPVVRSYSTHENSKKNSNEDDEQLENDRPSANGVPNSQASTSKTSCELSHAEKQDLHHKLTKLLSMLDEVDNRYKQYYQQMQIVVSSFDVVAGCGAAKPYTALALQTISCHFRCLRDAITGQISATQKNLGEQNASGSNKGVGMTRLKYMDQQIRQQRVLQQLGMMQHAWRPQRGLPESSVVILRAWLFEHFLHPYPKDSDKIMLAKQTGLTRSQVSNWFINARVRLWKPMIEEMYKQENCDADMDSSSSSENVSKVTKSDVKTSNDMGDDWQHCQSPIVADTNHIGGQAKDLRHDQALDTEIMSSTGLASLINGVRGVETEHR

SEQ ID NO: 125045 - protein, 130 aa, Glycine max
  Coding DNA Sequence Number=SeqID_8267
MAELYIYQYNLDYIYSLSTTVSAFSVASDITAEGFTVLSFLDEVSMIYKNVGLSLTQPQKLVQKVRTDLLPLIWLYSRQVIMSLRCLVSLLLVEGHPLLEPPETGHCLLVPRALLARKTPCLSTLIEILV

SEQ ID NO: 125046 - protein, 262 aa, Glycine max
  Coding DNA Sequence Number=SeqID_8268
  Gene Ontology: Mol. function=helicase activity; Biological process =viral genome replication
  Homolog annotation: Hit_ID=Q2R1R7; Match level="QueryCoverage=99%, HitCoverage=16%, E-value=2e-53, Identity=45%"; Hit description=AT hook motif-containing protein, putative
MWYDERISKNKNFQNPRFSLCCGDDKVELPLLQNPPEYLQQRLFHDDTIDSKNYQHNLRAYNMMFAFTSAGIKLDKTINNSRGPPTIRIQGQPCHRIGSLLPMPDKKPKFAQLYIFDTENEVQNRINVMSQYSGIQNHIVSALSHMLDQHNSHAKSFRMARDRLAVDQANNIKLQLIATRGKDGRVYNMPNVPEIAGLIVGDFHPGSKRDIIVETQNGELQKIHELHPSYLPLQYPLLFPYGEDRYRADILHRCTSSSKKRK

SEQ ID NO: 125047 - protein, 516 aa, Glycine max
  Coding DNA Sequence Number=SeqID_8269
  Gene Ontology: Biological process=protein localization
MDVHKLPGCGIWISVQQTTIVISCEEGKMDLLTDLSRILSSVFEFKNSVGYNIDHIVLENLLLRSINCLHEISILGCLFTLCLSGIQNTSSSGTASKTFGGFNANGNTSYSVRETNLTASERLSNQSSQSVIKMGSPTNISMPASASHWLLIDVAITNIFIGRCSLKSDLIEAHKLNKLHSLLSIGGEFHMISWKVQGGFIFLETTSLAMAIDNYSSYLHCIGNLTSDARQPNKGTKKDEDGNNTLDDVIDQGTASTSQQASRRLPDAFQLSLSDFVFVLALENESGGIQEIMVEVDIHLNFELATTGRKLTIDLSRLSILSQIMQGRVEDETAIPHFSSVSSKDLSSQLTSADPISGFQNFGALNSVSEASSSKNIVPVQLSHQNQILKNLRAFMSLERPDNGTMHLSRCWFGIGSLSGFDMTLSVSEIQTILLLYSTLSGISSQNTIKNLERNHWSTSHEVDNSLEAMIPDGAIVAIQDVNQHMYFTVEGEEKNFSLGGVMHYSLVGERALFMV

SEQ ID NO: 125048 - protein, 355 aa, Glycine max
  Coding DNA Sequence Number=SeqID_8270
  Gene Ontology: Biological process=protein localization
MGVPLRLNFQPGSCFVDISCTNDGGCALWRVYPPQGENYVGITDSEASNQSMKRTFYLVNKKNDSAIAFVDGALEFVRKPGSPIKFKVFNDITAAYGVSETASYPRMAPQTTLRTDEESTSWQGGKHPCIDIRIEKISLNIVHELSDTEYLFPLICLFINNTQLIIQTLATKSRVISTSSAVAHYFDAERNLWGELLHPVEICIFYRSNIQAQLSEYRSHAVPVNFFCRMKEMDVYLNENSLDVLLFVIGILNLSGPYSLRSSIIQANCCKVENQSGLNLVVHFDQQSITIPRKQSASILLRRISDFKHQASEATSISIQLTDFGSFATSSNHLLLSRTQTLAWRTRIMSTEGFS

SEQ ID NO: 125049 - protein, 122 aa, Glycine max
  Coding DNA Sequence Number=SeqID_8271
  Gene Ontology: Mol. function=structural constituent of ribosome; Cellular component=large ribosomal subunit; Biological process =translation
  Homolog annotation: Hit_ID=Q2HVI3; Match level="QueryCoverage=45%, HitCoverage=23%, E-value=1e-17, Identity=78%"; Hit description =Peptidase, cysteine peptidase active site; Ribosomal protein L30
MVHRVEPYVTYGYPNLKSVRELIYKKGYGKLNKQRTALTDNSIIEQLYANIIYCIEITPLVSRIPSAREVKLKRQALYVEAHYQSEPRDRNNNNRARGQNSKLGGIGGNKAQKKNCQTILPQ

SEQ ID NO: 125050 - protein, 201 aa, Glycine max
  Coding DNA Sequence Number=SeqID_8272
  Homolog annotation: Hit_ID=Q1S049; Match level="QueryCoverage=94%, HitCoverage=77%, E-value=9e-46, Identity=49%"; Hit description=Zinc finger, LRP1-type
  Pfam annotation: Domain name=DUF702; Domain location=17-147; Score =191.0; E_value=2.8e-54; Accession=PF05142.3; Description=Domain of unknown function (DUF702)
MSLGVKDQMQRVRQGEEEVASGGSKCQDCGNQAKKECSYLRCRTCCKNKGFHCQTHIKSTWTPVDHRRRHFQGQGGDHHIPQNQNQINPYSGLELRFPAATNSMATFRCIHVRSMDDAVNEIAYQTSVNIGGHVFSGLLYDQGPEYQRGHQGESSTGFVDKQQNNNNNNLDSSGASATHQEYPFPLSSFRPGMPYLTYPRS

SEQ ID NO: 125051 - protein, 184 aa, Glycine max
  Coding DNA Sequence Number=SeqID_8273
  Gene Ontology: Mol. function=sequence-specific DNA binding; Cellular component=nucleus; Biological process=regulation of transcription, DNA-dependent
  Homolog annotation: Hit_ID=Q5VKS3; Match level="QueryCoverage=63%, HitCoverage=55%, E-value=1e-46, Identity=74%"; Hit description=MADS -box protein GmNMH7
  Pfam annotation: Domain name=K-box; Domain location=54-142; Score =21.7; E_value=6.6e-06; Accession=PF01486.8; Description=K-box region
  Pfam annotation: Domain name=SRF-TF; Domain location=9-45; Score =24.9; E_value=0.00028; Accession=PF00319.9; Description=SRF-type transcription factor (DNA-binding and dimerisation domain)
  Pfam module annotation: Pfam domain module=K-box::SRF-TF; Domain location=54-142::9-45
MARGKIQIKRIENTTKKANKLTILCDAKVSIIMFSSTGKLHKIEQSTKQFFDQYQMILGVDIWNSHYENMQENLKKLKEVNRNLRKEFRMGDCLNVEDLRLLEEGMDKAAKVVRERKDIGTYDWPVEECHYCCRYLVCMILVALTGEKGKFNELLEDKGVNILIDPKALMNVIGTKMDFVDDKL

SEQ ID NO: 125052 - protein, 132 aa, Glycine max
  Coding DNA Sequence Number=SeqID_8274
MAVLRVVALPAQGAGTLPRRVINERKGQRRTRRVVNDIHGSSTKKNKEYQEKLPLVVLKAVEIIYSKANSVILHVVKVPLSPFIEFLKLTTCTLLREMDIGHNPSIGAEPLYPCSAGLSLLSQPTLRWEGDA

SEQ ID NO: 125053 - protein, 45 aa, Glycine max
  Coding DNA Sequence Number=SeqID_8275
MEVCTFCRRVQESLTEVDLSIENNVSDDNELKDEEDCDSEVLNDE

SEQ ID NO: 125054 - protein, 363 aa, Glycine max
  Coding DNA Sequence Number=SeqID_8276
  Homolog annotation: Hit_ID=Q1SFS3; Match level="QueryCoverage=46%, HitCoverage=33%, E-value=1e-18, Identity=34%"; Hit description =Lambda repressor-like, DNA-binding
GLDVTSLKELGRLMGPLQRQAFHKVYRKILDLTATEVFTEVIVSLAQYYDQPLRCFTFRDFQIVLTIEEFEEILGCPLGGRKPYLFSGFLPSLSKIAAMVGDSTRELDHMKQTRNGVVGLPRKYLEGKARDMANQEEWVPFADILALLIFGVVLFPNVDGLVDLAAIDAFLAYHHSKESPVLGYPMRGAPTEESPLRKDKELRGIRNGIIGGYHEWLRVHTRGLDWLSKLKIINKENFEAPEEDEEVQALKSELGKARLSKEKFKSAATNIRKECAELREENAATTRALEQETKRARKEEHGRDKFRGALWGSNNELKLRREERDQSRVHGMVLKEELAACSRSKRSLAQHLEATKQSMLAII

SEQ ID NO: 125055 - protein, 87 aa, Glycine max
  Coding DNA Sequence Number=SeqID_8277
MAPLPGNLDSLEECSDLIPIDLDINATCRRCNSERISIFLQDLEVAATPEEEPRSSEASSSFPIAGHSHIGPVEDPIMAKEPRRVTL

SEQ ID NO: 125056 - protein, 106 aa, Glycine max
  Coding DNA Sequence Number=SeqID_8278
MGETHEIPHHNLANFEPWLGYATEGQAVGGIPFENTLEGPQFRPQPQPLHFAVGRAPPAMAEKGKANHLKERLRAIEGGEDYAFANLEKLFLIPKHGHSQVQGAGL

SEQ ID NO: 125057 - protein, 85 aa, Glycine max
  Coding DNA Sequence Number=SeqID_8279
MPPDTPDTMEARRKWKVKYGKMLFVLRMTINKELIDHIRDLDTPKDVWETLEKLFSKKNVARLQLLENELASTMQDLSEKISEAR

SEQ ID NO: 125058 - protein, 174 aa, Glycine max
  Coding DNA Sequence Number=SeqID_8280
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=1e-14, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLQFRGLDLISFTGLHVLAFRGLHALAFRGLQILAIRGLHALTFRGLHDPTFRGLHDPHLQRTTRSHLQRAARPRLQRTTRTRLQRAARPRLSSPSEDHMSSPLEDYASSPSEGCRLPRSEDYMSSPSEDKTPPASEGYTPAPSEDFESSPLGGCIPSPILTFRELLVLTM

SEQ ID NO: 125059 - protein, 111 aa, Glycine max
  Coding DNA Sequence Number=SeqID_8281
MSDSGTQYIKMLEVKHGSTRQIQMAITFDLDSNISRRSNLNNGSSRQTRQKYIESLKIEQQKLSRNSNRHKFSLGCLIQAHNISRCLKFKMEATGKLKRPQLLTRMSDLGQ

SEQ ID NO: 125060 - protein, 225 aa, Glycine max
  Coding DNA Sequence Number=SeqID_8282
  Gene Ontology: Mol. function=N-acetyltransferase activity; Cellular component=intracellular; Biological process=metabolic process
  Homolog annotation: Hit_ID=Q1M7S6; Match level="QueryCoverage=76%, HitCoverage=92%, E-value=9e-48, Identity=57%"; Hit description =Putative acetyltransferase
  Pfam annotation: Domain name=Acetyltransf_1; Domain location=98-176; Score=54.7; E_value=3.1e-13; Accession=PF00583.14; Description =Acetyltransferase (GNAT) family
MPCKPASKEAPLKEDTVRWRLFAPTQQSRAAFVQRRLSMVDIIVQSSLLDPAAQPLIDGLAHEYDLRYADLDRSGGARAEILRYPTDAFAPPLGGFLLLQRDGETIAGGAYMSHDDETVELKRIWTASHLRRQGLARRIVLALEESAGNLGYTRAYLSTGFRQPEATALYIALGYRPLFDTSVDVLQYRSLPFEKHIGTKLGQPISSPLYPASASFEEATQRVQE

SEQ ID NO: 125061 - protein, 105 aa, Glycine max
  Coding DNA Sequence Number=SeqID_8283
  Gene Ontology: Mol. function=monooxygenase activity
  Homolog annotation: Hit_ID=Q1BW35; Match level="QueryCoverage=99%, HitCoverage=26%, E-value=9e-36, Identity=65%"; Hit description =Luciferase-like
MPYALSFLDKSPIHDGEAAQTALARTIKLAQKAETAGFHRFWVAEHHNSPELASSSPEVLISFLLAHTKHIRIGSGGVMLQHYSTYKVAENFNLLSSLAPGRVDL

SEQ ID NO: 125062 - protein, 111 aa, Glycine max
  Coding DNA Sequence Number=SeqID_8284
MAKIQGPKEGKPYSNIYKEEWTQPWHMDPYIYPEVLENTRAMSKRLQEDWARAAEEGPRVLMNLRFKVQNSFEAQNFVLLLSFSLYPSSPTFKILSMASYGGELLLDSSSP

SEQ ID NO: 125063 - protein, 106 aa, Glycine max
  Coding DNA Sequence Number=SeqID_8285
  Gene Ontology: Mol. function=DNA binding; Biological process=DNA integration
  Homolog annotation: Hit_ID=Q1SIT1; Match level="QueryCoverage=89%, HitCoverage=32%, E-value=6e-15, Identity=44%"; Hit description =Integrase, catalytic region
AGEERKLQLSELDEIRLEAYKNSKFYKEKTKKFYDSLIAKKEFVVGQKVLLYNFRLRLMSVEIKSESIDKSFKVNGHRLKPFLTNPSFLDVVVEETSLLHPTFLPP

SEQ ID NO: 125064 - protein, 60 aa, Glycine max
  Coding DNA Sequence Number=SeqID_8286
MAETEIATNPSPWRRKSSRFLYPGQAIGSLVWLPVELIPALAERLPCRPIPLPFVSYPPI

SEQ ID NO: 125065 - protein, 73 aa, Glycine max
  Coding DNA Sequence Number=SeqID_8287
MWGTLAIIYEEMSQLDERLKKGKSRALNSQKTKKASSSREKGFKSSSKAIKAKKSLDKEYEELSDEYELAFIS

SEQ ID NO: 125066 - protein, 95 aa, Glycine max
  Coding DNA Sequence Number=SeqID_8288
  Gene Ontology: Mol. function=iron-sulfur cluster binding; Cellular component=mitochondrion
  Homolog annotation: Hit_ID=Q1S6K5; Match level="QueryCoverage=67%, HitCoverage=49%, E-value=8e-18, Identity=63%"; Hit description =HesB/YadR/YfhF
  Pfam annotation: Domain name=Fe-S_biosyn; Domain location=2-69; Score= 4.1; E_value=0.00058; Accession=PF01521.11; Description=Iron-sulphur cluster biosynthesis
MKELEASESSAYKKMLPLSVETGGCVGFQVFERDGIKLVVDNISYDFVKGTTVDYVEELSSHSFLHRYYNTELHHNFSMMTLSLLEPPSLQMIPV

SEQ ID NO: 125067 - protein, 198 aa, Glycine max
  Coding DNA Sequence Number=SeqID_8289
  Gene Ontology: Mol. function=hydrolase activity
  Homolog annotation: Hit_ID=Q2I313; Match level="QueryCoverage=80%, HitCoverage=60%, E-value=2e-31, Identity=44%"; Hit description =Cyclase
  Pfam annotation: Domain name=Cyclase; Domain location=59-185; Score= -49.1; E_value=0.069; Accession=PF04199.3; Description=Putative cyclase
MNCLSLFTFLYAICAHSITSTTYPSILDMKTGECSLRSISIGDGVLVPPWREVYEERRIFDITHRYVPEMLVWDSTEGLGHHFLWLEKSMKNGSRANNSNMKVGVHTDTHVDALGHIYNNYYDVDFVVDSLDLTLLNAEVTKSLNIPRGVSHVLFRTLNTDRLAVHLNLLTCTQVVREWRGGGRWWSLYSETRLAYYQ

SEQ ID NO: 125068 - protein, 104 aa, Glycine max
  Coding DNA Sequence Number=SeqID_8290
MVPEAKGSNVSRLEVINFPGALQNKKPKTSTTLPSQTAARSDTTQKGHDFGYVAVVGTTRGAEVRKRGNVGFLLWRSGKRHNVKVVRGTFRQNSRRELRFFVRQ

SEQ ID NO: 125069 - protein, 72 aa, Glycine max
  Coding DNA Sequence Number=SeqID_8291
MYYQCATVVSDVVFTCAVWVFEFAVGVLPSAVVGDFVFPNFLVVMRVGRRRRKKEWSERRDSSFGRGILELI

SEQ ID NO: 125070 - protein, 44 aa, Glycine max
  Coding DNA Sequence Number=SeqID_8292
MKQAQSNTRAERALRAKPMIQQKRALSPRSNRSGLDARERVTSK

SEQ ID NO: 125071 - protein, 114 aa, Glycine max
  Coding DNA Sequence Number=SeqID_8293
MEEGSFVKTYERTFFRMNDFHTKTPAEECSFVFQKLFVSYVEAMSPKKVHLLGDCYTENKRGYISCGSVQVEGTPTWLFKENKGGYIPCGSLACKGFYKVERNLKNRRLLGDWM

SEQ ID NO: 125072 - protein, 542 aa, Glycine max
  Coding DNA Sequence Number=SeqID_8294
  Gene Ontology: Mol. function=long-chain-fatty-acid-luciferin -component ligase activity; Biological process=bioluminescence
  Homolog annotation: Hit_ID=Q2KXJ0; Match level="QueryCoverage=64%, HitCoverage=95%, E-value=1e-106, Identity=57%"; Hit description=Acyl- protein synthetase
  Pfam annotation: Domain name=LuxE; Domain location=181-536; Score= -41.1; E_value=1.9e-07; Accession=PF04443.3; Description=Acyl-protein synthetase, LuxE
  Pfam annotation: Domain name=Peptidase_M15; Domain location=1-113; Score=55.7; E_value=1.6e-13; Accession=PF01427.8; Description=D-ala -D-ala dipeptidase
  Pfam module annotation: Pfam domain module=LuxE::Peptidase_M15; Domain location=181-536::1-113
AQWHLWDACPDADYVVPPARGSNHSRGVAIDVTLMDEAGNILEMGTGFDDMSAESHPFHPNVPQQAQRHRLLLNAIMLGGGFVGMPTEWWHFELPDAQNYPLLSDRFACVSRADRAPRGVLRLPALTRPPFRPQNAACSKGCPGCGTGVTARPHSLFAPFCESCAFLRPWLAVMPQSKEGTFMTEASIIATLLAFMQREETTEADFNQLALQLFAWQFEHNLPYARFARQRGRTPLTVKQWRQIPAVPITAFKDLTLSCRPVAEIPHIFMTSGTTGTGRGRSYHPTLAVYDLSMLINFRQRFMAGYPRLPMAILFPHSSELPHSSLAHYLTLAMQECGTPDSEVMVDAQGLKLPRLIAALEQAQASGQPYALLGASYSFVHLLDELARQQRRFRLPPGSRILDTGGFKGQSREVAAEAFYSALQQTLGVPRSHCINMYGMTELSTQFYDAGNEICPPVKSGPHWIRTRVVNPLTGADVPEGETGVLVHHDLAHFNSVSAILTEDAGVMVPGGFQLLGRVAGADAKGCSLAMESFLAAAQARA

SEQ ID NO: 125073 - protein, 495 aa, Glycine max
  Coding DNA Sequence Number=SeqID_8295
  Homolog annotation: Hit_ID=Q1T242; Match level="QueryCoverage=40%, HitCoverage=37%, E-value=1e-32, Identity=44%"; Hit description =Homeodomain-like
  Pfam annotation: Domain name=La; Domain location=331-388; Score =113.4; E_value=6.5e-31; Accession=PF05383.7; Description=La domain
VLVLNITDSTGKGKSWELGGLQREKKAVMVIAENEIGEDQKEIGAPKSPWKTPTVDGKGGDVSVMMGTESWPRLSDAQRPPKNLETAAAAASVTSAGEIAPRPPSMQKVNGAGNVNPVHKLPLSRHQKPGAKRNSNGGPPFPVPIPYHQPVPPFFHPMVPPPHVAVPGYAFPLGPGPFPGAENPLVKPVSQAPGQAFAPPAHAVDGKNVQPLVRGDPNAYVGNFSNGRTNIQEQGDHLNHAWHHQRPFPSRVNIPMQQGLGPRPFIRPPFYGPPPGYMVGPSFPGPAPVWCVPMPPPGSIRGPHPRHFVPYPVNPTPQPPPPETVSLRTSIVKQIDYYFSDENLQNDHYLISLMDDQGWVPISTVADFKRVKKMSTDIPFILDALQSSNTVEVQGDKIRQRDSWSKWIGASSGNSGSSTAQVQQGQLVDGAFNSLENSDAVGDKMKEISEENPKDAVHDSIFEEHNQPNRDMLQVSLMNQEKNNEGHRSNDKSHE

SEQ ID NO: 125074 - protein, 137 aa, Glycine max
  Coding DNA Sequence Number=SeqID_8296
  Homolog annotation: Hit_ID=Q1SMF0; Match level="QueryCoverage=96%, HitCoverage=28%, E-value=3e-12, Identity=29%"; Hit description =Tetratricopeptide-like helical
MRSDTNTGVRGKASFLLMNCKRSCEYRPKKIDLVRTCTDTRKCGCPFKLHAKPVLSLVGHPYAGRLTKDEKIVVVDMTKSMVKPRNILLTLKEHNANNYTTIKQIYNARHAYRSSISGSNTKIQQLMMLLDRDQYIH

SEQ ID NO: 125075 - protein, 295 aa, Glycine max
  Coding DNA Sequence Number=SeqID_8297
  Gene Ontology: Mol. function=RNA binding; Cellular component =ribonucleoprotein complex; Biological process=RNA processing
  Homolog annotation: Hit_ID=Q00SY0; Match level="QueryCoverage=96%, HitCoverage=32%, E-value=6e-17, Identity=26%"; Hit description=[A] KOG4213 RNA-binding protein La
MDVLTEMDVRDLSNDFGNTFMLDEEIELEQKMLRKTELSSSGRNDDEDDEMAVIEQDVQRLVIVTQNGDPKQRSRGGGKESISISNELASAINDGLYFYEQELKHRRSNRRKNNSDSRDQNIKSPSRNSGASNIKAVENIGGNCVEESGSYNSRRKQKVFHKQPSSLKQRFFSSNFRNHGTGRNSHGIISESPPSNSVGFFFASTPPENHGFKPSKLSSSPHGGFSGSPRGGFAGSPHGGFAGSPPVGSMPKSFPLFQHPSHQLLEENGFKQQKYLKYHKRCLNDRKKLGIGCSE

SEQ ID NO: 125076 - protein, 127 aa, Glycine max
  Coding DNA Sequence Number=SeqID_8298
MILHRVWNSSIFCFLPLNLTCILIPLWRMQFSSAGGGSNERFNGQKLMEDAIFFFWSWFKHLEKGFDIPFHSWASNIRMSLAIKKILYAADAKGSALDEAQEYLNDVINGGEDEAEAEAEAEVETEA

SEQ ID NO: 125077 - protein, 59 aa, Glycine max
  Coding DNA Sequence Number=SeqID_8299
MNADDLKRDSVTRSLHSFNSGISEHLFTSSHSSGGFVLLAALGRLMMWCGVVTWRAEIR

SEQ ID NO: 125078 - protein, 167 aa, Glycine max
  Coding DNA Sequence Number=SeqID_8300
  Gene Ontology: Mol. function=oxidoreductase activity; Cellular component=fatty acid synthase complex; Biological process=metabolic process
  Homolog annotation: Hit_ID=Q1T231; Match level="QueryCoverage=97%, HitCoverage=99%, E-value=1e-66, Identity=77%"; Hit description=MaoC -like dehydratase
  Pfam annotation: Domain name=MaoC_dehydratas; Domain location=24-140; Score=61.5; E_value=2.7e-15; Accession=PF01575.9; Description=MaoC like domain
MLVRNLHCHKVHSLSLRCFTSGTPNVLKPGDVLRKARVYTDEDVLQYSKVSCDSNPLHTDSAAAKDVGFEGPLVHGMLVASLFPHIISSHFPGAVYVSQNLNFKFPVYIGDQIIGEVQATNLRENKNRYLAKFKTRCFKNGDLLVIDGEAVALLPTLTVEQIQHEKW

SEQ ID NO: 125079 - protein, 177 aa, Glycine max
  Coding DNA Sequence Number=SeqID_8301
  Gene Ontology: Mol. function=transcription regulator activity; Cellular component=nucleus; Biological process=regulation of transcription
MEKTEMVEDNSSLKTQIEKLLGEIKARVTQSRPDLNAPLHLELQQQEKATKFTGESLQLSTTEPTLQQGHEVLIVPLSHQHQDALSTHNVAEVTPKPTSTIRKPHARYPTPMDSWPLQLLAEQPTSIGNQNIQWENAFVGHRLVAGHLAIDHLVGHCLVAVVGLTGVGPDAARKVVD

SEQ ID NO: 125080 - protein, 130 aa, Glycine max
  Coding DNA Sequence Number=SeqID_8302
MTKIPGTEKGRNHKKLGIGNNEHVGEGSGTQKCLKFVFKELSNQAKKLQPLGFPHGRENNDFTKQQPFDFLAKPTKWKKKTQQDRREKNTKEWRGIEDSEEWRGMEKNENGKRRVEKQWETDRGQKQNSK

SEQ ID NO: 125081 - protein, 164 aa, Glycine max
  Coding DNA Sequence Number=SeqID_8303
GPARGVDTVKVTQQLMALFSQMQSQMQSQGLALPLEPLVGPSGPRVSTKESCVDPSGNDPETGDSNRCGLYIEANLARLVALGRVYEGSTVVHNTPLLPGQVKVGNSHLLCLADTSGKAFIRMVVSPAKPPQKSDPEVDDPLYLMTLTIRELFLRPYQVTWDAT

SEQ ID NO: 125082 - protein, 104 aa, Glycine max
  Coding DNA Sequence Number=SeqID_8304
GAFKVQSGLERMVDFFDKVPLLNIERAGHGSKRKKPDTIHLEDENAQAKKAKAPTPSTLGSPLATEYVEDKIKEVEKNEEALLAWVVKAENFTKALEAMVKRLN

SEQ ID NO: 125083 - protein, 91 aa, Glycine max
  Coding DNA Sequence Number=SeqID_8305
DIQIDEPVVFSSPQKIDIDKRDKGKGTDRQKFLEEASTDLKPKARTADKIKAKYRKTGTWDASAAAALARDKLVERQEKLQEQYEIKRKDD

SEQ ID NO: 125084 - protein, 68 aa, Glycine max
  Coding DNA Sequence Number=SeqID_8306
MTIICLCVPSDTIVSEWRKGPPPLDDKRRRMTIICLCVPPDMIVSEWRKGERNDHNLSPHVIGPAASG

SEQ ID NO: 125085 - protein, 539 aa, Glycine max
  Coding DNA Sequence Number=SeqID_8307
  Gene Ontology: Mol. function=ATP-dependent helicase activity; Cellular component=nucleus; Biological process=translation
  Homolog annotation: Hit_ID=P41380; Match level="QueryCoverage=81%, HitCoverage=98%, E-value=1e-158, Identity=84%"; Hit description =Eukaryotic initiation factor 4A-3
  Pfam annotation: Domain name=DEAD; Domain location=57-283; Score =181.7; E_value=1.7e-51; Accession=PF00270.19; Description=DEADDEAH box helicase
  Pfam annotation: Domain name=Helicase_C; Domain location=351-424; Score=113.3; E_value=7.2e-31; Accession=PF00271.21; Description =Helicase conserved C-terminal domain
  Pfam module annotation: Pfam domain module=DEAD::Helicase_C; Domain location=57-283::351-424
MATTSVVPANRRRAANPAEEMDFETTEGVKAIASFEEMGIKDDLLRGIYQYGFEKPSAIQQRAVTPIIQGRDVIAQAQSGTGKTSMIALTVCQVVDTSVREEEILVRCWERVQGFKLWSRFHCVPLNCGLMRPVQLQLQLRCGQAPINLDVVTEIGIFQSRVQALILSPTRELASQTEKVILAIGDFINIQAHACVGGKSVGEDIRKLEYGVHVVSGTPGRVCDMIKRRTLRTRAIKMLVLDESDEMLSRGFKDQIYDVYRYLPPDLQVCLISATLPHEILEMTNKFMTDPVRILVKRDELTLEGIKQFFVAVEREEWKFDTLCDLYDTLTITQAVIFCNTKRKVDWLTEKMRNNNFTVSSMHGDMPQKERDAIMGEFRAGTTRVLITTDVWARGLDVSLVINYDLPNNRELYIHRIGRSGRFGRKGVAINFVKSDDIKILRDIEQYYSTQIDEMPMNLSYSSCGKNRGFKETSHIFVCICVDNAMFKMDWDQESLRSKNSQIVKEYYIKGSTELPDQKCFKGSLTFQILKARLARLAR

SEQ ID NO: 125086 - protein, 49 aa, Glycine max
  Coding DNA Sequence Number=SeqID_8308
MVNKPSEFNIHRKVKRNWKGGFVSSIKEFQSRSDGPTTLRAIGLRSTPN

SEQ ID NO: 125087 - protein, 552 aa, Glycine max
  Coding DNA Sequence Number=SeqID_8309
  Gene Ontology: Mol. function=protein dimerization activity; Cellular component=chromatin; Biological process=DNA integration
  Homolog annotation: Hit_ID=Q2R1C3; Match level="QueryCoverage=96%, HitCoverage=84%, E-value=1e-120, Identity=46%"; Hit description=HAT family dimerisation domain containing protein
  Pfam annotation: Domain name=DUF659; Domain location=127-261; Score =31.4; E_value=6.6e-10; Accession=PF04937.6; Description=Protein of unknown function (DUF 659)
VKSSYSRVKAHLLSICGSGIATCLKVTDAYLVDLRRVCEETENRLKSKNVPLPTDKRTPTPPTLPPKRRKSSNIESAFNIEDRNHLRAEIAMMFYSAGLSFHLVRNPHFVSSYSFAANCNLSGFLPPSYNALRTSLLQQERRPLINFMAISEEGPMFLKAIDGSKEYKDKHYMFDLLKDVIKEVGPQNVVQVITDNAPICKASGLLIEAEFPHIFGTPCVVHTLNLGVKNICAAKNVDGNDNVFNECGWIAEVIGDASFIKVFIMTHSMRLAIFNEFSSLKLLSIAETRFASMIVVLKRFKLLKRCLQNMVISDQWNSYREDDVRKAAHVKELILNDIRWDNVDYILSFMDPIYSMIRICDTDASNLHLVYEMWDSMIEKVKATIYRHDEVLENEVSSFFEVINEILNSRWSKSCNPLHCLAHSLNSRYYSDNWLNEVPNRVPPHRDDELSSQRNKCLKRYFSHVNRNKMDPKRAEDLVFVHSNLRLLSRKEEGYKKGETRLWDINGDVHDPLDDSAGVLEMAYLSLDEPDLEAMLFLDDGNGGEENETIRV

SEQ ID NO: 125088 - protein, 120 aa, Glycine max
  Coding DNA Sequence Number=SeqID_8310
  Homolog annotation: Hit_ID=Q1RTJ9; Match level="QueryCoverage=81%, HitCoverage=28%, E-value=3e-11, Identity=41%"; Hit description =Cyclin-like F-box; F-box protein interaction domain
MLGYHLVGSCNGLHCGVSEIPEGYRVCFWNKATRVISRESPTLSFSPGIGRRTMFGFGYDPSSDKYKVVAIALTMLSLDVSQKTEMKVYSAGDSSWRNLKGFPVLWTLPKVGEVYFEWNP

SEQ ID NO: 125089 - protein, 51 aa, Glycine max
  Coding DNA Sequence Number=SeqID_8311
MINAGMICPLRCHEEMHDAIKEPARGLSATMHHQKRKTLDEASLSSNESET

SEQ ID NO: 125090 - protein, 91 aa, Glycine max
  Coding DNA Sequence Number=SeqID_8312
  Gene Ontology: Mol. function=nucleic acid binding; Cellular component= intracellular; Biological process=regulation of transcription, DNA -dependent
  Homolog annotation: Hit_ID=Q58A50; Match level="QueryCoverage=98%, HitCoverage=14%, E-value=2e-17, Identity=51%"; Hit description =Embryonic flower 2
MAWDCFPNFRLGQRAEIMSTVDLLPCILKSDFLNEDTRISIQVPSNFENMSTSKQVQITISAEEFGAKEKSPYLSYAGGEVPSSSLSHIIG

SEQ ID NO: 125091 - protein, 56 aa, Glycine max
  Coding DNA Sequence Number=SeqID_8313
MKKICSNLQGKDNAPPPPPQWIEAKYFSDGTALDTDTMTTLRKKWAAYFLEVGKWM

SEQ ID NO: 125092 - protein, 163 aa, Glycine max
  Coding DNA Sequence Number=SeqID_8314
MVANRACPCLPVWDSAKKKGFELYCKEEMPIRKMKVEIVNLPLNWSPLFHGKQLIRTSNADDARTFWSQIVWVVSKKASTFGYNGSGIVVHRDKKFDKDVVVVVKKEVLASIQVKSFAEVVDDTIVCRVIIDLTNISIMDKTGDTSNVVVVDEVEPHIQDPAS

SEQ ID NO: 125093 - protein, 120 aa, Glycine max
  Coding DNA Sequence Number=SeqID_8315
MEPQDEEEIHNCLIKLRSNPERRRDKVYIGCGAGFGGDNPLAALKLLQRVQELNYLVLECFAERTLADHYQIMMSGGDGYDSQMDPLGAQQKVLEIANSLGLNVSVAVAHEVFVTNIVGI

SEQ ID NO: 125094 - protein, 82 aa, Glycine max
  Coding DNA Sequence Number=SeqID_8316
  Gene Ontology: Mol. function=methyltransferase activity; Biological process=metabolic process
  Homolog annotation: Hit_ID=Q2SAC6; Match level="QueryCoverage=86%, HitCoverage=11%, E-value=1e-14, Identity=51%"; Hit description =Predicted ATPase
GINTYLGAAPIVPCLEKYQPNVIITSRIADAALFLAPMVYELGWNWDELEHLAQGSLAGHLLECCCQLTGGYFMHPACSLNS

SEQ ID NO: 125095 - protein, 111 aa, Glycine max
  Coding DNA Sequence Number=SeqID_8317
MKQCECECKNCTFRILNLRHESRGFREWMIKILERWMVGSARPYRFQVLAPWWDPAAGYCPNQLLFFCPFHGALAGIRVLINDPLKYGPPFNQAGPSIWRAILSIAALNDW

SEQ ID NO: 125096 - protein, 79 aa, Glycine max
  Coding DNA Sequence Number=SeqID_8318
  Homolog annotation: Hit_ID=Q1SCJ0; Match level="QueryCoverage=64%, HitCoverage=14%, E-value=7e-15, Identity=68%"; Hit description=TCP -domain protein
  Subcellular localization annotation: CTP_CleavageSite=59; ConfidenceScore=5.09e-01
ALYRGTMSSGLHFMNFPTPMALLPGQQLGSSGIGGNMNEGHLNMLSGLNPYRTTVIGVSESQASESQQSHHGGSEDQHE

SEQ ID NO: 125097 - protein, 358 aa, Glycine max
  Coding DNA Sequence Number=SeqID_8319
MALPRKNESSSIPSFNNIEDTSQAFPEDWFIPGKWVNFQSLKEEGFDVKGLFDRVGRTSFLENFNTWHYGPYALFWETARQDGVNIKGTFVRTQVVISLTTIIVVSACALDGLTMSKDWEKEITLETMDKLLYGKPHPDRNGNKALNTFLRIANLTYLCRMIHNVLFNTVMPRLHSRHYVSDRDHFCICKIMVGEKVQPQGGEKSYSLWNALHLDSEASWSGGFFDGAIIWSHSTQEELAKPSQPRHKLPTKRKDHPPSSNPKPPTSAKKPRTQPPSNPKKRTAHHFWAKHNISALNAIEEYGRPSISRPCAKHEICLQSAAVVFSQAQRMTGANSNPLTHAKHEGGAKRNVVDLEPI

SEQ ID NO: 125098 - protein, 125 aa, Glycine max
  Coding DNA Sequence Number=SeqID_8320
  Subcellular localization annotation: CTP_CleavageSite=56; ConfidenceScore=5.21e-01
MGSSKKQKVMEKINCSSNAVVPLEKPGSQIHMGRRRSVRKRNPAVATTSMLEKLVDSQNDSDIYELLPKMEKQGSQVHMGRRRSVKKGNPAIAMPSSILEKLVDPQNDSDIYEHLPKMEVLPNCN

SEQ ID NO: 125099 - protein, 1040 aa, Glycine max
  Coding DNA Sequence Number=SeqID_8321
  Gene Ontology: Mol. function=RNA-directed DNA polymerase activity; Cellular component=extracellular region; Biological process=RNA -dependent DNA replication
  Homolog annotation: Hit_ID=Q1S7B8; Match level="QueryCoverage=73%, HitCoverage=95%, E-value=1e-115, Identity=32%"; Hit description=RNA -directed DNA polymerase
  Pfam annotation: Domain name=Exo_endo_phos; Domain location=1-231; Score=-7.5; E_value=0.036; Accession=PF03372.13; Description =EndonucleaseExonucleasephosphatase family
  Pfam module annotation: Pfam domain module=Exo_endo_phos::RVT_1; Domain location=1-231::452-747
MIILSYNVRGLGRGVKWPGIRRLVKEHHIDMLCIQETKKEIVEKSMCQVLWGDSGFSWESYPSSNADGGILCIWNEKSFKVESRTSGAGFIMLTGKWCQETQPRHIINIYSPCSLQDKRMLWERVKQLKNQNPGGWCVLGDLNNIRTAAERVSTFQGGTVDGSIRDFNEWIEEMEVEEVPWVGKSFTWFKPNDPTMLIGVQSLYEYYTADLQTSPSRNWFKKAGHLINGVVGGDVIKQKIKALKAKIKVWNKEQFGDTYSKYKKIEEDLNKMEEESEERQLNHNELLLRKQLQQELWEAAKAHESLLRQKARSKWIKEGDCNSRFFHLMINARRRSNCLNGVLIDGVWIEEPAIVKEEVRRFFMQRFQENDHARPTPDDIRFQTIDTQHNDMLVERFGEEEVKRAVWSCGSDKSLGPDGLNFKFIKQFWDIIKSDFLRFLDEFHANGVFPRGLNASFIALIPKTVDPQLLNEYRPISLIGCTYKILAKVLANRMKKVMHLLINERQLAFIEGRHMLHSVLIANEVVEEAKRGQKPCIIFKVDYEKAYDSVSWEFLIYMMRRMDFCAKWIHWIAGYLKSASVSILVNGSPSSEFIPQRGLRQGDPLSPMLFNIVAEGLNGLMTNALEKRVHKKVENKIVRLQRKFLWGGASEQNKIAWIRWEKVCLPKEDGGLGVKDIRSFNTALLGKWKWKLFQKQGELWARVIESKYGGWRSLNEAPRANNESIWWKDLKNVSQHPQQGKLLNTLISWKVGRGDKFKFWEDNWTGGDNRLLEKYQRISVQQNQIIQHMGAYKETGWEWDFKWRRPLFDNEIDQAVAFIQEVEGIRIQNDIDDQWVWEADLSGRYSVKSAYSVLRQDVLEEAPAEEFKELWKLKVPSKVAMFAWRLLNDRLPTKDNWRRKQVELNDYLCPFCSSVEESASHLFFHCSKVLPLWWESLSWVNMVAVFPQHPRQHFIQHMHQSYEGLMATRWKWWWLSLTWSIWKHRNSIIFSSSTFNANKMMDDAVFLLWTWLRRHLEKGFVSHLNQWSSNIREGFRCNRG

SEQ ID NO: 125100 - protein, 433 aa, Glycine max
  Coding DNA Sequence Number=SeqID_8322
  Gene Ontology: Mol. function=nucleic acid binding
  Homolog annotation: Hit_ID=Q1RVN3; Match level="QueryCoverage=74%, HitCoverage=51%, E-value=8e-12, Identity=21%"; Hit description =Nucleotide-binding, alpha-beta plait
  Pfam annotation: Domain name=RRM_1; Domain location=64-134; Score =39.9; E_value=8.8e-09; Accession=PF00076.12; Description=RNA recognition motif. (a.k.a. RRM, R
MSLERESRERDCGWERVRNRRERRERARERTTEGPGLNIDRKWEGHQHSYQRANWREHKDVTSFYFTRFPKDTTEKDLWYHLKQVGDVRENFISPKRNRNGRRYGFVRFKGVEDVHQVKKKLDSMVFGGLKMYVNTPKFGRTHRVNSQSVVRGRMEGQHHTEGTRDMYLGMKQAANVKFPQGSYAEAVRRHTPRTEQRRTQAKENSRCCISTPSVSLEIPATGKQWLKGAWVGRLKNLALFDSLEDEMLWDIEETISPRYIGDDMVLLLGLTERKAQKVMEEEDAGWSDLFYSLEKWTPQLRLGYRLTWVQCWGIPLIAWDTQHIKQIVSSIGDMVDVDDDVEELRKLDRARILIKTPWKPFIQHTVNVQIRGELYVVHIVEESGKACANCQRRRCNGQSSSEEIQSEESDAGTLLGDVPPPWWNKPRLLDRT

SEQ ID NO: 125101 - protein, 92 aa, Glycine max
  Coding DNA Sequence Number=SeqID_8323
  Gene Ontology: Mol. function=galactosylgalactosylxylosylprotein 3 -beta-glucuronosyltransferase activity; Cellular component=membrane
  Homolog annotation: Hit_ID=Q50HW5; Match level="QueryCoverage=99%, HitCoverage=25%, E-value=2e-11, Identity=50%"; Hit description=Beta -1,3-glucuronosyltransferase
  Subcellular localization annotation: CTP_CleavageSite=47; ConfidenceScore=5.06e-01
MASFRRTLSPAYPDRQYLNASVLKRKVLLAAAGACGGVPSPRRRGVHAPARSEGAVEARGGQVRAVLLRWVLARHVPVRPRVGGRSLARILV

SEQ ID NO: 125102 - protein, 117 aa, Glycine max
  Coding DNA Sequence Number=SeqID_8324
  Gene Ontology: Mol. function=structural constituent of ribosome; Cellular component=ribonucleoprotein complex; Biological process =translation
  Homolog annotation: Hit_ID=Q2QD65; Match level="QueryCoverage=81%, HitCoverage=74%, E-value=7e-38, Identity=85%"; Hit description =Ribosomal protein S12
  Pfam annotation: Domain name=Ribosomal_S12; Domain location=2-116; Score=152.4; E_value=1.2e-42; Accession=PF00164.15; Description =Ribosomal protein S12
MGQKIDREKDFLFLLEDRDWIHICLSGSKGDLSVNFSTITPKKPNSALRKVARVRLTSGFEITAYIPGIGHNLQEHSVVLVRGGRVKDLPGVRYHIVRGTLDAVGVKDRQQGRSSAL

SEQ ID NO: 125103 - protein, 97 aa, Glycine max
  Coding DNA Sequence Number=SeqID_8325
MGRTLEDLWKDGGETSSIEEWSMSQMVNQLQHIKKGKGGILRGVLTANNQYTFEHRLKNTTHHQAQYKVKAKIIKRYHKPSTAGKATAGRARHGLLV

SEQ ID NO: 125104 - protein, 125 aa, Glycine max
  Coding DNA Sequence Number=SeqID_8326
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=Q43874; Match level="QueryCoverage=99%, HitCoverage=80%, E-value=8e-40, Identity=69%"; Hit description =Ribulose bisphosphate carboxylase precursor
  Pfam annotation: Domain name=RuBisCO_small; Domain location=59-117; Score=-31.8; E_value=0.073; Accession=PF00101.10; Description =Ribulose bisphosphate carboxylase, small chain
  Subcellular localization annotation: CTP_CleavageSite=16; ConfidenceScore=5.49e-01
MASSMMSSPAVTTVNRGSMVAPFSGLKSMAGFPVRKTKYDITSIASNTGRVWPRIGKKKFETPSYLPPLTREQLLKEDGWIPCLEFELECRKVLCTVRTTDHLDTMMEATNVWVHRLSSGVEGGS

SEQ ID NO: 125105 - protein, 227 aa, Glycine max
  Coding DNA Sequence Number=SeqID_8327
  Gene Ontology: Mol. function=nutrient reservoir activity; Cellular component=apoplast
  Homolog annotation: Hit_ID=Q9FLT3; Match level="QueryCoverage=53%, HitCoverage=73%, E-value=3e-26, Identity=43%"; Hit description =Putative germin-like protein subfamily 3 member 4 precursor
  Pfam annotation: Domain name=Cupin_1; Domain location=82-180; Score= -24.8; E_value=0.087; Accession=PF00190.13; Description=Cupin
MVMVAGKAVIMMMMMVLVIVEDTLIETQDQELNWAHISIYKLSRIIFSANIDTCPAVPPNKQIIFINGLQCKNPVNVAAQDFRTTKLSKADLTDIFGASLKIVSAAEFNGLNTHGLSIGKTDLDGKGLYFQKFLKVGDVFVFHKALFHFCLNTGFEEATVFSVYNSQNLGFVSLSPTTFDQHWSHWTRSRKDSSHFLPLKLKLKLSTVSSLQNWKPCTVSHLKLLSI

SEQ ID NO: 125106 - protein, 88 aa, Glycine max
  Coding DNA Sequence Number=SeqID_8328
MAIGWFKCENHQGRALCALRSEGILAQSQKLPHIHQWWFFGEAAWCTFESGLSQVRIRVTQNLEPMPCHLVHGDMSKLDLQLWWGVAD

SEQ ID NO: 125107 - protein, 500 aa, Glycine max
  Coding DNA Sequence Number=SeqID_8329
  Gene Ontology: Mol. function=RNA-directed DNA polymerase activity; Cellular component=chromatin; Biological process=RNA-dependent DNA replication
MDWQKKTVSFKDNGQMITLNGHYFKYIHCSLALQGFLHGVATEDVTRHQLHSWVLSPVEDSELKQGLSPQRAHDHAITLFPGSKLVSIRPYKYVYHHKDEIERQVGEMMSEGIIRHSMIPFFSPVSLVKKKDNSWCMCMDFWVLNKIELKIGFHQIRMNEEDIHKIEFWTHEGKSVEIDPSNVKAMVDWSTLLNVNDVCDFLGLTGYYQHFIKDYGKLVQPLTELAKKEGFFWGPAQVNVFECLKQSLSSFSILVLSNFTKEFFIKCNDIGHVLEAVLMQDKQPIAYFKKVISPRTMSKFVYEKEIMALALSIHYWQHYLLGRSFKVYTDHQSLKHLLQQCITTTDQQCWLAKLIGYQIKVIYKPDPDKVVDALSYQHPTPKINAITIRPYWVDFPKIRAEGRLMFPNSFALIPFLLAEYHDTVTGGHLAFEIVYGRSPPTILHFLNGETRVVIVATMLMDRDEALRQPKFHLHRAQQTVKKYVDAHRRHVTFTLGDWPT

SEQ ID NO: 125108 - protein, 608 aa, Glycine max
  Coding DNA Sequence Number=SeqID_8330
  Gene Ontology: Mol. function=zinc ion binding
  Homolog annotation: Hit_ID=Q69L44; Match level="QueryCoverage=92%, HitCoverage=83%, E-value=0.0, Identity=63%"; Hit description=SWIM zinc finger family protein-like
YWCSFGPENYGEGGGILPSRRYRLNTRNRAARPQSMRGCTCHFVVKRLYAQPSLALIVYNERRHINKSGFICHGPLDRDAIGPGAKKIPYICNEIQQQTMSMIYLGIPEENILEKHIEGIQRYCGSDAKVSSLASQYVHKLGMIIKRSTHELDLDDQASIRMWIERNRKSVFFHQDTSESDPFILGIQTEWQLQQMIRFGHRSVVAADSTFGVKRLKYPLFTLLVFDSRQHALPVAWVITRSFTKPDVSKWLKALIDRARSVEPGWKVSGFLIDDAAAEIDLLRSWLRNIVKKCSNIEIQREIFKRLGRIVYNIWGGINASLALEQFLLDFVDQTAFMEYFKVMWLPKLEMWLSTMRNFPLASLEASGALEAYHVKLKAKLFDDSHLGALQRVDWLVHKLTTELHSSYWLDRYADESDSFQNVKEKYIASTSWHRALQIPDYAVSLDDKDHLFAKVVSQKDSSLTHIVWNPGSEFAFCDCSWSMQEVLMDLWKKPVDDSFALDLSLAWTHQMLDQIQKQVELNNSTDIGTVVNNMPLKWVSKKGRTYIGKPSSSLALPHGSSNTKNSGIKTNRSGTIPKRLPLQAMTSTGSTILPPSCLGACLPELPN

SEQ ID NO: 125109 - protein, 110 aa, Glycine max
  Coding DNA Sequence Number=SeqID_8331
  Gene Ontology: Mol. function=zinc ion binding; Cellular component =intracellular
  Homolog annotation: Hit_ID=Q948W7; Match level="QueryCoverage=51%, HitCoverage=24%, E-value=3e-25, Identity=85%"; Hit description=Zinc -binding protein
  Pfam annotation: Domain name=PLATZ; Domain location=46-110; Score= -6.9; E_value=2.6e-05; Accession=PF04640.4; Description=PLATZ transcription factor
MVRDMMGTTTTTSSGGCGGGGDMNMNMNEKPAWLERLMAETFFGACGVHQDRRKNEKNVFCLHCCLSICPHCLSSHRSHPLLQLLISDEFHSNFHEIIRYTKMFLPSHGC

SEQ ID NO: 125110 - protein, 89 aa, Glycine max
  Coding DNA Sequence Number=SeqID_8332
  Gene Ontology: Mol. function=zinc ion binding; Cellular component =intracellular
  Homolog annotation: Hit_ID=Q948W7; Match level="QueryCoverage=92%, HitCoverage=35%, E-value=2e-35, Identity=83%"; Hit description=Zinc -binding protein
  Pfam annotation: Domain name=PLATZ; Domain location=4-82; Score =134.9; E_value=2.2e-37; Accession=PF04640.4; Description=PLATZ transcription factor
MRGSYTMSQVRRYVYHDVIRLDDLEKLIDCSNIQPYTINSAKVIFLNQRPQSRTCKGPANSCFTCDRILQEPFHFCSLSCKVFHLISHS

SEQ ID NO: 125111 - protein, 137 aa, Glycine max
  Coding DNA Sequence Number=SeqID_8333
MTQNLRSRKRIKSGLHMFDDDVEVVYDLRVQIEGLGANMVLEVDKGGTSDNGGGSFVVNVENEVFAHANWRFVHGSGPPENEGSADDNGGGSFIINCERHCYSSFEKISSVTLLSSIVALTSEECVERRVRKLGFWK

SEQ ID NO: 125112 - protein, 315 aa, Glycine max
  Coding DNA Sequence Number=SeqID_8334
MDMFDKLYEECYLGSLGEIKLKYLDDDLVQVEGGNQPWYLAQACGRNIITEEHQACKSSYQNLKSTKHLQISKGEDRRKGVPGHGNLHTNGKKGGDDKVTDFESERDSLEAKAKNVSEVEKIKEMGYIYLGLTENKRGYISCGSVLVEGTSTRFKENKGGYIPCGSLLGVEGNVTKLGPSGIERGDSSIKGVTNTPTSTQTPLGVMVLSTRSNNMLEGGTFRLSSVVRLRDAKVEAKRICDNGCMLGISYHGQKHEGMDILAWRVFGRKEDFNCVRYPNERIGEAMKDYWSRKRSDFNQLIKDMRVEEIPFDTEE

SEQ ID NO: 125113 - protein, 73 aa, Glycine max
  Coding DNA Sequence Number=SeqID_8335
MTIWRCMGNRQSNWRVPQHRSRLRLCRDGKRMQLKGNRHSYGRVSLNWSCQWYWRVRHKGGANNIGDLYFQKL

SEQ ID NO: 125114 - protein, 502 aa, Glycine max
  Coding DNA Sequence Number=SeqID_8336
  Gene Ontology: Mol. function=transcription factor activity; Cellular component=nucleus; Biological process=regulation of transcription, DNA-dependent
  Homolog annotation: Hit_ID=Q6SA75; Match level="QueryCoverage=91%, HitCoverage=65%, E-value=1e-126, Identity=55%"; Hit description=ANT -like protein
  Pfam annotation: Domain name=AP2; Domain location=132-202; Score =122.5; E_value=1.2e-33; Accession=PF00847.10; Description=AP2 domain
  Pfam annotation: Domain name=AP2; Domain location=231-296; Score =123.8; E_value=4.9e-34; Accession=PF00847.10; Description=AP2 domain
  Pfam module annotation: Pfam domain module=AP2::AP2; Domain location =132-202::231-296
HVAVCCSQVPQVVEGIACFKNWVPPREFSSSTQQNLEQDQVNSSRSGGLGEDNNNGASGNIGVGSSVGCGELQSLSLSMSPGSQSSCVTVPTQISSSGTDSVTVDAKKRGSSKLGQKQPVHRKSIDTFGQRTSQYRGVTRHRWTGRYEAHLWDNSCKKEGQTRKGRQGGYDMEEKAARAYDLAALKYWGPSTHINFSLENYQTELEEMKNMSRQEYVAHLRRKSSGFSRGASMYRGVTRHHQHGRWQARIGRVAGNKDLYLGTFSTQEEAAEAYDIAAIKFRGLNAVTNFDITRYDVERIMASNTLLAGELARRNKNSEPRTEAIEYNVVSSQRVISNREEVHEAVNNNNNNENGSSSDWKMGLYHHQQQQQQSNNCDQKTMKCGNYNRGGGGAAAAFSVSLQDLIGIESVVGSSQGMMNESTKIGTHFSNPSSLVTSLSSSREGSPDKTGPTLLFPKPPMGSKIVTSPTIANGVTVGSWFPSQMRPVSMSHLPFFAAWSDT

SEQ ID NO: 125115 - protein, 289 aa, Glycine max
  Coding DNA Sequence Number=SeqID_8337
  Gene Ontology: Mol. function=nucleic acid binding; Cellular component= nucleus; Biological process=chromatin modification
  Homolog annotation: Hit_ID=Q9FIH7; Match level="QueryCoverage=83%, HitCoverage=15%, E-value=9e-69, Identity=59%"; Hit description =Similarity to SET-domain transcriptional regulator
  Pfam annotation: Domain name=SET; Domain location=125-256; Score =52.1; E_value=1.8e-12; Accession=PF00856.18; Description=SET domain
  Subcellular localization annotation: CTP_CleavageSite=29; ConfidenceScore=5.23e-01
MDGTSSHPTKVLKISNGGAYLGASKQVPVASRKSAKSKPLNLCPRSDGCARTSIDGWEWHKWSRSASPAYKARVRGLPCVRNKCIDSENNLFQLSNGKGLSARTNRVKLRNLLAAAEGADLLKVPQLKARKKHLRFQRSKIHDWGLVALEPIEAEDFVIEYIGELIRPRGFLQASYLVAALLKNEYTLRLLMTISDIRERQYEKMGIGSSYLFRLDDGYVVDATKRGGIARFINHSCEVSWITELGIDWVSDAGCFFRGPLVKLLSGQNFCHRYYYTPAIIVGCCILKT

SEQ ID NO: 125116 - protein, 322 aa, Glycine max
  Coding DNA Sequence Number=SeqID_8338
  Homolog annotation: Hit_ID=Q00M75; Match level="QueryCoverage=9%, HitCoverage=5%, E-value=3e-09, Identity=100%"; Hit description=PPR -repeat containing protein
ASPGAAVKLCLGDLLVMGSNPETASLHMQGLPVGTCQFDWRFPMHGDIAITTGDFFANNKLASSTGGLRGQLEGYLVLNKQGGANLGGLLCLWEEGSFQILKCVAAYGYLFLQGVWKGCNEVINLINVYSPCSLIDKRSLWANLVQLKKDVGGGIWCVVRDFNTIEWEPKPFRIFNAWINELGFLDFVKKVYGNLEVQGAKLENLVASINNLDIKDELEGLSLESCSDIIKADNIRAIREFPSNGRLPSGTNASFLALIPKKVDPQWMGTREIVKGEKSHTMATLSSWLTVMSQLPVLQPIVAEESNSRSKAAEETGGRSKP

SEQ ID NO: 125117 - protein, 86 aa, Glycine max
  Coding DNA Sequence Number=SeqID_8339
MVKEENSFWGSVVAKYDIRDLDSLVSGGEVPRGSQVWNDTHKVYVVLVGRKAPQELRVLINTKGPKLDGQDGCEWLGSSSCGYVML

SEQ ID NO: 125118 - protein, 311 aa, Glycine max
  Coding DNA Sequence Number=SeqID_8340
  Gene Ontology: Cellular component=nucleus
  Homolog annotation: Hit_ID=Q9FIH7; Match level="QueryCoverage=87%, HitCoverage=19%, E-value=2e-15, Identity=29%"; Hit description =Similarity to SET-domain transcriptional regulator
SKFSAEISKGSAISSDPASSHTLDDQTCHESSRLPPAIIKSVGSIENFWWSFAVVRKVLLDYSMQVMWNAVFFDTLAEYLSSWRKKMLWSHPKPQPSANGCEDHTEKIESEALVFNPDSSESNVDGDNQFGVLTTEKNCPLLFSSPSSLKGGNLLEGQKVSCPYVNSRDLTCILESVENELHFSSKVSLADYIRSFVEKEVNKLIPFPEENKFNEVAVGGTHFSGILADKTSMKEILNDKSVDPVKAGNSFGESASGNHKSDIFSKAFKELCGYVDDVVEEEIDDLPPGLEKSQTVVPHYNSKFRPSRSAE

SEQ ID NO: 125119 - protein, 424 aa, Glycine max
  Coding DNA Sequence Number=SeqID_8341
  Gene Ontology: Cellular component=nucleus
  Homolog annotation: Hit_ID=Q9FIH7; Match level="QueryCoverage=52%, HitCoverage=16%, E-value=3e-41, Identity=42%"; Hit description =Similarity to SET-domain transcriptional regulator
MVFSTVFLDEDDPFFSRKRPRVSDLGHQDDLLADAGISSDISLFSHQDIERGILEGVSKAKFLVNILVADIGWGTGDFPSSSNTDDKVDPDSGMEMSCPSNVNSGYVPVCSTTGHILHMDQSFCGYVQQPAFVSGWMYVNENGQMCGPYIKEQLYEGLTSGFLPSELPVYPVINGTIMNPVPLNYFKQFPDHVSTGFAYLSLGISGTRVPTLAVYEQDRFFEHAAPLAVNPDSQPVSKSHINYCIKESNRLNSNSEAFKSLISCQMLGVECCWLYEDEKGMKHGPHSIKELISWHRHGYLKDSTVIIYGSVWYFFSHMIWAMVLYPTPVTTTPPFSRSLTLSILSADKTSCPTEPSPGHWLVFLSLDLFRRLALQRQQWPVMMKRLNCFNNSLYLLIICCLSGSGSGSGERETVVVTRKGKEMM

SEQ ID NO: 125120 - protein, 321 aa, Glycine max
  Coding DNA Sequence Number=SeqID_8342
  Homolog annotation: Hit_ID=Q5WA77; Match level="QueryCoverage=39%, HitCoverage=28%, E-value=1e-34, Identity=51%"; Hit description=MYB transcription factor-like
  Pfam annotation: Domain name=Myb_DNA-binding; Domain location=189 -235; Score=36.8; E_value=7.3e-08; Accession=PF00249.21; Description =Myb-like DNA-binding domain
  Pfam annotation: Domain name=Myb_DNA-binding; Domain location=241 -286; Score=44.0; E_value=5.1e-10; Accession=PF00249.21; Description =Myb-like DNA-binding domain
  Pfam module annotation: Pfam domain module=Myb_DNA-binding::Myb_DNA -binding; Domain location=189-235::241-286
  Subcellular localization annotation: CTP_CleavageSite=19; ConfidenceScore=5.42e-01
MEFDPSFKGPQYLSSLFPRNSYLKPLTQTIFPSQSSIFTPPPPSSVMFHPNNNSHHFQDHIMNVPTNSTPFVMEGPSNPITTPMYGITTPSLGDGSSLGGFVNVQCHPPMMLAPNNNNKMEALYGQDKGKAISDFSQKTMLCSSEDSSSKSPSPFSLPNDWWMSQYHWDTDQKVKVEKDSNIGNDNVIKGKWSMKEDRDLIELVNQYGLKKWSQIAKLLHCRTGKQCQERWNNHLQPNIRKDSWTLKEDKIFIETHIKVGNKWSEIAKMLPGRAPNTIKNRWNGSKRRKNDKRQNKNKHGPYDGSVLDAYVKMVTATEETT

SEQ ID NO: 125121 - protein, 108 aa, Glycine max
  Coding DNA Sequence Number=SeqID_8343
  Homolog annotation: Hit_ID=Q70I19; Match level="QueryCoverage=45%, HitCoverage=12%, E-value=4e-22, Identity=100%"; Hit description=TCP -domain protein
  Subcellular localization annotation: CTP_CleavageSite=49; ConfidenceScore=5.46e-01
MTDGSACWRSHSIVSPSDLCPSSRVSWNTLAAQRAGIRIRRPRPSTFVCRSLVEVLLGGGFLGEGSEEGVGRSWLLLLEVEVGMGSFVGGGYGYGDGGGSGSHHYLPP

SEQ ID NO: 125122 - protein, 407 aa, Glycine max
  Coding DNA Sequence Number=SeqID_8344
  Gene Ontology: Mol. function=nucleic acid binding; Cellular component= intracellular; Biological process=DNA integration
HGIVAQYTMPGSLNQNDEVTIYNPNEKKLDSRTISAYFIGYVERSKGYRFYCPTHSTRIVESRNAKFLENDVASGSDLTQGIGLEKNQCEGIVPTSSYKLVVFSDTHQNRATQAPHQVDPILEYLVEQHQTQDVEQPVEQQLEGVDVTLRISIRIKKPTIPSDYQVYLQESQYDFGVENDPKSALQAINNCNSKLWYGAMKDELEFMANNKVWDLVELPNGIKPIGCKWVLKTKKDSLGDIERHMAQLVAKGFAQRERVDYRETFSSVSMKDSIHIIMALVAYFDLELHQMYVKTVFLNGDLEEVYMTQPKGFSSSDGAHLVCKIKKSIYGLKQASHQWYLKFYIVISSFGYVENGMDRCIYRKTLESLPSIKDSYKEYQDMRMRNKSHLPSQPEDEIHITYYAIDT

SEQ ID NO: 125123 - protein, 266 aa, Glycine max
  Coding DNA Sequence Number=SeqID_8345
  Gene Ontology: Mol. function=oxidoreductase activity
  Homolog annotation: Hit_ID=O23763; Match level="QueryCoverage=96%, HitCoverage=72%, E-value=7e-46, Identity=43%"; Hit description =Gibberellin 7-oxidase
MGEACIPTADLSPFVREDEDGKKKVMEAITQACSEYGFFQIVNHGVSLDLIKEAMQPSKTFFDYSDEEKSKSSPSTNAPLPAGYSKQPLHSPDKNEYFLFFPPGSSFPSKPSQVQMVKGEGKSGKVVDSIPSTSVYELNWVKTKPLNTSVNMIGVDVQIYIISIMHADSIINECLGLPTNFLKEFNHDRSWDFLLALRYFPASNNDNNGITEHEDSNILTFVIQDGVGSLQVLRNVEWIPAVPRGHYCGQWKRCYPGNSVFKCTKI

SEQ ID NO: 125124 - protein, 65 aa, Glycine max
  Coding DNA Sequence Number=SeqID_8346
MFLRNYKGEGFGWGDIEDDLVLEVVENDHDKAGKAANAEHVGLEAPCLELARVRRWREKCAGEEM

SEQ ID NO: 125125 - protein, 115 aa, Glycine max
  Coding DNA Sequence Number=SeqID_8347
  Gene Ontology: Mol. function=glutathione transferase activity; Cellular component=cytoplasm; Biological process=metabolic process
  Homolog annotation: Hit_ID=Q9FQE6; Match level="QueryCoverage=96%, HitCoverage=47%, E-value=6e-42, Identity=70%"; Hit description =Glutathione S-transferase GST 12
  Pfam annotation: Domain name=GST_N; Domain location=5-78; Score=69.8; E_value=8.5e-18; Accession=PF02798.10; Description=Glutathione S -transferase, N-terminal domain
MAEQNKVILHGMWASPFVKRVELVLKLKGIPYDYLKEDLANKSELLLKYNPVYKKVPVFVHNRNTISESVVILQYIDETWTDDGPKLMPDDRYKRAQARFWCHSLMKSYLRTCLK

SEQ ID NO: 125126 - protein, 112 aa, Glycine max
  Coding DNA Sequence Number=SeqID_8348
  Gene Ontology: Mol. function=methyltransferase activity; Cellular component=cellulose and pectin-containing cell wall
  Homolog annotation: Hit_ID=Q1SBL8; Match level="QueryCoverage=91%, HitCoverage=16%, E-value=3e-40, Identity=71%"; Hit description =Putative methyltransferase
  Pfam annotation: Domain name=DUF248; Domain location=1-99; Score= -359.8; E_value=0.00044; Accession=PF03141.7; Description=Putative methyltransferase
MVTRLGHAEWCEAFSTYPRTYDLIHANGVFSLYKNVCNAEDILLEMDRILRPEGAVIFRDQANMLMQVKRTVKGMRWNTKMVDHEDGPLVSEKVLFAVKQYWAVGDNTMSSV

SEQ ID NO: 125127 - protein, 434 aa, Glycine max
  Coding DNA Sequence Number=SeqID_8349
  Gene Ontology: Mol. function=methyltransferase activity; Cellular component=cellulose and pectin-containing cell wall
  Homolog annotation: Hit_ID=Q1SBL8; Match level="QueryCoverage=99%, HitCoverage=80%, E-value=1e-161, Identity=57%"; Hit description =Putative methyltransferase
  Pfam annotation: Domain name=DUF248; Domain location=94-432; Score =521.1; E_value=1.2e-153; Accession=PF03141.7; Description=Putative methyltransferase
  Pfam annotation: Domain name=Methyltransf_11; Domain location=160 -255; Score=41.6; E_value=2.6e-09; Accession=PF08241.2; Description =Methyltransferase domain
  Pfam annotation: Domain name=Methyltransf_12; Domain location=160 -253; Score=11.3; E_value=0.043; Accession=PF08242.2; Description =Methyltransferase domain
  Pfam module annotation: Pfam domain module=DUF248::Methyltransf _11::Methyltransf_12; Domain location=94-432::160-255::160-253
MVTKGNPGDNKNNRSSLSIFIIVGLCGFFYILGLWQRSGFGKGDSIAVEITKRTDCIVLSDLNYETHHDDNSGTPNGFGAQVKEFKPCDDRYIDYTPCHDQARAMTFPRDNMAYRERHCPPDEEKLFPGGGTQFPKGADAYIDELASVIPLDNGMVRTALDTGCGVASFGAYLFKKNVVAMSIAPRDSHEAQVQFALERGVPAIIGVLGTIMLPFPSGAFDMAHCSRCLIQWGANDGKYMKEVDRVLRPGGYWILSGPPINWKNSFQAWQRPEDELEEEQRQIEDTAKLLCWEKKYEKGEIAIWRKKLHNDDCSEQDTQPTICETTNSDDVWYKKMEDCVTPSKSSGPWKPFQERINVVPFRIISGFVPGVSVKAFEEDNRLWKKHVNAYKRINKIISSGRYRNIMDMNAGLGSFAAALESPKLWVMNVVPTIA

SEQ ID NO: 125128 - protein, 114 aa, Glycine max
  Coding DNA Sequence Number=SeqID_8350
  Subcellular localization annotation: CTP_CleavageSite=60; ConfidenceScore=5.37e-01
MDMNLGYLNSSHTSLIAPHDSSRLDDPSVTFWGTHKSRGKGSEVPSSSAPSTSAPSTSALASSAPAPVLPGPATPSSEHLLSMLQSLHQGQILIMQSLQNSVQQRPVMSVEEFI

SEQ ID NO: 125129 - protein, 215 aa, Glycine max
  Coding DNA Sequence Number=SeqID_8351
MEGTPFDLRQILFNYFATKVMKDKSIRKDIYHSVILIKVFEVHGVMRKFISLESTLGGTTSWTQFGRKLLKKKEWTQMKPLLKLSREPRRVWTHLRPRLHPLNSIHLPLSLLPRKQMPRLMALSEIEDEDNRPLVFRKHNATPPLDETCVPHVKKVKPTQKVLPSSSQPRASKREKRGAQRPKRPKGEKSSIANDTADDPPPTDIQPVRHQISTV

SEQ ID NO: 125130 - protein, 99 aa, Glycine max
  Coding DNA Sequence Number=SeqID_8352
MASCKTLELLTTTSWDLSMDRRFISGLSSRQSKGKKILEMMEEGFVVNKPPMFKGASYDYWKERMIGFFESTHVDKWDVVEKDNHIPLNAQKNEIPGNK

SEQ ID NO: 125131 - protein, 186 aa, Glycine max
  Coding DNA Sequence Number=SeqID_8353
  Homolog annotation: Hit_ID=Q1SJY5; Match level="QueryCoverage=26%, HitCoverage=4%, E-value=5e-11, Identity=62%"; Hit description =Integrase, catalytic region
MDDAKQMKTPIHPTTILGLDEESKQVDEKTYRGIIGSLFYLTASRPNIIFNDDSPVQINKLAPVTILAMKVTMKDKEPGVHIKHFFDIISLENAGYAIKVYLMLCDIHHFFEDHKMVVPELIREFWRAAKIYKNEDSGGYFAGKVLGIPMKLPVKTITQAIGCERHETKFMNNWGYELEDHIGNSV

SEQ ID NO: 125132 - protein, 152 aa, Glycine max
  Coding DNA Sequence Number=SeqID_8354
MTLEELIKILKVHQQELAQGERTKKWKSLALRVQRPKHNFASKESSSKALIINDASGEESKDDDFDEEDDELSLITGALLDEKVQRNPKDKSSHGFKGKKVVHGEEVTVCYFYGKGDHETHKCKNLSEKGNPSKGPCSAYQNLQDNQEKDPK

SEQ ID NO: 125133 - protein, 49 aa, Glycine max
  Coding DNA Sequence Number=SeqID_8355
IKTGGVTSKKDRKIEENLKQAQSNTRAEHASRAKPMIQQKRALSLQHAH

SEQ ID NO: 125134 - protein, 64 aa, Glycine max
  Coding DNA Sequence Number=SeqID_8356
  Homolog annotation: Hit_ID=Q9C9C4; Match level="QueryCoverage=64%, HitCoverage=8%, E-value=4e-08, Identity=66%"; Hit description =Putative enolase; 31277-33713
MEVDLVVDRILRLAVPSGVSMGIYEALELRDKDNSIYSGKAVSITYKFRVLRWMHLGKVLARID

SEQ ID NO: 125135 - protein, 200 aa, Glycine max
  Coding DNA Sequence Number=SeqID_8357
  Gene Ontology: Mol. function=phosphatidylinositol phosphate kinase activity; Biological process=phosphatidylinositol metabolic process
  Homolog annotation: Hit_ID=Q1S1T3; Match level="QueryCoverage=75%, HitCoverage=26%, E-value=1e-42, Identity=63%"; Hit description =Phosphatidylinositol-4-phosphate 5-kinase
  Subcellular localization annotation: CTP_CleavageSite=27; ConfidenceScore=5.57e-01
MMQPIVSHKGSGGATYKNGKGGTRGATGMSTSESGRMMPSPAMVCWCERTGTITKSVGRTVFRRGEGCSRGAMEALLLGIGGKNLICIWELDGEAGDITCDIVEASMIYGGGGVCESDVQLQKSPCGSVDGDVKKSGHTVSKGHKNYDLMLNLQLGIRYLIYIATLISFSVMEVKNLDDGDGEAWRFRIIAKTVLRNDGH

SEQ ID NO: 125136 - protein, 73 aa, Glycine max
  Coding DNA Sequence Number=SeqID_8358
MPFATASELEQPIPQDSPAAQPLEENEHVIGTMTENVSQFVRLIVKECINRIPVKVRSLKFERNDYHLVLIFA

SEQ ID NO: 125137 - protein, 135 aa, Glycine max
  Coding DNA Sequence Number=SeqID_8359
  Gene Ontology: Mol. function=nucleic acid binding; Biological process= DNA integration
MGSTEECSQTADKSFAGTLISRLITMKFDGSRTMHKHVIGMSNIAARLKTLGMTVNENFLVQFILSSLSYEYDPFQMSYNIMKDKWNVHELHNMLVQEKTRLKNQGRHSAHYVSYQGNQGTRKKFLKKHVRAKGY

SEQ ID NO: 125138 - protein, 94 aa, Glycine max
  Coding DNA Sequence Number=SeqID_8360
  Gene Ontology: Mol. function=nucleic acid binding; Biological process= DNA integration
MKAIPYAFVVGSIMYAYIYIRPDISFTDGLLGRYQSNPGMKHWKVARKVLRYLYGIKDHMLTYRRSGHLEVIGYPDLDLARCVQIRPCLSISFS

SEQ ID NO: 125139 - protein, 49 aa, Glycine max
  Coding DNA Sequence Number=SeqID_8361
MQEERAIRVGRLGYKWRVTQNLQLTLTPYLVQLKQFKGRRSIDEVHSCS

SEQ ID NO: 125140 - protein, 230 aa, Glycine max
  Coding DNA Sequence Number=SeqID_8362
  Gene Ontology: Mol. function=transferase activity, transferring glycosyl groups
  Homolog annotation: Hit_ID=Q43085; Match level="QueryCoverage=69%, HitCoverage=44%, E-value=5e-73, Identity=82%"; Hit description =Phosphoribosylanthranilate transferase
  Pfam annotation: Domain name=PRT_C; Domain location=120-229; Score =213.3; E_value=5.4e-61; Accession=PF08372.1; Description=Plant phosphoribosyltransferase C-terminal
MADAEPFDASLDRLEAAMANLTAVDSDLHASHLHLDTLHASMLFKLDLISLKLDTLISRQRSPFSSLEYEANFYSPMTVFSGILSVVRWLGEVSTWKHPITTVLVHILFLMLVCFPELILPTVFLYMFVIGMWNWRFRPRCPPHMNIRLSYAERVTPDELDEEFDTFPTSKSPDILRWRYDRLRSVAGRIQSVVGDLATQGERIQALVNWRDPRATAMFMGILLRGLLLR

SEQ ID NO: 125141 - protein, 188 aa, Glycine max
  Coding DNA Sequence Number=SeqID_8363
  Homolog annotation: Hit_ID=Q1SVG6; Match level="QueryCoverage=95%, HitCoverage=95%, E-value=1e-87, Identity=82%"; Hit description =Barwin-related endoglucanase
  Pfam annotation: Domain name=DPBB_1; Domain location=105-185; Score= -5.1; E_value=0.045; Accession=PF03330.8; Description=Rare lipoprotein A (RlpA)-like double
MKVSNSIASFVLLLILISKNCLCSEAQQCRPSGRIMGKKPPPGECNKENDSDCCVQGKAYTTYKCSPAVSRHTKAELTLNSFEKGGDGGGPSECDNQYHSDDTPVVALSTGWFNDRSRCLHNITISGNGKSVVAMVVDECDSTMGCDEDHDYQPPCSNNIVDASKAVWKALGVPHNQWGGLEITWSDA

SEQ ID NO: 125142 - protein, 153 aa, Glycine max
  Coding DNA Sequence Number=SeqID_8364
  Homolog annotation: Hit_ID=Q1SVG6; Match level="QueryCoverage=98%, HitCoverage=80%, E-value=7e-78, Identity=85%"; Hit description =Barwin-related endoglucanase
  Pfam annotation: Domain name=DPBB_1; Domain location=70-150; Score= -1.4; E_value=0.02; Accession=PF03330.8; Description=Rare lipoprotein A (RlpA)-like double
MGKKPPPGECNKENDSDCCVQGKAYTTYKCSPAVSRHTKAELTLNSFEKGGDGGGPSECDNQYHSDDTPVVALSTGWFNDRIRCLHNITISGNGKSVVAMVVDECDSTMGCDEDHDYQPPCSNNIVDASKAVWKALGVPHNQWGGLEITWSDA

SEQ ID NO: 125143 - protein, 182 aa, Glycine max
  Coding DNA Sequence Number=SeqID_8365
  Homolog annotation: Hit_ID=Q1SVG4; Match level="QueryCoverage=98%, HitCoverage=53%, E-value=7e-67, Identity=63%"; Hit description =Barwin-related endoglucanase
MKFKICTTSFQTILFLLILVASFWLISIAGANCRPSGRLRGKKPPSGKCNRENESECCKKGKVYHTFKCSPPISHHTKAILTLNSFEKGGDGGGPSECDNKFYSDNTPVVALSTGWFNDKKRCHHNITIFGKGRRVHAMVVDECDSKRGCDAEHDFLPPCPNNVVDASKAVWKALGVPKRDW

SEQ ID NO: 125144 - protein, 70 aa, Glycine max
  Coding DNA Sequence Number=SeqID_8366
MKLDFKIQMVPSTPLTHYPGKCNIQIAEHIEYAAVPNYTADNKANQEESTVTNSRSKRDTHRPKYLADYV

SEQ ID NO: 125145 - protein, 154 aa, Glycine max
  Coding DNA Sequence Number=SeqID_8367
MECSKPIMEYHGSMDEFLGRQRTRKIMRFRLKCNSDDCCSFDVEEWVDEVVTRKVKHVNISLYMCHSSVFNLAALFVCTTLVTFDFSIPCNVHLPNLKSFHLHVYTFLQFPSISKLISGSPALELFHLKQKQYKHYFDELKIEVFHHNWSISLL

SEQ ID NO: 125146 - protein, 293 aa, Glycine max
  Coding DNA Sequence Number=SeqID_8368
  Homolog annotation: Hit_ID=Q1SVG6; Match level="QueryCoverage=56%, HitCoverage=87%, E-value=2e-78, Identity=82%"; Hit description =Barwin-related endoglucanase
MSNLIASFVLLLILISTNCLCSEAQQCRPSGRIMGKKPPPGECNKENDSDCCVQGKAYTTYKCSPAVSRHTKAELTLNSFEKGGDGGGPSECDNQYHSDDTPVVALSTGWFNDRSRCLHNITISGNGKSVVAMVVDECDSTMGCDEDHDYQPPCSNNIVDASKAVWKALDVDMLKKLIFMLSGTASKLEDLQPFAGSYIWNSRNAEIFNDEVWPIWLLKSKVEALLNITPEDISDPNQREIKGTLEVQGDNCGASEQGGEGEHTCMAHVHAQGDIHTFNFSGYNCRYPFFRVT

SEQ ID NO: 125147 - protein, 464 aa, Glycine max
  Coding DNA Sequence Number=SeqID_8369
  Gene Ontology: Mol. function=amino acid binding; Biological process =metabolic process
  Homolog annotation: Hit_ID=Q1RVD0; Match level="QueryCoverage=84%, HitCoverage=88%, E-value=0.0, Identity=81%"; Hit description=Amino acid-binding ACT
  Pfam annotation: Domain name=ACT; Domain location=112-184; Score =40.3; E_value=6.7e-09; Accession=PF01842.15; Description=ACT domain
  Pfam annotation: Domain name=ACT; Domain location=243-314; Score =17.6; E_value=0.02; Accession=PF01842.15; Description=ACT domain
  Pfam annotation: Domain name=ACT; Domain location=31-94; Score=21.0; E_value=0.0042; Accession=PF01842.15; Description=ACT domain
  Pfam annotation: Domain name=ACT; Domain location=321-387; Score =35.6; E_value=1.7e-07; Accession=PF01842.15; Description=ACT domain
  Pfam module annotation: Pfam domain module=ACT::ACT::ACT::ACT; Domain location=112-184::243-314::31-94::321-387
NFGIKYENFADFDPSLRNRVVIDNAVCSTATIVKVDSARKHGILIDAVQVLSDLNLSIKKAYISSDGRWFMDVFHVTDENGDKLTDKSVLSYIEQSLGSIHNAKTNHSNGLTILELTGTDRVGLLSEVFAVLAEQQCDVVDAKVWTHNGRIASLIYVKDSNSGTLIEDSQRISTIEARLRNVLKGDNDIRNAKTSVTNAVLHAERRLHQMMYTDRDYQRNPILKFASVTPIVTVQNWAERGYSVVNIQCKDRVKLLFDVVCNLTDMEYVVFHATIKTTIDQAYLEFYIRHRDGTPISSEPERHRVIQCLQAAVERRAYEGVRLELCTEDRQGLLAEVMRTFRENGMNVTRAEISTIGNMASNVFYVTDAVGYPVDPKIVESVRQKVGLSNLKVKELPLVCHEKAEREDQPVGVGGAVLLCLGSLKGEEFRSVGRYLQLLEHNILCFWRGLGEEGKYLGEVVGLG

SEQ ID NO: 125148 - protein, 195 aa, Glycine max
  Coding DNA Sequence Number=SeqID_8370
  Gene Ontology: Mol. function=protein binding; Cellular component =actin cytoskeleton; Biological process=cytoskeleton organization and biogenesis
  Homolog annotation: Hit_ID=Q9FV01; Match level="QueryCoverage=96%, HitCoverage=60%, E-value=1e-38, Identity=46%"; Hit description=SKP1 interacting partner 4
  Pfam annotation: Domain name=Kelch_1; Domain location=1-43; Score =17.3; E_value=0.042; Accession=PF01344.15; Description=Kelch motif
  Pfam annotation: Domain name=Kelch_1; Domain location=45-90; Score =30.5; E_value=5.8e-06; Accession=PF01344.15; Description=Kelch motif
  Pfam annotation: Domain name=Kelch_2; Domain location=1-43; Score =0.1; E_value=38; Accession=PF07646.5; Description=Kelch motif
  Pfam annotation: Domain name=Kelch_2; Domain location=45-90; Score =17.7; E_value=0.042; Accession=PF07646.5; Description=Kelch motif
  Pfam module annotation: Pfam domain module=Kelch_1::Kelch_1::Kelch _2::Kelch_2; Domain location=1-43::45-90::1-43::45-90
MGFEALGNKLFLLGGCSGFLDFTDEAYSYDASSNCWAVAASLSNARCYLTCEVLDEKLYAIGGLVSNSSNHSWNTFDPLTNCWTFHIDPNIGSDIKDSVVLDGRIYVRCARHPDVTRRVFVVVHEPSSGTWQYADADMVSGWTGPAVVVDGTLYVLDKSLGTSLMMWHKDQVGKLSPWLTRPSFRCMVIWGMKVR

SEQ ID NO: 125149 - protein, 172 aa, Glycine max
  Coding DNA Sequence Number=SeqID_8371
  Gene Ontology: Mol. function=diaminohydroxyphosphoribosylaminopyrimidi ne deaminase activity; Biological process=riboflavin biosynthetic process
  Homolog annotation: Hit_ID=Q10SM6; Match level="QueryCoverage=66%, HitCoverage=25%, E-value=6e-22, Identity=52%"; Hit description =Riboflavin biosynthesis protein RibD containing protein, expressed
  Pfam annotation: Domain name=dCMP_cyt_deam_1; Domain location=112 -171; Score=-6.7; E_value=0.0024; Accession=PF00383.13; Description =Cytidine and deoxycytidylate deaminas
MLLGKTKRPRLHSLKKWFTDEGDFTCNKTQTRCVNCAVTEPYLGYLGIVESLYCSTLRVPRFSISATPPNFASFLSPSKAGIKLSCGIHKPVWRSRCDGLRVQCAASNGENDDDDGFYIRRCVELARKAVGFTSPNPLVGCVIVKDGKVVGEGFHPKAGQPHAEVPTFCLSL

SEQ ID NO: 125150 - protein, 214 aa, Glycine max
  Coding DNA Sequence Number=SeqID_8372
  Homolog annotation: Hit_ID=Q9FV01; Match level="QueryCoverage=80%, HitCoverage=62%, E-value=7e-29, Identity=37%"; Hit description=SKP1 interacting partner 4
  Pfam annotation: Domain name=Kelch_1; Domain location=67-113; Score =26.3; E_value=0.00011; Accession=PF01344.15; Description=Kelch motif
MEHIDKGKESSNSENEVEATNSPIICGLPDDIFLMDKSNEIFCYVLDPTSSMRYWKLVDDLPPHILKREGMGFEALGNKLFLLGGCSEFLDSTDEVYSYDASSNCCAQATSLSTARLVSLFLFFLEANSTDPKIVNEIKDSVILDGKIYVRCSRYPVTPHVFAVVYEPSSGTWEYADEDIVSGWTGPAVAVDGTLYVLDQMWLLMLVIWGMRIK

SEQ ID NO: 125151 - protein, 168 aa, Glycine max
  Coding DNA Sequence Number=SeqID_8373
MEAIKEQMAKMMKAMMSMKKIMEANAVIVAAISAVAKVNPMLPSGLKQMNHPTSNMAHISQTMGETHEIPHHNLADFEPWLGYATEGQAVGGIPFENTLEGPQFRPQPQPLHFAVGRAPPAMAEKGKADHLKERLRAIEGGEDYAFANLEKLFLIPKHGHSQVQGAGL

SEQ ID NO: 125152 - protein, 217 aa, Glycine max
  Coding DNA Sequence Number=SeqID_8374
  Homolog annotation: Hit_ID=Q1SDG1; Match level="QueryCoverage=28%, HitCoverage=5%, E-value=1e-09, Identity=46%"; Hit description =Integrase, catalytic region; Zinc finger, CCHC-type
NKRGCISCGPVLVEGTSTRFKENKGGNRLIQDHDEDQVNLCLMTKSDENNKEDSVRKKWYIDSGCSKHMTGDVSKFTTISPKKSGHVTYNNKITKHWYLYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 125153 - protein, 112 aa, Glycine max
  Coding DNA Sequence Number=SeqID_8375
MARYSMETYLGWGQHKPFSCRVASSLDESLLKGMGGGLVGMGSNDLGVGGGGDGGCREETGPVEKGGRGLKWLRRRESKNFSSCKWAKTPPELELMVAKPAPPDEFLVRVRR

SEQ ID NO: 125154 - protein, 70 aa, Glycine max
  Coding DNA Sequence Number=SeqID_8376
MKCERKDMRTRKAKRKNENDVDLVQEVLLLCLPHILVRGEDLHYACIGLGVHLSSRLHQQELLGHSGGDE

SEQ ID NO: 125155 - protein, 74 aa, Glycine max
  Coding DNA Sequence Number=SeqID_8377
MSVKNHVGRLGVHDKTNRTLGDQSGSQYFARMLQPYGINIGLKEHSNRVTPKAYTPKSPSGPLPHDSGPTQKTF

SEQ ID NO: 125156 - protein, 298 aa, Glycine max
  Coding DNA Sequence Number=SeqID_8378
  Gene Ontology: Mol. function=transcription factor activity; Cellular component=intracellular; Biological process=regulation of transcription, DNA-dependent
  Homolog annotation: Hit_ID=Q7W2R3; Match level="QueryCoverage=98%, HitCoverage=84%, E-value=1e-111, Identity=68%"; Hit description =Probable LacI-family transcriptional regulator
HRGQRRRQQGAEAHAVETADGNIGRNRQAQRHQVGNHGRGQQVVGAEQRRRRLFAAQCGLDRLGVAAGVRIHGDVLDRFQAQLLGAGARARQAAASAIGGRQRAGHDGDAPMSQRRQVRDHVNGGRAIVDRGIGMVGGFVVDQHVGHAGAVQVVQRGAAGRVRHRQDQAVDLVVDQALHRGRFHRRVIAGGGQHHAVAGLAGAPFGAFKALGEYRIGQRRQNQSDRAGAAGTQAAADAIGPETRALGDGADVRQRIRMDDFGLVERARNRGGGNPRLAGHFDDGKAGRCARRHGYIAA

SEQ ID NO: 125157 - protein, 150 aa, Glycine max
  Coding DNA Sequence Number=SeqID_8379
MEAIKEQMATMMKAMMSMKKIMEANAVIVAAISAVAKVNPMLPSGLKQMNHPTSNMVGKDLGSTDDPMMCKFKTSTPSHHMACLSTIHHPMWHTLSMKISITPLRYSLRTNNLIRHISLKPWGETHEIPHHNLADFEPWLGYATEGQAVG

SEQ ID NO: 125158 - protein, 54 aa, Glycine max
  Coding DNA Sequence Number=SeqID_8380
MAQSRFCGLAFLYGRIIKKQILSAQSTVKEYIVGSKKESQESHVGRLDSNKDNP

SEQ ID NO: 125159 - protein, 225 aa, Glycine max
  Coding DNA Sequence Number=SeqID_8381
  Gene Ontology: Cellular component=integral to membrane
  Homolog annotation: Hit_ID=Q9M2D2; Match level="QueryCoverage=88%, HitCoverage=43%, E-value=1e-67, Identity=62%"; Hit description =UPF0187 protein At3g61320, chloroplast precursor
  Pfam annotation: Domain name=UPF0187; Domain location=1-211; Score =40.6; E_value=3.1e-12; Accession=PF05249.2; Description =Uncharacterised protein family (UPF0187)
MQPANLVDCSHSDYFLKPRSNLCHVLYGSDVRRDLQHLLEVDDLVVVMNSEHRPRCIIEFISQSIRLLKLEESRRNVLVCANWNCLQDMDLLTYQLTLESKITCFHEGIGICDQLMGIPIPLAYTRLTSRFLVLWHLTLPIILWDDCHWIVVPATFISAASLFCIEEVGVLIEEPFATLALDDLCQKAQTDIQEAIASGNLIHARLVAKQKSHAEEHSPNGWPNS

SEQ ID NO: 125160 - protein, 179 aa, Glycine max
  Coding DNA Sequence Number=SeqID_8382
  Gene Ontology: Cellular component=integral to membrane
  Homolog annotation: Hit_ID=Q9M2D2; Match level="QueryCoverage=86%, HitCoverage=40%, E-value=1e-32, Identity=46%"; Hit description =UPF0187 protein At3g61320, chloroplast precursor
MPSPSEYPSPSILEARQAHHLGLPPSGAHLRPGPNPNLAPPFHPGLGRCRAGARHAEEARPLHPPELARPPQLPPPPPPRLLQPLLPRHPLPRPSRTLLHRFLRRHRRLQRGPPPPPPPGVLTAPPHLLPPLPAHRPRPRPPPRLPHRGLLLPLRRGEEGLDQRHRRNPRFRETSRRHR

SEQ ID NO: 125161 - protein, 59 aa, Glycine max
  Coding DNA Sequence Number=SeqID_8383
MSVLQVIFRDEESLAFCFRDEVYAFCGHWMRSIVRRTSYSKSESEHREQEHLFVMVSNP

SEQ ID NO: 125162 - protein, 58 aa, Glycine max
  Coding DNA Sequence Number=SeqID_8384
MNRNTWRQLLLQQFLPCGEDRERMMLVVEMSVSCRRGNEEAGRDLQKVNAPKRPILSV

SEQ ID NO: 125163 - protein, 42 aa, Glycine max
  Coding DNA Sequence Number=SeqID_8385
MGHVHVVLTYEVVWIKKFILTTKVNNLFLITLAAGWPLHFRM

SEQ ID NO: 125164 - protein, 232 aa, Glycine max
  Coding DNA Sequence Number=SeqID_8386
  Gene Ontology: Mol. function=DNA binding; Cellular component=nucleus
  Homolog annotation: Hit_ID=Q1SVI1; Match level="QueryCoverage=98%, HitCoverage=58%, E-value=2e-61, Identity=54%"; Hit description=HMG-I and HMG-Y, DNA-binding
  Pfam annotation: Domain name=DUF296; Domain location=14-164; Score =176.7; E_value=5.9e-50; Accession=PF03479.5; Description=Domain of unknown function (DUF296)
MAGELMSGSAGMGFTPHIITIAVGEDIATKIMSFSQQGPRAICILSANGAVSTVTLRQPSTSGGTVTYESMYMAVFKMSDIKTIGVYSTNIIHKCILMYGRFEIVCLSGSYLVADSGGSRNRTGGLSVSLASPDGRVVGGGVGGVLIAASPVQVILGSFSWGASKTKIKKKEGSEGAEVALETDHQTVHNPVAVNSISPNQNLTPTSSLSPWPASRSLDMRNSHIDIDLMRG

SEQ ID NO: 125165 - protein, 163 aa, Glycine max
  Coding DNA Sequence Number=SeqID_8387
  Gene Ontology: Mol. function=DNA binding
  Homolog annotation: Hit_ID=Q1SVI1; Match level="QueryCoverage=71%, HitCoverage=34%, E-value=3e-27, Identity=57%"; Hit description=HMG-I and HMG-Y, DNA-binding
  Pfam annotation: Domain name=AT_hook; Domain location=122-134; Score =9.8; E_value=0.47; Accession=PF02178.9; Description=AT hook motif
  Pfam annotation: Domain name=AT_hook; Domain location=87-99; Score =18.6; E_value=0.014; Accession=PF02178.9; Description=AT hook motif
  Pfam module annotation: Pfam domain module=AT_hook::AT_hook; Domain location=122-134::87-99
MDRGDQMTLPGSASYYMQRGIPGAGNQPVLHNSPNIGPLSNPNLPCQSSIGGGGTIGSTLPLESSGISAPCVNVSAPSGTLPGETVKRKRGRPRKYGSDGAVSLALTPTPASHPGALAQGQKRGRGRPPGSGKKQQLASLAKVLKHSSVERLIVSVVTSLVLF

SEQ ID NO: 125166 - protein, 607 aa, Glycine max
  Coding DNA Sequence Number=SeqID_8388
  Gene Ontology: Mol. function=nucleic acid binding; Cellular component= intracellular; Biological process=DNA integration
MAKSMLKARGVPNRFRCEAVATAVYILNVSPTKVVINMTPLEAWRRKKPFVSHLRIFGCTAYALVDLRTKLDDKSVKCVFIGYATQSKAYRLYNPLTGKIIVNRNVVFDEDAGWVWEECEISKSVQQKSVSFDGSDEVSNVPENDHTPSPPLTPSSQGSLTPLSQGSSSSSSDSAPRRYRSLADLYENCDFALMAADPTCFEEAEKEVEWQNAMKEQIKSIEKNTTWQLLNLPEGKNVIGLKWVFRTKFNTYGSIQNHKARLVAKGYAQQKGIDFEETFSPVARFETVRVVLALAAQWKLKVFQLDVKSAFFNGDLQEEVFVEQPLGFVKAGEEGKVYKLQKALYRLKQAPRAWYSKIDSFFLQNEFERSENEPTLYVKKVKQGEDRIFLCQRKYAEDFLKKFHMEKCEAMRTPMNTNEKLQRDDGTEKADEKLFRSLVGGLNYLTHMRPDIAHSSIKLGILYESVDNFKLVGYSDSDRAGCLDDRKGTSGSVFSLASGAITWSSKKQDTVALSSSEAEYVVVGAIELWCNNRSAIAMTKNPAFHARTKHIEVQHHFIRQLVAEEKLVLKFCGTNEQNADLFTKALAQAKHQFFLEKIGMHELELRG

SEQ ID NO: 125167 - protein, 77 aa, Glycine max
  Coding DNA Sequence Number=SeqID_8389
MDVNTMLMSNDRFSCVGPIELLCTVGRTPDGILNLLERTMTPTHDEVLKQFVPIEILALFSKPVMENEDEVVTSLQD

SEQ ID NO: 125168 - protein, 288 aa, Glycine max
  Coding DNA Sequence Number=SeqID_8390
  Gene Ontology: Mol. function=kinase activity; Cellular component =intracellular; Biological process=intracellular protein transport
  Homolog annotation: Hit_ID=Q2V732; Match level="QueryCoverage=95%, HitCoverage=34%, E-value=6e-67, Identity=49%"; Hit description=VHS and GAT domain protein
  Pfam annotation: Domain name=GAT; Domain location=226-287; Score= -9.6; E_value=0.0082; Accession=PF03127.5; Description=GAT domain
  Pfam annotation: Domain name=HEAT; Domain location=129-165; Score =2.5; E_value=21; Accession=PF02985.12; Description=HEAT repeat
  Pfam annotation: Domain name=HEAT; Domain location=86-122; Score =16.2; E_value=0.12; Accession=PF02985.12; Description=HEAT repeat
  Pfam annotation: Domain name=VHS; Domain location=3-186; Score=36.6; E_value=4.9e-08; Accession=PF00790.9; Description=VHS domain
  Pfam module annotation: Pfam domain module=GAT::HEAT::HEAT::VHS; Domain location=226-287::129-165::86-122::3-186
MANNAAACAERATSDMLIGPDWAINIELCDIINMDPREHHVLGTGSKFIVGVLGDLCMLREYHTDNLGSANITDIYFPLKIFMAGELQAKDAIKILKKRLSSKNPQIQLLALFALETLSKNCGDSVFQQIIEQDILHEMVKIVKKPDLRVREKILILIDTWQEAFGGPSGKYPQYLAAYNELKSAGVEFPPREENSAPFFTPPQTLPVHLAAAEYDDASIQASLHSDASGLSLPEIQNAQGLADVLTEMVNALDPKNPEVENQEVIAELVDQCRSYQKRVMLLVNETS

SEQ ID NO: 125169 - protein, 74 aa, Glycine max
  Coding DNA Sequence Number=SeqID_8391
MEFESEAIGICDARMRKPQLRDWAMGIVGVTCQNKDAYAKVIVDALTKLRIHPSTFSKAHKLLEGYCGDCSEDA

SEQ ID NO: 125170 - protein, 397 aa, Glycine max
  Coding DNA Sequence Number=SeqID_8392
  Gene Ontology: Cellular component=intracellular; Biological process =intracellular protein transport
  Homolog annotation: Hit_ID=Q8W2G2; Match level="QueryCoverage=31%, HitCoverage=51%, E-value=4e-14, Identity=39%"; Hit description=Seed protein B32E
  Pfam annotation: Domain name=GAT; Domain location=71-164; Score= -14.4; E_value=0.022; Accession=PF03127.5; Description=GAT domain
MVIVAGTGYTITWRFFDACCECGFFMNFGHMIGLSLSVCPKCTGIVLIIDSITVLGVRSAKSIVSLRGSVGSCDSLALPLLVSSPIVLISESLMSLHSCHGFKSDPPQHELEEESSVFGVVLCTPVLDEQLLGQGLALNDSLQRVLCQHDNIVKGTPDTGTRGTETSTLPLVYVTNEEDESDVDFAQLAHRSSRDTNAQRANAKAEPVRVNPILPPPPAPKKPIFTDAGMIDYLSGDAYKTEASHEQSEPTSYAVPLHSSPTNPASTAATLSSSPPYSPSTPSRILSKQPVYDEPPPINKSSESLPLSPLETQSPGFLLPPPSSYNQRQQFFEQQGVPHSSSGFSSADDSLLAQTQNLSLNSSTPTKQEKTEDVLFKDLVDFAKSKTSSSSKPSRPF

SEQ ID NO: 125171 - protein, 68 aa, Glycine max
  Coding DNA Sequence Number=SeqID_8393
MSEYTASKARKNFFHEVARKKMDEDQWAYDNTMSEEVDMDFEDEQHCGVNEGHVDCSDAFNTSQVFAT

SEQ ID NO: 125172 - protein, 98 aa, Glycine max
  Coding DNA Sequence Number=SeqID_8394
MMKGAWRKQCLLLSLLAFVVLSEGSRLPKEYWEQMMPKKLPSPSSSPSKGTNSVLPSSLSNTKNDGLPTSDGKIHWSWSEDSAVPCKDVGVTIPHWTR

SEQ ID NO: 125173 - protein, 182 aa, Glycine max
  Coding DNA Sequence Number=SeqID_8395
MYNLSKEDALSGIAAESVCRVDGIFPCTNSNATSQYMFDDGDYAPPSLSASPLHVPRINPSMPPLKTSEAYKHCAPCTGPAMANDAGVSSEQCHRVGRGFGPVPVVVPENKELNLDNDKDVVHPIHAEVPVFSHHIGTRSSGSGVGCGGGGDGGCGASSTVGEMPLVAGESGGGGGVGAELA

SEQ ID NO: 125174 - protein, 133 aa, Glycine max
  Coding DNA Sequence Number=SeqID_8396
  Gene Ontology: Mol. function=helicase activity; Biological process =protein amino acid phosphorylation
  Homolog annotation: Hit_ID=Q1SN45; Match level="QueryCoverage=89%, HitCoverage=6%, E-value=1e-28, Identity=51%"; Hit description=AAA ATPase
MPYPEGGNPASCLENSLILSELNYNNDEARSEFENLFLSMADEQKQIYYKIMEHVNNNEGGMFFLYGYGGTGKTYIWITLASSLRAKNQIVIMVASSGIASLLLPGGRTARSKFKIPVPILKTQHAIYFKEVS

SEQ ID NO: 125175 - protein, 78 aa, Glycine max
  Coding DNA Sequence Number=SeqID_8397
MSSGPPPLDDKRVQNDHIGLCSSITLWVTERRGADNCKVSPRVTSSWVMATKGGVVDKSKAFAPTYPPMRNSDLRSSG

SEQ ID NO: 125176 - protein, 187 aa, Glycine max
  Coding DNA Sequence Number=SeqID_8398
  Gene Ontology: Mol. function=chromatin binding; Cellular component =chromatin; Biological process=chromatin assembly or disassembly
  Homolog annotation: Hit_ID=Q1SAV4; Match level="QueryCoverage=82%, HitCoverage=39%, E-value=2e-40, Identity=50%"; Hit description =Integrase, catalytic region
  Subcellular localization annotation: CTP_CleavageSite=32; ConfidenceScore=5.19e-01
MGSKSTLRLMRTLRPSLGSLAQSTWSFLSNPLAGTRLRMSITYHPQIDGQTEVMNRVLEYYMCSLVHLNPADWFNFLALAEWLYNTSIHSSTCLTPYEVIYGKAPRTIPHYIVGSSNNEVVNSLLPSRQAMHDTLRRCLLKAQNTMKLHVDTRCHDVTFDVGQWFYVKLQPFHQCSVTGVLHPKLSK

SEQ ID NO: 125177 - protein, 125 aa, Glycine max
  Coding DNA Sequence Number=SeqID_8399
  Gene Ontology: Cellular component=nucleus
  Homolog annotation: Hit_ID=Q2HVJ8; Match level="QueryCoverage=60%, HitCoverage=15%, E-value=4e-24, Identity=75%"; Hit description =Nuclear protein SET
MGQTLYGPAMTVTFFSLNARLQEKPNLFQHSGKLEKLIFLHDYGPQSSHAYLREHQFVYIRWHLCLTTPTIVANFVNFALVIFSTVLGAYWKLSIIQQSFGVTVFPGNLTFGILIIAKLKAYNLS

SEQ ID NO: 125178 - protein, 43 aa, Glycine max
  Coding DNA Sequence Number=SeqID_8400
MWEDEFVRCSQFPSLILKDKAVAPRKGHVRTHGQPVIVSGALT

SEQ ID NO: 125179 - protein, 75 aa, Glycine max
  Coding DNA Sequence Number=SeqID_8401
MTLGSYFRKFLTGLKIKFEICKIVSETNLATGGADGAILPMKGLVTRAMSKRLQEYWARAAEEGPGILMNLRVDF

SEQ ID NO: 125180 - protein, 276 aa, Glycine max
  Coding DNA Sequence Number=SeqID_8402
  Gene Ontology: Mol. function=zinc ion binding
  Homolog annotation: Hit_ID=Q15KI9; Match level="QueryCoverage=36%, HitCoverage=5%, E-value=1e-33, Identity=68%"; Hit description =Chloroplast Phyllo
VNVLTHIAEVKLDSDQLTVIEKLKQKHLEQEKRELLGDDQDGETNVDMLNNSPSTINALDRQSSVEVMEQEGGLCDGKEVDQFHQPSGSNEVAIANEDGISYGSEVIEVDKVKINQGDLLFGGDASDGALWDIFRRQDVPKLQEYLKKHFREFRHVHCCPLKQLDHANELSNSLKESANINTVWASLIVEECTRLGLMYLCIAPGSRPSPVAVAVASHKLITCISCFDERSLAYHAVGYGRGSHIPAVAITSSGTAVSNLLPAGDQNCGLSIIGDQ

SEQ ID NO: 125181 - protein, 112 aa, Glycine max
  Coding DNA Sequence Number=SeqID_8403
  Homolog annotation: Hit_ID=Q1T3M2; Match level="QueryCoverage=85%, HitCoverage=75%, E-value=5e-22, Identity=57%"; Hit description =Barwin-related endoglucanase
MVLWQWGQAACAQQCHHRKEPPSRRMQPRERFRLLSTRQHVALQYLSNDTPVVALSTGWFNNRSRCLHNITISANGKTGWPWWSYVTKTMIINNIVDASKAVWKILGVPHDQ

SEQ ID NO: 125182 - protein, 148 aa, Glycine max
  Coding DNA Sequence Number=SeqID_8404
HGQPMQNKMMPMMGHKDNSGGSRNINGSVKKAEVIDQAMLFKGKGQNQEKGDLDNPKAVGEVDYHKKKNGKSENGFLGRFLGFGKKDKNQNSGAENKKGKEGKLEDHEGQMDPGPIMVNNIPMRHQMENIQAVQGLPMMNGDGGYYQG

SEQ ID NO: 125183 - protein, 84 aa, Glycine max
  Coding DNA Sequence Number=SeqID_8405
MQDKQKVEKASPKERKSERSENGKRRNGKNPDRTRGGRGFNNGKGKRKKAKTGRTRGLKCQQDRQQAVRALFVYKIEIEIEIKI

SEQ ID NO: 125184 - protein, 617 aa, Glycine max
  Coding DNA Sequence Number=SeqID_8406
  Gene Ontology: Mol. function=DNA binding; Cellular component=beta -galactosidase complex; Biological process=DNA integration
  Homolog annotation: Hit_ID=Q1SLU3; Match level="QueryCoverage=98%, HitCoverage=48%, E-value=1e-152, Identity=57%"; Hit description =Integrase, catalytic region
  Subcellular localization annotation: CTP_CleavageSite=52; ConfidenceScore=5.12e-01
MIKVFGCLYYASTHNQTHKFQPRSRKGAFLGFQNGTKGYVVLDINTREIFISRNVVFHESFFPFHTNQNLSTSEAQPHSHIDPISHALHIDPISYTLPTPPQFTPSTPITTNPEPTIPQPNGSPSPFPNPSTPPTIDTPNPNIIDRHIQELSSNHALPRPSNRDTHPPSYLSDYQFQIPSLKVVIALASINQWHLHQLDVSNAFLHGDLGEDVYMRIPLGLLGYTSSQSCKLKKSLYGLKQSNRQWYEKLSILLLTCGYSHAHADHSLFIKAHNSEFTALIVYVDDIVLIGNSLAEIERIKHILHTNFHIKDLGKLKYFLGIEVAHSHKGISLCQRKYCLDLLKDSGMLGCKPSSTPMDSSLRLHNDSSGFLDDPLSYRRLVGRLVYLTSTRPDIAFATQQLSQFMSKPTKPHHATVVRVLRYLKGCPGKGLFFPRTCSGHLLGFSDVDWATCIDSRCFITGYCFFIGNSLVSWKTKKQTIVSCSSSEAEYRALASATCELLWLSYLLRDLRIPLLKTPVLYYDNHNALHITVNPVFHERTKHLDIDCHLVCEKSQAGLMLLLLAPYSNQLADIFTKVLPPQSFNTNLSKLQLQNIFAPPACGGLIEETYNPSLNAT

SEQ ID NO: 125185 - protein, 60 aa, Glycine max
  Coding DNA Sequence Number=SeqID_8407
MPKLGGIGVGGGDIVGRWAFILSNYQVKKAFLQEGGGGGGVRSSSPDEPEVATGRWRWEA

SEQ ID NO: 125186 - protein, 57 aa, Glycine max
  Coding DNA Sequence Number=SeqID_8408
MAMRKVTPLRPCKGCNNEIHKAILKNKELCSTQMAETNSDTTIIDDLGVAGWGVGGI

SEQ ID NO: 125187 - protein, 123 aa, Glycine max
  Coding DNA Sequence Number=SeqID_8409
MVGLGLLFIWWDVQFLSKRSPPKTFTYLGWKNGNLLDWPKELHRPWWLRAKAKDMFAIRYLPYPHEKEVSTKSTYAEAQSYNEDMKLTSNPTPTMAARLAVKHTSGHHEFPNPCSRNQKRSLG

SEQ ID NO: 125188 - protein, 69 aa, Glycine max
  Coding DNA Sequence Number=SeqID_8410
  Gene Ontology: Mol. function=histone deacetylase activity; Cellular component=nucleus; Biological process=histone deacetylation
  Homolog annotation: Hit_ID=Q1T5Y9; Match level="QueryCoverage=68%, HitCoverage=11%, E-value=4e-17, Identity=89%"; Hit description =Histone deacetylase superfamily
MLPQVTWKTRILVIYLKKLDLNYLKIFPSYSMLLVSNFRKGLLILILERHCDGYVPSSYSAYGLYQPIS

SEQ ID NO: 125189 - protein, 200 aa, Glycine max
  Coding DNA Sequence Number=SeqID_8411
MVYTILTLMTVHVAQIIADAIYLFAGTAPTRHPLDPERSNRALGFSALITGLCQFYGVLVIPSKVIQPPITRVFIEKHCTPRQAKGDTQQAADAPPPQQPDPVIPLSVEQYLRHMVRQQTANNRVQGQGSPPFVRPTPEQFKAKVAWPGDWPTEEGTGPAGSPGEAEEAHMDEDMTDLLGYLGEGGATRPRSSHLLFHVV

SEQ ID NO: 125190 - protein, 119 aa, Glycine max
  Coding DNA Sequence Number=SeqID_8412
MNGSWERWIKMMIMMLEMIWLRGLECRMYTRRKKQKTTSVAATQTSKKQAMVVGSSSRKQKAVQENDEDLDFEENIDLESEEEEIMVNFEASDGEEGEGDAPLPYDNNEDDYVGIGEDD

SEQ ID NO: 125191 - protein, 178 aa, Glycine max
  Coding DNA Sequence Number=SeqID_8413
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=86%, HitCoverage=65%, E-value=2e-38, Identity=51%"; Hit description =Transcription factor, MADS-box
  Pfam annotation: Domain name=SRF-TF; Domain location=25-75; Score =68.2; E_value=2.7e-17; Accession=PF00319.9; Description=SRF-type transcription factor (DNA-binding and dimerisation domain)
  Subcellular localization annotation: CTP_CleavageSite=43; ConfidenceScore=5.11e-01
MESNNMPDLNGVAKKTKGRQKIEMKKMRNESNLRVTFSKRRTRVFKKASELATLCGVDVVVIMFSPGNRVFSFGSPSVDSVVQRYKTQGPPPLLTLDLNKVHSTVDEVELHTHLHYLSNQIAIEKKRTKDLNHLAKVAEDQFWWARPIESMTDSQLDKYKKMLEEFKRQLKEKRGNLN

SEQ ID NO: 125192 - protein, 107 aa, Glycine max
  Coding DNA Sequence Number=SeqID_8414
  Subcellular localization annotation: CTP_CleavageSite=39; ConfidenceScore=5.15e-01
MSGRSSTRQFPSQKLGGHGHTKSNPLGESSSYIATTWPSCLSYPNFVRGPLFDGMHPLLDRFEGVQIATRPTWAFQEVPPEGGAFWRKQPISPGRAGWQASPSFPYK

SEQ ID NO: 125193 - protein, 114 aa, Glycine max
  Coding DNA Sequence Number=SeqID_8415
MKMKANKTRNELKVSDSNTYQLKNKERMKNAGKSSQIYSRKRLRSPPSPIYREKGRCLPPRGFLRKISKRTPITKFTPFSTILSEICLPKIFGNFTEATEAPECYRSLTEVFRI

SEQ ID NO: 125194 - protein, 247 aa, Glycine max
  Coding DNA Sequence Number=SeqID_8416
  Homolog annotation: Hit_ID=Q9AVH2; Match level="QueryCoverage=18%, HitCoverage=16%, E-value=1e-19, Identity=97%"; Hit description =Putative senescence-associated protein
MCPVVGFGPWLGLGKPLVEILPPGQLRGFCPLLAWLGSAVLGYGPVLSFGLVGPLLPPVISFVARILPTLACAPLAKSVPRLVDHHVITWQDTRSHAHTHTHTHAGTRGRRGLVVRPPGHTPREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 125195 - protein, 138 aa, Glycine max
  Coding DNA Sequence Number=SeqID_8417
  Subcellular localization annotation: CTP_CleavageSite=39; ConfidenceScore=5.49e-01
MATPPSSPPSPTVAESQSPSTLKRTRKATQLRSLATRLVGAERPMVHVDPGTGKANNPHRKKLRTYLGIVARDKAKFDIPEASGLRTKKKILQTVGEQWRQFKYDLTSKCALAVDKESVTNTICEKYDISKEKWAQFC

SEQ ID NO: 125196 - protein, 43 aa, Glycine max
  Coding DNA Sequence Number=SeqID_8418
MTTITRIVNLIWVRMSEVGSYKEGGGGGVRSSSPDEPEVATGR

SEQ ID NO: 125197 - protein, 189 aa, Glycine max
  Coding DNA Sequence Number=SeqID_8419
  Gene Ontology: Mol. function=cyclin-dependent protein kinase inhibitor activity; Cellular component=nucleus; Biological process =cell cycle arrest
  Homolog annotation: Hit_ID=Q6T2Z1; Match level="QueryCoverage=71%, HitCoverage=75%, E-value=5e-60, Identity=89%"; Hit description =Cyclin-dependent kinase inhibitor 2;1
  Pfam annotation: Domain name=CDI; Domain location=132-167; Score =12.3; E_value=0.013; Accession=PF02234.9; Description=Cyclin -dependent kinase inhibitor
  Subcellular localization annotation: CTP_CleavageSite=58; ConfidenceScore=5.65e-01
MAQVKARARTALAMAASASSRKRRKISINNNFVQIKSLSNATVPATGERISGESPASCCSSNGSVDDENRIIKFSDLEVESTRVVTSTCDCGEQQQQIRREMSLTSELRITNSSSQEVDSAEEQITQTKSLPPQKMPTELELDEFFAAAEKDIRKRFSDKGLASGVDELDTWRRLVDSPVELASCCPRG

SEQ ID NO: 125198 - protein, 431 aa, Glycine max
  Coding DNA Sequence Number=SeqID_8420
MEREMCTDVLLVCWGSSVYAPNVGLTWRIDTCLRVPCRVPRVIIEPWTVHKPPSSEPACRRKRLSSAEGEYLLSEVRELQVDAACQAPEPGQVFSVLLLSSCLDGHVFYVSGALKTDITFCLLLQACAAHVQYCCIRVTRGVDTYWSHGAWVSGGHCYFDLLLPSACDPLSLILQGTLSSIMSSFLSDSAISMGSSDSGSSIEQPMMDWEDTHRGASDSESSSLERVSASCHTGEVVAVEMSGHLPACDIAIVLGRRHPHLSSLAMTVQACGSDDFPFLRAASGLGFHSPLDRFPMCSKLEHLNLTGKIGWVSLNIVSKKLFEFDSNIFRHFKDYFFKVLSTDAMDDGLPLMFKSIDEDLLTLVERIDKAILEQVSASLDARAILSLPSASDPLAALDAEWRRKKDDWRHHFKEKMSQEQAHHHRKLWIRA

SEQ ID NO: 125199 - protein, 69 aa, Glycine max
  Coding DNA Sequence Number=SeqID_8421
MATTQIIKTTGNHKKIDKYRENRKHIQTGANSGKDTNIQNLFVPENSGKQEQITGRIPTSKTFLFRMKH

SEQ ID NO: 125200 - protein, 127 aa, Glycine max
  Coding DNA Sequence Number=SeqID_8422
  Subcellular localization annotation: CTP_CleavageSite=22; ConfidenceScore=5.21e-01
MRQGLVASTSFILAASTSFILVASSLSKTEDTETVATMMGTMELARTREALPQALTNCTHAKKKAHIKYLISDLFYKKATRWKPSHSPMPPCIPTTLFSEFEDSSDEFLRKLNEEAVKNKKGRKSKS

SEQ ID NO: 125201 - protein, 185 aa, Glycine max
  Coding DNA Sequence Number=SeqID_8423
  Homolog annotation: Hit_ID=Q1SVG6; Match level="QueryCoverage=96%, HitCoverage=95%, E-value=2e-86, Identity=82%"; Hit description =Barwin-related endoglucanase
  Pfam annotation: Domain name=DPBB_1; Domain location=102-182; Score= -5.1; E_value=0.045; Accession=PF03330.8; Description=Rare lipoprotein A (RlpA)-like double
  Pfam annotation: Domain name=PSK; Domain location=9-64; Score=-11.5; E_value=0.1; Accession=PF06404.3; Description=Phytosulfokine precursor protein (PSK
  Pfam module annotation: Pfam domain module=DPBB_1::PSK; Domain location=102-182::9-64
MSNSIASFVLLLILISTNCLCSAQQCRPSGRIMGKKPPPGECNKENDSDCCVQGKAYTTYKCSPAVSRHTKAELTLNSFEKGGDGGGPSECDNQYHSDDTPVVALSTGWFNDRSRCLHNITISGNGKSVVAMVVDECDSTMGCDEDHDYQPPCSNNIVDASKAVWKALGVPHNQWGGLEITWSDA

SEQ ID NO: 125202 - protein, 75 aa, Glycine max
  Coding DNA Sequence Number=SeqID_8424
MEQHQIKELSSSSSNNIDLDKRMFKIQLKVSNDIGVATFTMFDQDAQQILNRTASELLHTQNANKPHIPQYCIPF

SEQ ID NO: 125203 - protein, 579 aa, Glycine max
  Coding DNA Sequence Number=SeqID_8425
  Gene Ontology: Mol. function=oxidoreductase activity; Cellular component=intracellular; Biological process=lignin catabolic process
  Homolog annotation: Hit_ID=Q2LD62; Match level="QueryCoverage=95%, HitCoverage=95%, E-value=0.0, Identity=64%"; Hit description =Putative copper ion-binding laccase
  Pfam annotation: Domain name=Cu-oxidase; Domain location=163-314; Score=196.9; E_value=4.7e-56; Accession=PF00394.12; Description =Multicopper oxidase
  Pfam annotation: Domain name=Cu-oxidase_2; Domain location=426-564; Score=164.3; E_value=3e-46; Accession=PF07731.4; Description =Multicopper oxidase
  Pfam annotation: Domain name=Cu-oxidase_3; Domain location=30-154; Score=170.5; E_value=4.2e-48; Accession=PF07732.5; Description =Multicopper oxidase
  Pfam module annotation: Pfam domain module=Cu-oxidase::Cu-oxidase _2::Cu-oxidase_3; Domain location=163-314::426-564::30-154
  Subcellular localization annotation: CTP_CleavageSite=25; ConfidenceScore=5.29e-01
MKLFVFFLAWAMALLASSFASAAVVERTFKVQNKTIKRLCNERVIVTVNGTFPGPKINVREGDTVIVHLLNEGPYNITIHWVKMYNIPTKLYELKYSLGRDGPEYVTQCTISPGTKYTYKFNVTQQEGTLWWHAHASVLRATVHGAFIIHPRSGQFPFPKPFKQVPIILGDWYDANVVDVETQALASGGPPNVSNAFTINGLPGDLFNCSRTQTFKMKVKQGKTYMLRMINAALNNHLFFKIANHTFTVVALDAAYTDHYITEIIVIAPGQTIDALFTANQPLGSYYMAASPYSIGVPVIDNTTTRGIVVYDYAPPPSSSKPLMPTLPPINDTATAHKFYSNITGKVGAPHWVPVPAKVDEHMFITIGLNLDTCDPKNATNATCQGPSGQRFSSSMNNESFVIPKGRGFSMLEAFFKNVSGVYTADFPNNPPVMFDFTNPNISFNPNLLFAPKSTKSKKLKFNSTVEIVFQNTAIVGVQNHPIHIHGFSFHVLAQGFGNFNSTVDSTKFNLVNPQLRNTIAVPVGGWAVIRFQANNPGVWFVHCHVEDHVPWGLDMAFEVENGPTSSTSLPPPPVDLPK

SEQ ID NO: 125204 - protein, 88 aa, Glycine max
  Coding DNA Sequence Number=SeqID_8426
  Homolog annotation: Hit_ID=Q1SVG3; Match level="QueryCoverage=92%, HitCoverage=44%, E-value=2e-27, Identity=65%"; Hit description =Barwin-related endoglucanase
MEVALKSVTTSFTQTTLQCHHNITIFGNGRRVHAMVVDECDSKRGCDAEHDFQPPCPNNVVDASKAVWKALGVPKRDWGESDIHWSDA

SEQ ID NO: 125205 - protein, 188 aa, Glycine max
  Coding DNA Sequence Number=SeqID_8427
VGGPDDKQRPSLVILHPWYHPEAAGPMIRGDTLRLFAPFCHPEAAGPMTSRDQVWSFCTLVSSRGGGPDDTRRYLTVIRTLLSSRGGGPDDKQRPKAAGPMTSRDQVWSFCTLVSSRGGGPDDTRKYPSEADIVFCTFCSSGNNKSFTCGNFMVARDSRQPRGAKLVSYTDFQGPLLDDMRPFFGPCE

SEQ ID NO: 125206 - protein, 67 aa, Glycine max
  Coding DNA Sequence Number=SeqID_8428
MMTEPAQEIAEKIDSFEEQDVLTAAIGRPEHPGRIRAAGAGVTIKQYFGSAPRASHSSSSLPPEELQ

SEQ ID NO: 125207 - protein, 54 aa, Glycine max
  Coding DNA Sequence Number=SeqID_8429
MMVLSPCWGWMTKESLHERTSLVASSGTKGTISDGGSVVGPRRRQSDQNYCSGN

SEQ ID NO: 125208 - protein, 74 aa, Glycine max
  Coding DNA Sequence Number=SeqID_8430
MTTHTTSGFASPCFGGGSLACFRDFVRDNGGCRETKSHLCHWPLTAIAAISRFSNSLSQSFLNGFSSTNPLISL

SEQ ID NO: 125209 - protein, 115 aa, Glycine max
  Coding DNA Sequence Number=SeqID_8431
  Pfam annotation: Domain name=zf-GRF; Domain location=21-70; Score =10.1; E_value=0.0018; Accession=PF06839.3; Description=GRF zinc finger
MGERMNGEGGLSSLFSFLGMVKCKFEVPVVMFTSRSVNHPEKRFWRCPHWNESSSCRFFQWIGDTEADNNVSVEESELVRYVRENEELKLKVASLMEEAKTNVQEITDLRKKIVA

SEQ ID NO: 125210 - protein, 206 aa, Glycine max
  Coding DNA Sequence Number=SeqID_8432
  Homolog annotation: Hit_ID=Q2HRE1; Match level="QueryCoverage=79%, HitCoverage=37%, E-value=5e-53, Identity=54%"; Hit description =Lipopolysaccharide-modifying protein
  Pfam annotation: Domain name=DUF821; Domain location=75-206; Score= -70.7; E_value=1.3e-15; Accession=PF05686.3; Description=Arabidopsis thaliana protein of unknown function (DUF821)
MAKWIFFPIIFFVVFVASTFLLEINLSRITRTTIFKTIIIFNKQQPQFPLNCTDGNLAKTCSSYYPTTFDLDDDSSTTSCPNYFKWIHEDLKPWKSKGITRDMVERGKNVSHFRLVIVNGKAYVEKYDKVYQTRDVFTIWGILQLLRLYPGKIPDLDLMFQCGDKPVVLKKDFQGPQAMSPPPVFHYCGDENAHDIVFPDWSFWGW

SEQ ID NO: 125211 - protein, 383 aa, Glycine max
  Coding DNA Sequence Number=SeqID_8433
  Gene Ontology: Mol. function=zinc ion binding
  Homolog annotation: Hit_ID=Q1S5F3; Match level="QueryCoverage=75%, HitCoverage=65%, E-value=4e-21, Identity=61%"; Hit description=Zinc finger, C3HC4 type (RING finger), putative
  Pfam annotation: Domain name=zf-C3HC4; Domain location=108-157; Score= 34.1; E_value=4.9e-07; Accession=PF00097.15; Description=Zinc finger, C3HC4 type (RING finger)
MSTLQMSRVDLEQGNVNHRHSVVGSDVSGEGSVCFSDADDGSCYSRFYSTNGGSYDDYSFACVSDPEVGGVPHSGRASSSASECSVEAETRSGVPEIKVHLAKVEKDCRICHMGLESDSHESGAPIQLGCSCKDDLAAAHKHCAEAWFKIKGNSDECKAEEDGGGCIWKPILEATVAATTARALQWDGLAVRHRHVHGCGHHSHVAEPHHGGKGVGATTNVEAKDTWNNQGKCRSFSERECLRDCRCVGLSFDEGSGGGSSGRKKGFDRKVLSGIVVVLGVVVRKKRGFELDCCGFGGGGEEEEGTCEICHSVARNVYGGNEESTEHLSDVNNATTAATLSTPAPSAEPRRFWHGHRFLNFLLACMVFAFVISWLFHFNVPSS

SEQ ID NO: 125212 - protein, 232 aa, Glycine max
  Coding DNA Sequence Number=SeqID_8434
  Homolog annotation: Hit_ID=Q2HRE8; Match level="QueryCoverage=79%, HitCoverage=46%, E-value=5e-71, Identity=64%"; Hit description =Lipopolysaccharide-modifying protein
  Pfam annotation: Domain name=DUF821; Domain location=2-231; Score =187.4; E_value=3.4e-53; Accession=PF05686.3; Description=Arabidopsis thaliana protein of unknown function (DUF821)
MADIRRELGKCNPTKEHDWNARIHNIQWNKEEANNFESSKLENQCNFRYKIYVEGAAWSVSEKYIIGCDSMTLFIEPTYYEFFTRSMVPLQHYWPISPKNMCEDIKYAVDWGNAHLDNAQVIGNGGTSFIVENLKTKFVYDYMFYLLNEYAKLLKFKPTIPTGAVEICSESMACSVHGLEKRFMVESMVTSPSDTPPCTMPPPYTPETLKEFLQEKENIIKQVKTKEVNTKM

SEQ ID NO: 125213 - protein, 57 aa, Glycine max
  Coding DNA Sequence Number=SeqID_8435
MKGHGVGVVEAKKAKDEGHGIEVAIASSGDECLDGRNMMVGHGGNSVLKSVFGSGHL

SEQ ID NO: 125214 - protein, 53 aa, Glycine max
  Coding DNA Sequence Number=SeqID_8436
MYRCHLHLTLHWKVDEGWSWLVFGIGGTHASSEAHHLIKERFWIKLGYKYGRG

SEQ ID NO: 125215 - protein, 87 aa, Glycine max
  Coding DNA Sequence Number=SeqID_8437
  Homolog annotation: Hit_ID=Q9FIZ2; Match level="QueryCoverage=82%, HitCoverage=67%, E-value=2e-23, Identity=65%"; Hit description =Arabidopsis thaliana genomic DNA, chromosome 5, TAC clone:K23L20
  Pfam annotation: Domain name=Mit_rib_S27; Domain location=12-79; Score=55.8; E_value=1.5e-13; Accession=PF08293.2; Description =Mitochondrial ribosomal subunit S27
MASGSLKNMLSVAMNQGVVEARARIFGHQLNPTGMKTPHKLLRMKLFGEKVAQWYPHDIKKDDPLVMARQEQEYSLSLTHIFIFYPS

SEQ ID NO: 125216 - protein, 127 aa, Glycine max
  Coding DNA Sequence Number=SeqID_8438
MDTWDQITNFNPSTIRNGYKDMLGRGKRVEVRDFPLPLPCLARSIHVHLEEFANCICIACGLQLYIETSRKPTPKLTSNSNKEHWVIAALHFDGSSFGNPRFRGLSADCTAKCFERIFGYFYMHNME

SEQ ID NO: 125217 - protein, 750 aa, Glycine max
  Coding DNA Sequence Number=SeqID_8439
  Gene Ontology: Mol. function=ATP-dependent helicase activity; Cellular component=cytoplasm; Biological process=regulation of translation
  Homolog annotation: Hit_ID=Q1T3M9; Match level="QueryCoverage=55%, HitCoverage=76%, E-value=0.0, Identity=76%"; Hit description =Helicase, C-terminal
  Pfam annotation: Domain name=DEAD; Domain location=388-604; Score =196.7; E_value=5.6e-56; Accession=PF00270.19; Description=DEADDEAH box helicase
  Pfam annotation: Domain name=Helicase_C; Domain location=634-710; Score=118.3; E_value=2.2e-32; Accession=PF00271.21; Description =Helicase conserved C-terminal domain
  Pfam module annotation: Pfam domain module=DEAD::Helicase_C; Domain location=388-604::634-710
RSLVKKSIAPARGNPDDEGERGVRAAKTLTGGGEQGADRAVQCDSTAGEPPGEWGVPREEGRIDNAVLAVHGEGEQDQGGEGGDHEGTGGADGGLRVEHGGQVGVRGECAGGGIGGEGGAGGGRRRAGAGGDRREEYHREDVADSGADGHVEVVCDGGVLVAGFLPQCGFQVGEDFSDENPAHVVAVDGENANLAALVLDYKDAIHGGEPEPEPEPEPEPESSRVPGSAAVPPPATTAAVCAEAFVAAAAAAAAAAVAEKGCQCRRRGREDRAVRTHGFEVSDCVGNDEMVKSVFENFNGLYSCIVEFLGIRTVSAMGVVVAACILQPYVISSKSLSQDWKARLKIPPADTRYRTEDVTATKGNEFEDYFLKRELLMGIYEKGFERPSPIQEESIPIALTGSDILARAKNGTGKTAAFCIPALEKIDQDNNVIQGSAGVAVTSRTFKFEGHINYFMVVDFLNKHDDWLYPCFELNVFNVFFCNAVVILVPTRELALQTSQVCKELGKHLKIQVMVTTGGTSLKDDIMRLYQPVHLLVGTPGRILDLAKKGVCILKDCAMLVMDEADKLLSPEFQPSIEQLIHFLPTTRQILMFSATFPVTVKDFKDRYLRKPYVINLMDELTLKVNRVELLAKKITELGYSCFYIHAKMLQDHRNRVFHDFRNGACRNLVCTDLFTRGIDIQAVNVVINFDFPKNAETYLHRVGRSGRFGHLGLAVNLITYEDRFNLIEQELGTEIKQIPPQIDQAIYCR

SEQ ID NO: 125218 - protein, 107 aa, Glycine max
  Coding DNA Sequence Number=SeqID_8440
  Gene Ontology: Mol. function=DNA binding; Cellular component=nucleus; Biological process=regulation of transcription
  Homolog annotation: Hit_ID=Q1T3L9; Match level="QueryCoverage=85%, HitCoverage=32%, E-value=4e-37, Identity=74%"; Hit description =Homeodomain-related
  Pfam annotation: Domain name=Myb_DNA-binding; Domain location=5-53; Score=48.4; E_value=2.5e-11; Accession=PF00249.21; Description=Myb -like DNA-binding domain
MGLKKGPWTAEEDEILVNYINKNGGHGSWRSLPNLAGLLRCGKSCRLRWTNYLRPDIKRGSFTLEDEKLIIQLHGILGNRYLIMLTKSETQNFNIALVNDGKIYFNS

SEQ ID NO: 125219 - protein, 207 aa, Glycine max
  Coding DNA Sequence Number=SeqID_8441
  Gene Ontology: Mol. function=DNA binding; Cellular component=nucleus; Biological process=regulation of transcription
  Homolog annotation: Hit_ID=Q1T3L9; Match level="QueryCoverage=88%, HitCoverage=68%, E-value=1e-47, Identity=54%"; Hit description =Homeodomain-related
MISLFFFKAIYFDSVQKNEPIHRWAAIASQLPGRTDNEIKNLWNTHLKKRLICMGLDPQTHQPLASPHNPNDKAHASSSTSTRHMAQWESARLEAEARLSREPHLYYNNNKTDSDYFLRIWNSDLGESFRDVHKLESSIKCESQSATTDLASLTPASIVKEEFLWGVKKIVSDSSSSSSELHHDSCDTSLQLLLDFPMNNDMSFLEL

SEQ ID NO: 125220 - protein, 65 aa, Glycine max
  Coding DNA Sequence Number=SeqID_8442
MKGQIRVFVLYRNRKPSWKIPLRLKVAVGDGESAWNFRNGFGRGFLQKLPRGFFEKLSQETSLRS

SEQ ID NO: 125221 - protein, 112 aa, Glycine max
  Coding DNA Sequence Number=SeqID_8443
MHREFKERLLDLGVEVGPVLPLGDHGSSQVSGGSQLSSKDAFLSKAEVKTDSENNGISEDVVCVTLGTISKIVMDNHSWCYPACIQCHRKIDIQTGPFTCGCGKDNDQPVLR

SEQ ID NO: 125222 - protein, 78 aa, Glycine max
  Coding DNA Sequence Number=SeqID_8444
MQDEVNGSTGNNKTKWYPILLKKRGPTGGHTVLLGRQMMHKLFIKEIATWRREGDTFGSDPLGMTLGEIEDYKLFMID

SEQ ID NO: 125223 - protein, 147 aa, Glycine max
  Coding DNA Sequence Number=SeqID_8445
  Gene Ontology: Mol. function=cysteine desulfurase activity; Cellular component=mitochondrion; Biological process=cysteine metabolic process
  Homolog annotation: Hit_ID=Q8ZN40; Match level="QueryCoverage=100%, HitCoverage=36%, E-value=2e-63, Identity=79%"; Hit description =Cysteine desulfurase
  Pfam annotation: Domain name=Aminotran_5; Domain location=5-147; Score=-165.6; E_value=0.00056; Accession=PF00266.9; Description =Aminotransferase class-V
MKLPIYLDYAATTPADPRVASKMMQFLTLDGTFGNPASRSHRFGWQAEEAVDVARNQVAELINADPREIVFTSGATEADNLALKGAAQQHQSRGKHIITSQTEHKAVLDSCAQLAREGFEVTFLQPGADGIVTPAMLEAALRDDTVL

SEQ ID NO: 125224 - protein, 67 aa, Glycine max
  Coding DNA Sequence Number=SeqID_8446
MKSGDMQRYPSGYPYKRFLLTLTREVRWQAEGQRVRWQAEIPYGRSHLSSTKANEFDGIRMMFVIRF

SEQ ID NO: 125225 - protein, 138 aa, Glycine max
  Coding DNA Sequence Number=SeqID_8447
MGPESTLRLIRTLGLLLHLWPNLLGVFYPMPLRGRIASPQVRLTSRDQCGYLHPFWRCQHLPVETILVSHRFLKNYVDLEPGCMQRLTSSFAPFVNQGQANPLTRGDLHRLMHLCHPDPGSQVTCEDIQAVIRTNGFC

SEQ ID NO: 125226 - protein, 83 aa, Glycine max
  Coding DNA Sequence Number=SeqID_8448
MVEVQQPCDPELSCHIDLQSWVQGSCICIYCSGYYKALASFRHILRGQNTVAKDALRRVQQVLVLEDPPHYIAADVDATLPLF

SEQ ID NO: 125227 - protein, 150 aa, Glycine max
  Coding DNA Sequence Number=SeqID_8449
  Gene Ontology: Mol. function=adenosine deaminase activity; Cellular component=intracellular; Biological process=RNA processing
  Homolog annotation: Hit_ID=UPI0000162BF0; Match level="QueryCoverage =72%, HitCoverage=35%, E-value=1e-33, Identity=64%"; Hit description =RNA binding / adenosine deaminase
MASSVSSSEESNWGKRVSEKVLSFYTSLPKKGKPQGREVTVLASFLLSSPSNDLKVVAMGTGTKCLGRSLLRTCGDVVHDSHAEVIARRALIRFFYTQIQHLTGSKHAPSNGGKRFKLDDGNSPFELDPGWRCFTELASLSFGNCGFRRK

SEQ ID NO: 125228 - protein, 219 aa, Glycine max
  Coding DNA Sequence Number=SeqID_8450
  Gene Ontology: Mol. function=helicase activity; Biological process =protein amino acid phosphorylation
  Homolog annotation: Hit_ID=Q9LTU4; Match level="QueryCoverage=99%, HitCoverage=17%, E-value=2e-50, Identity=46%"; Hit description =Helicase-like protein
  Pfam annotation: Domain name=DUF889; Domain location=116-219; Score= -91.8; E_value=2.9e-05; Accession=PF05970.5; Description=Eukaryotic protein of unknown function (DUF889)
MFFLYGFGGTGKTSIWRTLATSLRANNQIVIIVASSGITSLLLPGGRTAHSKFKILVPIFEDSTCNIHQGSELAELLNQTSLIIWDEAPMAHKFCFEVLVQSLRDIIKTKPSSNQIFGVKVMILRLKKNMHLQNNVQSPDEQETATFAKWILDIGDGIIGHENDGYSTIEIPEDLLITKYDDQIHAIVNSTFPDLSQHHNDPQFFNSRAILASTNETVE

SEQ ID NO: 125229 - protein, 132 aa, Glycine max
  Coding DNA Sequence Number=SeqID_8451
  Homolog annotation: Hit_ID=Q1RTJ9; Match level="QueryCoverage=89%, HitCoverage=35%, E-value=2e-14, Identity=40%"; Hit description =Cyclin-like F-box; F-box protein interaction domain
MPGYHLVGSCNGLHCGVSEIPEGYRVCFWNKATRVISRESPTLSFSPGIGRRTMFGFGYDPSSDKYKVVAIALTMLSLDVSQKTEMKVYRAGDSSWRYLKGFPVLWTLPKVGGVYLSGTLNWVVIKVTRGIL

SEQ ID NO: 125230 - protein, 224 aa, Glycine max
  Coding DNA Sequence Number=SeqID_8452
  Gene Ontology: Mol. function=oxidoreductase activity; Cellular component=membrane; Biological process=metabolic process
  Homolog annotation: Hit_ID=Q2SKG5; Match level="QueryCoverage=99%, HitCoverage=88%, E-value=3e-79, Identity=67%"; Hit description=Short- chain alcohol dehydrogenase-like protein
  Pfam annotation: Domain name=KR; Domain location=7-193; Score=-61.4; E_value=0.00085; Accession=PF08659.1; Description=KR domain
  Pfam annotation: Domain name=adh_short; Domain location=4-176; Score =81.2; E_value=3.3e-21; Accession=PF00106.15; Description=short chain dehydrogenase
  Pfam module annotation: Pfam domain module=KR::adh_short; Domain location=7-193::4-176
MSHKIALITGGNRGLGKNGALKLAAKGVDILFTWRGHAEEAQAVVKEIEALGARAVALQLDVGDSKQFDDFAARVKATLNETWQRDSFDYLVNNAGHGHYKLLAETSEEEFDALVNVHFKGPYFLTQKLLPLIADGGRILNISSGLTRMTLPGSGTYAAMKGAMEVLTRYQAKELGERRIRVNILAPGAIETDFGGGRVRDTKDLNAHIASVTALGRVGLPDDI

SEQ ID NO: 125231 - protein, 57 aa, Glycine max
  Coding DNA Sequence Number=SeqID_8453
MNETTNLTKSANPHNHDNAGEGKANRKQLKNPTSILALPHNIADLDSNLPHWDAYVD

SEQ ID NO: 125232 - protein, 42 aa, Glycine max
  Coding DNA Sequence Number=SeqID_8454
  Gene Ontology: Mol. function=glucose-6-phosphate isomerase activity; Biological process=gluconeogenesis
  Homolog annotation: Hit_ID=Q5W8C2; Match level="QueryCoverage=88%, HitCoverage=27%, E-value=3e-14, Identity=94%"; Hit description =Putative cytosolic phosphoglucose isomerase
MKRLVSMESNGKGVSIDGVPLPFEAGEIDVGEPGTNGQHSFY

SEQ ID NO: 125233 - protein, 194 aa, Glycine max
  Coding DNA Sequence Number=SeqID_8455
  Gene Ontology: Mol. function=iron-sulfur cluster binding; Biological process=electron transport
  Homolog annotation: Hit_ID=Q1SP72; Match level="QueryCoverage=93%, HitCoverage=94%, E-value=5e-48, Identity=55%"; Hit description =Ferredoxin
  Pfam annotation: Domain name=Fer2; Domain location=72-161; Score =26.7; E_value=8.4e-05; Accession=PF00111.17; Description=2Fe-2S iron- sulfur cluster binding domain
  Subcellular localization annotation: CTP_CleavageSite=31; ConfidenceScore=5.56e-01
MSLLQLQLSSHALRSITSSSHNFRPTYSSKRVSYVRTRIRAVGTVPEKDSDSDTTDPDEPPYVGLVFVSSVLLPDGTPDMHFRSACGGQRLRKIMLDSNVELYGPYARPLLNCGGGGTCGTCMVEVLEGKELLNPRTDKEKEILKKKPKNWRLACQTIVGKPDSRGAVVIQQLPEWKGHEWKYAKPGESNWESD

SEQ ID NO: 125234 - protein, 291 aa, Glycine max
  Coding DNA Sequence Number=SeqID_8456
  Gene Ontology: Mol. function=serine-type endopeptidase activity; Cellular component=integral to membrane; Biological process=beta -lactam antibiotic catabolic process
  Homolog annotation: Hit_ID=Q1T538; Match level="QueryCoverage=99%, HitCoverage=92%, E-value=1e-121, Identity=70%"; Hit description =Protein secE/sec61-gamma protein
  Pfam annotation: Domain name=Rhomboid; Domain location=104-252; Score= 203.3; E_value=5.7e-58; Accession=PF01694.12; Description=Rhomboid family
MGKKPPHLSDVEAARNPPSPPPTFHVPLPSMWFPWLVPLIFLATIAMFVYTMYENDCPAYLDEEVCLFSQYLGRFSFQPFRENPLLGPAIRTLRLLGALEKELVVDQNEVWRFFSCMFLHAGVVHLLANMFSLLFIGVRLEKEFGFLKIGLLYVLSGFGGSVLSVLHLKESEANTVSVGASGALFGLLGAMLSELLTNWSIYANKCAALTSLLIIVGLNLAVGFLPHVDNSAHVGGFLAGYFLGFVLLMRPQYGYVNRKYIPPGYDVKRKSKYKWYQYFFLIMSVIILLLG

SEQ ID NO: 125235 - protein, 101 aa, Glycine max
  Coding DNA Sequence Number=SeqID_8457
MGWIGESVDSIKSLQIRQVLTQAVSLDYANHVGSFISFLYPTTSICLCLRHGDREVEHATQAGADIHEEVQTATEQQDTGVLAENKPKRRIAKPTYLRDYI

SEQ ID NO: 125236 - protein, 81 aa, Glycine max
  Coding DNA Sequence Number=SeqID_8458
  Gene Ontology: Cellular component=plastoglobule
  Homolog annotation: Hit_ID=Q2HUB7; Match level="QueryCoverage=85%, HitCoverage=39%, E-value=7e-25, Identity=80%"; Hit description =Putative thiol-disulphide oxidoreductase DCC
MVARTIRYESLQSEAGKLLLRRSGKAPDDISSVVLVEKERSFIKSEAVLKIMEYIDLPFPQLAILLQFVPLLIEAEDITKS

SEQ ID NO: 125237 - protein, 208 aa, Glycine max
  Coding DNA Sequence Number=SeqID_8459
  Gene Ontology: Mol. function=RNA-directed DNA polymerase activity; Cellular component=chromatin; Biological process=RNA-dependent DNA replication
MTDPSSTSDKLEAALILLTNQQLSLTNQQRSLGDSMSQITHRLDELIHRVTPFFSSPPPHNSNPVHHPPPVPALQHRMKLDVPRFDGTDPLGWIFKINQYFEYHGTSEHDRLTIASFYMEGRALAWFQWMTSNGQFTLWPVFLQALQTRFAPSQYEDPMGSLFKLMQKSSVSTYLAEFEDLANRIVGLPAPFLLSCFVSGLTPEIRRE

SEQ ID NO: 125238 - protein, 205 aa, Glycine max
  Coding DNA Sequence Number=SeqID_8460
  Gene Ontology: Mol. function=polygalacturonase activity; Cellular component=cellulose and pectin-containing cell wall; Biological process=carbohydrate metabolic process
  Homolog annotation: Hit_ID=Q2HUB1; Match level="QueryCoverage=99%, HitCoverage=52%, E-value=8e-90, Identity=76%"; Hit description =Glycoside hydrolase, family 28
  Pfam annotation: Domain name=Glyco_hydro_28; Domain location=1-205; Score=56.3; E_value=9.9e-14; Accession=PF00295.8; Description =Glycosyl hydrolases family 28
  Subcellular localization annotation: CTP_CleavageSite=72; ConfidenceScore=5.42e-01
ISGKGTIDGRGSAWWQQPCVGNPQPGATCRPPTAVTFNRCNRLQLKGYTSINPARSHVTLTSCNKGIISNIRLIAPGTSPNTDGIDISGSTGIQVLNSFIATGDDCIAISAGSSKIKITGITCGPGHGISIGSLGTRGDTDIVEDVHVENCTLTETLTGVRIKTWQGGAGYARRITFENIRFVRANSPIIIDQFYCPHRSDCQNQ

SEQ ID NO: 125239 - protein, 63 aa, Glycine max
  Coding DNA Sequence Number=SeqID_8461
MACEVMIIIYWGIIGLSISNCSILQHIESNYCAAQSGYSDHYIKLCSALEQHQKIDTLNVYVI

SEQ ID NO: 125240 - protein, 176 aa, Glycine max
  Coding DNA Sequence Number=SeqID_8462
  Gene Ontology: Mol. function=transcription factor activity; Cellular component=nucleus; Biological process=regulation of transcription, DNA-dependent
  Homolog annotation: Hit_ID=Q2HUA6; Match level="QueryCoverage=99%, HitCoverage=100%, E-value=1e-49, Identity=61%"; Hit description =Pathogenesis-related transcriptional factor and ERF
  Pfam annotation: Domain name=AP2; Domain location=4-68; Score=129.9; E_value=6.9e-36; Accession=PF00847.10; Description=AP2 domain
MVQSKKFRGVRQRHWGSWVSEIRHPLLKRRVWLGTFGTAEEAARAYDDAAILMSGRNAKTNFPVADNQKGNHISSSSPTFSSALNAKLKKCCKSLSPSLTCLRLDTENSHFGVWQKRAGPRSESNWIMTVELERSNVNVVSDSQVVSVPEKVESKNGLDEEQKIALQMIEELLNRN

SEQ ID NO: 125241 - protein, 157 aa, Glycine max
  Coding DNA Sequence Number=SeqID_8463
  Gene Ontology: Biological process=transport
  Homolog annotation: Hit_ID=Q2HUA7; Match level="QueryCoverage=74%, HitCoverage=80%, E-value=1e-60, Identity=94%"; Hit description =Longin-like
MGFHGVPAEERLHWRSFLVKLGADNLKGVKNEELLVACHKSVYIVYTVLGDVSIYVVGKEEYDELALSEVIFVITSAVKDVCGKPPSERLFLDKYGRICLCLDEIVWKGYLENTEKDRIKRLVRTWVLGGVVTLLTLYGMTAKMWIARNAWACKFVL

SEQ ID NO: 125242 - protein, 60 aa, Glycine max
  Coding DNA Sequence Number=SeqID_8464
MNQAQTLRIQLTPSSNLVKLGLTELISTPADNFQVPRVSTMHPPPSGYGMIFVAACVEAQ

SEQ ID NO: 125243 - protein, 35 aa, Glycine max
  Coding DNA Sequence Number=SeqID_8465
MVSKGVAEVALWWHGGDWTVVEGVVGKQKGPTRSH

SEQ ID NO: 125244 - protein, 419 aa, Glycine max
  Coding DNA Sequence Number=SeqID_8466
  Gene Ontology: Mol. function=glucose-1-phosphate adenylyltransferase activity; Cellular component=chloroplast; Biological process =glycogen biosynthetic process
  Homolog annotation: Hit_ID=P55230; Match level="QueryCoverage=85%, HitCoverage=80%, E-value=1e-135, Identity=58%"; Hit description =Glucose-1-phosphate adenylyltransferase large subunit 2, chloroplast precursor
  Pfam annotation: Domain name=NTP_transferase; Domain location=96-316; Score=216.2; E_value=7.7e-62; Accession=PF00483.13; Description =Nucleotidyl transferase
  Subcellular localization annotation: CTP_CleavageSite=70; ConfidenceScore=5.79e-01
MVASELQGFFMSLGSKKTSFHRDRNLPSSFTGSRVNLLHSKSVASGFRLGKYFSVTQRNTTRRFLATSTLADVANDFMALQSPILTGREANPKTVASIILGGGAGTRLFPLTQRRAKPAVPFGGCYRLVDIPMSNCINSGINKIYVLTQFNSQSLNRHIARTYNWGGCINFGGGFVEVLAATQTPGESGKKWFQGTADADADHKNIENILILCGDQLYRMDYMEIVQHVDTSIFGLSAQEARKFPYIASMGIYVFKIDVLLKVLRGCYPNANDFGSEVIPMAAKDFNVQACLFNGYWEDIGTIKSFFDANLALMDQRPKFQLYDQSKPIFTCPRFLPPTKMEKCEVINSLISDGCFLKECTVEHSIVGIRSRLDSGVQLKDTMIMGADYYQTEAVIASLLAAGNVPIGIGKNTKILSEF

SEQ ID NO: 125245 - protein, 575 aa, Glycine max
  Coding DNA Sequence Number=SeqID_8467
  Gene Ontology: Mol. function=phospholipase D activity; Cellular component=membrane; Biological process=phosphatidylcholine metabolic process
  Homolog annotation: Hit_ID=Q1T525; Match level="QueryCoverage=92%, HitCoverage=65%, E-value=0.0, Identity=81%"; Hit description=C2; Peptidase, cysteine peptidase active site
  Pfam annotation: Domain name=PLDc; Domain location=123-161; Score =39.8; E_value=9.6e-09; Accession=PF00614.12; Description =Phospholipase D. Active site motif
  Pfam annotation: Domain name=PLDc; Domain location=451-478; Score =41.2; E_value=3.5e-09; Accession=PF00614.12; Description =Phospholipase D. Active site motif
  Pfam module annotation: Pfam domain module=PLDc::PLDc; Domain location=123-161::451-478
MIHVKLQYFHVSKDLSWGQGIGSPKFPGVPYTSHTETRILGGQSVGDATLGELLKKKARDGVRVLMLVWDDRTSVPLLKEDGLMATHDEDTENYFYDSEVHCVLCPRNPDDGGSVVQDVEIFSMFSHHQKIVVVDSALPNGRSDKRRIVSFVGGIDFCDGRYDTQFHSLFRTLGTVHHDDFHQPNFSHTSIKKGGPREPWHDIHSRLEGPIAWDVLFNFEQRWKKQGGKDLLIPPKDLENVIIPPSVVTYPEDHEAWNVQLFRSIDGGAAFGFPETPEEAARSGLISGKDNIIDRGIQDAYIKAIRRAKNFIYIENQYFLGSCYAWSADGIKPEDIGALHLIPRELSLKIVSKIEAWERFSVYIVVPMWPEGYPEKGTVQAILDWQRRTMDMMYKDVVGALKGKGNEEDPLNYLTFFCLVNRELKKEGEYVPPERPDPHTDYMRAQVSRRFMIYVHAKMMIVDDEYIIIGSANINQRSMDGARDSEVAMAAYQPYHLATKQPARGQIHGFRMSLWYEHLGLLHDSFLHPESEECIEKVNQIADKYWDLYTTEPHLSKTFLAICFATLLRFPAKEM

SEQ ID NO: 125246 - protein, 1229 aa, Glycine max
  Coding DNA Sequence Number=SeqID_8468
  Gene Ontology: Mol. function=protein tyrosine phosphatase activity
  Homolog annotation: Hit_ID=Q6F2V0; Match level="QueryCoverage=97%, HitCoverage=98%, E-value=0.0, Identity=54%"; Hit description =Expressed protein
MSQIPKEPEQVMKMRGGCVLGKKTILKSDHFPGCQNKRLSPQIDGAPNYRQASDSLHVHGVAIPTIHGIRNVLNHIGARLKVLWISLREEPLAYINGRPFVLRDVERPFSNLEYTGINRERVEQMEARLKEDILVEAARYGNKILVTDELPDGQMVDQWEPVSCDSVKTPLEVYEELQVEGYLVDYERVPITDEKSPKELDFDILFPSLLPCHSAAAAGNIRLMAASFFSVFVCSYLGYDVSYEFSGVGTGFPRSNSIGRIFQSMTNVADHLPNSEEAIRRGEYAVIRSLIRVLEGGVEGKRQVDKVIDKCASMQNLREAIATYRNSILRQPDEMKREASLSFFVEYLERYYFLICFAVYIHSERAALRSNTADHCSFADWMRARPELYSIIRRRDPMGALGYSSLKPSLKKIAESTDGRPSEMGVVAALRKGEVLGSQTVLKSDHCPGCQNPSLPERVDGAPNFREVPGFPVYGVANPTIDGIRSVIQRIGSSKGGRPILWHNMREEPVIYINGKPFVLREVERPYKNMLEYTGIDRERVEKMEARLKEDILREAKQYGGAIMVIHETDDKHIFDAWEDVTSDVIQTPLEVFKSLEAEGLPIKYARVPITDGKAPKSSDFDTLANNIASAAKDTAFVFNCQMGRGRTSTGTVIACLVKLRIDYGRPIKILGDDVTHEESDRGSSSGDEAGGYVTTLSSNTLQRKTDDKQNCAFGINDILLLWKITTLFDNGVECREALDVIIDRCSALQNIRQAVLQYRKVFNQQHVEPRVRRVALNRGAEYLERYFRLIAFAAYLGSEAFDGFCGQGESKMTFKVWLHQRPEVQAMKWSIRLRPGRFFTVPEDLREPQESQHGDAVMEAIVKARNGSVLGKGSILKMYFFPGQRTSSHIQIHGAPHVYKVDEYPVYCMATPTISGAKEMLDYLGAKPKPSLTAQKVILTDLREEAVVYINYTPFVLRELNKPVNTLKYVGITGPVVEHMEARLKEDILAEIRQSGGRMLLHREEYNPSTNQSGVVGYWENIQADDVKTPAEVYSALKDDGYDIVYQRIPLTRERNALASDIDAIQYCQDDLYPYCLETVIPPCFGGVAYAMAIICIRLDAGSKVSQPLFGPHIGAVTEEDLPSQTSNEMALSMGDYGDILNLTRVLIHGPQSKADVDIVIERCSGAGHIREDILYYNGEFEKFTDDDDEERAYLMDMGIKALRKMLVAHHASFSSAQEYEVAQSEYR

SEQ ID NO: 125247 - protein, 93 aa, Glycine max
  Coding DNA Sequence Number=SeqID_8469
MQANLTFLTITFVFLIGSVNIRFEGAIQENKRFERYLRIEKPRKTYISVNNKGERITASSIMPCSKLACQKHSKSLQLRVIKKLVPDKSHQPK

SEQ ID NO: 125248 - protein, 64 aa, Glycine max
  Coding DNA Sequence Number=SeqID_8470
MEVFFSGFGGEGGEAVVTERNGAAMSLELFRETKGMKRSKGLKLKGMTCWKEMVLVEEVTVGSW

SEQ ID NO: 125249 - protein, 309 aa, Glycine max
  Coding DNA Sequence Number=SeqID_8471
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9LVZ9; Match level="QueryCoverage=92%, HitCoverage=73%, E-value=1e-117, Identity=72%"; Hit description=Beta- 1,3-glucanase-like protein
  Pfam annotation: Domain name=Glyco_hydro_17; Domain location=28-309; Score=273.3; E_value=5e-79; Accession=PF00332.9; Description =Glycosyl hydrolases family 17
MMLSSFFLWLLLFSSLFSHGDKAFTGTYGVNYGRIADNLPPPESVVTLLKAAKIKNIRIYDADHQVLRAFKGSGIEIVVGLGNEFLKDMSVGEDRAMSWVKENVQQFLPETKICGIAVGNEILGGTDMELWEVLLPAAKNVYNALSKLGLAKDVQVSSPHSEAVFANSFPPSSCTFKEDVLPYMKPLLQFFSQIGTPFFINAYPFLAYKNDPQHIDLNYALFLKNPGIYDAKTKLHYSNMFEAQVDAAYAALEKVGFDKMDVIVSETGWASHGDDNEAGATIKNARTYNGNLRKRLLKKKGTPYRPKKV

SEQ ID NO: 125250 - protein, 669 aa, Glycine max
  Coding DNA Sequence Number=SeqID_8472
  Gene Ontology: Mol. function=protein serine/threonine kinase activity; Cellular component=ubiquinol-cytochrome-c reductase complex; Biological process=protein amino acid phosphorylation
  Homolog annotation: Hit_ID=Q8RWZ5; Match level="QueryCoverage=99%, HitCoverage=84%, E-value=0.0, Identity=51%"; Hit description =Putative S-receptor kinase
  Pfam annotation: Domain name=PAN_1; Domain location=180-264; Score =6.5; E_value=0.035; Accession=PF00024.16; Description=PAN domain
  Pfam annotation: Domain name=Pkinase; Domain location=347-617; Score =180.1; E_value=5.3e-51; Accession=PF00069.15; Description=Protein kinase domain
  Pfam annotation: Domain name=Pkinase_Tyr; Domain location=348-617; Score=109.7; E_value=8.6e-30; Accession=PF07714.7; Description =Protein tyrosine kinase
  Pfam module annotation: Pfam domain module=PAN_1::Pkinase::Pkinase _Tyr; Domain location=180-264::347-617::348-617
MELLDSGNLVLLGENGTAIWQSFSHPTDTLLPRQDFVDGMTLKSFHNSLNMCHFLSYKAGEQAQGSSRNNTGKVHSASLVSNSLSFYDINRALLWKVVFSEHSDPKSLWAATLDPTGAITFYDLNKGRAPNPEAVKVPQDPCGIPQPCDPYYVCFFENWCICPKLLRTRFNCKPPNISTCSRSSTELLYVGEELDYFALKYTAPVSKSNLNACKETCLGNCSCLVLFFENSTGRCFHFDQTGSFQRYKRGAGAGGYVSFMKVSISSASDDGHGNKNRRNDAVLVVVIVVLTVLVIVGLIMGFWYFYKRKKNVAKYPQDDLDEDDDFLDSLSGMPARFTFAALCRATKDFSTKIGEGGFGSVYLGVLEDGIQLAVKKLEGVGQGAKEFKAEVSIIGSIHHVHLVKLKGFCAEGPHRLLVYEYMARGSLDKWIFKNSDNTFLLNWDTRYNIAIGTAKGLAYLHEECEVRIIHCDIKPQNVLLDDNFTAKVSDFGLAKLMSREQSHVFTTLRGTRGYLAPEWITNYAISEKSDVFSYGMLLLEIVGGRKNYDQWEGAEKAHFPSYVFRMMDEGKLKEVLDPKIDIDEKDERVEAALKVALWCIQDDVSLRPSMTKVAQMLDGLCPVPDPPSLSQSGTYSAFMKLSSGEATSSGQASFFSNVPMSCVQLSGPR

SEQ ID NO: 125251 - protein, 175 aa, Glycine max
  Coding DNA Sequence Number=SeqID_8473
MEKIKLVVRECDGNKCPGPDGILNYVSVMKELKNIRDLRLDDPLASFLFLMGDRDLFISLQFADGEALIQNVLSLKVVLVKCFEIIFGLKVNFHKAKLTVITVSNETLQRLAVKENEYKEKKIYDWCTSKKKNIDAAWEVVGESAHDNVHYHIRPFSQRRKAWSKLSASASTSTA

SEQ ID NO: 125252 - protein, 365 aa, Glycine max
  Coding DNA Sequence Number=SeqID_8474
  Homolog annotation: Hit_ID=Q41108; Match level="QueryCoverage=94%, HitCoverage=92%, E-value=1e-144, Identity=76%"; Hit description=Pv42p
  Pfam annotation: Domain name=CBS; Domain location=226-361; Score =16.3; E_value=0.0022; Accession=PF00571.18; Description=CBS domain
  Pfam annotation: Domain name=CBS; Domain location=33-204; Score=6.0; E_value=0.018; Accession=PF00571.18; Description=CBS domain
  Pfam module annotation: Pfam domain module=CBS::CBS; Domain location =226-361::33-204
KIKAMQEAKLGGEINMQRSGSMQLKEKKVRDLMVDKKRLVEVPYMASLAHTMTTLVANKVVAVPVAAPPGKWIGAGGSMIVESDKQTGDVRKHYIGMVTMLDIVAHIAGDDHLGGGDDITKDLDQKMSDPVSSVIGHSFEGLTLWTLNPNTSLLDCMEVLSKGVHRAMVPVDGQAENMSAGVELVESASSYQMLTQMDVLRFLHDRAGEADRELQSILSRSVQDLGADTEQIYAITDRTKLVDAIKCLKAAMLNAVPIVRASDGRCRKLIGTFSATDLRGCHVATLKSWLGISALAFTEEVASSPLYTESDTQINRRELVTCFAESPLSEVIEKAVTRHVHRVWVVDHEAQFHAQLELCLICHEN

SEQ ID NO: 125253 - protein, 80 aa, Glycine max
  Coding DNA Sequence Number=SeqID_8475
  Gene Ontology: Mol. function=protein binding; Biological process=two -component signal transduction system (phosphorelay)
  Homolog annotation: Hit_ID=Q104N3; Match level="QueryCoverage=95%, HitCoverage=58%, E-value=2e-26, Identity=71%"; Hit description=AHP6a
MGIHLNQFMGSSSSIGAKRVTNVCAAFRAATDQSNRAGCLRALEMLEHEYCYLKNKLHELFQIEQQRALVAGVRYPVQNQ

SEQ ID NO: 125254 - protein, 633 aa, Glycine max
  Coding DNA Sequence Number=SeqID_8476
  Gene Ontology: Mol. function=hydrolase activity; Cellular component =nucleus; Biological process=tRNA processing
  Homolog annotation: Hit_ID=Q4SAV4; Match level="QueryCoverage=83%, HitCoverage=58%, E-value=2e-38, Identity=28%"; Hit description =Chromosome 3 SCAF14679, whole genome shotgun sequence
  Subcellular localization annotation: CTP_CleavageSite=54; ConfidenceScore=5.72e-01
MAQVSKFGHLLLHSSLPKPSNSNIQFRSLLTLLASSSKRHRSIPPFRRKSTTPKPMEVKEESSSFNKRRAQGRDKNDISQKNLYLKVRKLNPINTISFVQILGTGMDTQDTSPSVLLFFDNQRFIFNAGEGLQRFCTEHKIKLSKIDHIFLSRVCSETAGGLPGLLLTLAGMGEDGMSVNIWGPSDLKYLVDAMRSFIPNAAMVHTKSFGPIFNTDGPIVPHQSKLLDPIVLIDGEVVKISAIILQPNCIEGQVLTPSESSSQERMDHSPETLDSPNGKKLPAAKPGDMSVVYVCELPEIKGKFDPEKAKALGLRPGPKYRELQLGNSVKSDHQNIMVHPSDVLGPSVPGPIVLLVDCPTESHLEALLSMQSLASYCDQTDNLPEAGKSVTCVIHLTPASVVSCSNYQKWMKKFGSAQHIMAGHEKKNVEIPILKASARIATRLNYLCPQFFPAPGLWSLPNHDSSKFGCLASREDSLSEFSEVISAENLLKFTLRPYAQLGLDRSCIPTRADSSEIIDELLSEIPEVLEAVKHVSQLWQECSQTKEDLTPVADHGMMNEEPWLCANGIPACLENIRRDDLEIVLLGTGSSQPSKYRNVSSIYINLFSRGGLLLDCGEGTLGQLKRRQVYPYP

SEQ ID NO: 125255 - protein, 92 aa, Glycine max
  Coding DNA Sequence Number=SeqID_8477
MQALNMHFKTVQYVCKTNVRYGLTSTLTWFIDTSKSLFERHTLFTVYGRRVQKDKVFLYGGLVGNIGIVKEVQTSSQSQNRREGIRKCIGRG

SEQ ID NO: 125256 - protein, 49 aa, Glycine max
  Coding DNA Sequence Number=SeqID_8478
MAMADNSGFSVSFYFLLSSSLHFILCGQVAGSNTGHGQVKENALVVETE

SEQ ID NO: 125257 - protein, 694 aa, Glycine max
  Coding DNA Sequence Number=SeqID_8479
  Gene Ontology: Mol. function=voltage-gated potassium channel activity; Cellular component=integral to membrane; Biological process=potassium ion transport
  Homolog annotation: Hit_ID=Q9SL29; Match level="QueryCoverage=99%, HitCoverage=99%, E-value=0.0, Identity=72%"; Hit description =Putative cyclic nucleotide-gated ion channel 15
  Pfam annotation: Domain name=IQ; Domain location=621-641; Score=18.7; E_value=0.02; Accession=PF00612.17; Description=IQ calmodulin-binding motif
  Pfam annotation: Domain name=Ion_trans; Domain location=113-401; Score=31.6; E_value=2.7e-06; Accession=PF00520.21; Description=Ion transport protein
  Pfam annotation: Domain name=cNMP_binding; Domain location=502-602; Score=28.6; E_value=2.2e-05; Accession=PF00027.19; Description =Cyclic nucleotide-binding domain
  Pfam module annotation: Pfam domain module=IQ::Ion_trans::cNMP _binding; Domain location=621-641::113-401::502-602
MAFGNSRSARFEDDPELAKFPVTNGDNGAKIKFHIDGTQIPEPSSNMAPKKVAGKFLKTRMLSRVFSEDYGRVKRIVLDPRGQTIHRWNKIFLVACLVSLFVDPLFFYLPVVRDEVCIDIGITLEVILTLILMKFRTAFVAPSSRVFGRGELVLGYYKIAFRYLRKGFWLDFVAALPLPQVLIWIVIPTLRGSTMANTKNVLRFFIIFQYIPRLLLIFPLSSQIVKATGVVTETAWAGAAYNLMLYMLASHILGACWYLLSIERQEACWRSVCDLEKSFCQYGFFDCHRVKGALRVSWFMASNITNLCSPNANHDFYQFGIYADAVTSKVTSSAFFNKYFFCLWWGLRNLRIIPLVNAFLIGGCSSLGQGLLTSTYVGEIMVAIVVATLGLVLFALLIGNMQTYLQSTTVRLEEWRVKRTDTEQWMHHRQLPPELRESVRKYDQYKWLATRGVDEEALLKGLPVDLRRDIKRHLCLDLVRGVPLFDQMDERMLDAICERLKPALCTEGMFLVREGDPVNEMLFIIRGHLDSYTTNGGRAGFFNSCCIGPGDFCGEELLTWALDPRPSVILPSSTRTVKAISEVEAFALIAEDLKFVASQFRRLHSKQLRHKFRFYSHQWRTWAACFIQAAWRRHKKRKEVAELIRARAIHVNVVDEPQTQTPTYAKRVARSTRTDSGVVSSLQKPAEPDFSVVE

SEQ ID NO: 125258 - protein, 260 aa, Glycine max
  Coding DNA Sequence Number=SeqID_8480
  Gene Ontology: Mol. function=RNA-directed RNA polymerase activity; Cellular component=mitochondrion; Biological process=RNA-dependent DNA replication
  Homolog annotation: Hit_ID=P92567; Match level="QueryCoverage=53%, HitCoverage=67%, E-value=2e-22, Identity=39%"; Hit description =Hypothetical mitochondrial protein AtMg01410
MRDSYPICQSQVEEKRVYRIPSFGSPERLAQSIDSGAAEHVSSYDLKSATDGWPINLQGDILAFLFGSEVEVPFCRAPYHKGGWGDPVEYPFARGRPVVSFETGQPLGYLSSWPLFTLSHHLVLQSCAEKVYPGRYFDRYAILGDDICITDRKIASIYHQVVTNLGVDLSIPKSLVSNSGGAEFSKCFRCHNLSVDFLRWKACRRLLGKEREEAPTVVDELSSIYMSSSSSAGTIFSKGSEVSRGHEMKGIKKGRRKLRH

SEQ ID NO: 125259 - protein, 572 aa, Glycine max
  Coding DNA Sequence Number=SeqID_8481
  Gene Ontology: Mol. function=heat shock protein binding; Cellular component=mitochondrial matrix; Biological process=response to heat
  Homolog annotation: Hit_ID=P92424; Match level="QueryCoverage=83%, HitCoverage=99%, E-value=6e-95, Identity=44%"; Hit description=DnaJ homologue precursor
  Pfam annotation: Domain name=DnaJ; Domain location=67-128; Score =136.7; E_value=6.3e-38; Accession=PF00226.21; Description=DnaJ domain
  Pfam annotation: Domain name=DnaJ_C; Domain location=317-459; Score =26.8; E_value=1.2e-08; Accession=PF01556.9; Description=DnaJ C terminal region
  Pfam annotation: Domain name=DnaJ_CXXCXGXG; Domain location=151-235; Score=99.8; E_value=8.4e-27; Accession=PF00684.9; Description=DnaJ central domain (4 repeats)
  Pfam module annotation: Pfam domain module=DnaJ::DnaJ_C::DnaJ _CXXCXGXG; Domain location=67-128::317-459::151-235
  Subcellular localization annotation: CTP_CleavageSite=76; ConfidenceScore=5.80e-01
MAVTTLSLLPPSTRPCFCGTVHLRSHNSFLSIHSTSSSSFLSFSSISIPNHSPTRRPFHTVLASSSDYYSTLGVPKSATGKEIKAAYRRLARQYHPDVNKEPGATEKFKEISAAYEVLSDDKKRALYDQYGEAGVKSAVGGGSSAYTAIFGKEKEFELSHLETCEVCTGTGAKIGSKMRVCSTCGGRGQVMRTEQTPFGLFSQVSVCPNCGGDGEVISEYCRKCNGEGRIRVKKNIKVKVPPGVSSGSILRVTGEGDAGPRGKEGYFKVKGALVSVLLNLKTNVPSKLEYSSIVNGTEGLDIKNSTIQPTPNVFYSQKVNSREENCPSLTRGPPGDLYVYLDVQEIPGIQRDDINLVSMLSISYLDAIRGAVVKVKTVEGISELQIPAGTQPGDVLVLARKELATLGDASRRSKSRPRTHSSGGGTESPTAQKDESPTATVEEKTEKSEDENDVWNKLKDFAGAVTLILTGAVTLVWFYNGFYVLDNNLQIWINLRRPPPTTVHGSNCDRETWWCEFRQPLSKHVWGGITISGGWVREGEGKERSERGRGVDAVAEVEEEGDDGVEEKKRRW

SEQ ID NO: 125260 - protein, 2370 aa, Glycine max
  Coding DNA Sequence Number=SeqID_8482
  Gene Ontology: Mol. function=RNA splicing factor activity, transesterification mechanism; Cellular component=spliceosome; Biological process=nuclear mRNA splicing, via spliceosome
  Homolog annotation: Hit_ID=Q9T0I6; Match level="QueryCoverage=98%, HitCoverage=98%, E-value=0.0, Identity=87%"; Hit description =Splicing factor-like protein
  Pfam annotation: Domain name=Mov34; Domain location=2133-2239; Score =62.8; E_value=1.1e-15; Accession=PF01398.11; Description=Mov34MPNPAD- 1 family
  Pfam annotation: Domain name=PRO8NT; Domain location=78-241; Score =399.5; E_value=5.1e-117; Accession=PF08082.2; Description=PRO8NT (NUC069) domain
  Pfam annotation: Domain name=PROCN; Domain location=426-834; Score =1107.4; E_value=0; Accession=PF08083.2; Description=PROCN (NUC071) domain
  Pfam annotation: Domain name=PROCT; Domain location=2245-2369; Score =306.7; E_value=4.2e-89; Accession=PF08084.2; Description=PROCT (NUC072) domain
  Pfam module annotation: Pfam domain module=Mov34::PRO8NT::PROCN::PROCT ; Domain location=2133-2239::78-241::426-834::2245-2369
  Subcellular localization annotation: CTP_CleavageSite=43; ConfidenceScore=5.07e-01
MWNNGQILPPGTSVPPIPPPPAAQPSYTVLPPPPPPPAPMETEADAEARLEEKARKWQQLNSKRYSDKRKFGFVETQKEDMPPEHVRKIIRQVFFLSESESCSDHGDMSSKKYRHDKRVYLGALKFIPHAVYKLLENMPMPWEQVRDVKVLYHISGAITFVNEIPWVVEPIYLAQWGTMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCVYHTPMIMFIKAEDPDLPAFYYDPLIHPITSANKERREKRVYEEDDDDDWILPDGVEPLLKDTQLYTDTTAAGISLLFAPRPFNMRSGRMRRAEDIPLVSEWYKEHCPPSYPVKVRVSYQKLLKCFVLNELHHRPPKAQKKKHLFRSLQATKFFQTTELDWVEAGLQVCRQGYNMLNLLIHRKNLNYLHLDYNFNLKPVKTLTTKERKKSRFGNAFHLCREILRLTKLVVDANVQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALEKLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQSIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETKHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLERQCSCVFLGTNLLVYLDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVGESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLSDDQWMKVEVALRDLILSDYAKKNNVNTSALTQSEIRDIILGAEITPPSQQRQQIAEIEKQAHEANQVTAVTTKTTNVHGEELIVTTTSPYEQAAFGSKTDWRVRAISATNLYLRVNHIYVNSEDIKETGYTYIMPKNILKKFICIADLRTQISGYMYGVSPPDNPQVKEIRCIVMPPQWGTHQQVHLPSALPEHDFLNDLEPLGWMHTQPNELPQLSPQDLTSHAKILENNKQWDGEKCIILTCSFTPGSCSLTAYKLTPSGYEWGRVNKDTGSNPHGYLPTHYEKVQMLLSDRFLGFYMVPDNGPWNYNFMGVRHASGMKYGVKLGTPREYYHEDHRPTHFLEFSNMEEVETAAEGDREDTFS

SEQ ID NO: 125261 - protein, 425 aa, Glycine max
  Coding DNA Sequence Number=SeqID_8483
  Gene Ontology: Mol. function=phosphoinositide binding; Biological process=cell communication
  Homolog annotation: Hit_ID=Q1S2J1; Match level="QueryCoverage=79%, HitCoverage=57%, E-value=3e-39, Identity=32%"; Hit description=Phox -like
MEKLLPDVDVSRSAPVAMFLELEAAARSSFHDVNEHVSDEASANATTPSHMIQDNSPGSVKAHGSSAAIVPGNNEVSELGTPQHGKDNCSDQIMDNSTLEHGLINPTETNVHCATSSENFVYKDNITDKVTGYTADAIAIHLDGTEFTPAVQDYNLNAHVKRLSTENITSDLSSLRNTETSNLTTTTLVQDALHSLAGSHEASRNSDLFFTFPLDEQHKLKKILNTQKQRLVTTKADVEDLIARLNQEMAARQYLVTKVSVVYTNAVGYGGTSEEMPETEMKLKLEEDERLLAESTKESVIQEKQMLQQELDVAREQLKHLQKHHDEFEMKSKTDMKVLIKEVKSLRSSELELKQQLSELMKEKLDLEGIVKSLLHRSCHLHESFINLGTETIFHAIFNFTFENTIPCSIRQGWSRLRLQADTTC

SEQ ID NO: 125262 - protein, 94 aa, Glycine max
  Coding DNA Sequence Number=SeqID_8484
  Gene Ontology: Mol. function=protein dimerization activity
  Homolog annotation: Hit_ID=Q5IH79; Match level="QueryCoverage=65%, HitCoverage=8%, E-value=2e-15, Identity=59%"; Hit description=HAT -like transposase
  Pfam annotation: Domain name=zf-BED; Domain location=20-71; Score =53.4; E_value=7.4e-13; Accession=PF02892.5; Description=BED zinc finger
MEFNIPDSETQQNSRRRKKSTVWEHFTVKKDGPGCARAYCKRCQKSFAYLKDSKQSGTSHLKRHIALGICQKNLGILCSKTDANPPKKQARAKP

SEQ ID NO: 125263 - protein, 110 aa, Glycine max
  Coding DNA Sequence Number=SeqID_8485
  Subcellular localization annotation: CTP_CleavageSite=68; ConfidenceScore=5.07e-01
MFIPVLVIAINSWVQDICYSTPRWVPRLQNVPVTNGKGTHPFVEGSFTVPKGLLSCRGVCLMFLVEVSGARVFGKAKGMIPTKDTPTLNDDNHGRMVFPVCTCRRTRCNV

SEQ ID NO: 125264 - protein, 282 aa, Glycine max
  Coding DNA Sequence Number=SeqID_8486
  Gene Ontology: Mol. function=NADH dehydrogenase (ubiquinone) activity; Cellular component=mitochondrion; Biological process =electron transport
  Homolog annotation: Hit_ID=O22769; Match level="QueryCoverage=100%, HitCoverage=86%, E-value=1e-97, Identity=67%"; Hit description=NADH -ubiquinone oxidoreductase 24 kDa subunit, mitochondrial precursor
  Pfam annotation: Domain name=Complex1_24kDa; Domain location=43-276; Score=163.2; E_value=6.5e-46; Accession=PF01257.9; Description =Respiratory-chain NADH dehydrogenase 2
MLARLAASRFNEIRQIFRQPSRAFSTALNYHLDTPDNNPKLPWEFTEANQAKVKEILSHYPSNYKQSATIPLLDLAQQQHGGWLPVSAMDADAKYIYSKDDPFEILANIVKVKPFVLVIVCLVHPFVKVAKIVEVPPIRVYEVATFYSMFNRAKVKAYCALMLSMLLIHINKGQSLSGPTCFQVGKYHLLVCGTTPCMIRGSRGIEEALLKHLGVKRNEVTPDGLFSVGEMECMGCCVNAPMITVADYSNGSEGYTYNYFEDVTPEKVVEIVEKLRKGEKPP

SEQ ID NO: 125265 - protein, 122 aa, Glycine max
  Coding DNA Sequence Number=SeqID_8487
MVMTQGPTVAVRASSSGGSRGSNGRAKEDSCDYARERRQQAIAKGGCETKKKKKEKEEAKGIKKDNRRENVKERKRNEKMKVGDLSSLHRQELLVHGTTTEGDGQQGRGHAVSCDRGRWHGS

SEQ ID NO: 125266 - protein, 112 aa, Glycine max
  Coding DNA Sequence Number=SeqID_8488
  Gene Ontology: Mol. function=calcium ion binding
  Homolog annotation: Hit_ID=Q7FZ95; Match level="QueryCoverage=70%, HitCoverage=45%, E-value=8e-26, Identity=76%"; Hit description =Calcineurin-like protein
MGVLRKEKCMMHQKMSKCGQQIEEKIKSENWVSNLVSQQEIVSLYQRFCQLDRNAKGFISADEFLSVPEFAMNPLSQRLLKMVDGLNFKDFVAFLSAFSAKASAQQKIERTF

SEQ ID NO: 125267 - protein, 867 aa, Glycine max
  Coding DNA Sequence Number=SeqID_8489
  Gene Ontology: Mol. function=protein binding; Cellular component =intracellular; Biological process=primary shoot apical meristem specification
  Homolog annotation: Hit_ID=Q1S365; Match level="QueryCoverage=99%, HitCoverage=76%, E-value=0.0, Identity=87%"; Hit description =Lissencephaly type-1-like homology motif; CTLH, C-terminal to LisH motif; WD40-like; ...
  Homolog annotation: Hit description=Quinonprotein alcohol dehydrogenase-like
  Pfam annotation: Domain name=WD40; Domain location=447-487; Score =36.6; E_value=8.6e-08; Accession=PF00400.22; Description=WD domain, G-beta repeat
  Pfam annotation: Domain name=WD40; Domain location=491-531; Score =24.1; E_value=0.00051; Accession=PF00400.22; Description=WD domain, G-beta repeat
  Pfam annotation: Domain name=WD40; Domain location=581-620; Score =3.4; E_value=14; Accession=PF00400.22; Description=WD domain, G-beta repeat
  Pfam annotation: Domain name=WD40; Domain location=820-857; Score =6.6; E_value=6.2; Accession=PF00400.22; Description=WD domain, G -beta repeat
  Pfam module annotation: Pfam domain module=WD40::WD40::WD40::WD40; Domain location=447-487::491-531::581-620::820-857
MSSLSRELVFLILQFLDEEKLEQESGFFFNMKYFEDEVHNGNWDEVERYLSGFTKVDDNRYSMKIFFEVMKQKYLEALDKHDRSKAVEILVKDLKVFATFNDELFKEITQLLTLENFRENEQLSKYCDTKSARAIMLVELKKLIEANPLFHDKLQFPNLKSSRLRTLINQSLNWQHQLCKNPRPNPDIKTLFVDHSCGQLNGAPAPSPANNLLLGSLPKAGGFPPLGAHGPFQPSPAPVPTPLAGWMSNPTTVAHPEVSGGAIGLGVPSIPAALKHPRTPPTYPSVDYPSGDSDHVSKRTRPMGMSDEVNLPVNVLSATFPGHGHGHGHGQAFNAPDDLPKTAMRTLNQGSSPMSMDFHPVQQTLLLVGTNVGDIALWEVGSRERLLMRNFKVWDLSACSMPFQAALVKDPGVSVYRVIWSPDGALFGVAYSRHIVQIYSYHSGDDVQQHLEIDAHVGGVNDLAFSHPNKQLCVITCGDDKTIKVWDAATGAKQYTFEGHEAPVYSVCPHYKENIQFIFSTALDGKIKAWLYDNLGSRVDYEAPGRWCTTMAYSADGTRLFSCGTSKDAESSIVEWNESEGAVKRTYQGFRKRSLGFVQFDTTKNRYLAAGDDFSIKFWDMDNIQLLTTVDADGGLPGSPRIRFNKDGALLAVSAKENGIKILANADGIRLLRTLENSLYDTSRTSEVMTKPTINPISAAAAAATSAALGERALSVNGDARNLGDVKPRISEESNDKSKIWKLTEINEPSQCRSLKLPENVRVNKISRLIYTNSGNAILALASNAIHLLWKWQRNDRNSTVKASASVQPQLWQPSSGILMTNDITDSNTEDAVPCFALSKNDSYVMSASGGKISLFNMMTFKVSYDP

SEQ ID NO: 125268 - protein, 87 aa, Glycine max
  Coding DNA Sequence Number=SeqID_8490
MVAAACESETESGGTCCRCVTCKHHSTHFLLSQCPSLLNLITHALDSYLGEYANAYGGGGAAAAIVVDAWMDVISSQGSSLLKLLLQ

SEQ ID NO: 125269 - protein, 95 aa, Glycine max
  Coding DNA Sequence Number=SeqID_8491
  Gene Ontology: Mol. function=calcium ion binding
  Homolog annotation: Hit_ID=Q7FZ95; Match level="QueryCoverage=91%, HitCoverage=50%, E-value=5e-30, Identity=72%"; Hit description =Calcineurin-like protein
  Pfam annotation: Domain name=efhand; Domain location=15-43; Score =26.5; E_value=9.2e-05; Accession=PF00036.22; Description=EF hand
  Pfam annotation: Domain name=efhand; Domain location=56-84; Score =2.7; E_value=7.5; Accession=PF00036.22; Description=EF hand
  Pfam module annotation: Pfam domain module=efhand::efhand; Domain location=15-43::56-84
MEGVFRRADSCNNEFFTVIFKVYDSDRNGKVSFKDMLEVLKDLSGPFMSDEQREEVLSQVLREAGYTKDSYLTLDDFIKVLGQSDLKMDVEVPVD

SEQ ID NO: 125270 - protein, 82 aa, Glycine max
  Coding DNA Sequence Number=SeqID_8492
MAQEIVGPEIRGHDNGVFPLPSPLAVPKQRGGRTRLVQSGIERNWVKRVTGYSTQFPGYFLQVTKHIAIPSFSIYGISAPMD

SEQ ID NO: 125271 - protein, 537 aa, Glycine max
  Coding DNA Sequence Number=SeqID_8493
  Gene Ontology: Mol. function=acetate-CoA ligase activity; Cellular component=cytoplasm; Biological process=metabolic process
  Homolog annotation: Hit_ID=Q6H798; Match level="QueryCoverage=82%, HitCoverage=59%, E-value=0.0, Identity=82%"; Hit description =Putative acetyl-CoA synthetase
  Pfam annotation: Domain name=AMP-binding; Domain location=2-350; Score=188.2; E_value=2.1e-53; Accession=PF00501.18; Description=AMP -binding enzyme
MKRVDTKWKEGRDIWWQDVIHQYPTTCPVEWVDAEDPLFLLYTSGSTGKPKGVLHTTGGYMVYTATTFKYAFDYKPHDIYWCTADCGWITGHSYVTYGPMLNGASVIVYEGAPNYPDAGRCWDIVDKYKVTIFYTAPTLVRSLMRDGDTFVTRYSRKSLRVLGSVGEPINPSAWRWFYNVVGDSRCPISDTWWQTETGGFMITPLPGAWPQKPGSATLPFFGVQPVIVDEKGVEIEGECNGYLCVKKSWPGAFRTLYGDHERYETTYFKPFSGYYFSGDGCSRDKDGYHWLTGRVDDVINHLNMNVFHAVLFYLMFKSDIVPVICSGHRIGTAEVESALVSHPQCAEAAVVGVEHEVKGQGIYAFVTVVDGVPYSEELRKDLVLTVRKQIGAFAAPDKIHWAPGLPKTRSGKIMRRILRKIASRQLDELGDTSTLSDPNVIKVLWSFCFGYGSTWTITYDFTSIITPEDVLESLMNDGTVDALRLKIINQLKANEELKNTTIKMTEQNKILNTPAAEKQTKRDESSLRRLGKNYSLC

SEQ ID NO: 125272 - protein, 262 aa, Glycine max
  Coding DNA Sequence Number=SeqID_8494
  Gene Ontology: Mol. function=glyceraldehyde-3-phosphate dehydrogenase (NADP+) (phosphorylating) activity; Cellular component=chloroplast; Biological process=reductive pentose-phosphate cycle
  Homolog annotation: Hit_ID=P12858; Match level="QueryCoverage=90%, HitCoverage=59%, E-value=1e-112, Identity=86%"; Hit description =Glyceraldehyde-3-phosphate dehydrogenase A, chloroplast precursor
  Pfam annotation: Domain name=Gp_dh_N; Domain location=69-220; Score =304.7; E_value=1.6e-88; Accession=PF00044.14; Description =Glyceraldehyde 3-phosphate dehydrogen
  Subcellular localization annotation: CTP_CleavageSite=54; ConfidenceScore=5.52e-01
MASATLSVAKPALQANGKGFSEFSGLRSSSGFLPFSRKSSEDFHSVIAFQTYAVGSSGGYKKGVTEAKLKVAINGFGRIGRNFLRCWHGRKDSPLDVIAINDTGGVKQASHLLKYDSILGTFDADVKPVGSDIISVDGKEIKVVSDRNPANLPWKDLGIDLVIEGTGVFVDREGAGKHIQAGAKKVLITAPGKGDIPTYVVGVNEYDYSPDEPIISNASCTTNCLAPFVKVLDQKFGNVPCHNHIFFSLSSCPIHEIEECFK

SEQ ID NO: 125273 - protein, 145 aa, Glycine max
  Coding DNA Sequence Number=SeqID_8495
AGGAGKNGERRLTARLPEEVFRKLSGRRVLPEIPNVSGRNLLPESFRKQGSSGKRLVSSGRTLLPESFPNGSSGSLAVSPLSPFFPAPPALVFYPMAKEAAAGLAVACGGRECSRKRKEKKQKHWVKVKRMLPEEERKETKALGE

SEQ ID NO: 125274 - protein, 510 aa, Glycine max
  Coding DNA Sequence Number=SeqID_8496
  Gene Ontology: Mol. function=transferase activity; Cellular component= nucleus; Biological process=regulation of transcription
  Homolog annotation: Hit_ID=Q9FJY7; Match level="QueryCoverage=75%, HitCoverage=62%, E-value=2e-72, Identity=36%"; Hit description =Selenium-binding protein-like
  Pfam annotation: Domain name=PPR; Domain location=116-150; Score =34.7; E_value=3.2e-07; Accession=PF01535.11; Description=PPR repeat
  Pfam annotation: Domain name=PPR; Domain location=186-220; Score =17.4; E_value=0.052; Accession=PF01535.11; Description=PPR repeat
  Pfam annotation: Domain name=PPR; Domain location=248-282; Score =37.3; E_value=5.2e-08; Accession=PF01535.11; Description=PPR repeat
  Pfam annotation: Domain name=PPR; Domain location=284-318; Score=4.8; E_value=2; Accession=PF01535.11; Description=PPR repeat
  Pfam annotation: Domain name=PPR; Domain location=350-384; Score =39.3; E_value=1.4e-08; Accession=PF01535.11; Description=PPR repeat
  Pfam annotation: Domain name=PPR; Domain location=385-419; Score=2.0; E_value=4.3; Accession=PF01535.11; Description=PPR repeat
  Pfam module annotation: Pfam domain module=PPR::PPR::PPR::PPR::PPR::PP R; Domain location=116-150::186-220::248-282::284-318::350-384::385 -419
MASATLSAAKPALQVQQVKKIHLLFQIQFFVCIHPDIINAPYLGTPRTRFGSEEALVLLQKCSNFKQLKQVHGKIIRFGLTYDQLLMRKLIQLSSSYGKMKYATLVFDQLNAPDVFTWNVMIRAFTIGGSPKMALLLFKAMLCQGFAPDKFTYPFVINACMASSALDLGIVAHALAIKMGFWGDLYVQNTMMNLYFKCENVDDGRKVFDKMRVRNVFAWTTVISGLVACGKLDTARELFEQMPSKNVVSWTAMIDGYVKHKQPIEAFNLFERMQQVDNVRPNEYTLVSLVRACTEMGSLKLGRRVHDFALKNGFELEPFLGTALIDMYSKCGYLDDARTVFDMMQVRTLATWNTMITSLGVHGYRDEALSLFDEMEKANEVPDAITFVGVLSACVYMNDLELAQKYFNLMTDHYGITPILEHYTCMVEIYTRAIELDENYTSGNTMEANHDVAELLHKNKLTSFDDIKKLIHKQYGDLDFSELVLDHSSTSSPPQVPSSRGMQIDISKTS

SEQ ID NO: 125275 - protein, 170 aa, Glycine max
  Coding DNA Sequence Number=SeqID_8497
MKRICDSISCKKEGQTRKGQQVARRKGKPGKDNKHCREVRPATSLTFWYRREELVPVTRCSHHRYRDTGEVMGFSDLSSVGEGCYLELSRRRSHPQTKTHGIACTNDEDMTKSKGKDPLEGLGGPMTRARARKAKEALQQVLSILFEYKPKFQGEKSKVVSCIMAQMKED

SEQ ID NO: 125276 - protein, 133 aa, Glycine max
  Coding DNA Sequence Number=SeqID_8498
MTLIVIVVYILGRALGRQISGDVEESPQRRRSTVAAHRQLAAAAAAKDVEHVNHPVNEVHKQSHKSPLLMMLEMKFMDDDGDMAEMYLPEKKSLSTTVSCLLFQLKEYIDDTEDFINIQLVYGTTTSYSHGET

SEQ ID NO: 125277 - protein, 111 aa, Glycine max
  Coding DNA Sequence Number=SeqID_8499
MDIDLGLDNLSNSRHQLLPNNMKNTKGAAIFLGRETNLFALRLPLSYVDFFILTFKALSKANDLDPAERMADSELCPNPSLYLSGRPIHYKFFFINKALLELEFGIKKNQL

SEQ ID NO: 125278 - protein, 84 aa, Glycine max
  Coding DNA Sequence Number=SeqID_8500
MSPQNLLKKQSKQHIKLNSKRKDIVFFEITVGIEGLRIRKRLGDRVRVKENAEGGVVAVNGALVVPLGLFGEGLQESGWNGEKV

SEQ ID NO: 125279 - protein, 212 aa, Glycine max
  Coding DNA Sequence Number=SeqID_8501
VASDSLVFKHLSPVINLAYIRKNCWNPDDLTVTIREARRVRTRLVEAPSTSTAPPPACTLAAPSAPAYADFQRLEAVLQNIHQGQIILLQSLQMVAPPNSIPSVEQFNEWVAWPGTQSSLHREGEGPQPRKKADQTQEAATTSEKSLEATFEPSEPVTNIASLQQAADPSTPEDQTTPVLSPKTSPTTTVVLHLTDEEDVQTQDTQDRSQDF

SEQ ID NO: 125280 - protein, 97 aa, Glycine max
  Coding DNA Sequence Number=SeqID_8502
MSPVESPTVATYPSAGVRKGPLEWAKGASSIEGKCMESPSTFIQEKCYKNQKDKGQRILKMKVPELFTHGEGYEQSVKTRFKQRKRSLMIEEGDEDA

SEQ ID NO: 125281 - protein, 217 aa, Glycine max
  Coding DNA Sequence Number=SeqID_8503
  Homolog annotation: Hit_ID=Q2R300; Match level="QueryCoverage=92%, HitCoverage=20%, E-value=9e-69, Identity=63%"; Hit description =Importin, putative, expressed
MKSAYLYLIDDVSQDALSACGSLLEISIQKAAICCTAMHRGAALAAMSYLSCFLDVGLVSLLECMNCITEGSFNITAIHVISHSGEGLVSNVVYALLGVSAMSRVHKCATILQQLAAICTLTERTTWKAILCWQTLHGWLHAAVQALPSEYLNHGEAEAIVPLWSKALADAASDYLESKNSDGLKSDFGHMQGKGGRVLKRLVREFADSHRNIPNLT

SEQ ID NO: 125282 - protein, 180 aa, Glycine max
  Coding DNA Sequence Number=SeqID_8504
  Homolog annotation: Hit_ID=Q8H6R2; Match level="QueryCoverage=30%, HitCoverage=25%, E-value=4e-12, Identity=70%"; Hit description=CTV.15
MVVFEGRGTLKALLVLGFVVSALFNFRFDDNDKDFACMLEATMILGFGHEGEASGPGLKGFAATQVMRGGPNESGRQRSPHNLITFHSSDSHHRVLHRRSKKVQPPTTQRQHMHVLFSLDDDTASLFLSLFDGNGRCSCTLTGEKLVDDVDVDVDANAEEYERGDDVWFLEEGEAIDIVD

SEQ ID NO: 125283 - protein, 157 aa, Glycine max
  Coding DNA Sequence Number=SeqID_8505
  Homolog annotation: Hit_ID=Q2R300; Match level="QueryCoverage=89%, HitCoverage=14%, E-value=4e-32, Identity=49%"; Hit description =Importin, putative, expressed
GLDKWHLSLEDEEEVMHAISLILGSVPSRELKNKLLAKLLSPSYEAIGKLVDPEISLSLKQNPASYTQVLNASSRGLHRMGTVFSHLPISMATEPAADDSILSLLRVFWPILEKFFGSEHMENGNLSVAACRALSLAVRSSGLPTWTHLFTVLWFLL

SEQ ID NO: 125284 - protein, 196 aa, Glycine max
  Coding DNA Sequence Number=SeqID_8506
  Homolog annotation: Hit_ID=Q8H6R4; Match level="QueryCoverage=98%, HitCoverage=99%, E-value=2e-50, Identity=54%"; Hit description=Jp18
MDWFSWLSKSGLEPSLVYEYGLTFAHNELEEEDMFYFNHEFLQSMGISIAKHRLEILKLARKEKGKSPRAVARLAVAIKRTKNTFASYVRTLMHKEESSSSNSALVVVPVPPSRPSSSGLGKRWKSAMMKRGKKQETLFLTNGSSTVVPAQPGFSSPVVYHFQKDEKMGGDDDDGYWSAAVEEIKWDTMFQDLKPN

SEQ ID NO: 125285 - protein, 215 aa, Glycine max
  Coding DNA Sequence Number=SeqID_8507
  Gene Ontology: Mol. function=nucleic acid binding; Cellular component= intracellular; Biological process=nuclear mRNA 3'-splice site recognition
  Homolog annotation: Hit_ID=O80897; Match level="QueryCoverage=94%, HitCoverage=74%, E-value=6e-94, Identity=80%"; Hit description =Putative spliceosome associated protein
MDREWGSKPGSGGAASAQNEAIDRRERLRRLALETIDLAKDPYFMRNHLGSYECKLCLTLHNNEGNYLAHTQGKRHQTNLAKRAAREAKDAPAQPQPHKRKVTLRKTVKIGRPGYRVTKQYDPETKQRSLLFQIEYPEIEDLMKPRHRFMSSYEQRVQPFDKRYQYLLFAAEPYEIVAFKVPSTEIDKSTPNFFSHWDPDSKMFTFSEEALSSSF

SEQ ID NO: 125286 - protein, 151 aa, Glycine max
  Coding DNA Sequence Number=SeqID_8508
  Homolog annotation: Hit_ID=Q1S375; Match level="QueryCoverage=24%, HitCoverage=2%, E-value=3e-07, Identity=67%"; Hit description=Globin- like
MDNNNWRPNQGTEANMDTSDWRGGLPHESRQRIVNKMSKDPWRAESLEGEITLGLRFTKFNHGIVDPSIPAKRSMAKITLYFSFDEMFPAIRDLNPIQKSLNRVPLDLSFFTTAKASPRATSAAVRCHCCCQLLHLLPNVPDSQHISSHFL

SEQ ID NO: 125287 - protein, 97 aa, Glycine max
  Coding DNA Sequence Number=SeqID_8509
MAVSEWHMLVLTYPKATLVSASKAMKCSTVESMKNIGTSKINLLTIENKMENLEANPDEDAYDLVSHNRIENVKARTVERDKGFHELITNSAFQTVC

SEQ ID NO: 125288 - protein, 67 aa, Glycine max
  Coding DNA Sequence Number=SeqID_8510
MAVGVMGGQQSPSDSHVFMGESHYKNSKEKKWTKFEVENYHRVLKCGGEDSFQIANTEEATAIRMIL

SEQ ID NO: 125289 - protein, 500 aa, Glycine max
  Coding DNA Sequence Number=SeqID_8511
  Homolog annotation: Hit_ID=Q1S375; Match level="QueryCoverage=97%, HitCoverage=37%, E-value=1e-116, Identity=50%"; Hit description =Globin-like
MSHESSLDSTAQTGQSSGGDWQEEVYQKIKSMKESYLPELNEMYQKIASKLQQHDSLPQQPKSDQLEKLKVSKSNISPNFKEKLNSYEKQIINFINTNRPRKNMPGHLPSPHMHSMSQSQPQVTQVQSHENQMNSQLQTTNMQGSVATMQQNNMAAMQHNSLSGVSTAQQSKMNSMQPSTNLDSGPGNAVNSLQQVPVSSLQQNPVSAPQLTNVNSLSSQAGVNVVQPNHNPLQPGSSMLQHQQLKQQQEQQMLQNQQLKQQYQRQLIQRKQQQILQQQQQQQQLHQTAKQQLPAQLPTHQIQQLHQMNDANDIKMRQGISVKPGVFQQPLTSSQRSTYPHQQMKGSPFPVSSPQLLQATSPQIPQHSSPQVDQQNHLPSLTKVATPLQSANSPFVVPTPSPPLAPSPMPGDSEKPISGVSSISNAANIGYQLTGGAAAPAQSLAIGTPGISASPLLAEFTGPDGAHGNALAPTSGKSTVTEQPIERLIKAVSLVDLKLA

SEQ ID NO: 125290 - protein, 79 aa, Glycine max
  Coding DNA Sequence Number=SeqID_8512
MEENWRSHAFHVQVSFEAFNSKPNKDHTSFSNLVGAAYNALIDMARKYDEEMLAEGLSPKPRKDLGTKLLLMMNLKVPY

SEQ ID NO: 125291 - protein, 252 aa, Glycine max
  Coding DNA Sequence Number=SeqID_8513
  Gene Ontology: Mol. function=metal ion binding; Cellular component =cytoplasm; Biological process=ubiquitin cycle
  Homolog annotation: Hit_ID=Q6H890; Match level="QueryCoverage=79%, HitCoverage=63%, E-value=5e-81, Identity=70%"; Hit description=BRAP2- like protein
  Pfam annotation: Domain name=BRAP2; Domain location=51-161; Score =136.6; E_value=7e-38; Accession=PF07576.2; Description=BRCA1 -associated protein 2
  Pfam annotation: Domain name=zf-C3HC4; Domain location=168-207; Score= 40.1; E_value=7.4e-09; Accession=PF00097.15; Description=Zinc finger, C3HC4 type (RING finger)
  Pfam module annotation: Pfam domain module=BRAP2::zf-C3HC4; Domain location=51-161::168-207
  Subcellular localization annotation: CTP_CleavageSite=39; ConfidenceScore=5.25e-01
MWSSTSSTAAIPSDEEPSESSSSSSFSTSLFNFSSGNPRIEETRGLMHLFPDDTPSTLPVGRKPLVCVVGVPNHMTYADFCQFCGSFIQHMLEMRIVRMDGMEDQYSVLVRFDDQDSTDSFYKHYNGRRFSSLEVEVCRVLFTLDVQYTGSIEHAQPSNATSTELPTCPVCLERLDQDTGGILTTICNHSFHCSCISKWADSSCPVCRYCQQQAEKSICFVCQTTENLWICVICGVRMQTMDVEVAAVKIMP

SEQ ID NO: 125292 - protein, 88 aa, Glycine max
  Coding DNA Sequence Number=SeqID_8514
  Subcellular localization annotation: CTP_CleavageSite=26; ConfidenceScore=5.16e-01
MRNLANPPSPPLSSGNDTPSTLPPLVCVVGVPNHMTYADFCQFCGSFIQHMLEMRIVWYATGIYAYSCSQITIAITSAILMSSSFFMF

SEQ ID NO: 125293 - protein, 375 aa, Glycine max
  Coding DNA Sequence Number=SeqID_8515
  Gene Ontology: Mol. function=oxidoreductase activity, acting on the CH-OH group of donors, NAD or NADP as acceptor; Cellular component =chloroplast; Biological process=branched chain family amino acid biosynthetic process
  Homolog annotation: Hit_ID=P93832; Match level="QueryCoverage=98%, HitCoverage=99%, E-value=1e-147, Identity=66%"; Hit description=3 -isopropylmalate dehydrogenase 2, chloroplast precursor
  Pfam annotation: Domain name=Iso_dh; Domain location=45-360; Score =548.2; E_value=8.3e-162; Accession=PF00180.10; Description =Isocitrateisopropylmalate dehydrogenase
  Subcellular localization annotation: CTP_CleavageSite=30; ConfidenceScore=5.09e-01
MAACLQLWQCKLARPFDSLPVRRSIPLSLRCSAAPSSSKPTRSYSITLIPGDGIGPEIISVAKDVLVLAGYLEGIKYDFREMLMGGAALDATGLPLPHETLSAAKQSHAVLLGAVGGYKWDRNDKHLKPETGLLQIRKELGVFANLRPATVYSPLVDASTLKREVAEGVDIMLIRELTGEPRGFGTNDNGEEIGFNTEIYATHEASMLWRKRFLAIAQEYPDVELSHMYVDNASMQLIRDPKQFDTMVTNNIFGDILSDEASMVTGSIGMLPSASLGASGPGLFEPIHGSAPDIAGQDKANPFATVLSAAMLLRYGLGEEKAAERIENAVMDTLNRGFRTGDIYSAGTKLVGCKQLGEEILKSVESNVPAGAAAV

SEQ ID NO: 125294 - protein, 105 aa, Glycine max
  Coding DNA Sequence Number=SeqID_8516
  Gene Ontology: Mol. function=protein dimerization activity; Cellular component=nucleus; Biological process=regulation of transcription
  Homolog annotation: Hit_ID=Q1SP83; Match level="QueryCoverage=85%, HitCoverage=24%, E-value=6e-34, Identity=96%"; Hit description =AUX/IAA protein
  Pfam annotation: Domain name=AUX_IAA; Domain location=1-71; Score= -14.3; E_value=2e-08; Accession=PF02309.7; Description=AUXIAA family
QCNSPGLPGKDGLSESSLRDLLHGSEYVLTYEDKDGDWMLVGDVPWEMFTDSCRRLRIMKGSEAIGLDLLNMCSELSWLQLQGPWKNLGAKTNAEKTCLTEAGYY

SEQ ID NO: 125295 - protein, 144 aa, Glycine max
  Coding DNA Sequence Number=SeqID_8517
MVYISGGNCHIITGHAEGSEIGVEAIEAEEAGARDGAVGRGDADEAARCEEEGEGQEDEKEDDDAREVEGTGTGDSGEVIGGSGGDAEENVLVLLCLGFVGVSVGVAVGAGVDAAGGESPLQHGGRGEIGMTVSRGGGAAALRL

SEQ ID NO: 125296 - protein, 362 aa, Glycine max
  Coding DNA Sequence Number=SeqID_8518
  Gene Ontology: Mol. function=protein binding; Cellular component =membrane; Biological process=meiosis
  Homolog annotation: Hit_ID=Q655Y4; Match level="QueryCoverage=88%, HitCoverage=89%, E-value=1e-115, Identity=60%"; Hit description=LEM3- like
  Pfam annotation: Domain name=CDC50; Domain location=78-350; Score =374.1; E_value=2.1e-109; Accession=PF03381.6; Description=LEM3 (ligand-effect modulator 3) family  CDC50 family
MDMPVDKDDAPTSKRTSKKPICVFFTWLDNCPVSFTILSHSKFSQQELPAWKPILTPGWVIATFSVIGVIFIPIGLASLFSSESVEEAVFRYDETCLPPSHAQNAVAYIQSDTTNKTCITKWTVEHKMEAPIYIYYQLDNYYQNHRRYVKSRNDKQLWNKAAEGETNNCFPEDKTKDNQPIVPCGLIAWSMFNDTYKFSTSNKDLTVNKKNIAWGSEQRSKFASDVYPKNFQRGDLIGGAKLNESIPLSQQEDLIVWMRTAALPTFRKLYGKIEVDLEVNDEIEIAIENNYNTYEFGGKKNLVLSTTTVMGGKNPFLGTAYLFVGGLSLFCAIAFILLYVIKPRPLGDPSYLSWNRNPGSMK

SEQ ID NO: 125297 - protein, 457 aa, Glycine max
  Coding DNA Sequence Number=SeqID_8519
  Gene Ontology: Mol. function=transcription regulator activity; Cellular component=nucleus; Biological process=regulation of transcription
  Homolog annotation: Hit_ID=Q1RW15; Match level="QueryCoverage=39%, HitCoverage=50%, E-value=1e-53, Identity=57%"; Hit description=Mg2+ transporter protein, CorA-like
  Pfam annotation: Domain name=CorA; Domain location=284-457; Score= -1.8; E_value=3.7e-06; Accession=PF01544.9; Description=CorA-like Mg2+ transporter protein
  Pfam annotation: Domain name=HLH; Domain location=103-152; Score =46.0; E_value=1.3e-10; Accession=PF00010.16; Description=Helix-loop -helix DNA-binding domain
  Pfam module annotation: Pfam domain module=CorA::HLH; Domain location= 284-457::103-152
EVDDEVVNESLCHTNLFDEEFLRDILQRPQEGAPNLNNSSIMSSLCAQDIKPTTLFPTTYILSFDNSAALLPTETDRDFSSSKLPSSNSRANHGIKKPGSASESLNHIMSERNRRQELTSKFIALAATIPGLKKMDKAHVLREAINYVKQLQERVEELEEDIQKNGVESEITITRSHLCIDDGTNTDECYGPNEALPEVEARVLGKEVLIKIHCGKHYGILLEVMSELERLHLYISASNVLPFGNTLDITIIAQMGDKYNLVAKDLVKELRQVAMMKRKGVGTTAVKSWMVVSETGHSRLEDVGKHSIMRRTGLPARDPRVLDPVLSYPSSILGRERAIVVNFEHVKAIITASELLLINSSNPFFLSFLQDLQTRLSNLNPSHCAETVTGTPAPNKPLPFEFKVLEECIESACRCLESEVEAYPALDELTSQLSTLNLERVRQIKSRLVELSGRVQK

SEQ ID NO: 125298 - protein, 51 aa, Glycine max
  Coding DNA Sequence Number=SeqID_8520
MSERKRRQLMAEIFIALSAIIPGSNKSFCNAFHHELMRGIQYKNPMLITLK

SEQ ID NO: 125299 - protein, 73 aa, Glycine max
  Coding DNA Sequence Number=SeqID_8521
MMRVISQLGKVFLVLGKTEWSNHIHGRIGLLTRKWGRMRRSSFATSLVNRLFLPRVKVKHQLSHALPKAKGLR

SEQ ID NO: 125300 - protein, 850 aa, Glycine max
  Coding DNA Sequence Number=SeqID_8522
  Homolog annotation: Hit_ID=Q8H3D8; Match level="QueryCoverage=26%, HitCoverage=99%, E-value=2e-72, Identity=54%"; Hit description =Integral membrane protein-like
  Pfam annotation: Domain name=SNARE_assoc; Domain location=692-794; Score=10.2; E_value=5.5e-05; Accession=PF09335.1; Description=SNARE associated Golgi protein
MPEKVESHRALWSSSINWRFGLLTALVLGGMVVVWSVDGFTVRDVIEAWSWSSPSIPLSLNQNQTNATTLFDSHNLVNITLSEHSETVSAKNYSSSGVSDKLDTKTPVKPEVKGHSTWLSRELEPDLTSNLLARWLAPGGEPCKDSKTVGISIPGLDGGKLIELSAGDVHEFGFQALDDSGKPHCLGGDYFETDLSGDAWKSRPLVKDFCNGSYSISLQVHPDFVGVYNLTIILLYRHFEGLKFTPWRFVYDRVVWNVAIRFYKSSAQLLELETCKASDFGKDVWCGRWTRHGRNDDCQIGNDGRYRCLAPSFPCKAPWCDGSLGVIESNGWVYSTHCSFKMYSAESAWKCLKNRWIFFWGDSNHVDTVRNMLNFVLDLPEIRSVPRRFDMNFSNPKDPSQTVRITSIFNGHWNETQNYLGLDSLRDEGFQNLLKKYFSEDTIPDTVIMNSGLHDGVHWLNIRAFSAGADYAASFWGDVMMSVKQRGLGWPRVFYRSTVATGGYARSLAFNPYKMEVFNGVLIEKLKKAGIITGVIDDFDMTFPWHFDNRCNDGVHYGRAPAKMKWRDGEIGHQYFVDLMLAHVLLNALHSLWNNAYHSRARSSSKQASPDLQDDEEECRPWRRRLIMSFSWSSTLRITILLLLLAAVIVACFTLPIEKMMKDFLLWVDHDLGPWGPLVLAVAYIPLTVLAVPASVLTLGGGYLFGLPVGFVADSIGATVGAGAAFLLGRTDYPQFRSVAIAIRRSGFKPITLALVYVGTTLKDLSDVTHGWGEFSKTRWAFIILGLVISVVLMICVTRVAKAALDKALAENEDIDGITSSPDLPIVAEPSADLNQPLIIKIDSSEDSHE

SEQ ID NO: 125301 - protein, 168 aa, Glycine max
  Coding DNA Sequence Number=SeqID_8523
  Gene Ontology: Mol. function=transcription regulator activity; Cellular component=nucleus; Biological process=regulation of transcription
  Homolog annotation: Hit_ID=Q1SYF1; Match level="QueryCoverage=72%, HitCoverage=38%, E-value=6e-21, Identity=46%"; Hit description=Basic helix-loop-helix dimerisation region bHLH
MALTRNGLERFVIINIIQKDKSSMLGKAIDYVKQLQERVTELEQRKKRGKESMIILKKSEANSEDCCRANKMLPDVEARVTENEVLIEIHCEKEDGLELIKILDHLENLHLCVTASSVLPFGNSTLSITIIAQKGQKLRKNMYPFVEGHSSFSGEYDMDYFSAVAFDT

SEQ ID NO: 125302 - protein, 172 aa, Glycine max
  Coding DNA Sequence Number=SeqID_8524
MKLRMSTSGGHPKPRLLIPAKQPLPERPGEKRCCYLLTLAELKAEEDLLLKERRNLKKELAFLRLTVEKHRATNESIKRKKLDFESRQNSSAAATASEVSGKAVNGSFQFVKAECHPSNSVSHDDSPVCAANVSPKAQDNIGNQESTFVLPDLNLPVDEDISANIMHYIELS

SEQ ID NO: 125303 - protein, 94 aa, Glycine max
  Coding DNA Sequence Number=SeqID_8525
MEGSQQNTHYPKEKLPKIITHKWKFGNLLEAPNTLPMKDLFVTKLESNEVLLSPIALKVVGPFLLDSNSSRDGTNPPSNFLYGNPQTRTQRDKQ

SEQ ID NO: 125304 - protein, 246 aa, Glycine max
  Coding DNA Sequence Number=SeqID_8526
  Gene Ontology: Mol. function=protein-tyrosine kinase activity; Cellular component=membrane; Biological process=protein amino acid phosphorylation
  Homolog annotation: Hit_ID=UPI000034ED8B; Match level="QueryCoverage =97%, HitCoverage=61%, E-value=5e-46, Identity=44%"; Hit description =ATP binding / kinase/ protein kinase/ protein serine/threonine kinase/ protein-tyrosine kinase
  Pfam annotation: Domain name=Pkinase; Domain location=109-246; Score=- 102.1; E_value=0.018; Accession=PF00069.15; Description=Protein kinase domain
  Pfam annotation: Domain name=Pkinase_Tyr; Domain location=109-246; Score=-85.1; E_value=3e-07; Accession=PF07714.7; Description=Protein tyrosine kinase
  Pfam module annotation: Pfam domain module=Pkinase::Pkinase_Tyr; Domain location=109-246::109-246
MENNKTFIGSGIQEVRTVHHQNLNKRILIALVACSTLLGGVFLFLLYVWFRRHKNLRCSKSISQETIETAKGETISSVNAKLNYSRMADKRSSVAIFDYQLLEAATNSFSTSNIMGESGSRIVYRARFDEHFQAAVKKAESDADREFENEVSWLSKIRHQNIIKLMGYCIHGESRFLVYELMENGSLETQLHGPNWGSSLTWHLRLRIAVDVARALEYLHEHNNPPVVHRDLKCSNVLLDSNFNAK

SEQ ID NO: 125305 - protein, 52 aa, Glycine max
  Coding DNA Sequence Number=SeqID_8527
MERIENETAQIARAKAKEEKAKAANDSLSEVDPLSEMHPFSEASAPLADGKS

SEQ ID NO: 125306 - protein, 994 aa, Glycine max
  Coding DNA Sequence Number=SeqID_8528
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q42556; Match level="QueryCoverage=95%, HitCoverage=99%, E-value=0.0, Identity=76%"; Hit description=ATPase 9, plasma membrane-type
  Pfam annotation: Domain name=Cation_ATPase_N; Domain location=66-131; Score=45.1; E_value=2.3e-10; Accession=PF00690.16; Description=Cation transporterATPase, N-terminus
  Pfam annotation: Domain name=E1-E2_ATPase; Domain location=143-364; Score=292.5; E_value=7.7e-85; Accession=PF00122.10; Description=E1 -E2 ATPase
  Pfam annotation: Domain name=Hydrolase; Domain location=368-654; Score=73.2; E_value=8.4e-19; Accession=PF00702.16; Description =haloacid dehalogenase-like hydrolase
  Pfam module annotation: Pfam domain module=Cation_ATPase_N::E1-E2 _ATPase::Hydrolase; Domain location=66-131::143-364::368-654
MDLRQMCPWLCYLHGHVEAHDRGQTQRVPLLCYWIELLENNMGSLENIKNEAVDLIYVLYYMQCNVIGLQERIPIDEVFRELNCSKEGLSNEEGQKRLQESKVLKFLGFMWNPLSWVMEAAAIMAIALANGGGEPPDWQDFVGIMVLLVVNSTISFIEENNAGNAAAALMAGLAPKTKVLRDGRWSEEEASILVPGDIISIKLGDIIPADARLLEGDPLKIDQSALTGESLPTTKHPGDEIFSGSTVKQGEIEAVVIATGVHTFFGKAAHLVDSCNQVGHFQKVLTAIGNFCICSIAVGMIIEIVVMYPIQHRKYRSGINNLLVLLIGGIPIAMPTVLSVTMAIGSHRLSEQGAITKRMTAIEEMAGMDVLCSDKTGTLTLNKLTVDKSLIEVFARDADKDTVMLLGARASRVENQDAIDACIVGMLGDPKEARDGITEVHFLPFNPVDKRTAITYIDTEGNWHRVSKGAPEQIIELCKLREDVKKKALSIIDKFADRGLRSLAVAKQEVPEKSKESAGGPWTFVGLLPLFDPPRHDSAETIRRALNLGVNVKMITGDQLAIGKETGRRLGMGSNMYPSSSLLGEHKDESIAGLPVDELIEKADGFAGVFPEHKYEIVKRLQERDHICGMTGDGVNDAPALKRADIGIAVADATDAARGASDIVLTEPGLSVIVSAVLTSRAIFQRMKNYTIYAVSITIRIVLGFMLLALIWKFDFSPFMVLIIAILNDGTIMTISKDRVKPSPVPDSWKLREIFVTGIVLGTYLAVMTVIFFWAAHASDFFSDKFGVRSIRENYSELTAAVYLQVSIVSQALIFVTRSRSWSYVERPGMFLLVAFFIAQLIATLIAVYANWGFAKMKGIGWGWAGVIWLYSIVFYIPMDILKFIIRYALTGKAWNTITENRVAFTTKKDYGKGEREAQWAAAQRTLHGLNPPETEEMLNEKNNYRELSELAEQAKKRAEVARLRELHTLKGHVESVVKLKGLDIETMQQHYTV

SEQ ID NO: 125307 - protein, 47 aa, Glycine max
  Coding DNA Sequence Number=SeqID_8529
MRCHTEFGVEEQEHENGGTKRDDTAKECAELGHYDVHDFCVDPKSHI

SEQ ID NO: 125308 - protein, 541 aa, Glycine max
  Coding DNA Sequence Number=SeqID_8530
  Gene Ontology: Mol. function=protein serine/threonine kinase activity
  Homolog annotation: Hit_ID=Q5K2M9; Match level="QueryCoverage=78%, HitCoverage=62%, E-value=1e-36, Identity=27%"; Hit description=START domain-containing protein
  Pfam annotation: Domain name=PH; Domain location=17-124; Score=37.9; E_value=3.6e-08; Accession=PF00169.19; Description=PH domain
  Pfam annotation: Domain name=START; Domain location=169-367; Score =16.1; E_value=7.9e-06; Accession=PF01852.10; Description=START domain
  Pfam module annotation: Pfam domain module=PH::START; Domain location= 17-124::169-367
MASSGAATAALQSDASSRMEGWLYLIRFNRIGLQFSRKRYFVLDGNLLRSFKSVPVSNNQDPVRSAIVDSCIRVMDNGRESVNRKVFFIFTLYNTSNHNDQLKFGASRPEEAARWIQSFHEASLRGAPDGGDDAVGCSKRRWQSFRLSGSSSSISHPNSVDWTLSSADVIAPSPWTIFGCQNGLRLFKEAKDRDSNGKKWDDHPAIMAVGVVDGTSEAIFQTLMSLGPSRSEWDFCFYKGNVVEHLDGHTDIIHKQLFSDWLPWGMKRRDLLLRRYWRREDDGTYVILYHSVFHKKCPPQKGYVRACLKSGGYVISPVNKGKQSVVKHMLAIDWKCWRSYLKSSSAHSITIRMLGRVAALRELFKARLGNCSSSDYSSGELTRNSELHIKEEVIINSDTEIQADENNHDNSVGEVDQTQSEHACLVTLNDADDEFYDVPEPSDCDESENGWMTECSQQKSQARNEMTKLKKKFIGSYLERKEWKGGGGAPIRFSYSPTNFSISCQIHWVLTASMFIIAHDIPRGAFKVGAASGHIYLSSFL

SEQ ID NO: 125309 - protein, 64 aa, Glycine max
  Coding DNA Sequence Number=SeqID_8531
  Subcellular localization annotation: CTP_CleavageSite=33; ConfidenceScore=5.06e-01
MVSEFTMPIQGCTLSGHTLPSNTKKLQTRQSVRSGHDGGPTWETLLTECNGKSNDVTNGFDRRV

SEQ ID NO: 125310 - protein, 551 aa, Glycine max
  Coding DNA Sequence Number=SeqID_8532
  Gene Ontology: Mol. function=ubiquitin-protein ligase activity; Cellular component=ubiquitin ligase complex; Biological process =protein ubiquitination
  Homolog annotation: Hit_ID=Q6H6D6; Match level="QueryCoverage=77%, HitCoverage=51%, E-value=1e-25, Identity=21%"; Hit description =Transducin-like
ESIMKENENEDDLDYELDDASINSDNKNNIFLPEMKMVKDEDIEPKASKNTQRKNNNQTLSMNDDNENSLGLNDGSLCESDKGNQSSISLPKLEKLTIGSKPPKDFVCPITEIARLWKDSKTDPQIDAYLSKPTIISDERLGETLNSADSDFDCLATLLKNDLVEAALLIYQLRPVFAQLSAHELTPSLMQVIQNTNKGSNDFQLAIDPKDVDREILEQILIRGDEYSRSLNALSVISQNGIPALAKYLERIKGRRLVVSILLCCMQPEKGSKSLIADIIELSPVLELFHGGNDNVRGIYVEFLLELVQLNRTVCNQILQTIKDEGAFSMMHTFLVYLHMAPMEHQLVASLQVEPRKMSIYREEGVETLIEALWQKDFSNTQMKALDALLFLIGHVTLSGKSYTKVWLLKIVGFDQPYNALIKAKRLGQYALEECLRINSLKMEKSCLVLVIWLTHMLSTFPDTDIKDVACKSLLHELINVLQSSKNLEEKIWVALALKNFINDLIAQQELRAYAKSIYKIMRKLIKYSTIVVDIMKTLLNLNSIDVVSTK

SEQ ID NO: 125311 - protein, 94 aa, Glycine max
  Coding DNA Sequence Number=SeqID_8533
  Subcellular localization annotation: CTP_CleavageSite=27; ConfidenceScore=5.17e-01
MAARGATGDREWWRRSVQILAQRNFLCIMARSPSQFSLSVIPSRVGIALSSTFTLSETSKVVIFKIPMVKLWRNVLGSSRNELKMIQRLTNTSL

SEQ ID NO: 125312 - protein, 443 aa, Glycine max
  Coding DNA Sequence Number=SeqID_8534
  Gene Ontology: Mol. function=sequence-specific DNA binding; Cellular component=nucleus; Biological process=regulation of transcription, DNA-dependent
  Homolog annotation: Hit_ID=Q76DY3; Match level="QueryCoverage=34%, HitCoverage=46%, E-value=2e-35, Identity=49%"; Hit description=AG -motif binding protein-1
  Pfam annotation: Domain name=GATA; Domain location=357-392; Score =68.5; E_value=2.2e-17; Accession=PF00320.17; Description=GATA zinc finger
MKGVGVVVFPNSFCCVEARNDNDIANMKDSWFFDNNFNGLSDEIFDDVINFFDFPLEDVDANGVEEDWDAQLKCLEDPRFDVYSASSAGLCAETQNEKPQLGMKLSASVSILFTVMETQPMQLQLRSQQGIIIKLVIINNSEKNCYISSDTDPKCAGDAAIICMKFSVINYAPKVSGVARQMEEEGRKLGANLFPLPFRLQKLPLLSNGISPIKQLAKAPGPAYGKTIPHQNVTSNGKDLHQFQTYTYSPVSVFESSSSSSVENSNFDRPVIPVKRARSKRQRPSNFSPLFSIPLIVNLPAVRKDQRTAASDSDFGTNVAGNLSNKVKKQRKKDLSLLSDVEMTRSSSPESGPPRKCMHCEVTKTPQWREGPMGPKTLCNACGVRYRSGRLFPEYRPAASPTFVASLHSNCHKKVVEMRSRVIQEPVRCSMLASSNLHGNSVG

SEQ ID NO: 125313 - protein, 90 aa, Glycine max
  Coding DNA Sequence Number=SeqID_8535
MTQGNGDALQHGKGLLKKQDSDREEVRACHITGRNLGTNQKSKRDHPALKIGFGHLNCSAVFFRFQNGLRMETCTSIQLLLHPCFMIRKT

SEQ ID NO: 125314 - protein, 62 aa, Glycine max
  Coding DNA Sequence Number=SeqID_8536
MELIRVPHSYIGNESEVKYSSYYPTSPQDSREQRMGLKNSSNMGSVSGHLALWYMGSVENAV

SEQ ID NO: 125315 - protein, 140 aa, Glycine max
  Coding DNA Sequence Number=SeqID_8537
MQFTTPFHNDMDTIVVPSSYHQQCAPKYPDFVHFRYDGITYQIRLRQHQQKRLPNCVITHVNACSQHMTILRKFGPPLQWNVVLLDIGIGHRYVVQPCYQFLVDNDFSHGDEVSFYYRHKDKIWEIIIRRSKHWDDSDTE

SEQ ID NO: 125316 - protein, 123 aa, Glycine max
  Coding DNA Sequence Number=SeqID_8538
MEIIPNCNPHNCIRPSTPGRLGGKGAKESPLQQQQLSGSDEVEDIGAPASLLCYYKDVCLYFGLEEPHHDLEFELTLVGYDEQGNVLSYHMELEIEEHKKLLWQLEPSFKEEYDDLLEDMSYS

SEQ ID NO: 125317 - protein, 76 aa, Glycine max
  Coding DNA Sequence Number=SeqID_8539
MGFEIYPEVHENPRAFFSRSSLILLKSSIQYPWGWRLQSPFLFVHSTAINLQEAKDSIDEEDPRPASSTWSYIMWY

SEQ ID NO: 125318 - protein, 700 aa, Glycine max
  Coding DNA Sequence Number=SeqID_8540
  Gene Ontology: Mol. function=protein dimerization activity; Cellular component=nucleus; Biological process=regulation of transcription, DNA-dependent
  Homolog annotation: Hit_ID=Q8S976; Match level="QueryCoverage=95%, HitCoverage=98%, E-value=0.0, Identity=59%"; Hit description=Auxin response factor 10
  Pfam annotation: Domain name=Auxin_resp; Domain location=275-358; Score=164.4; E_value=2.9e-46; Accession=PF06507.4; Description=Auxin response factor
  Pfam annotation: Domain name=B3; Domain location=108-213; Score =113.3; E_value=7e-31; Accession=PF02362.12; Description=B3 DNA binding domain
  Pfam module annotation: Pfam domain module=Auxin_resp::B3; Domain location=275-358::108-213
MKETDKSLDPQLWHACAGGMVQMPPVNSKVFYFPQGHAEHAQSNVDFGAARIPIPPLILCCVAAVKFLADPETDEVFARLRMVPLRNSELDYEDSDGNGAEGSEKPASFAKTLTQSDANNGGGFSVPRYCAETIFPRLDYSAEPPVQTVIAKDVHGEVWKFRHIYRGTPRRHLLTTGWSSFVNQKKLVAGDSIVFLRAENGDLCVGIRRAKRGGVGGAEGPCGWSSSGGGLGPGPGLGLGPGPGPYGAFSGFLREESKVVRSGRPKVSGESVREAVTLAASNQPFEVVYYPRANTPEFCIRTSAVRGAMRIQWSSGMRFKMPFETEDSSRISWFMGTIASVQLLDPIRWPNSPWRLLQVTWDEPDLLHNVKRVSPWLVELVSNVPIIHLAPFSPPRKKLRFPQHPEFPLDFQFPIPSFSGNPFGSSTSSPLCCLSDNAPAGIQGARHAQIGISLSDLHLNNKLQLGLLPTNVHQLNLHTGICNGNITNHGKSKESLSCLLTMGNSNKSLEKSDHVKRHQFLLFGQPILTEQQISRSSSDVLSQNFTVTDDENKEKKEKGFLSDSQSSVSPGKSSSTTEFSWQVGSDTSHCKVFIESEDVGRTLDLSCLGSYEELYMRLANMFGIERSEMLSHVLYRDAAGALKQTGEEPFSEFMKTAKRLTILTDSNNKDSRRVWITGIRNAEHGLDTASNKTGPLGIFA

SEQ ID NO: 125319 - protein, 89 aa, Glycine max
  Coding DNA Sequence Number=SeqID_8541
  Gene Ontology: Mol. function=sequence-specific DNA binding; Cellular component=nucleus; Biological process=regulation of transcription, DNA-dependent
  Homolog annotation: Hit_ID=Q1T0T2; Match level="QueryCoverage=66%, HitCoverage=98%, E-value=3e-24, Identity=95%"; Hit description =Transcription factor, MADS-box
  Pfam annotation: Domain name=SRF-TF; Domain location=9-59; Score =103.6; E_value=5.7e-28; Accession=PF00319.9; Description=SRF-type transcription factor (DNA-binding and dimerisation domain)
MGRGKIVIERIDNSTSRQVTFSKRRKGLIKKAKELAILCDAQVGLVIFSSTGKLYEYASTRNFTLEKYDATNMHGYKFKEITFKACDRY

SEQ ID NO: 125320 - protein, 125 aa, Glycine max
  Coding DNA Sequence Number=SeqID_8542
  Homolog annotation: Hit_ID=Q3LFT5; Match level="QueryCoverage=28%, HitCoverage=6%, E-value=8e-07, Identity=72%"; Hit description =Putative auxin-regulated protein
MVLPLETKVKDKQRFGRVLGLGMSSISVLFDLFGGLSVLVQLGSGMNLVNEVMERRFYGSRYCLWPRWVMELVISLVALLRVSYKNGKALSFKYGSKQFKKKGGLAARTATSNVFRSAGYKFIDG

SEQ ID NO: 125321 - protein, 259 aa, Glycine max
  Coding DNA Sequence Number=SeqID_8543
  Gene Ontology: Mol. function=nucleic acid binding; Cellular component= intracellular; Biological process=regulation of transcription
  Homolog annotation: Hit_ID=Q42485; Match level="QueryCoverage=72%, HitCoverage=83%, E-value=6e-31, Identity=46%"; Hit description=Zinc finger protein 1
  Pfam annotation: Domain name=zf-C2H2; Domain location=99-121; Score =20.4; E_value=0.0063; Accession=PF00096.16; Description=Zinc finger, C2H2 type
SRPSENLSIPFLETPRPCSKPQVPSMDTQKEKKEEDKEQPHESAPHLALLDLSLPSKDSGGDDDESKPLNLINCIDTNLSMNSSESSHGHGDELEPRIFSCNYCQRKFYSSQALGGHQNAHKRERTLAKRGHKAGAAVSIDFARRYSNISMASLPLHGSYNRSLGIQAHSMINKPSYQTQTPFSGLSRSHAQKRLMFSQPPIGAESESSLTGGIPVPRLGKFSPRLVPEGFGGYWLDSINHLKTKQEDQLHKLDLSLKL

SEQ ID NO: 125322 - protein, 52 aa, Glycine max
  Coding DNA Sequence Number=SeqID_8544
MVKKTSSPYELISNDNPGTRRGKGGTMRTNVVHNDETSADTRISEGDSSDDR

SEQ ID NO: 125323 - protein, 45 aa, Glycine max
  Coding DNA Sequence Number=SeqID_8545
MKRLFYVPSMKSLIERYNTCKEEHHHQMNPESEVKQLRSENSDNP

SEQ ID NO: 125324 - protein, 108 aa, Glycine max
  Coding DNA Sequence Number=SeqID_8546
MESDRDPWLGMDKLYHVLMCFSLTFLFYALASLTPYPYRRYAISIGSVLSLLAGAAKEAADHLGYFRSSGASLRDALADILGVCIASFALSLFRSPPPPPHLRALSLV

SEQ ID NO: 125325 - protein, 117 aa, Glycine max
  Coding DNA Sequence Number=SeqID_8547
  Gene Ontology: Mol. function=transcription factor activity; Cellular component=nucleus; Biological process=regulation of transcription, DNA-dependent
  Homolog annotation: Hit_ID=Q1T0T1; Match level="QueryCoverage=53%, HitCoverage=35%, E-value=2e-23, Identity=85%"; Hit description =Transcription factor, K-box
  Pfam annotation: Domain name=K-box; Domain location=3-88; Score=29.0; E_value=1.6e-06; Accession=PF01486.8; Description=K-box region
MQKQHSFTSILDYLQETLILCPNRQLMGEQLYGLTVRNLQDLENQLELSLQGVRMKKEQILKDEIQELNRKGNLIFQENVELYKKEGIHKNWSNFSYASLNKKFVRHWTLPQNEGHV

SEQ ID NO: 125326 - protein, 348 aa, Glycine max
  Coding DNA Sequence Number=SeqID_8548
MRDSDDDELHDRDYDVAALANNLNQAFRYKIYGNEDNEEERGNLDRDDEDVYFDNDSAQVVISSLRLSDDQGSSLFTNSNWFEFQDDRIGDATGGTTSSEMMDEINLNGAANGGNSSDDEVVVGEDEELDESKNNLNGTSSSSTNLNGITGSDSMNGDTLNFESKKTSASHDMGFFRFEASDNEELFGDRPLPDWVGWGEPSDMQDAGSSKNPFIDHDDSSGSNLCTTKPQIDSPTPSPPSNGESVPSNRSPTKEDSIDGGVDSSQRAVPVPSLFEEDVEFVGVELEGTEKAMEQALKEGIVGEAGPLKRNMVSKVPEKESTDEGGPGIKEFNDANYWRVDQEVAVLE

SEQ ID NO: 125327 - protein, 97 aa, Glycine max
  Coding DNA Sequence Number=SeqID_8549
MIYCTNDRLKFTLQEENRLLMIEEGYEDAQNNKEDVEVDYSRDSEMRAFGTMVAWPGELMLSLEENDSPRRAVSFSPKQFGGPGEPEASQGPENFLK

SEQ ID NO: 125328 - protein, 82 aa, Glycine max
  Coding DNA Sequence Number=SeqID_8550
MKVEQLFACHHISEERKVPLATFSFQGYALYWWTSLVRERKIHADPLVDIGMILRVPLGRGTFPPTLKGSLSTSSKGLDMGV

SEQ ID NO: 125329 - protein, 61 aa, Glycine max
  Coding DNA Sequence Number=SeqID_8551
MRILLIGQGVSLGPNFHIIPQGTRDSDDLETTCKISHGHSQVGTQASHLRHCDTTVGNLHK

SEQ ID NO: 125330 - protein, 238 aa, Glycine max
  Coding DNA Sequence Number=SeqID_8552
  Homolog annotation: Hit_ID=Q7WKE2; Match level="QueryCoverage=57%, HitCoverage=68%, E-value=2e-07, Identity=33%"; Hit description =Putative membrane protein
GLGRFDEGGAQEAGAAVDPVRIDHAVQVALQLQHRGRLGLVQSDNVIHFHSGYSWGLCEGGGNVSTIAAEAGPLQPSLRYDEVLSGGSFSSGRLRGSRAPLAALNSISAKKPRNTAGMKSSRSKRGACSALKATLTAAQPATAPAMVRKMPCLRWRARLASETASASVWPGATVDGTLSARCDCGGAVLPQARSFRDPGLGAGAGVGVATGAVAWRLVSVLLGTRPGVAPPARDRFSM

SEQ ID NO: 125331 - protein, 91 aa, Glycine max
  Coding DNA Sequence Number=SeqID_8553
  Subcellular localization annotation: CTP_CleavageSite=41; ConfidenceScore=5.43e-01
MSSSFFLTFPTPSKTSCPQGVGCRKQNMSKIEAQPVPIMVVVEAVASVVNPNQVQKNLMLYGIVVEQDGVIAVRSFGAMAMKVTTMGGADQ

SEQ ID NO: 125332 - protein, 470 aa, Glycine max
  Coding DNA Sequence Number=SeqID_8554
  Gene Ontology: Mol. function=protein phosphatase binding; Cellular component=centric heterochromatin; Biological process=regulation of phosphoprotein phosphatase activity
  Homolog annotation: Hit_ID=UPI000059FD71; Match level="QueryCoverage =96%, HitCoverage=53%, E-value=5e-49, Identity=27%"; Hit description =PREDICTED: similar to CG10289-PA isoform 1
  Pfam annotation: Domain name=SAPS; Domain location=130-470; Score =422.7; E_value=5.1e-124; Accession=PF04499.6; Description=SIT4 phosphatase-associated protein
MAESFKRTTESATQVETILDKENFTLEELLDEEEVIQECKALNSRLINFLRDQAQVEQLLRYIIEEPPEDAENKRAFKFPFIACEIFTCEIDVILKTLVDDEELMNLLFSFLEPNRSHSTLLAGYFSKVVVCLMIRKTVPLMKYVQAHQNVFRQLVDLIGITSIMEVLVRLVGADDHMYHNFIDVMQWLAESNLLEMIVHKLSPSSPPEVHANAAETLCTITRNPSSTLAIKLSSPSFVAKILDHALEDSQSKSSLVNSLSVCVSLLDPKRSAISSPLFHSFRSQHMYEPPIPVNPDTIGAMLPKLSELLMLLNVSSDEKVLPTTYGELRPPLGKHRLKIVEFIAVLLKTGNEVAEKEMVNSGTIQRVIDLFFEYPYNNSLHHHVESIILSCLESKTNAIVEHLLQECNLIGRFLQADKRSTLSADINMPTVPAAGKQVPRAGNIGHITRIVNKLVHLAHNRNLILTCLQ

SEQ ID NO: 125333 - protein, 116 aa, Glycine max
  Coding DNA Sequence Number=SeqID_8555
MSVKNLVECQEVYDKTNHTLVSQVILTLFCKNAPTIWDQHMFKGTLKSSEFTHKAYTLKSPLGFLPPDSGKRKYRGMDIALTIYRRWHDGDTTMVGGVDSKGTMTRMARGVSARRK

SEQ ID NO: 125334 - protein, 635 aa, Glycine max
  Coding DNA Sequence Number=SeqID_8556
  Gene Ontology: Mol. function=transferase activity; Cellular component= chromatin; Biological process=DNA integration
  Homolog annotation: Hit_ID=Q1S0E3; Match level="QueryCoverage=87%, HitCoverage=73%, E-value=1e-112, Identity=44%"; Hit description =Peptidase S8 and S53, subtilisin, kexin, sedolisin; Zinc finger, CCHC- type; Peptidase ...
  Homolog annotation: Hit description=aspartic, catalytic; Polynucleotidyl transferase, Ribonuclease H fold
  Pfam annotation: Domain name=rve; Domain location=112-257; Score =44.1; E_value=4.8e-10; Accession=PF00665.16; Description=Integrase core domain
  Pfam module annotation: Pfam domain module=RVT_2::rve; Domain location=239-464::112-257
MAKEENEADSEEQSLLLMMITDSESQNNEIWYIDSGCSNHMTGHRDWLVNFDAMKKSKVRFVDDRVIQAEGEGNVAVRRLDGRQAMFTYVLYVLGMKSNLISMSQLLENGFSMKMSNGSLEVYDTAKKMIVKALLARIRTFKVKSEVFDTFKGFKALVEKQSGKCIKTFRIDGGGEFTSSELEDFCKEHEIVHEVTAPYTPQHNGIVERRNRTILNMAITETIPRLQLDWEEIDSRKEATQDLEETKISPQDYQIINYILIMLSLMMKEGIDYTEVFAPVARLETVRLVIALASWKNWKLWELDVKSVFLNGPLDEDVFILQPPDFICKGNEHKVLKLRKALYGLKQAPRGWNKSINTFLHNIGFQKFTAEHGVYIKFVKHTEIIIICLYMDDLLLTGNSSTGIDSLKQNLKKEFEMADLGTLSYFLGLEFAYIAQGIFMHQKKYTSDALKRNSNRGEFEAAKGENEASIDGTLFRQIVGSLRFICHSRPEITFNVGLVRRFMGDPRQSHLLAAKRIMRYLKGTLGYGIIFPHQTKEDDNLHLVAYSNSNWCGDLVDRKSTMGQQINYRFGQESVAHGRSKHIDTKFHFLRDQVSKGRIKLRHCRSEVQLADIMTKSLKAERFKELRTLLNVVYL

SEQ ID NO: 125335 - protein, 183 aa, Glycine max
  Coding DNA Sequence Number=SeqID_8557
  Gene Ontology: Mol. function=protein serine/threonine kinase activity; Biological process=protein amino acid phosphorylation
  Homolog annotation: Hit_ID=Q9T058; Match level="QueryCoverage=36%, HitCoverage=8%, E-value=2e-14, Identity=58%"; Hit description=KI domain interacting kinase 1-like protein
  Pfam annotation: Domain name=ABC1; Domain location=2-63; Score=-39.0; E_value=0.07; Accession=PF03109.7; Description=ABC1 family
MKDGMQVAMKIQYPGVADSIDSDIENVKLLLNYTNLIPKGLYLDKPMNGTLPRGQDVAVKRLLGVSTQGLQEFKNEVILIAKLQHLNLVRLRGYCIKGDEDIRLWPCRYLKELDELRTQLVATRATVNHKDRVLRLGEQLDNLQKDLQARESSQKQLKDEVLRIEHDIMEALAKVGENRNCEL

SEQ ID NO: 125336 - protein, 179 aa, Glycine max
  Coding DNA Sequence Number=SeqID_8558
  Gene Ontology: Mol. function=monooxygenase activity; Cellular component=integral to membrane; Biological process=electron transport
  Homolog annotation: Hit_ID=Q1SJ90; Match level="QueryCoverage=96%, HitCoverage=34%, E-value=2e-51, Identity=57%"; Hit description=E -class P450, group I
MEKARKEIDSIIGKDIMVLETDIDNIPSLQAIVKETLRLHPPSPFVLRESTRNCTIAGYDIPAKTQVFTNVWAIGRDPKYWDGPLEFRPKSWIQGTTLSTFAFGSGRKGCPGASLALKVAHTTLAAMIQCFEMKAEEKGGYCGSVDMEEGPSFILSRVEPLICVPKSRLMPFPLYHAKY

SEQ ID NO: 125337 - protein, 185 aa, Glycine max
  Coding DNA Sequence Number=SeqID_8559
  Pfam annotation: Domain name=B3; Domain location=10-102; Score=0.8; E_ value=0.063; Accession=PF02362.12; Description=B3 DNA binding domain
MSSNCLAIIRFTAPFHVQKNLLQVPFSFHRQWLYRYPKYVLFHYDGNKYFIRVRRHGGKCFFADGLKEYRRAHDLNESVILRCVASDKNTTFSVHILPAAASRFVHASKKFITLQRGLAKRTHWDITIHNDVPSVADPWFHLLDEKKLIPGDEVVFYYRFDDHAWELLDKKDIEWENDDINFEEM

SEQ ID NO: 125338 - protein, 244 aa, Glycine max
  Coding DNA Sequence Number=SeqID_8560
  Gene Ontology: Mol. function=helicase activity
  Homolog annotation: Hit_ID=Q1SN45; Match level="QueryCoverage=51%, HitCoverage=7%, E-value=8e-25, Identity=43%"; Hit description=AAA ATPase
MENHRFISKSDSTKAKSNRKRIRQQKVHLDVQHSVQASLNPASSHTEDDYNQPKTPPHSVHAIADRAPHDAEDHFNICDSSENETFGSAEESETISSVRYPNCESSHHDSSMDTGEYFDLGDQLIQCRHCNAKMWYHENISKRSNASSPRFSLCCGDGKIELPLLQNPPKFLQQLLFEQNTAYAKNYQQNIRTYNMMFTFTYAGIKFDKTIGHSRGPPTIRIQGQPCHRIGSLLPMPGKEPKFA

SEQ ID NO: 125339 - protein, 492 aa, Glycine max
  Coding DNA Sequence Number=SeqID_8561
  Gene Ontology: Mol. function=transporter activity; Cellular component= membrane; Biological process=transport
  Homolog annotation: Hit_ID=Q2Z1Q0; Match level="QueryCoverage=99%, HitCoverage=91%, E-value=0.0, Identity=67%"; Hit description=NRAMP family metal transporter
  Pfam annotation: Domain name=Nramp; Domain location=17-392; Score =502.0; E_value=6.9e-148; Accession=PF01566.9; Description=Natural resistance-associated macrophage protein
MGPGFLVSIAYIDPGNFETDLQSGAQYKYELLWIILLASCAALVIQSMAANLGVVTGKHLAEHCRSEYPRVPNFILWIIAEIAIVACDIPEVIGTAFALNMLFNIPVWIGVLLTGLSTLILLALQQYGVRKLEFLIAFLVFTIAACFMVELGYAKPDAKEVLKGLFVPGLKGSGATGLAISLLGAMVMPHNLFLHSALVLSRKIPRSVLGIRLVDKLLRFMSSDHLPGVNLCLPMAHLLLVLHKFYMIESAFALMVAFLINICVISVSGTVCNSSNLNAEDQLSCQDLDLNKASFLLRNVLGKWSSKLFGIALLASGQSSTITGTYAGQYVMQGFLDLRLEPWIRNMLTRCLAIVPSLIVAVIGGSAGAGKLIIIASISAVTWIIGTLLMAINIYYLITGFIKLLLHSHLKIVAKVFLGILGFSGMAMYLAGTTYLVLRKNKEATHLLALTAPENQQMTNELGNGSIYSLPREDIVSMQLPQRSTPAPADVD

SEQ ID NO: 125340 - protein, 298 aa, Glycine max
  Coding DNA Sequence Number=SeqID_8562
  Homolog annotation: Hit_ID=Q2HSJ5; Match level="QueryCoverage=50%, HitCoverage=30%, E-value=8e-23, Identity=42%"; Hit description=Zinc finger, CCHC-type; Zinc finger, SWIM-type
MTLLLYTSASKTLLLYVSALVTLLLYVSASGTLLLYAVRQRHFCFASGNPMLQTLTLGHKPLTLTPIYRSHIRLHLTHSHNTFFLCYFLPTLQTQTFCHILSLILNMSSLSINCLVHYNGQIIKIDEGDMFQCPYPMLFQTKRGLTLEALKRKIHKGLQLQPLDQQSLAYLTKNSVPLVRTKMKLYAINPRKIIRKKLVELRGVGQYTSLQVDGTWLYGKYKGTLLVTVAQDGNNKILPIAFAIIEGEIVEAWLFFLKNLKRHATPQHAYARTNPTFNHYYNILREEAEDDQAINWLS

SEQ ID NO: 125341 - protein, 52 aa, Glycine max
  Coding DNA Sequence Number=SeqID_8563
MEDNSTLHALICKELNDSTNNTMCSLSLAKVTVATYPSAVDKGVALASMYPQ

SEQ ID NO: 125342 - protein, 92 aa, Glycine max
  Coding DNA Sequence Number=SeqID_8564
MKKDDGTHYHTLISFGDNCLSTCEFSLAKLSRLTSITTESDFAMFQKETGKELKVGAKGSILDNLGEKQPARLGELLAWASYSPRRARLFLN

SEQ ID NO: 125343 - protein, 505 aa, Glycine max
  Coding DNA Sequence Number=SeqID_8565
  Gene Ontology: Mol. function=protein serine/threonine kinase activity; Cellular component=cytoplasm; Biological process=protein amino acid phosphorylation
  Homolog annotation: Hit_ID=Q53VE1; Match level="QueryCoverage=86%, HitCoverage=100%, E-value=0.0, Identity=74%"; Hit description =Ser/Thr protein kinase
  Pfam annotation: Domain name=NAF; Domain location=328-387; Score =80.1; E_value=7e-21; Accession=PF03822.5; Description=NAF domain
  Pfam annotation: Domain name=Pkinase; Domain location=21-275; Score =359.4; E_value=5.6e-105; Accession=PF00069.15; Description=Protein kinase domain
  Pfam annotation: Domain name=Pkinase_Tyr; Domain location=21-280; Score=60.5; E_value=3.5e-16; Accession=PF07714.7; Description =Protein tyrosine kinase
  Pfam annotation: Domain name=RIO1; Domain location=34-192; Score= -96.0; E_value=0.068; Accession=PF01163.12; Description=RIO1 family
  Pfam module annotation: Pfam domain module=NAF::Pkinase::Pkinase _Tyr::RIO1; Domain location=328-387::21-275::21-280::34-192
MDRRSHPTGTVSTRNILFNKYEIGKLLGQGNFAKVYHGRNLSTNESVAIKVIKKERLQKERLVKQIKREVSVMRLVRHPHIVELKEVMANKAKIFMVVEYVKGGELFAKVAKGKMKEDVARKYFQQLISAVDFCHSRGVTHRDLKPENLLLDENEDLKVSDFGLSALPDQRRSDGMLLTPCGTPAYVAPEVLKKKGYDGSKADIWSCGVILFALLSGYLPFQGENVMRIYSKSFKADYAFPEWISPAAKNLISNLLVVDPQKRYSIPDIMKDPWFQIGFLRPIAFSMKESALEDNIDFSGDDVPSPGSDDGNSSSNNEDGELTGAKPARPSYNAFEIISSLSHGFDLRNLFETRKRSPSMFISKFSASAVMAKLEGVAKKLNFRVTGKKEFMVRMQGATEGRKGKLAMTVEVFEVAPEVAVVEFSKSAGDTLEYLNFCEDQVRPSLRDIVWSWQGDANCHQSGNEGFQVSNNNEDHHDVISSAVQHDSDDNNHHDASSSVRVILG

SEQ ID NO: 125344 - protein, 66 aa, Glycine max
  Coding DNA Sequence Number=SeqID_8566
MKIAMWELELVEVGETQIEGLKPFNDEEGVERTHHVLEKAFGGVENLHGCMQQRRGEAKAKAALKA

SEQ ID NO: 125345 - protein, 122 aa, Glycine max
  Coding DNA Sequence Number=SeqID_8567
  Homolog annotation: Hit_ID=Q1SN78; Match level="QueryCoverage=35%, HitCoverage=5%, E-value=2e-11, Identity=72%"; Hit description =Rhodopsin-like GPCR superfamily; D-galactoside/L-rhamnose binding SUEL lectin; Galactose-binding like
MNGARDQDPALAVDDQCSVIILYIGAEQLGSVNAEQPKQNQHNLCREKRTRQVTDVCVNEDKKVVGEIVVLLCVSMVEGGEWSTEENGVFSINVRTENNGGQKWIVRRELRRESGMWRTVKQ

SEQ ID NO: 125346 - protein, 414 aa, Glycine max
  Coding DNA Sequence Number=SeqID_8568
  Gene Ontology: Mol. function=helicase activity; Biological process =protein amino acid phosphorylation
  Homolog annotation: Hit_ID=Q2R1R7; Match level="QueryCoverage=98%, HitCoverage=42%, E-value=3e-52, Identity=42%"; Hit description=AT hook motif-containing protein, putative
MVESEKLNYIRNNQKKLRVDKYCSLQNSLDDGTIQGLNKGKRVIWPSTFVGSPRYMDQLYFDGMAICNHDFPNLFITLTCNLNWPEIHRLLAPLNLKVADRPDIMSRVFKLKYEEMLSDLTKNHLLGKAVAYEIDQIISAEIPSNEDDPELYTLVQNHMVHGPCGIICFESPCAINKPEEVWNQTWHWLADDIAYHYSKSTINTELHIDDNHLSNLALLEIEQLLHVKQKSLKDYPSMSYPEDADCTSYLDNSLILAELNYNNDETNEQTSINNQIIEAVNKNQGDMFFLYGFGGTGKTSIWRTLATSLRANNQIVIIVASSGITSLLLPGGRTAHSKFKILVPIFEDSTCNIHQGSELAELLNQTSLIIWDEAPMAHKFCFEVLVQSLRDIIKTKPSSNQIFGVKVMVFGGDF

SEQ ID NO: 125347 - protein, 280 aa, Glycine max
  Coding DNA Sequence Number=SeqID_8569
  Gene Ontology: Mol. function=beta-galactosidase activity; Cellular component=beta-galactosidase complex; Biological process =carbohydrate metabolic process
  Homolog annotation: Hit_ID=Q1SN78; Match level="QueryCoverage=94%, HitCoverage=31%, E-value=1e-133, Identity=84%"; Hit description =Rhodopsin-like GPCR superfamily; D-galactoside/L-rhamnose binding SUEL lectin; Galactose-binding like
  Pfam annotation: Domain name=Glyco_hydro_35; Domain location=1-189; Score=172.6; E_value=1e-48; Accession=PF01301.10; Description =Glycosyl hydrolases family 35
MKRFTAKIVDMIKQEKLYASQGGPVILSQIENEYGNIDTAYGAAGKSYIKWAATMATSLDTGVPWVMCLQADAPDPIINTWNGFYGDEFTPNSNTKPKMWTENWSGWFLVFGGAVPYRPVEDLAFAVARFFQRGGTFQNYYMYHGGTNFDRASGGPFIATSYDYDAPIDEYGIIRQPKWGHLKEVHKAIKLCEEALIATDPTITSLGPNLEAAVYKTGSVCAAFLANVGTKSDVTVNFSGNSYHLPAWSVSILPDCKSVVLNTAKCIGSQKHFCYLLVQE

SEQ ID NO: 125348 - protein, 77 aa, Glycine max
  Coding DNA Sequence Number=SeqID_8570
LHLLRYCLHGGGIVLRRRDGVLCGGSVVLCLCDGVFRGGGAVLRCHDGALLSGFCVSVAEVQNSKSQDRIEVNENDK

SEQ ID NO: 125349 - protein, 163 aa, Glycine max
  Coding DNA Sequence Number=SeqID_8571
  Gene Ontology: Mol. function=protein serine/threonine kinase activity; Biological process=protein amino acid phosphorylation
  Homolog annotation: Hit_ID=Q1SJP6; Match level="QueryCoverage=99%, HitCoverage=32%, E-value=1e-41, Identity=68%"; Hit description =Protein kinase
MMGCCGCFGFVQKPRPRRAKRSISNLLSQGLLLDGETEGEETYSGDVTSNCTSGDDNEVQAVRNRSEDILNFRAENGMVCRPFPVKETCKLDRSEDENGNKMINEYVREYKIGCGSYGKVVSIVFAELSFLYSHGIHCPEPFLDTHRRLFIEVVLMESIMQLR

SEQ ID NO: 125350 - protein, 350 aa, Glycine max
  Coding DNA Sequence Number=SeqID_8572
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q1SJP8; Match level="QueryCoverage=92%, HitCoverage=18%, E-value=1e-138, Identity=72%"; Hit description=D -galactoside/L-rhamnose binding SUEL lectin; Integrase, catalytic region; ...
  Homolog annotation: Hit description=Galactose-binding like; Peptidase aspartic, catalytic
  Pfam annotation: Domain name=Gal_Lectin; Domain location=272-349; Score=128.4; E_value=1.9e-35; Accession=PF02140.8; Description =Galactose binding lectin domain
  Pfam annotation: Domain name=Glyco_hydro_2_N; Domain location=84-207; Score=-53.8; E_value=0.025; Accession=PF02837.8; Description=Glycosyl hydrolases family 2, sugar binding domain
  Pfam module annotation: Pfam domain module=Gal_Lectin::Glyco_hydro_2 _N; Domain location=272-349::84-207
MGSSPPIFLAHLSVLVMKLDLERWSQPGNSGKYKFTVDIPVTLVAGKNTIDLLSLTVGLQNYGAFFDTWGVGITGPVILKGFANGNTLDLSSQKWTYQVGLQGEDLGLSSGSSGQWNLQSTFPKNQPLTWYKTTFSAPSGSDPVAIDFTGMGKGEAWVNGQRIGRYWPTYVASDASCTDSCNYRGPYSASKCRKNCEKPSQTLYHVPRSWLKPSGNILVLFEERGGDPTQISFVTKQTESLCAHVSDSHPPPVDLWNSETESGRKVGPVLSLTCPHDNQVISSIKFASYGTPLGTCGNFYHGRCSSNKALSIVQKACIGSSSCSVGVSSDTFGDPCRGMAKSLAVEATCA

SEQ ID NO: 125351 - protein, 53 aa, Glycine max
  Coding DNA Sequence Number=SeqID_8573
MGRGAGPTETWTAEPFEARKIQPLDFGDGKMKSQRWRRDKQKPLRSVHCHGYR

SEQ ID NO: 125352 - protein, 933 aa, Glycine max
  Coding DNA Sequence Number=SeqID_8574
  Homolog annotation: Hit_ID=O48579; Match level="QueryCoverage=14%, HitCoverage=6%, E-value=1e-10, Identity=34%"; Hit description=Mi-2 autoantigen-like protein
MAEFQFDYILAIALLNWCYAGHFILMNHNAKDEENNNRRVTRNSEKGKIKSHRNVSDTTGVRRSPRETSSKKNIPSPSSSTRKSGRLENRPPPAPVNKRKSERVEKKKPSPLRRSGRTRSQSSTGYSDSKSSGSVSSDPKPKKEKSVKQLIFEAKEVNGTEQHDLGTPQVKVKRMNARMYRSLFQLPKEEPNRIDNLNQGGNNGGGKIDECSGECHDFEEISKNGALPSEDGKSKEMRVDTGLSGSVKDLVENNMTLGSLAPSNVALPSEDGKSKEMRVDTGLSGPVKDLVEDTMTLDSLAPSNAATYETGLAPESIHPDYCREETLQVLVSSNSILDEDSIRNSVGDDRGENLIPSKSKEITVDVDSDVSAMLAKGDNCNLTPDASSLSRLGGYIMGTDCPSNATLYETGLLPERVQPDCCREETLPSSNSKNGVLPSEDGKSKETRVDSGLSVPVKDLVENTVTLGSLAPSTAATYVASLAPESFQTDYRREKGNSILDEEDLISNSVGHDSSGETLVPSKRKGIMVDMDSDVSAMLAKGDNCNLVPDSGSPSQLGGNIMGIDGSCSKRISEGELAIDPDFVLHGQKLKRREELDEKVRILMKGWDEGDCVEGEVGFGEDKVGLVEEEEELDMTTIQLTAESDYNPIDSESCIPSATELQDGDYIDASMLQKDSQIDNEKEPGLINNSNNSVTQLKERLSSHIGYRCKFVEYWVPVQISNLQLEQYCSILLSNASILRSSSKVDSVEAVRDVLISTRKCCSHPYLVGPELQPSLNKGLKPIEYLDFDLKASGKLQLLDSMLEELRKNDLRVVILFQVCKQRAERSGCWRAMGLLEILGLAVNNGCELGQITAVYMFVGYLAPAEVAQNCWKKWRDSTIQLPCLTHRQVKTIGIQKKNKEHVQLTEIAANRSTVQMMQDEHQLSANPQEMAE

SEQ ID NO: 125353 - protein, 44 aa, Glycine max
  Coding DNA Sequence Number=SeqID_8575
MANVKGILESGGVSGKFMIYDKTQGILLGSSNTEYQANFLLKPI

SEQ ID NO: 125354 - protein, 102 aa, Glycine max
  Coding DNA Sequence Number=SeqID_8576
MKPSKSSTLGFKIKLNKRGKKKTYLRLQRRSEVKMQEVECNGKHSANGTRRNDERDRLASPNSQKYEPERFLGLARRCAFIEFYNSDWSATSAKPDMARSTD

SEQ ID NO: 125355 - protein, 167 aa, Glycine max
  Coding DNA Sequence Number=SeqID_8577
MKPCKVSYQNIKHKMKFDNQELPVLTNEFHYPGREAVNDKFNCLIDNIWNIPKIQIITSGPHRGVYTNFKDLCLAKEDLDQFKSFGYEDLAISAKSLLDYGCLESILIPPSDRFEGFNPSINEAINLIQEKMMDYIAIKITTCPNNFTVENYPCHVMRVIHNINIAS

SEQ ID NO: 125356 - protein, 72 aa, Glycine max
  Coding DNA Sequence Number=SeqID_8578
MATIVMATIELSSRYGSKLAYYTGIGVGFMVDLGMALVDDWVVGNDIVEPVENLAIPTSILSPAKTKSAKFE

SEQ ID NO: 125357 - protein, 212 aa, Glycine max
  Coding DNA Sequence Number=SeqID_8579
MHRARLIFGLVSRLDMNIGALISGQMTFIVQSNTSRLGFPALITALCRARGLLSDSITFERLSPVINLVYIRKNCWNPDDLIVTIRRARRARTRPVEALSTSAAPPPACTLAAPSAPAPADFQCLEAMLQSIHQGQIILLQSLQIVAPPDSIPSVEQFNEWVAWPETQSSLHKEDEGPTAQVPQQIEDESSETTTCHTLISSGDYNLMIYNH

SEQ ID NO: 125358 - protein, 269 aa, Glycine max
  Coding DNA Sequence Number=SeqID_8580
  Gene Ontology: Mol. function=transcription regulator activity; Cellular component=nucleus; Biological process=regulation of transcription
  Homolog annotation: Hit_ID=Q1SP86; Match level="QueryCoverage=96%, HitCoverage=85%, E-value=1e-76, Identity=59%"; Hit description=Helix- loop-helix DNA-binding
  Pfam annotation: Domain name=HLH; Domain location=164-207; Score=3.6; E_value=0.06; Accession=PF00010.16; Description=Helix-loop-helix DNA -binding domain
MVDNPNWWSMHQQPSLIPPQYVFPPSSIPFNSLTENQEPPQSWSQLFFTGLPGEEEKLGPKKLENWNVQDLNTASRVPFLDVIRQQVSQRGNLYDHGPSWSHMVPVSSPVSCVTSFSSNNILDFTYNKSDHRRNLQQDQISKCNSTATVGVCKKARVQPSSSQAPLKVRKEKLGDRITTLHQLVSPFGKTDTASVLLEAIGYIRFLQGQIEALSSPYLGSASKNMRNQQSVHGERNSVPEDPGQLLNDHNIGLKRKGAPNQAYASYSDH

SEQ ID NO: 125359 - protein, 169 aa, Glycine max
  Coding DNA Sequence Number=SeqID_8581
MADNEATEIVGVEWFSTYRGCLLTVTIFARCFICNLMAIILISLGTDHHFDIVAFMWMNQTGTVLGMTMEPELEFYKYVGVGGREINLHSIGFQAGARDKWGFRGGSELVHSCSDINKSFCGVLYHGMDLDNNIGVATGDWIIDEDPAIKAIIHWLAASQKKASRISEF

SEQ ID NO: 125360 - protein, 137 aa, Glycine max
  Coding DNA Sequence Number=SeqID_8582
MELMVAGDNHNPRFIYFYTQELIAALLGCSLLCLFPDRPANHQFRSIVCISSDMPKGIVSFKRIVLPVTLHGLSDFPHRMSDTLLWELKVKSLGEMLLARGLHRNLFDDCYIRKQAILWHFNRFTLQGKLKINQVKV

SEQ ID NO: 125361 - protein, 118 aa, Glycine max
  Coding DNA Sequence Number=SeqID_8583
  Gene Ontology: Mol. function=receptor activity; Cellular component =membrane; Biological process=oligopeptide transport
  Homolog annotation: Hit_ID=Q2HU45; Match level="QueryCoverage=87%, HitCoverage=16%, E-value=2e-25, Identity=54%"; Hit description=TGF -beta receptor, type I/II extracellular region
MEKEMEAALVHVETTQQHMNPHVLRRKGGFITMPFIIANEALAKLASVGLMPNMVLYLIGDYRLRVLKATKIMFYWFAATNFAPVIGAFVADAYLGRFLAIGLGSILSFLVPSFLLSP

SEQ ID NO: 125362 - protein, 445 aa, Glycine max
  Coding DNA Sequence Number=SeqID_8584
  Gene Ontology: Mol. function=transporter activity; Cellular component= membrane; Biological process=oligopeptide transport
  Homolog annotation: Hit_ID=Q2HU49; Match level="QueryCoverage=97%, HitCoverage=96%, E-value=1e-177, Identity=68%"; Hit description=TGF -beta receptor, type I/II extracellular region
  Pfam annotation: Domain name=MFS_1; Domain location=23-391; Score= -44.5; E_value=0.034; Accession=PF07690.6; Description=Major Facilitator Superfamily
  Pfam annotation: Domain name=PTR2; Domain location=1-379; Score =170.6; E_value=3.8e-48; Accession=PF00854.12; Description=POT family
  Pfam module annotation: Pfam domain module=MFS_1::PTR2; Domain location=23-391::1-379
MVPEARPCSHCEESATTPQMAILLSCFALISIGGGGISCSLAFGADQLNQKSKPNNPRVLESFISWYIASQAIAVVFSLTGIVYIQDHFGWKLGFGVPAALMFLSTLMFFLISSRYVKQKPHSSLLTGFVQVLFVAYKNRNLSFPPKDSTCMYHHKKDSPLVAPTDKLRFLNKACIIKDREQDIASDGSASDKWSLCTIEQVEELKAIIKVIPLWSTGIMVSVSTSQTSLWLLQAKTMDRHITSSFQIPAGSFGVFIMLAVCVTAGVYDRVILPLASKVRGKPVTISAKKRMGIGLFFSFLDFVASAVVESIRRRKAIREGYINNPEAVLDMSAMWLIPHNILCGIAEAFNAIGQSEFYYSEFPSSMSSIAASLFSLGSAVGNLVASLILSIVDDITSRGGKESWVSDNINKGHYDNWAYGPSAEPASKKEERGNGVRDQQEEAM

SEQ ID NO: 125363 - protein, 135 aa, Glycine max
  Coding DNA Sequence Number=SeqID_8585
  Gene Ontology: Cellular component=integral to membrane
  Homolog annotation: Hit_ID=Q2HU50; Match level="QueryCoverage=88%, HitCoverage=73%, E-value=6e-58, Identity=84%"; Hit description =Uncharacterized Cys-rich domain
  Pfam annotation: Domain name=PLAC8; Domain location=8-100; Score =91.4; E_value=2.8e-24; Accession=PF04749.7; Description=PLAC8 family
MADLIIYSLLFWFAAVMTAFFPCVTFGQIAEVQDGGELSCHLGSFIYLLMMPALCSQWIMGSKYRTKLRKRYNLVEAPYTDIVSHIFCPCCSLCQEFRELKIRGLDPALGWNGILAQQQSDQTLKNPPLNQVMSK

SEQ ID NO: 125364 - protein, 634 aa, Glycine max
  Coding DNA Sequence Number=SeqID_8586
  Gene Ontology: Mol. function=oxidoreductase activity, acting on the CH-OH group of donors, NAD or NADP as acceptor; Cellular component =chloroplast; Biological process=malate metabolic process
  Homolog annotation: Hit_ID=Q9M4Q9; Match level="QueryCoverage=96%, HitCoverage=94%, E-value=0.0, Identity=79%"; Hit description=NADP -dependent malic protein
  Pfam annotation: Domain name=Malic_M; Domain location=350-603; Score =471.6; E_value=9.6e-139; Accession=PF03949.5; Description=Malic enzyme, NAD binding domain
  Pfam annotation: Domain name=malic; Domain location=159-348; Score =421.2; E_value=1.4e-123; Accession=PF00390.9; Description=Malic enzyme, N-terminal domain
  Pfam module annotation: Pfam domain module=Malic_M::malic; Domain location=350-603::159-348
  Subcellular localization annotation: CTP_CleavageSite=26; ConfidenceScore=5.51e-01
MSNSGLGGCSSLCDAQRKRSTRFRVVSMTPSSSRSGDRNGSVVMETPLKELKKESTVADVDNNPISAGGPQDVYGEDRATEDHFVTPWSVSVASGYTLLRDPHFNKGLAFTENERDAHYLRGLLPPSVIPQETQVKKMIQHVRQYQVPLQKYMAMMDLQERNERLFYKLLIDHVEELLPVVYTPTVGEACQKYGSIFMRPQGLYISLKEKGKIREVLRNWPEKNIQVIVVTDGERILGLGDLGCQGMGIPVGKLSLYTALGGVRPSACLPITIDVGTNNEKLLNDELYIGLKQRRATGQEYAELMHEFMTAVKQTYGEKVLIQFEDFANHNAFDLLEKYRSTHLVFNDDIQGTASVVLAGLVAALKLVGGNLADHRFLFLGAGEAGTGIAELIALETSKQTNAPLEEVRKNIWLVDSKGLIVSSRKDSLQHFKKPWAHEHEPVRNLVDAVNKIKPTVLIGTSGQGRTFTKEVIEAMASINERPIILSLSNPTSQSECTAEEAYKWSQGRAIFASGSPFPPVEYEGKVFVPGQANNAYIFPGFGLGLIMSGTIRVHDDLLLAASEALAAQVSQENFDKGLIYPPFTNIRKISAHIAANVAAKAYELGLATRLPQPKDLVKFAESCMYTPSYRSYR

SEQ ID NO: 125365 - protein, 532 aa, Glycine max
  Coding DNA Sequence Number=SeqID_8587
  Gene Ontology: Mol. function=RNA polymerase II transcription factor activity; Biological process=transcription from RNA polymerase II promoter
  Homolog annotation: Hit_ID=Q2HU52; Match level="QueryCoverage=98%, HitCoverage=52%, E-value=0.0, Identity=75%"; Hit description =Tropomyosin; tRNA-binding arm; t-snare
  Pfam annotation: Domain name=Tropomyosin; Domain location=33-278; Score=-119.7; E_value=0.091; Accession=PF00261.10; Description =Tropomyosin
MVWPWKGLDNVYRRGEEEGEELSKKQAAQESTIRKLRAQIRDFEEEKKGLTTKLQVEENKVESIKRDKTATEKLLQETIEKHQNEIAAQKEYYTNALAAAKEAEALAEARANNEARTELESRLREAEERESMLVQALEELRQTLSRKEQQAVFKEDMLRRDIEDLQKRYQASERRCEELITQVPESTRPLLRQIEAMQETNARKAEAWAAVERTLNSRLQEAEAKAATAEERERSVNERLSQTLSRINVLEAQISCLRAEQTQLSRTLEKERQRAAESRQEYLAAKEEADTQEGRVRQLEEEIRDIRQKYKQELQEALMQREHLQQEIEKEKAARSELEKTLRVHSSPLSDQTPTTKLNSAFENGNLSRKLSSASSLGSLEESHFLQASLDSSDSISERRNIGELSMSPYYVKSMTPSSFEAALRQKEGELASYMSRLASLESIRDSLADELVKMTEQCEKLRGEAAVLPGLRSELEALRRRHSAALELMGERDEELEELRADIVDLKEMYREQVNLLVNKIQTMGPSMGSD

SEQ ID NO: 125366 - protein, 332 aa, Glycine max
  Coding DNA Sequence Number=SeqID_8588
  Homolog annotation: Hit_ID=Q1RZD5; Match level="QueryCoverage=23%, HitCoverage=16%, E-value=1e-08, Identity=37%"; Hit description=Zinc finger, C2H2-type
  Pfam annotation: Domain name=zf-U1; Domain location=289-322; Score =10.3; E_value=0.0048; Accession=PF06220.3; Description=U1 zinc finger
  Subcellular localization annotation: CTP_CleavageSite=54; ConfidenceScore=5.32e-01
MEFKYHDGQIQRTPSPLRRPLPSNSYVSNRPLHGCDFASGGFPSNVSAPRVFPMAMPINVNEVFQRELEKEKIWRELEKEEIRREIIAREMAFAQRRELEDEVRKEIELERTSRMSMQRSEGIAFREPISVSIIQSSSNNITMFGGRQFHLASQASMKIHMDNIQIDNKQASNNKDKVIILNKPDDHSGEKRKAVTLAIDDNESVQKKAKKAWNCELCQISATRLDSRPQGQTLHPCLTPMDTCKLESKEKGQAVQKSKGLGGLDNHNETTISKQAPETSAPLKGKKFKFWCEFCQVQTQSEIVMQSHKNGKKHLANMKKFNHNNGGVANSG

SEQ ID NO: 125367 - protein, 631 aa, Glycine max
  Coding DNA Sequence Number=SeqID_8589
  Gene Ontology: Mol. function=catalytic activity; Cellular component =intracellular; Biological process=metabolic process
  Homolog annotation: Hit_ID=Q2HU53; Match level="QueryCoverage=99%, HitCoverage=100%, E-value=0.0, Identity=81%"; Hit description =Tetratricopeptide-like helical
  Pfam annotation: Domain name=PPR; Domain location=125-159; Score =39.6; E_value=1.1e-08; Accession=PF01535.11; Description=PPR repeat
  Pfam annotation: Domain name=PPR; Domain location=226-260; Score =41.8; E_value=2.3e-09; Accession=PF01535.11; Description=PPR repeat
  Pfam annotation: Domain name=PPR; Domain location=327-360; Score =36.2; E_value=1.2e-07; Accession=PF01535.11; Description=PPR repeat
  Pfam annotation: Domain name=PPR; Domain location=361-394; Score=4.8; E_value=2; Accession=PF01535.11; Description=PPR repeat
  Pfam annotation: Domain name=PPR; Domain location=397-431; Score =10.5; E_value=0.43; Accession=PF01535.11; Description=PPR repeat
  Pfam annotation: Domain name=PPR; Domain location=463-497; Score =16.6; E_value=0.082; Accession=PF01535.11; Description=PPR repeat
  Pfam module annotation: Pfam domain module=PPR::PPR::PPR::PPR::PPR::PP R; Domain location=125-159::226-260::327-360::361-394::397-431::463 -497
MSFSSIRKTQETSRILSILSFSLNLFPVSPYYFLHQSFATQLIPQHKVDSFPSSPSNHYYYASLLESCISAKALEPGKQLHARLCQLGIAYNLDLATKLVNFYSVCNSLRNAHHLFDKIPKGNLFLWNVLIRAYAWNGPHETAISLYHQMLEYGLKPDNFTLPFVLKACSALSTIGEGRVIHERVIRSGWERDVFVGAALVDMYAKCGCVVDARHVFDKIVDRDAVLWNSMLAAYAQNGHPDESLSLCCEMAAKGVRPTEATLVTVISSSADIACLPHGREIHGFGWRHGFQYNDKVKTALIDMYAKCGSVKVACVLFERLREKRVVSWNAIITGYAMHGLAVEALDLFERMMKEAQPDHITFVGALAACSRGRLLDEGRALYNLMVRDCRINPTVEHYTCMVDLLGHCGQLDEAYDLIRQMDVMPDSGVWGALLNSCKTHGNVELAEVALEKLIELEPDDSGNYVILANMYAQSGKWEGVARLRQLMIDKGIKKNIACSWIEVKNKVYAFLSGDVSHPNSGAIYAELKRLEGLMREAGYVPDTGSVFHDVEEDEKTDMVCSHSERLAIAFGLISTLPGTRLLITKNLRICEDCHVAIKFISKITEREITVRDVNRYHHFRHGLCSCGDYW

SEQ ID NO: 125368 - protein, 103 aa, Glycine max
  Coding DNA Sequence Number=SeqID_8590
VFIVLQETLVPQPGPLILIYLIRRVQGDNPFHLLHEIKEKQENPKGKNKRRLKGKGEKERKKKTSDEDGIFWGLAEGQFGEHSFDERERNVRERKKGSSIEDR

SEQ ID NO: 125369 - protein, 33 aa, Glycine max
  Coding DNA Sequence Number=SeqID_8591
MAKCFALHQLLPLVERKALNLVVVGSSPTVGAK

SEQ ID NO: 125370 - protein, 391 aa, Glycine max
  Coding DNA Sequence Number=SeqID_8592
  Gene Ontology: Mol. function=serine carboxypeptidase activity; Cellular component=cellulose and pectin-containing cell wall; Biological process=proteolysis
  Homolog annotation: Hit_ID=Q9M099; Match level="QueryCoverage=94%, HitCoverage=81%, E-value=1e-175, Identity=76%"; Hit description =Serine carboxypeptidase 2 precursor (EC 3.4.16.6) (Serine carboxypeptidase II) ...
  Homolog annotation: Hit description=(Carboxypeptidase D) (Bri1 suppressor 1) [Contains: Serine carboxypeptidase 2 chain A (Serine carboxypeptidase II chain A); Serine carboxypeptidase 2 chain B (Serine carboxypeptidase II chain B)]
  Pfam annotation: Domain name=Peptidase_S10; Domain location=9-385; Score=577.3; E_value=1.5e-170; Accession=PF00450.12; Description =Serine carboxypeptidase
MSQLVCILSYVTCKNGVKKGPGCSSVAYGASEEIGPFRINKTGSSLYLNKYAWNKEASILFLESPAGVGFSYTNTSSDLKTSGDKRTAQDALVFLIRWMSRFPQYKYREFYIAGESYAGHYVPQLAKKIHDYNKNNPQIINLKGFIVGNAVTDSYNDGIGTVTYWWSHSMISDQSYKSILKYCNFTAEETSGKCDDVYSYAVNYEFGNIDQYSIYTPTCTASQNNTVRHMRFKNLHLISGYDPCTENYAEKYYNLPEVQKAMHANVTNIPYKWTACSDVLLKNWKDSAISVLPIYKELIAAGLKIWVFSGDTDSVVPVTATRFSLNHLNLSIRTRWYPWYSGGQVGGWTEVYDGLTFATVRGAGHEVPLFQPKRAYILFKSFLAAKELPKY

SEQ ID NO: 125371 - protein, 226 aa, Glycine max
  Coding DNA Sequence Number=SeqID_8593
MNSTSFQGLENQKTSESFWYKEEEEVQRDSRLVNDFRAFYNNLQIRDGVIFFEVHKIPIVVDQSLFYSLTKLSSQGVPFEGTLVDNWKHIYSTHDARKMVCNEHADMISKLLVGSFTFECRIMHYILCRVLLPRSTNLAQASEEELILLWALQTGRQIEWAHLARYRMHKALRANTPLPYPHLVTLFLQHFNVPLEDEPFVKVNRSFAIGVDVVASFGYRKDLDGQ

SEQ ID NO: 125372 - protein, 93 aa, Glycine max
  Coding DNA Sequence Number=SeqID_8594
MVLFWNLFLHGSVFYVNCMEIASPIGEFGLASTCGTGLASLTGDLTMHGTRQFDWRVALGGAFFQARVAGMCSRRRVGCSEHQLVALASCALI

SEQ ID NO: 125373 - protein, 78 aa, Glycine max
  Coding DNA Sequence Number=SeqID_8595
  Gene Ontology: Mol. function=sequence-specific DNA binding; Cellular component=nucleus; Biological process=regulation of transcription, DNA-dependent
  Homolog annotation: Hit_ID=Q5DWW4; Match level="QueryCoverage=100%, HitCoverage=18%, E-value=1e-10, Identity=53%"; Hit description =Mutant protein of GL2
  Subcellular localization annotation: CTP_CleavageSite=40; ConfidenceScore=5.21e-01
MAADMSNNNNPPPTSHAKDFFASPALSLSLAGIFRHAGVAAADEAATSVEEGEECERLDDISSENSGPTRSRSEDDFE

SEQ ID NO: 125374 - protein, 527 aa, Glycine max
  Coding DNA Sequence Number=SeqID_8596
  Gene Ontology: Mol. function=oxidoreductase activity, acting on the CH-OH group of donors, NAD or NADP as acceptor; Biological process =metabolic process
  Homolog annotation: Hit_ID=Q65CJ7; Match level="QueryCoverage=57%, HitCoverage=99%, E-value=1e-94, Identity=56%"; Hit description =Hydroxyphenylpyruvate reductase
  Pfam annotation: Domain name=2-Hacid_dh; Domain location=77-374; Score=74.0; E_value=4.6e-19; Accession=PF00389.20; Description=D -isomer specific 2-hydroxyacid dehydr
  Pfam annotation: Domain name=2-Hacid_dh_C; Domain location=180-342; Score=195.7; E_value=1.1e-55; Accession=PF02826.9; Description=D -isomer specific 2-hydroxyacid dehyd
  Pfam module annotation: Pfam domain module=2-Hacid_dh::2-Hacid_dh_C; Domain location=77-374::180-342
MGYASRLGWQRDGQAVNFVVHGEAEELVWMGMAVRDNVLAFGEDDPHTPKMQEEELLTLEEALDSILSLKKMESIGVLMTCPMHSYIQEELAKRFNLFKLWHYPSFSAFAQAHAHSIRALVASAKVGVDAATIDSLPNLEIVSTYSVGYDNIDLHKCRHRAIPVTNTPNVLTDDVADVAIALALSLLCRICPRNSTWQFTPKLSGKAVGIVGLGRIGWAIAKRAEGFGCPVSYHSRSEKSETGYKYYSHIIDLAANSEVLFVACTLSEETRHIVNRGVIDALGPKGILINVGRGPHVDEPELVAALIEGRLGGAGLDVFENEPEVPEDLLGLENLVMTPHVGTDTLETCIAMGDLVIANLEAHFLGNPLFTPAGSGGDSVHDEEEEAEACDDMEADDGLCTAGPCKRNLEAHVADFGLAKFLYDPGASQSMSSIAGSYGYIAPAILSLRIRCLGNWDGRGNKSSGDNFLAAPNIDHSQDFVRKDLKEWLCWMSQFATSFIIILLFIIQGFIFKEEAVFQYPECGLTN

SEQ ID NO: 125375 - protein, 106 aa, Glycine max
  Coding DNA Sequence Number=SeqID_8597
  Gene Ontology: Mol. function=microtubule motor activity; Cellular component=microtubule associated complex; Biological process =microtubule-based process
  Homolog annotation: Hit_ID=Q9M810; Match level="QueryCoverage=85%, HitCoverage=97%, E-value=6e-40, Identity=82%"; Hit description =Dynein light chain, putative
  Pfam annotation: Domain name=Dynein_light; Domain location=12-102; Score=97.6; E_value=3.9e-26; Accession=PF01221.9; Description=Dynein light chain type 1
MTKKHERVLDSMLEGKAVIEDTDMPDKMQIQAMASASEALDLYDVFDCTSIAAHIKKEFDTKYGSGWQCVVGSSFGCFFTHSKGTFVYFTLETLNFLIFKGASYLI

SEQ ID NO: 125376 - protein, 533 aa, Glycine max
  Coding DNA Sequence Number=SeqID_8598
  Gene Ontology: Mol. function=kinase activity
  Homolog annotation: Hit_ID=Q5DK69; Match level="QueryCoverage=83%, HitCoverage=89%, E-value=1e-168, Identity=69%"; Hit description =Pollen-specific kinase partner protein
  Pfam annotation: Domain name=DUF315; Domain location=16-442; Score =736.0; E_value=2.5e-218; Accession=PF03759.4; Description=Domain of unknown function (DUF315)
MVRAGEQEQEGYRAKLFNFRGIFEGTGRHTKSLSVDTATILEPTEDGAASSRSQGSKPLNDLDNIIPKVRVISKEEIAVKEAKEKLLQDMEQMKERFAKLLLGEDMSGGGKGVSSALALSNAFTNLAASIFGEQKRLEPMPAERKAKWRKEIDWLLSVTDYVVEMVPSQQKSKDGSNMEIMTTRQRTDLHMNVPALRKLDAMLLECLDNFKDQNEFYYVSKGSDDSDQDSAKTKNDDKWWLPTPKVPAEGLSDMARKFLQYQKDCVNQVLKAAMAINAQILTEMEIPESYIDSLPKNGRASLGDSNYRSITVEFFDPDQFLSTMDLSSEHKILDLKNRIEASIVIWKRKMHQKDSKSAWGSAVSLEKRELFEERAETILLLLKHRFPGLPQSALDISKIQYNRDVGQAVLESYSRILESLAFTVLSRIDDVLQADYQIQSQNLLGRRISSVSRPSREEIDKASAEAGSMTLSDFMGWGSDQGDADMKKDPFAISDDLCKDDDPKQQKLQTVVTNKKVSYLETLGVMRSPTSRH

SEQ ID NO: 125377 - protein, 758 aa, Glycine max
  Coding DNA Sequence Number=SeqID_8599
  Gene Ontology: Mol. function=sequence-specific DNA binding; Cellular component=nucleus; Biological process=regulation of transcription, DNA-dependent
  Homolog annotation: Hit_ID=P46607; Match level="QueryCoverage=81%, HitCoverage=82%, E-value=0.0, Identity=65%"; Hit description =Homeobox protein GLABRA2
  Pfam annotation: Domain name=Homeobox; Domain location=1-40; Score =34.2; E_value=4.5e-07; Accession=PF00046.19; Description=Homeobox domain
  Pfam annotation: Domain name=M; Domain location=45-65; Score=3.5; E _value=43; Accession=PF02370.7; Description=M protein repeat
  Pfam annotation: Domain name=M; Domain location=89-109; Score=12.9; E_ value=1.2; Accession=PF02370.7; Description=M protein repeat
  Pfam annotation: Domain name=START; Domain location=152-376; Score =309.1; E_value=8.1e-90; Accession=PF01852.10; Description=START domain
  Pfam module annotation: Pfam domain module=Homeobox::M::M::START; Domain location=1-40::45-65::89-109::152-376
LFKESPHPDEKQRQQLSKQLGLAPRQVKFWFQNRRTQIKAIQERHENSLLKSEIEKLKEKNKTLRETINKACCPNCGVPTTSRDGAMPTEEQQLRIENAKLKAEVEKLRAVLGKYAPGSTSPSCSSGHDQENRSSLDFYTGIFGLDKSRIMDTVNQAMEELIKMATVGEPLWLRSFETGREILNYDEYVREFAVENSSSGKPRRSIEASRDTAVVFVDLPRLVQSFLDVNQWKEMFPCLISKAATVDVICNGEGPGRNGAVQLMFAELQMLTPMVPTREVYFVRFCKQLSAEQWAIVDVSIDKVEDNIDASLVKCRKRPSGCIIEDKSNGHCKVIWVEHLECQKSAVHSMYRTIVNSGLAFGARHWIATLQLQCERLVFFMATNVPMKDSTGVATLAGRKSILKLAQRMTWSFCHAIGASSFHTWTKFTSKTGEDIRISSRKNLNDPGEPLGLILCAVCSVWLPVSPNVLFDFLRDETRRTEWDIMSSGGTVQSIANLAKGQDRGNAVAIQTIKSKENSVWILQDSYTNPYESMVVYASVDITGTQSVMTGCDSSNLAILPSGFSIIPDGLESRPLVISSRQEEKNTEGGSLFTMAFQILTNASPAAKLTMESVDSVNTLVSCLGLGLEGNGKLIGLGLGPVGGPLGNGECEKGLGLADGPGLLELDDVADIELVIGIVGLVLLLLPHAPLVLWVRGQPHHLHCHRLVVRGAHHFSLHRLHRIDLRQQTRRGPVGLSHRRTGFPEKAGAMAMAVQKWG

SEQ ID NO: 125378 - protein, 425 aa, Glycine max
  Coding DNA Sequence Number=SeqID_8600
  Gene Ontology: Mol. function=voltage-gated potassium channel activity; Cellular component=membrane; Biological process=potassium ion transport
  Homolog annotation: Hit_ID=Q1RWG4; Match level="QueryCoverage=89%, HitCoverage=52%, E-value=1e-162, Identity=75%"; Hit description =Cation channel family protein, putative
  Pfam annotation: Domain name=Ion_trans; Domain location=151-409; Score=24.1; E_value=0.00049; Accession=PF00520.21; Description=Ion transport protein
MFDCGPKSEYMGGQRENFLRLEALDSTLSSSSDAGVIKSGFSIDKLSHGHGNSTTSRSFKRGMRRGSEGLKSIGRSLGLGVSRAVFPEDLKVSEKKIFDPQDKFLLLWNKLFVISCILAVSIDPLFFYLPVINDSFHCLGIDRKLATIVTTLRTLVDAFYLLHMALQFRTAYIAPSSRVFGRGELVIDSAQIAKRYLQRYFIIDFLSVLPIPQIVVWRFLQRSKGSDVLATKQALLFIILLQYVPRFLRMVPLTSELKRTAGVFAETAWAGAAYYLLLYMLASHIVGAFWYLLAIERNDSCWQKACSDIRCNKNFLYCGNQHMEGYSAWNKTSEDIQSRCSADGDPAHFDYGIFGQVLSSGIISSKKFISKYCYCLWWGLQNLRLTAIRKTETSIFYVKPDLNTDIPSISPEMKNELGKKENCVV

SEQ ID NO: 125379 - protein, 112 aa, Glycine max
  Coding DNA Sequence Number=SeqID_8601
  Gene Ontology: Mol. function=endonuclease activity
  Homolog annotation: Hit_ID=Q2LW15; Match level="QueryCoverage=96%, HitCoverage=36%, E-value=3e-14, Identity=34%"; Hit description =Endonuclease/exonuclease/phosphatase family protein
MSVSLTVMTFNLYDDEPQDSPNSWEKRRDLCISVITSYSPIILCTQQGYDQFGISRKGPQDTTSEHCTIFYDKEKVELLEGGTFWLSESPSVPGSMSWGSEVPCIATWAISL

SEQ ID NO: 125380 - protein, 310 aa, Glycine max
  Coding DNA Sequence Number=SeqID_8602
  Gene Ontology: Mol. function=leucyl aminopeptidase activity; Cellular component=intracellular; Biological process=protein metabolic process
  Homolog annotation: Hit_ID=Q1RWG8; Match level="QueryCoverage=98%, HitCoverage=47%, E-value=1e-124, Identity=75%"; Hit description =Cytosol aminopeptidase family, catalytic domain, putative
  Pfam annotation: Domain name=Peptidase_M17; Domain location=1-300; Score=400.0; E_value=3.4e-117; Accession=PF00883.11; Description =Cytosol aminopeptidase family, catalytic domain
MGSYLGVAAASENPPHFIHLCYKPLSGPVNVKLALVGKGLTFDSGGYNIKTGPGCSIELMKFDMGGSAAVLGTAKALGQIKPLGVECLLWCSNDNACNAQIKNPTCAGMRPGDIVTASNGKTIEVNNTDAEGRLTLADALVYACNQGVEKVFGFNLHKLNNCFIGVRFVFRMVLMGWSTVLQIIDLATLTGACVVALGPSIAGVFTPSDDLAKEVFEASDVSGEKLWRLPLEESYWETMKSGVADMLNTGGRQGGAIVAALFLKQFVDEKVQWMHIDMAGPVWNDKKRSATGFGIATLVEWVLKNASKAN

SEQ ID NO: 125381 - protein, 395 aa, Glycine max
  Coding DNA Sequence Number=SeqID_8603
  Gene Ontology: Mol. function=voltage-gated potassium channel activity; Cellular component=membrane; Biological process=potassium ion transport
  Homolog annotation: Hit_ID=Q1RWG4; Match level="QueryCoverage=85%, HitCoverage=46%, E-value=1e-179, Identity=92%"; Hit description =Cation channel family protein, putative
  Pfam annotation: Domain name=cNMP_binding; Domain location=188-288; Score=37.6; E_value=4.3e-08; Accession=PF00027.19; Description =Cyclic nucleotide-binding domain
MALPFEEHLLIFIFLCSFTSRKSRKGTKGIVLTAEAEECEKSRGLYQSAHTARDLGLQTSTYPGEVIFSIALAISGLILFALLIGNMQTYLQSLTIRLEEMRVKRRDSEQWMHHRLLPQDLRERVRRYDQYKWLATRGVDEENLVQSLPKDLRRDIKRHLCLALVRRVPLFESMDERLLDAICERLKPCLFTENTYIVREGDPVDEMLFIIRGRLESVTTDGGRSGFFNRGFLKEADFCGEELLTWALDPKSGSNLPSSTRTVKALMEVEAFALTADELKFVASQFRRLHSRQVQHTFRFYSQQWRTWAACFIQAAWRRYSKKKIMKLRQKEDESDGAHENVGGSSYSFGAALLASKFAAHTLRGVHRNRLAKTARELVKLQKPPEPDFSADDAN

SEQ ID NO: 125382 - protein, 642 aa, Glycine max
  Coding DNA Sequence Number=SeqID_8604
  Gene Ontology: Mol. function=transmembrane receptor activity; Cellular component=integral to membrane; Biological process=defense response to bacterium
  Homolog annotation: Hit_ID=Q1SI21; Match level="QueryCoverage=97%, HitCoverage=98%, E-value=0.0, Identity=76%"; Hit description =Nonaspanin
  Pfam annotation: Domain name=EMP70; Domain location=58-600; Score =1115.3; E_value=0; Accession=PF02990.7; Description=Endomembrane protein 70
  Pfam annotation: Domain name=Rab5ip; Domain location=476-551; Score= -45.9; E_value=0.087; Accession=PF07019.2; Description=Rab5 -interacting protein (Rab5ip)
  Pfam module annotation: Pfam domain module=EMP70::Rab5ip; Domain location=58-600::476-551
MAREPLARDLCISVFICILLITHQSTCFYLPGVAPEDFWKGDPLRVKVNKLTSTKTQLPYSYYSLPYCRPKHIFDSAENLGEVLRGDRIENSPYVFKMREPQLCNVACRLILDEKTAKEFKEMIDDEYRVNMILDNLPLVVPIRRLDQEASVVYLHGFLVGLKGQYSGIKEDKYFIHNHLAFVVKYHRDPELELSRIVGFEVTPFSIKHEYEGKWNENTRLTTCDPHAKKLVTSSESPQEVEDKKEIIFTYDVEFEASDVKWAYRWDTYLLMADDQIHWFSIVNSLMIVLFLSGMVAMIMLRTLYRDISKYNQLETQEEAQEETGWKLVHGDVFRPPSNSDLLCVYVGTGVQFFGMTLVTMMFAALGFLSPSNRGGLMTAMLLLWVFMGMLAGYASARLYKMFKGTEWKKISFGTAFIFPATAFAVFFVLNALIWGQKSSGAVPFQTMFALLLLWFGISFPLVFVGGFVGFNKKPAIEDPVKTNKIARQIPEQAWYMNYVCSILIGGILPFGAVFIELFFILTSIWLHQFYYIFGFLFIVFVILIITCAEITIVLCYFRLCSEDYNWWWRSYLTSGSSALYLFLYAVFYFFTKLEISKPISGILYFGYMLLLSYAFFVLTGTIGFYACFWFTRLIYSSVKID

SEQ ID NO: 125383 - protein, 287 aa, Glycine max
  Coding DNA Sequence Number=SeqID_8605
  Gene Ontology: Mol. function=leucyl aminopeptidase activity; Cellular component=intracellular; Biological process=protein metabolic process
  Homolog annotation: Hit_ID=Q1RWG8; Match level="QueryCoverage=86%, HitCoverage=42%, E-value=6e-83, Identity=69%"; Hit description =Cytosol aminopeptidase family, catalytic domain, putative
  Pfam annotation: Domain name=Peptidase_M17_N; Domain location=92-227; Score=94.9; E_value=2.4e-25; Accession=PF02789.7; Description=Cytosol aminopeptidase family, N-terminal domain
  Subcellular localization annotation: CTP_CleavageSite=67; ConfidenceScore=5.75e-01
MAAIATIFVSFTTTSSSPFLTRLTSRLHFAAFPLRSPTRKLMSHTLARATLGLTHPSNIETPKAFYVCENSWKISFGSKDVDVTEWKGDILAVGVTEKDLARDANSKFENVILRKIDSKLGGLLAEASSEEDFSGKVGQSTVLRITGLGSKRVGLIGLGQSPSTPSPFKGLGEAVVEAAKSSQASSVAVVLASSEGLSAQSKLSTAYAIASGAVLGLFEDNRYKSEAKKSTLRSIDIIGLGMGPELEKKLKYAGDVSSGIIFGRELVNSPANVLTPGSYDTLNVYDM

SEQ ID NO: 125384 - protein, 298 aa, Glycine max
  Coding DNA Sequence Number=SeqID_8606
  Gene Ontology: Mol. function=ATP-dependent peptidase activity; Cellular component=integral to membrane; Biological process=ATP -dependent proteolysis
  Homolog annotation: Hit_ID=Q6Z001; Match level="QueryCoverage=98%, HitCoverage=74%, E-value=2e-49, Identity=36%"; Hit description =Membrane protein-like
  Pfam annotation: Domain name=DUF81; Domain location=31-293; Score= -54.8; E_value=0.0092; Accession=PF01925.9; Description=Domain of unknown function DUF81
MITGGAAATVFYNLRQKHPTLDMPVIDYDLALLFQPVLVLGISIGVAFNARKLLTTESFLFFPTNPLTGCICKTGIATKAFLKGVETWKKETIIKKETARQSQFNGTERTAEVAYEPLPGGPNTSNHKEPKKSKETGSILENVRWKALGVLFTVWVLILASEIAKVPVALGATSYQAVLLYTGKRVIASKGDQRTQWRAHQLIMYCSCGICAGIVGGLLGLGGGFILGPLFLELGIPPQVSSATATFAMTFSASMSVVEYYLLKRFPIPYSGVGISNMIQRIANKEYMGFENLCTYSA

SEQ ID NO: 125385 - protein, 217 aa, Glycine max
  Coding DNA Sequence Number=SeqID_8607
  Homolog annotation: Hit_ID=Q9LW80; Match level="QueryCoverage=84%, HitCoverage=98%, E-value=1e-15, Identity=30%"; Hit description =Arabidopsis thaliana genomic DNA, chromosome 3, P1 clone: MSL1
  Subcellular localization annotation: CTP_CleavageSite=61; ConfidenceScore=5.02e-01
MLLRETIRKTRVLFHKTLRSFKSVIFGGYQKLPRSLSFNPFLGRSGNARTYTSEQFYNEFYDMLQSDLNRIKRSDSNSMNRSRDHAIGDAAANTEILTKQSSQKSIAEEGVVLKEKKSKGSCELGKKECLNNSKSINEGVHDLTQKMKELEMMDTGDVEHVLDIEEALHYYSRLKSPVYLDIVDKFFMDMHSEFSVQDSSISVKRSKSKGRLGSIRL

SEQ ID NO: 125386 - protein, 57 aa, Glycine max
  Coding DNA Sequence Number=SeqID_8608
  Gene Ontology: Mol. function=structural constituent of ribosome; Cellular component=ribonucleoprotein complex; Biological process =translation
  Homolog annotation: Hit_ID=Q6SPR2; Match level="QueryCoverage=81%, HitCoverage=49%, E-value=2e-18, Identity=91%"; Hit description =Ribosomal protein L37
  Subcellular localization annotation: CTP_CleavageSite=45; ConfidenceScore=5.25e-01
MGKGTGSFDNWSVKAIRRKTTGTGRMRYLRNVPRRFKSGFREGTEAAPRKKGAATTA

SEQ ID NO: 125387 - protein, 139 aa, Glycine max
  Coding DNA Sequence Number=SeqID_8609
  Gene Ontology: Mol. function=microtubule motor activity; Cellular component=microtubule associated complex; Biological process =microtubule-based movement
  Homolog annotation: Hit_ID=Q9AVP4; Match level="QueryCoverage=90%, HitCoverage=17%, E-value=6e-40, Identity=64%"; Hit description=BY-2 kinesin-like protein 10
MNGAGRQGLRSGAAGVHHQRQYSDNFLDSSSNGNRWLQSAGLQHLQSSSNQLPPLQDYNLYGGAQGGRMYRNAPRSFNGGNEYYMEPSTPPGGYRASMQKKNGEDLSGDFSPGLLDLQSFDTELLPPEVVIFLNGRTFI

SEQ ID NO: 125388 - protein, 59 aa, Glycine max
  Coding DNA Sequence Number=SeqID_8610
MQPAYFINEVVEESELPYNQQEFHSENEKITHEAMTIIQKEIIQRCGKIIRNTIQIQGE

SEQ ID NO: 125389 - protein, 294 aa, Glycine max
  Coding DNA Sequence Number=SeqID_8611
  Gene Ontology: Mol. function=binding; Cellular component =mitochondrial inner membrane; Biological process=transport
  Homolog annotation: Hit_ID=Q1SK80; Match level="QueryCoverage=99%, HitCoverage=96%, E-value=1e-118, Identity=72%"; Hit description =Mitochondrial carrier protein
  Pfam annotation: Domain name=Mito_carr; Domain location=104-197; Score=88.9; E_value=1.6e-23; Accession=PF00153.17; Description =Mitochondrial carrier protein
  Pfam annotation: Domain name=Mito_carr; Domain location=11-97; Score =59.2; E_value=1.3e-14; Accession=PF00153.17; Description =Mitochondrial carrier protein
  Pfam annotation: Domain name=Mito_carr; Domain location=204-292; Score=94.7; E_value=2.8e-25; Accession=PF00153.17; Description =Mitochondrial carrier protein
  Pfam module annotation: Pfam domain module=Mito_carr::Mito_carr::Mito_ carr; Domain location=104-197::11-97::204-292
MEFWPEFLASSTGKEFVAGGFGGTAGIISGYPLDTLRVMQQNSNNGSAFTILRNLVAKEGPTTLYRGMAAPLASVTFQNAMVFQIYAVLSRAFSTSVSVNDPPSYKGVALGGFCSGALQSMLLSPVELLKIRLQLQNTGQSTEPQKGPIRVANNIWKREGLRGIYRGLGITILRDAPAHGLYFWTYEYAREKLHPGCRKSCGESLNTMLVSGGLAGVVSWVFSYPLDVIKTRLQAQTFSSLKYKGILDCLRKSVEEEGYVVLWRGLGTAVARAFVVNGAIFSAYEITLRCLFDK

SEQ ID NO: 125390 - protein, 192 aa, Glycine max
  Coding DNA Sequence Number=SeqID_8612
  Homolog annotation: Hit_ID=Q2HRM7; Match level="QueryCoverage=42%, HitCoverage=12%, E-value=1e-23, Identity=73%"; Hit description =Polynucleotidyl transferase, Ribonuclease H fold
MAHFIPYHKVDDDCVVKDLFFREVVCLHGLPKSIVSNRDSKFLSHFLKTLWGKAWHQDYSIHNMSPPKRWANHKSYSLSTPMADYFQGGDDGGPPMEELEVKGPLTRSSSKKLEEELKRKLNTLGEHGVERLDLKWLNLSQILEQAKGQFGAVAARPGELNLSPEVRGGSLLCTVTSIQCHKSTNKNQKINE

SEQ ID NO: 125391 - protein, 68 aa, Glycine max
  Coding DNA Sequence Number=SeqID_8613
MVERAKKSAHFRLVVKRGRVYVERDKKSIQTPSEEVRSRKEEEAKQTRRGRKRKCWVYKYFKKFDKGI

SEQ ID NO: 125392 - protein, 95 aa, Glycine max
  Coding DNA Sequence Number=SeqID_8614
MDNEEGVQEQMKADLSALKDQMASITEAMLKLQKTLEDNATATASNAVREAKPVLQPAINLSHDRNGTVFGQRYSPQAYPYGLPPDFTPRAAPED

SEQ ID NO: 125393 - protein, 106 aa, Glycine max
  Coding DNA Sequence Number=SeqID_8615
  Gene Ontology: Mol. function=RNA binding
  Homolog annotation: Hit_ID=Q1RWD7; Match level="QueryCoverage=92%, HitCoverage=20%, E-value=1e-25, Identity=60%"; Hit description =Cyclin-like F-box; Agenet
MHTLKSSWVSDTILSHVDSDKFLVHYHNLSEKAVVGLHRLRPLPLPESHHEFNSGDNVEAFRKDRWWEGRVTETLGNGRFIVSFNDSEEITFSKELLRAPLQWINQ

SEQ ID NO: 125394 - protein, 75 aa, Glycine max
  Coding DNA Sequence Number=SeqID_8616
MVIKYAVFEPRSAVEARIDSNRFLLHYHNFSERALANLHRPRPLPRRRSIGNSSPATGWKRSAIIAGGKVVSPKI

SEQ ID NO: 125395 - protein, 501 aa, Glycine max
  Coding DNA Sequence Number=SeqID_8617
  Gene Ontology: Mol. function=protein serine/threonine kinase activity; Cellular component=membrane; Biological process=protein amino acid phosphorylation
  Homolog annotation: Hit_ID=Q5NJB1; Match level="QueryCoverage=68%, HitCoverage=50%, E-value=8e-65, Identity=43%"; Hit description=S -receptor kinase-like protein 1
  Pfam annotation: Domain name=PAN_2; Domain location=165-227; Score= -5.8; E_value=0.0054; Accession=PF08276.2; Description=PAN-like domain
  Pfam annotation: Domain name=Pkinase; Domain location=343-501; Score=- 60.8; E_value=6.1e-05; Accession=PF00069.15; Description=Protein kinase domain
  Pfam annotation: Domain name=Pkinase_Tyr; Domain location=343-500; Score=-72.7; E_value=5.2e-08; Accession=PF07714.7; Description =Protein tyrosine kinase
  Pfam module annotation: Pfam domain module=PAN_2::Pkinase::Pkinase _Tyr; Domain location=165-227::343-501::343-500
MANLAQYLKSNSDSQTIQQKQLPASLYLSAAPQCPFPDARLGSAIGTGIFDYVWVQFYNNPSCSYSQNNLDNFLKSWREWATSLKVGKLFLGLPADEAAAPAGGYVPADVLMSKILPEINKSTNYGGLMLWSRYYDKISGYSTRIQNPLRNGTANPLCTRKSQACRSHEGGFAELLGYMSTLGIKVYEDDNNGTQCCEIICRNNCSCDAFAPLNHINNTSTGCQIWLKGTKFVRASGNIALPINVSVALLEHKVNSWWIWLIVGVGAAFVIPVIFYLSRAFLRKYKAKVERKKMQKKLLHDIGGNAMLAMVYGKTIKSNNKGKTNNEVELFAFDTIVVATNNFSAANKLGEGGFGPVYKGNLSDQQEVAIKRLSKSSGQGLIEFTNEAKLMAKLQHTNLVKLLGFCIQRDERILVYEYMSNKSLDFYLFGRLSFILTKHINKQPYFKTDSARKDLLDWEKRLNIIGGIAQGLLYLHKYSRLKVIHRDLKASNILLDHEMKC

SEQ ID NO: 125396 - protein, 59 aa, Glycine max
  Coding DNA Sequence Number=SeqID_8618
MSFSKKIYSPVVSFGKIIHPQLGHNIVPAYDNFDLSRYQASHEQQSQRELNSLRNLQSL

SEQ ID NO: 125397 - protein, 68 aa, Glycine max
  Coding DNA Sequence Number=SeqID_8619
MGKDLSEEQVSLMKEAYSLFDTNDGSGIAPFELRILMRTDLCLIAPNTEALNALYLSSTSNRVLGFWS

SEQ ID NO: 125398 - protein, 74 aa, Glycine max
  Coding DNA Sequence Number=SeqID_8620
MDSRYVYIGFFPEGQLKTPVPCSQNPNDHSSSPKTCNGKTILNMSAQDKTAGLPYVKEAENHNINEDANIDTLP

SEQ ID NO: 125399 - protein, 259 aa, Glycine max
  Coding DNA Sequence Number=SeqID_8621
  Gene Ontology: Mol. function=S-adenosylmethionine-dependent methyltransferase activity
  Homolog annotation: Hit_ID=Q4TC60; Match level="QueryCoverage=70%, HitCoverage=43%, E-value=3e-16, Identity=36%"; Hit description =Chromosome undetermined SCAF7053, whole genome shotgun sequence
MESEEVMSEVHLGCPAGFSGPYISLFSFSTNLQFDQDGDLLLPRRRTAMFEANAQHSFSVRIQHNITSSIPNVGLQVWRAELLLSDFILHKASSSSQLHQVIALELGAGTVPLFPAPMNHHGGNSYSPTTNGEWGPYCIIIENYDHGTEILDNCAKNVQLNFGLLNYQAKIYVRELDWFGCWPPKAKTGEAPSTQKEIEDAENASLLVAADVIYSDELTDAFFSTLERLMSRGSTKGYGDNTHHDEYGTWGGNVAVMIC

SEQ ID NO: 125400 - protein, 257 aa, Glycine max
  Coding DNA Sequence Number=SeqID_8622
  Homolog annotation: Hit_ID=Q9C824; Match level="QueryCoverage=22%, HitCoverage=7%, E-value=2e-10, Identity=57%"; Hit description=BZIP protein, putative; 48652-45869
  Pfam annotation: Domain name=DUF630; Domain location=1-60; Score =119.8; E_value=7.9e-33; Accession=PF04783.3; Description=Protein of unknown function (DUF630)
MGCNQSKIENEEAVARCKERKRFMKDSVASRNAFAAAHSAYATCLKNTGAALGDFAHGEVQNPQFHSNDNNTSSSSSYVTAAQPFEIPLPPPPLPDFSPAPPLQRAASMPEIKINNPDSRPRPEPVTTIVEEDDEEDKELENEGSLRMRRSNRVNSNRRVSEEEVQEPRPPMPPPPSKQPDHATHHHHHSMAPDTQSGAWEYFFPSMENIAGTSLNAAEEDAVHKVHDIERKVFEEKPSRVVLEEEDEVVTPVRKVE

SEQ ID NO: 125401 - protein, 490 aa, Glycine max
  Coding DNA Sequence Number=SeqID_8623
  Gene Ontology: Mol. function=binding; Cellular component =intracellular; Biological process=metabolic process
  Homolog annotation: Hit_ID=Q943L3; Match level="QueryCoverage=91%, HitCoverage=99%, E-value=1e-123, Identity=40%"; Hit description =Pentatricopeptide (PPR) repeat-containing protein-like
  Pfam annotation: Domain name=PPR; Domain location=163-197; Score =43.5; E_value=7.2e-10; Accession=PF01535.11; Description=PPR repeat
  Pfam annotation: Domain name=PPR; Domain location=264-298; Score =43.1; E_value=9.7e-10; Accession=PF01535.11; Description=PPR repeat
  Pfam annotation: Domain name=PPR; Domain location=401-435; Score =13.2; E_value=0.2; Accession=PF01535.11; Description=PPR repeat
  Pfam annotation: Domain name=PPR; Domain location=75-109; Score=22.7; E_value=0.0013; Accession=PF01535.11; Description=PPR repeat
  Pfam module annotation: Pfam domain module=PPR::PPR::PPR::PPR; Domain location=163-197::264-298::401-435::75-109
MKIHMRNIVSRLCVAHTWIAPHVVSCSYITKTHHANVTKHEASVAHIDINPCSLDSTTFQVACHMFEEMSEQTVALATTIIQGFVKRHCHEDAIYLFSKMLASKIRPNEFTFGTVLNSSTALGNVVVGKQLHACAMKIGLSCHRGRFEDALQVFHEMPERNVVSWNAMVGGCSQMGHSEEAVDFFIGMLREGFIPNESTFPCVICAAANITSLGIGKSFHACAIKFLGKVDQFVGNSLISFYAKCGSMEDSLLMFDKLFKRDIVSWNAMICGYAQNGTGVEAISLFKRMGSEGYKPNYVTLLGLLWACNHASLVDEGYSYFNRAWLDSPSLLKSEHYACMVNLLARSGRFAEAEDFLQSVPLDPGLGFWKALLARCQIHSNLKLGELAARKILALDPDDVSSYVMLSDAHSAAGKWSDVATVRTEMKEKGMKRIPGSSWIEVRGEVHPFLTGDQNHNKQDEIYLILKFFFEHLRENEDSDLLNIYWYFSS

SEQ ID NO: 125402 - protein, 68 aa, Glycine max
  Coding DNA Sequence Number=SeqID_8624
  Subcellular localization annotation: CTP_CleavageSite=26; ConfidenceScore=5.40e-01
MAPTIFVQFFFFVFSLCSVKVKVFIVAVVNSSSTTYKINLIPKLNTNYGSSIPIVDQLRPTLSLLRMT

SEQ ID NO: 125403 - protein, 84 aa, Glycine max
  Coding DNA Sequence Number=SeqID_8625
MAPKFTCSTRILVYSLFQIGITCFIWEWSYRQAHRVTNLSWQGNSFYTEEEESREIACLQRSGDVSSTSRNLTITQKLTNLPKR

SEQ ID NO: 125404 - protein, 204 aa, Glycine max
  Coding DNA Sequence Number=SeqID_8626
  Gene Ontology: Mol. function=nucleotide binding; Cellular component =membrane; Biological process=small GTPase mediated signal transduction
  Homolog annotation: Hit_ID=Q9SBU1; Match level="QueryCoverage=90%, HitCoverage=75%, E-value=7e-49, Identity=55%"; Hit description=GTP binding protein
  Pfam annotation: Domain name=Arf; Domain location=31-189; Score= -77.6; E_value=0.00088; Accession=PF00025.11; Description=ADP -ribosylation factor family
  Pfam annotation: Domain name=Miro; Domain location=27-144; Score=5.4; E_value=0.0016; Accession=PF08477.3; Description=Miro-like protein
  Pfam annotation: Domain name=Ras; Domain location=1-189; Score=182.5; E_value=1e-51; Accession=PF00071.12; Description=Ras family
  Pfam module annotation: Pfam domain module=Arf::Miro::Ras; Domain location=31-189::27-144::1-189
MGTGKTSIALRFVKGHFFPNQVYFHFIALIEIGKLLSQHNNNYSLGILTLIYAQEPTIGAAFFTQILSLSEATVKFDIWDTAGQERYHSLAPMYYRGAAAAIVVYDISSVDTFVRAKKWVQELQTHGNASNSKSVMALVANKSDLEPKREVEAEVGEQFAQENGMFYMETSAKTAENINELFYEIAIYKIEGEIIFVAQPDIPT

SEQ ID NO: 125405 - protein, 98 aa, Glycine max
  Coding DNA Sequence Number=SeqID_8627
MPSWRTFWRKIKWEKRRLFSSSPAVHVQYDPSSYSQNFDDGYSTDPDNLSRSFSARFAVPSKIFDKSEMFINFLSNSGYAIFESGCCQSKCLKLSLNK

SEQ ID NO: 125406 - protein, 178 aa, Glycine max
  Coding DNA Sequence Number=SeqID_8628
MEASCSHIVEGGLKCYQKVIKENKEFSSIKLLGYTLVDGEVRVYFSRFDEKFSIQHFLDYILVCLIEEDELCLVTLQLYQTDTHPQTNFVFVNKGKENNDFFFYMYDCIYLNLHVSSNLECRPFSIAPEWVGGHSGIMLVYLYQGYPWVVFLFLLFLAENDGEVGVLGSSCLSTLVLA

SEQ ID NO: 125407 - protein, 265 aa, Glycine max
  Coding DNA Sequence Number=SeqID_8629
  Homolog annotation: Hit_ID=Q0XIJ8; Match level="QueryCoverage=21%, HitCoverage=14%, E-value=4e-22, Identity=92%"; Hit description =Flagellar P-ring protein precursor
  Pfam annotation: Domain name=FlgI; Domain location=98-255; Score= -203.5; E_value=0.00044; Accession=PF02119.7; Description=Flagellar P- ring protein
DLPSQWLLFLSAVPPVQLLTGWCVTAKAPPDISAGKCSGRVPFAIQAAQLLGRAIGAGLFAITPAGERGMCCKAIKLGNARVFPEFDGLLATPANALRIKEVASVQGVRSNQLTGYGLVVGLDGTGDQTTQMPYTTQTLSNYLQQMGIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 125408 - protein, 83 aa, Glycine max
  Coding DNA Sequence Number=SeqID_8630
MTPSQQHDAPMATPNAPLAPQWNVPGAIPDMGDLLGVDLHHEFSAEAEQQGRRQRARRNPDREARRWDRPCGTGSRHHGHHND

SEQ ID NO: 125409 - protein, 146 aa, Glycine max
  Coding DNA Sequence Number=SeqID_8631
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=98%, E-value=2e-12, Identity=30%"; Hit description =UPI00006A17C9 related cluster
GLYIVAIRGLHVLAFRGLHVLPFRGQHDLPFRGLHALALTGLHVLIFRGLHNLAFRGLDALAFRGVHILPLRGLHALAFGYTSSTSEDYMPIPSKDTFIGLHALGFVRLHALTFRGLHMLAYRRLHAFAFVGLHALTFRGLHILVF

SEQ ID NO: 125410 - protein, 227 aa, Glycine max
  Coding DNA Sequence Number=SeqID_8632
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-27, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSEGCTPLEDCMSSPSEGCTPSTFDDYTSSPSEDYTSSPSEDYTSSPSQGYVSSPSEGYMHALRGLWVLIFRGLHALVFRGLHILTFRELHVLTFRGLHALAFRGLHTLSFRGLHAIAFRGLRVLTFRGQHALAFRGLHALTFRGLHALTFRGLHVFAFRGLHTLSFRGLHALAFRGLHILAIKDYTSLPSEGYTPSPSEEYTSSPLEGCTPLPSEDYMSSPSEDC

SEQ ID NO: 125411 - protein, 41 aa, Glycine max
  Coding DNA Sequence Number=SeqID_8633
MVRGNEDDGIRRQGHKYERRWQEYKRFKEDRQERIIVDRVS

SEQ ID NO: 125412 - protein, 249 aa, Glycine max
  Coding DNA Sequence Number=SeqID_8634
  Homolog annotation: Hit_ID=Q53ND9; Match level="QueryCoverage=55%, HitCoverage=41%, E-value=3e-12, Identity=33%"; Hit description =Expressed protein
  Pfam annotation: Domain name=DUF623; Domain location=158-218; Score =98.2; E_value=2.4e-26; Accession=PF04844.4; Description=Protein of unknown function, DUF623
MPKKIRDYLFKIKNPRPQVRLPSKNWILSGCKHPRTPSFALYSGRNQSHHNPVLNNNNNNDAATLADVDRFLMENFKSLYLKDEHDHQNHDQEITTPRDLPGSTRFFVKPAGFSGSLVEDAFTSDEAASISTINDVSSSNSYEKEALPDNSIALLTRSTSPYEDFKRSMQEMVNNHESVVDWDFMEELLFCYLNLNEKKSHKFILSAFVDLITVMRRNSETPSNNPQSVRTVRSHRGTRNVTLEFGSSS

SEQ ID NO: 125413 - protein, 57 aa, Glycine max
  Coding DNA Sequence Number=SeqID_8635
MSSLEEQNALSHFFPHRYHNNNAEKRTFSIEKWTLVMVPETPNSTTHQCKWIWILPL

SEQ ID NO: 125414 - protein, 114 aa, Glycine max
  Coding DNA Sequence Number=SeqID_8636
  Homolog annotation: Hit_ID=Q53M14; Match level="QueryCoverage=85%, HitCoverage=66%, E-value=9e-12, Identity=37%"; Hit description =Expressed protein
  Pfam annotation: Domain name=DUF538; Domain location=2-100; Score =35.2; E_value=2.7e-08; Accession=PF04398.3; Description=Protein of unknown function, DUF538
MEYGFPLGLLPKGAIGYSLNKDNDEFTVYFQGVCSLDIEAYMLKLYNLKGVTVKILLLWLNIVKVYRQGNDFYFSVGITSTDFDIENFLESPQCGCSFDCKPLPLNSDVSVSSI

SEQ ID NO: 125415 - protein, 87 aa, Glycine max
  Coding DNA Sequence Number=SeqID_8637
  Subcellular localization annotation: CTP_CleavageSite=40; ConfidenceScore=5.52e-01
MTRDVGTQSTPPYISSTSLSPASTPSITERSKPLVSDSPNSNAKSKSEEELFPLSHMKALKTSPYSTNDSFTTCVLTTVHNRRKKSK

SEQ ID NO: 125416 - protein, 140 aa, Glycine max
  Coding DNA Sequence Number=SeqID_8638
  Homolog annotation: Hit_ID=Q69WS1; Match level="QueryCoverage=43%, HitCoverage=45%, E-value=2e-12, Identity=70%"; Hit description =Synaptobrevin-like protein
MATKTTSLMETMTTRARGNKSQGVCSKNDNVHFAVEGELDLDINEHLPSCNATIVESPKTKDDCGKLSNATRVLNRNHFGFSAYCVATIEFSRRQIPIAFLQRINEDFTKKYVGGKAATTAAQSLNREFGLLTVGQKLSF

SEQ ID NO: 125417 - protein, 397 aa, Glycine max
  Coding DNA Sequence Number=SeqID_8639
  Gene Ontology: Mol. function=DNA binding; Cellular component=nucleus; Biological process=regulation of transcription
  Homolog annotation: Hit_ID=Q9LV59; Match level="QueryCoverage=57%, HitCoverage=67%, E-value=2e-55, Identity=45%"; Hit description =Arabidopsis thaliana genomic DNA, chromosome 3, P1 clone: MOB24
MDGIEDDARYPHNPYGYGYQNSPYSPPVDTEYAHDDNDENEQEQLEGDDEVDVDQSNNLQLPQEDAVDEDGMYGGGDENDDNHDDDDDDDEEEEEEEEEEVEENKQIDYYAIKSEDELEWHPKKQKLKSLISTYELAPRVPAPSSVAATAPTVPKPSSGGRNSLTDWTEQETFVLLDAWGDRFLQHGRKSLRCEEWQQVAKMVSQVSKIERTDTQCRNRLDTLKKKYKKEKAKFPDSDGGACKWVYLKRMDELMSSPPQQAGLSCGLDSGEYVFMNTRVHLNHANGLDEMKDNPDNTESTGEEDSDGPQAKKRKKRRGSGEASSFRLLADSIQKFSKIYEKIENSKRQQMVELEKMRKDFHKELERQKRQILENLQCEISKLEQRNDENNDSAENGT

SEQ ID NO: 125418 - protein, 253 aa, Glycine max
  Coding DNA Sequence Number=SeqID_8640
  Gene Ontology: Mol. function=protein-tyrosine kinase activity; Cellular component=integral to membrane; Biological process=protein amino acid phosphorylation
  Homolog annotation: Hit_ID=Q2QM73; Match level="QueryCoverage=89%, HitCoverage=82%, E-value=6e-17, Identity=30%"; Hit description=Wall -associated kinase 3, putative, expressed
MHTQLALVLALALLVVHVRAITTRDIALHGYMDTCRNVSIPYPFGIGTSKETGENCFLEENLNLTCPNNNLYSRFNLQVLDITLKGHFMDSCFMSPYFAITPSNGVANDPFLRTASNFTISSKENKFISVGCETYGFLNIASTMACNIRLGIGCCEVDIPPNMKNISIEAYRFDLSSNYFQTCGHSFVPKRGSYNFDISHLEKPFNTIPMVVDWSVRDDLGCEAFRKRFRKSACMDNSYCHDIEISYGYQCRC

SEQ ID NO: 125419 - protein, 46 aa, Glycine max
  Coding DNA Sequence Number=SeqID_8641
MLSASVCKNNCAMSAENISRGNVRSASSDDASVLNLDRLTFLADVG

SEQ ID NO: 125420 - protein, 184 aa, Glycine max
  Coding DNA Sequence Number=SeqID_8642
  Gene Ontology: Mol. function=carboxypeptidase activity; Cellular component=membrane; Biological process=auxin mediated signaling pathway
  Homolog annotation: Hit_ID=Q9SUF1; Match level="QueryCoverage=95%, HitCoverage=46%, E-value=7e-55, Identity=57%"; Hit description =Nodulin-like protein
  Subcellular localization annotation: CTP_CleavageSite=56; ConfidenceScore=5.24e-01
MNNLVGQPVVDQGFTFLGMQYTSASFASAVMNAVPSVTFVLAVIFRLEHIKIRELRSQAKVIGTLVTFAGALLMTLYKGPQFDLFHHSNTTHQQGGSHTQNHSHWVAGTLFICLGCLAWSSFYILQSITVKRYPAELSLSSLICLAGALQSAVVALIADHNPRAWAIGFDYSLYGPLYTGCIYK

SEQ ID NO: 125421 - protein, 150 aa, Glycine max
  Coding DNA Sequence Number=SeqID_8643
  Gene Ontology: Mol. function=protein serine/threonine kinase activity; Cellular component=integral to membrane; Biological process=protein amino acid phosphorylation
  Homolog annotation: Hit_ID=Q39191; Match level="QueryCoverage=51%, HitCoverage=10%, E-value=1e-17, Identity=55%"; Hit description=Wall -associated receptor kinase 1 precursor
ELKKPTNNYDERLIIDNGEELKKPTNNYDERLIIDNGGFGTVFKGVLPNNKVVAIKKSKVVDKSQVEQFINEVVIVSQINHRSVNPSIEQCAQNDANDEDDATETEYATETKKEGEERPKRGSKRPRYLDDYVANTAFPNSSKAENAKIR

SEQ ID NO: 125422 - protein, 153 aa, Glycine max
  Coding DNA Sequence Number=SeqID_8644
  Gene Ontology: Mol. function=transition metal ion binding; Biological process=cytoskeleton organization and biogenesis
  Pfam annotation: Domain name=Transposase_21; Domain location=39-153; Score=8.7; E_value=2.4e-15; Accession=PF02992.5; Description =Transposase family tnp2
MGMKYQKIHAYPNDCILYKNEFNEMRKCLTCGVSRYIVKDDACSDNPTTNNNFPAKDPRNLRLGLASDGMNHFDNLSTSDSSWPALLMIYNLPPWLCMKQKCMMLCMMISGPRQPGNDIDVYLTRLIEDLRKLWVHRVDVYDGNVQQTFRLHA

SEQ ID NO: 125423 - protein, 121 aa, Glycine max
  Coding DNA Sequence Number=SeqID_8645
  Homolog annotation: Hit_ID=Q6V8P1; Match level="QueryCoverage=71%, HitCoverage=60%, E-value=4e-11, Identity=43%"; Hit description =Putative senescence-associated protein SAG102
  Pfam annotation: Domain name=DUF581; Domain location=57-93; Score= -4.6; E_value=0.044; Accession=PF04570.5; Description=Protein of unknown function (DUF581)
SLSAREIELSEDYTCIISHGLNPKRTHIFGDCILECHNNDFTEFNKKEEPAFSSSQVPAFSDGSAPYPSGNILSFCYSCNKKLVKEEGIYRYRFVPNISLSYCYFSQVKSASGNILYILQR

SEQ ID NO: 125424 - protein, 439 aa, Glycine max
  Coding DNA Sequence Number=SeqID_8646
  Gene Ontology: Mol. function=sulfate porter activity; Cellular component=integral to membrane; Biological process=sulfate transport
  Homolog annotation: Hit_ID=Q6ZXB7; Match level="QueryCoverage=99%, HitCoverage=75%, E-value=1e-160, Identity=62%"; Hit description =Plasma membrane sulphate transporter
  Pfam annotation: Domain name=STAS; Domain location=309-427; Score =123.5; E_value=6.1e-34; Accession=PF01740.11; Description=STAS domain
  Pfam annotation: Domain name=Sulfate_transp; Domain location=36-286; Score=334.6; E_value=1.6e-97; Accession=PF00916.10; Description =Sulfate transporter family
  Pfam module annotation: Pfam domain module=STAS::Sulfate_transp; Domain location=309-427::36-286
MGSMLSEKISYTQEPILYLGLAFTATFFAGVFQASLGILRLGFVIDFLSKATLVGFTGGAAVIVSLQQLKGLLGIVHFTSKMQIIPVMISVFKQRHEIGHLPKGVNPPSANMLYFNGPYLALAIKTGIITGILSLTEGIAVGRTFASLKNYQVDGNKEMMAIGLMNIAGSCSSCYVTTGSFSRSAVNYNAGAQTTVSNIIMAAAVLVTLLFLMPLFYYTPNVVLAAIIITAVIGLIDYQSAYKLWKVDKLDFLACLCSFFGVLFISVPLGLGIAVIISVFKILLHVTRPNTLVLGNIPGTQIFHNINQYIEALRVPSFLILAVESPIYFANSTYLQERILRWVREEEEHIKANNGAPLKCIILDMTAVTAIDTSGLDTLCELRKMLEKRSLELVLANPVGNVMEKLHKSNILDSFGLKGVYLTVGEAVADISSIWKAQP

SEQ ID NO: 125425 - protein, 110 aa, Glycine max
  Coding DNA Sequence Number=SeqID_8647
MHTQGKASRDATTTRGVARPGHAGGALSFHDLDVTSFWKTSKQQPSTRTGNAPDQLKAKRTIVFLAKIKNLWELWDSTRPDRVTGGSCHRNLPSLAGKASRRGGSRRRMI

SEQ ID NO: 125426 - protein, 1143 aa, Glycine max
  Coding DNA Sequence Number=SeqID_8648
  Gene Ontology: Mol. function=nucleoside-triphosphatase activity; Cellular component=integral to membrane; Biological process=defense response to fungus, incompatible interaction
  Homolog annotation: Hit_ID=Q1T3I2; Match level="QueryCoverage=98%, HitCoverage=91%, E-value=0.0, Identity=57%"; Hit description=AAA ATPase
  Pfam annotation: Domain name=ABC2_membrane; Domain location=396-609; Score=231.0; E_value=2.7e-66; Accession=PF01061.14; Description=ABC -2 type transporter
  Pfam annotation: Domain name=ABC_tran; Domain location=71-294; Score =43.3; E_value=2.5e-11; Accession=PF00005.17; Description=ABC transporter
  Pfam annotation: Domain name=ABC_tran; Domain location=802-992; Score= 114.7; E_value=2.7e-31; Accession=PF00005.17; Description=ABC transporter
  Pfam annotation: Domain name=PDR_assoc; Domain location=614-678; Score=120.5; E_value=4.8e-33; Accession=PF08370.2; Description=Plant PDR ABC transporter associated
  Pfam module annotation: Pfam domain module=ABC2_membrane::ABC _tran::ABC_tran::PDR_assoc; Domain location=396-609::71-294::802 -992::614-678
MGVGIRLPTVEVRYQNLIVEADCYIGSRALPTLPNVALNIAESALGLCGISTAKRTKLTILKNVTGIIKPSRMALLLGPPSSGKTTLLLALAGKLDNDLRVNGEISYNGYKLNEFVPRKTSAYISQNDVHIGEMTVKETLDFSARCQGVGTRYDLLSELARREKEAGIFPEAELDLFMKATAMEGTESSLITDYTLKILGLDICKDTIVGDEMQRGVSGGQKKRVTTGEMIVGPTKTLFMDEISTGLDSSTTYQIVKCFQQIVHLTEATIFMSLLQPAPETFDLFDDIILISEGQIVYQGPRDHIVEFFESCGFRCPERKGTADFLQEVTSRKDQEQYWANRSLPYRYITVSEFANRFKQFHVGMQLENELSVPYDKSRGHRAALVFKKYTVPTMGLLKACWDKEWLLIKRNAFVYVFKTGQIVIIGIIAATVFFRTNMHQRNEADAAVYIGSILFTMIMNMFNGFAELPLTIARLPIFYKHRDHLFHPPWTYTLPNFILRIPITMFEAIVWVLITYYTIGLAPEASRFFKHLLLVFLVQQMAAGMFRFISGVSRTMIIANTGGSLMLLLVFLLGGFILPKSSIPNWWIWGYWISPLTYGYNAFTVNELFAPRWSKPSSDGRTPIGIATLNNFDVFTEKRWYWIGVAALVGFIILYNVLFTFALMYLDPIGKKQAIISEEEASEMEGEGNFSEDPRLLKPEPNREIALQSLSSTDGNNTREVAMQQMGSRGNPSGIRSVDSMHESATGVAPKRGMVLPFQPLAMSFDSVNYYVDMPAEMKGQGVTDDRLQLLREVTGAFRPGVLTALMGVSGAGKTTLMDVLAGRKTGGYIEGDVRISGFPKNQETFARISGYCEQTDIHSPQVTVRESLIYSAFLRLPKEVNNEEKMKFVDEVMDLVELNNLKDAIVGLPGVTGLSTEQRKRLTIAVELVANPSIIFMDEPTSGLDARAAAIVMRTVRNTVDTGRTVVCTIHQPSIDIFEAFDELLLMKRGGQVIYSGPLGRNSHKIIEYFEAIPEVPKIKDKYNPATWMLEVSSMAAEVRLQMDFAEYYKSSSLYQRNKALIRELGTPPPGAKDLYFPTQYSQSTWEQFKSCLWKQWLTYWRSPDYNLVRFFFTLAAAFLVGTVFWRVGKNRFKLVATLVE

SEQ ID NO: 125427 - protein, 100 aa, Glycine max
  Coding DNA Sequence Number=SeqID_8649
MAEPSKKRKGTSSRSQRHSGSQEAPIPPSIPSGSLFSSEEQRIRCSNDVKLHLELVGLGSSSSMDSFASWKMNGSGMEKGREREEMPLQGEDESRRSSPP

SEQ ID NO: 125428 - protein, 81 aa, Glycine max
  Coding DNA Sequence Number=SeqID_8650
MGVQIEIFKFSNLGLLEHFGSGVAYGGSNPARLGELGGNLVPPFPINRRREAVPNIPNGGGNWPGRPTGAYDLAYIKPGLN

SEQ ID NO: 125429 - protein, 138 aa, Glycine max
  Coding DNA Sequence Number=SeqID_8651
  Gene Ontology: Cellular component=chloroplast
  Homolog annotation: Hit_ID=P03938; Match level="QueryCoverage=43%, HitCoverage=45%, E-value=8e-11, Identity=84%"; Hit description =Hypothetical 14 kDa protein ycf68
MSPHGGDMDGGEKRKERDGVSLAFGIAGPGGRPARRAISSVVERAPDNCVVVPGLRIDGAVQVRSNVDPTFSSLVGSGRSGGDHHGSSLLENSYIPYQYMDSYLSSTGLGLASMEKNGAPNNVSSQTKNYEIAPFILG

SEQ ID NO: 125430 - protein, 92 aa, Glycine max
  Coding DNA Sequence Number=SeqID_8652
MQSLQNVVHQRPIMSIEEFIQQVAWSGVQPSPLGGGEASATQEPQWDQQEDIPKAAEPTPPKAFTLESDPVVVQVQEDVTAAKPSPSEPFIF

SEQ ID NO: 125431 - protein, 77 aa, Glycine max
  Coding DNA Sequence Number=SeqID_8653
MDEKRKKKLEEVAQSGSTNTVIDPSSPIRRRVKWKIARTKKTRQMTSEAAEKLLRRLIRWRSRPHRVPLSPMDVRMY

SEQ ID NO: 125432 - protein, 366 aa, Glycine max
  Coding DNA Sequence Number=SeqID_8654
  Gene Ontology: Mol. function=protein kinase activity; Cellular component=membrane; Biological process=protein amino acid phosphorylation
  Homolog annotation: Hit_ID=Q1W203; Match level="QueryCoverage=98%, HitCoverage=88%, E-value=1e-131, Identity=63%"; Hit description=NAK -type protein kinase
  Pfam annotation: Domain name=Pkinase; Domain location=72-354; Score =159.7; E_value=7.5e-45; Accession=PF00069.15; Description=Protein kinase domain
  Pfam annotation: Domain name=Pkinase_Tyr; Domain location=72-354; Score=143.4; E_value=6e-40; Accession=PF07714.7; Description=Protein tyrosine kinase
  Pfam module annotation: Pfam domain module=Pkinase::Pkinase_Tyr; Domain location=72-354::72-354
  Subcellular localization annotation: CTP_CleavageSite=33; ConfidenceScore=5.23e-01
MNCFFLKNKSKSDAELPKRRKKKNQVGNNGASKSSTSSPLPSPRSIKELYKENEHNFRIFTLQELVDATHGFNRMLKIGEGGFGKVYRGTIKPHPEDGADPIVVAIKKLNTRGLQGHKEWLAEVQFLSVVNHPNLVKLLGYCSVDSEKGIQRLLVYEFMSNRSLEDHLFSLSLPHLPWKTRLQIMLGAAQGLHYLHNGLEVKVIYRDFKSSNVLLDKKFHPKLSDFGLAREGPTGDQTHVSTAVVGTQGYAAPEYVETGHLKIQSDIWSFGVVLYEILTGRRALNRNRPIGEKKLIEWVKNYPANSSRFSTIIDPRLKNQYSLGAARKVAKLADSCLKKNPEDRPSMSQIVESLKQALQDSETKNA

SEQ ID NO: 125433 - protein, 554 aa, Glycine max
  Coding DNA Sequence Number=SeqID_8655
  Gene Ontology: Mol. function=hydrolase activity, acting on glycosyl bonds; Biological process=polysaccharide catabolic process
  Homolog annotation: Hit_ID=Q5F305; Match level="QueryCoverage=96%, HitCoverage=97%, E-value=0.0, Identity=77%"; Hit description=Beta -amylase
  Pfam annotation: Domain name=Glyco_hydro_14; Domain location=97-510; Score=852.2; E_value=2.6e-253; Accession=PF01373.8; Description =Glycosyl hydrolase family 14
MALTLRSSISLASQKETKLQKPDDEVPTKVFNFAKANPSFRLRAKSSMQQTHVTGDNNKNKNNNFNSEVTMINEKREKVHAPSVAHSHNDSMRVPVFVMLPLDTVTMGGTLNKPRAMNASLMALKSAGVEGVMVDAWWGLVEKEGPLKYNWEAYAELVQMVQRHGLKLQVVMSFHQCGGNVGDCCSIPLPPWVLEEIRKNPEMVYTDRSGRRNPEYISLGCDSMPVLRGRTPLQVYSDYMRSFRHRFRDYLGSVIIEIQVGMGPCGELRYPSYPESNGTWRFPGIGEFQCYDKYMRASLEASTEAIGKKEWGKSGPHDSGQYNQFPEDTGFFKREGTWNTEYGQFFLDWYSTKLVEHGEKILVSAKGIFNSCGVKLSAKVAGIHWHYKTRSHAAELTAGYYNTRFRDGYLPIAQMVAKHGVVLNFTCMEMRDREQHEHCSPEGLVHQVKMAARTAGAELAGENALERYDAGAFSQVLSTSNSGSGLAAFTYLRMNRRLFEGDNWRHFVEFVKCMSEGGKRQRLPQSDSCGTHLYVGHITGIQKQQEQAQEVALV

SEQ ID NO: 125434 - protein, 291 aa, Glycine max
  Coding DNA Sequence Number=SeqID_8656
  Gene Ontology: Mol. function=protein transporter activity; Cellular component=endoplasmic reticulum; Biological process=ER to Golgi vesicle-mediated transport
  Homolog annotation: Hit_ID=Q9C827; Match level="QueryCoverage=99%, HitCoverage=29%, E-value=1e-101, Identity=49%"; Hit description =Coatomer complex subunit, putative; 33791-27676
  Pfam annotation: Domain name=WD40; Domain location=138-177; Score =48.4; E_value=2.4e-11; Accession=PF00400.22; Description=WD domain, G-beta repeat
  Pfam annotation: Domain name=WD40; Domain location=181-221; Score =34.0; E_value=5.1e-07; Accession=PF00400.22; Description=WD domain, G-beta repeat
  Pfam annotation: Domain name=WD40; Domain location=225-263; Score =51.3; E_value=3.1e-12; Accession=PF00400.22; Description=WD domain, G-beta repeat
  Pfam annotation: Domain name=WD40; Domain location=53-91; Score=18.1; E_value=0.032; Accession=PF00400.22; Description=WD domain, G-beta repeat
  Pfam annotation: Domain name=WD40; Domain location=95-133; Score =35.6; E_value=1.7e-07; Accession=PF00400.22; Description=WD domain, G-beta repeat
  Pfam module annotation: Pfam domain module=WD40::WD40::WD40::WD40::WD4 0; Domain location=138-177::181-221::225-263::53-91::95-133
MDSTGFVFRNYFYLELSDKGKELYLHLNTMKETGIIDINEKEKENLKLTSVFETEEKSLKISESPVRSAKFIARENWIVAATDDKNIHVYNYDKMEKIVEFAEHKDYIRSLAVHPVLPYVISASDDQVLKLWNWRKGWSCYENFEGHSHYVMQVAFNPKDPSTFASASLDGTLKIWSLESSAPNFTLEGHQKGVNCVDYFITNDKQYLLSGSDDYTAKVWDYHSRNCVQTLEGHENNVTAICAHPELPIIITASEDSTVKIWDAVTYRLQTTLNFGLKRVWSIGYKKGSSQ

SEQ ID NO: 125435 - protein, 462 aa, Glycine max
  Coding DNA Sequence Number=SeqID_8657
  Gene Ontology: Mol. function=metal ion binding; Biological process =metal ion transport
  Homolog annotation: Hit_ID=Q5JL93; Match level="QueryCoverage=28%, HitCoverage=34%, E-value=1e-07, Identity=32%"; Hit description =Glycine-rich protein-like
MATATEGVEYESDPEEAARSLAMRRRREASDDEETDADADRRDATSDRRITHSVDSDGEGGVADYDDEEDLEEEEEAVEEEEEEEVEEEDLEEEERSEHEYEGGANGTVVKDSDDADVKALLEESGNGDEEEKKENEPFAVPTAGAFYMHDDRFRDNAGARHRRMRGGRRLWESKDDRKWGHDKFEEITLQERHYKEGRRPSKGNFRGRGGKTRGVDRSGGYVRGNRKGYDNRGNQTQAPKSIVRGRGPRRYEPTSKNNDSASLVQNKQSGKQPEKTSHASSGKTFAPVSNSEPDPVPAKKQVFASSLNYASPPFYPSSSSNKDLSVAPKGDVQTCGTGRNVCSGVVNDGFLVQQNSALLRGKNVVDHVSMEKLYIDGPGAPSAGKAFNNMHIPPPGSSGVNASQSAHPRGHGRGGAVPVQMNYQPVTSHNQVSKIDPTQLQAIQRTAPGQTSPSLQTPAPQ

SEQ ID NO: 125436 - protein, 116 aa, Glycine max
  Coding DNA Sequence Number=SeqID_8658
  Subcellular localization annotation: CTP_CleavageSite=40; ConfidenceScore=5.18e-01
MRGYCMVTRTFRQPGANEPVDTQRLTSSSAPFVVLTREVRDSESGSRRRYLMVIRTFRHPRGTNSTVLLSSSGNIQARRRARFFSTEQGRSSAMAEGSVMVVQLCRFQDTEVFLCF

SEQ ID NO: 125437 - protein, 68 aa, Glycine max
  Coding DNA Sequence Number=SeqID_8659
MDSSCCITNNSAEEEGCVGETEERAQEIFQGQLHLVQRGDRSAGIVRSTCFVTSIIGRCLCLVCSHVG

SEQ ID NO: 125438 - protein, 304 aa, Glycine max
  Coding DNA Sequence Number=SeqID_8660
  Gene Ontology: Mol. function=protein serine/threonine kinase activity; Cellular component=cytoplasm; Biological process=protein amino acid phosphorylation
  Homolog annotation: Hit_ID=Q39868; Match level="QueryCoverage=99%, HitCoverage=100%, E-value=1e-158, Identity=84%"; Hit description =Protein kinase
  Pfam annotation: Domain name=Pkinase; Domain location=5-226; Score =236.9; E_value=4.2e-68; Accession=PF00069.15; Description=Protein kinase domain
  Pfam annotation: Domain name=Pkinase_Tyr; Domain location=5-224; Score=-18.1; E_value=2.3e-11; Accession=PF07714.7; Description =Protein tyrosine kinase
  Pfam module annotation: Pfam domain module=Pkinase::Pkinase_Tyr; Domain location=5-226::5-224
MDERYETLKELGSGNFGVARLAKDKETGELVAIKYIERGKKIDANVQREIVNHRSLRHPNIIRFKEVFLTPTHLAIVLEYAAGGELFERICNAGRLSEDEARFFFQQLISGVSYCHSMQICHRDLKLENTLLDGNPAPRLKICDFGFSKSALLHSQPKSTVGTPAYIAPEVLSRKEYDGKRIMSVQYAIPDYVRVSKECRHLISRIFVANPAKRINISEIKQHLWFRKNLPREIIEAERRGYEETQKDQPSQSVEEIMQIIQEARTKIHTGEQAGTGTSDVVRGDEANEEVDINDHFAKYLTLD

SEQ ID NO: 125439 - protein, 792 aa, Glycine max
  Coding DNA Sequence Number=SeqID_8661
  Gene Ontology: Cellular component=chloroplast
  Homolog annotation: Hit_ID=Q8RY73; Match level="QueryCoverage=54%, HitCoverage=71%, E-value=1e-145, Identity=61%"; Hit description =Protein Dom3z homolog, chloroplast precursor
  Pfam annotation: Domain name=CK_II_beta; Domain location=638-787; Score=343.3; E_value=4e-100; Accession=PF01214.9; Description=Casein kinase II regulatory subunit
  Pfam annotation: Domain name=RAI1; Domain location=413-477; Score =88.1; E_value=2.7e-23; Accession=PF08652.1; Description=RAI1 like
  Pfam module annotation: Pfam domain module=CK_II_beta::RAI1; Domain location=638-787::413-477
  Subcellular localization annotation: CTP_CleavageSite=76; ConfidenceScore=5.60e-01
MDFTEKDLFGEDSDNDNGSHSSGSSSSSSAASSSSSSSASSSASSSKASDAAADSSSASGSASSGAENDDENGDVVDSTKVRAHHHHDYEDKDLFGSDNEDYCKTLARSPYPIPGKNDRVSTWVALACVEETVELWRVNKMECNSMTRVLPAIRNVHNQGRGGFGRGRWQNDRGAGLLPRPGPYPQRQNFGYGNRFQDGRHDERFVSELKLSKSEETLSRKCIAFQEPCEVACYSRAEGREVYFDDRSLRHITEDVGADLNEGYDTYIPKKDLGSQGFGDLLACIRDKNIPLQNIHFVTFRNNLNKVIIHFGLFDFGILEISKSSGYNLILATAYIRHEPWEMGVHKRNGVVYLDVHKLPEKPQSDLDRRSLATEDPNRADGEGIHHVDANVEFCAVIKTKLGAHRILMGAEMDCCDSTNEGKRFYVELKTSCELNYHTEERFEREKLLKFWIQSFLAGVPYIVIGFRDDAGRLVRTERLRTKDITQRVKMKNYWQGGVCLAFADEVLCWLYGTVKEVENPKESNRIISTRSKTPAIVMYRERGGVGSKSEVTSVDRKRINDVLDKQLERSSPSTSRAAGAINGKDRSSSSLLAAAKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSKGMAAMLDKYKNYDFGRCPRVYCSGQPCIPVGQSDIPRSSTVKIYCPRCEDIYYPRSKYQGSILICYIIELV

SEQ ID NO: 125440 - protein, 125 aa, Glycine max
  Coding DNA Sequence Number=SeqID_8662
  Gene Ontology: Mol. function=structural constituent of ribosome; Cellular component=ribonucleoprotein complex; Biological process =translation
  Homolog annotation: Hit_ID=Q5QM99; Match level="QueryCoverage=71%, HitCoverage=97%, E-value=3e-45, Identity=96%"; Hit description=60S ribosomal protein L37a
  Pfam annotation: Domain name=Ribosomal_L37ae; Domain location=35-124; Score=209.9; E_value=5.9e-60; Accession=PF01780.9; Description =Ribosomal L37ae protein family
  Subcellular localization annotation: CTP_CleavageSite=40; ConfidenceScore=5.52e-01
MMSATTFSSFHFTNKRTFYFSLFLFTSATLHSVQTKRTKKAGIVGKYGTRYGASLRKQIKKMEVSQHSKFFCEFCGKYAVKRKAVGIWGCKDCGKVKAGGAYTLNTASAVTVRSTIRRLREQTEG

SEQ ID NO: 125441 - protein, 801 aa, Glycine max
  Coding DNA Sequence Number=SeqID_8663
  Gene Ontology: Mol. function=transferase activity; Biological process= biosynthetic process
  Homolog annotation: Hit_ID=Q9LSB5; Match level="QueryCoverage=84%, HitCoverage=98%, E-value=0.0, Identity=57%"; Hit description =Glycosyl transferases-like protein
  Pfam annotation: Domain name=Glycos_transf_1; Domain location=500 -675; Score=28.4; E_value=2.1e-05; Accession=PF00534.10; Description =Glycosyl transferases group 1
  Subcellular localization annotation: CTP_CleavageSite=52; ConfidenceScore=5.51e-01
MEESINRGEYQPNLAKQSSLRLGGSFKSTLSGRSTPRNSPSFRRLNSGRTPRKEGRSSVGGALWFRSNRLLLWLLLITLWAYLGFFVQSRWAHSDKKEEFSGYGTGPRNTNSDAEQIQRRDLLASNKSLSANNDTDADIAGISKTINVALAKNDNDVPSHRKTSSKNRSKGRRSSKGKSRGKLKPTTEIKNTDIEEQEPEIPTTNSTYGLLVGPFGPMEDRILEWSPEKRSGTCNRKEDFARLVWSRRFILIFHELSMTGAPLSMMELATELLSCGATVSAVVLSRKGGLMSELARRRIKVLEDKADLSFKTAMKADLVIAGSAVCASWIEQYIEHFPAGASQVAWWIMENRREYFDRSKDVLHRVKMLVFLSESQSKQWQKWCEEESIKLRSHPEIVPLSVNDELAFVAGIPSTLNTPSFSTEKMVEKKQLLRESVRKEMGLTDNDMLVISLSSINPGKGQLLLLESVSSVLEQGQSPGDKKMKEVSNIKEGLSSLARKHRIRKLLPLMSNGKVASNSISSNSLSRKQVLPNDKGTIQQSLKLLIGSVRSKSNKADYVKSLLSFLEQHPYTSTSIFWTPATTRVASLYSAADVYVINSQGLGETFGRVTIEAMAFGLPVLGTDAGGTQEIVEHNVTGLLHPVGHPGNLVLAQNLWFLLKNQSARKQMGVVGRKKVQKMYLKQQMYKNFVEVIASISRHLAYSQVTSVIAEVKPAILMVLVQVPYAGVSILFKLVANDGMSLRVLMAYRYLFTSVFMIPLAYFVDRLNIGTSAGKAKVVGTVMGIGGAMMLTFYKNIEIHI

SEQ ID NO: 125442 - protein, 205 aa, Glycine max
  Coding DNA Sequence Number=SeqID_8664
  Gene Ontology: Mol. function=chitin binding; Cellular component =extracellular region; Biological process=chitin metabolic process
  Homolog annotation: Hit_ID=UPI00006A17C9; Match level="QueryCoverage =69%, HitCoverage=100%, E-value=2e-15, Identity=35%"; Hit description= UPI00006A17C9 related cluster
  Subcellular localization annotation: CTP_CleavageSite=58; ConfidenceScore=5.77e-01
MSSTSVDYTSSPFGGTTCPCLLRATRLHLLRTTRPPLQRSTRPRLQRTTRPHLQRTTRSQLQWANMPSPSEDYTSSPLEGYTGLHFLAIRGLHVLAFKGLHVLTFRGLHVLTFKGLHALEFFGLHVLPFRGLHILIFIRLHALTFRGLHVLAFRGLPVCRNLPFGGRATRGSRVHLPRKENAQSHRHRLFKANVGKTGKGVVYKL

SEQ ID NO: 125443 - protein, 1023 aa, Glycine max
  Coding DNA Sequence Number=SeqID_8665
  Gene Ontology: Mol. function=histone-lysine N-methyltransferase activity; Cellular component=nucleus; Biological process=chromatin modification
  Homolog annotation: Hit_ID=Q8VZ17; Match level="QueryCoverage=56%, HitCoverage=73%, E-value=1e-176, Identity=57%"; Hit description =Histone-lysine N-methyltransferase, H3 lysine-9 specific SUVH6 (EC 2.1.1.43) (Histone ...
  Homolog annotation: Hit description=H3-K9 methyltransferase 6) (H3-K9- HMTase 6) (Suppressor of variegation 3-9 homolog protein 6) (Su(var)3- 9 homolog protein 6)
  Pfam annotation: Domain name=Pre-SET; Domain location=746-842; Score =131.4; E_value=2.4e-36; Accession=PF05033.6; Description=Pre-SET motif
  Pfam annotation: Domain name=SET; Domain location=844-1000; Score =176.8; E_value=5.2e-50; Accession=PF00856.18; Description=SET domain
  Pfam annotation: Domain name=YDG_SRA; Domain location=570-722; Score =259.8; E_value=5.4e-75; Accession=PF02182.8; Description=YDGSRA domain
  Pfam module annotation: Pfam domain module=Pre-SET::SET::YDG_SRA; Domain location=746-842::844-1000::570-722
GDTVKTSNCENDGQHSEVKDSLLTETLGQTTDSGLNKENPIVSSPQVNGSTAEHEPAKVTIGETIDSGLNKGNPAVSCHKMDELTAEDEAAKVTIGQTTDCVFNKENPVVSSHKVDGPTAEDKPVKVPLVDMEILNTEFARTANTVKCDSYMLKSSSQVGEVVMSGGSKPLLSNVNISAGSSACMVEPVTRRYLPRRKVSALRDFPTLCGRNALHLSKDKDVCLEGISSLNNKKLCLQNLAVDENNPLKEVRALAVDDSPLKEVGTVAVDDSPLKEVGTVAVDDSPLKEVGAADVKEIKSNIQDEYGCKRKLVDILKTDSESNAAKRVKKPLEIKRDKHVTLREESNHRVKINSKAVVKEQNREETRPLVLSHSKHKLKGNFNGSRVSSDRKVVLGLMAESECPWRSGKGSSKFKFSDAKNEGKKKKVASALPDRSKTAIKSKGALSYSGQKPLKKKKGNATSEGMSELVIWEKKDSLDPNENNEDLQIVLKSHEFNVNVTPSHSNFTGDEGDSNVTRKKVIKILRLFQVVFRKLLQEVESKLSERANGKRVDLIALKILKENGHYVNSGKQILGAVPGVEVGDEFQYRVELNIVGLHRQIQGGIDYVKHNGKILATSIVASGAYADDLDNPDVLIYTGQGGNVMNPDKEPEDQKLERGNLALKNSSEEKNSVRVIRGSESMDGKCRIYVYDGLYVVESYQPDVGPHGKLVFKFFLRRIPGQPELALREVKKSKKFKTREGVCVDDISYGKERIPICAVNTIDDEKPPPFNYITSIIYPNCHVLPAEGCDCTNGCSDLEKCSCVVKNGGEIPFNHNGAIVQAKPLVYECGPTCKCPSTCHNRVSQLGIKFQLEIFKTDTRGWGVRSLNSIPSGSFICEYIGELLEDKEAEQRTGNDEYLFDIGNNYSNSALWDDLSTLMPDVHTTSCEVVKDGGFTIDAAQFGNVGRFINHSCSPNLIAQNVLYDNHDTRMPHIMFFAADNIPPLQELTYDYNYEIDQIRDSGGNIKKKYCHCGSVECTGRMY

SEQ ID NO: 125444 - protein, 105 aa, Glycine max
  Coding DNA Sequence Number=SeqID_8666
  Gene Ontology: Mol. function=glutamate dehydrogenase [NAD(P)+] activity; Cellular component=mitochondrion; Biological process=amino acid metabolic process
  Homolog annotation: Hit_ID=Q5BU42; Match level="QueryCoverage=89%, HitCoverage=77%, E-value=5e-34, Identity=57%"; Hit description =Glutamate dehydrogenase 2
MAWILDEYSKFHGHSPAVVTGKPFVLGGSLGREAPTGLGVIFATEALFAEYEMVPALLKHKEGNGDLKEFSGADELLVHECHVLIPCDLGGVLNKYFLRSVDFLF

SEQ ID NO: 125445 - protein, 176 aa, Glycine max
  Coding DNA Sequence Number=SeqID_8667
  Gene Ontology: Cellular component=extracellular region; Biological process=sexual reproduction
  Homolog annotation: Hit_ID=O23547; Match level="QueryCoverage=96%, HitCoverage=67%, E-value=3e-58, Identity=60%"; Hit description =Expansin-like B1 precursor
  Pfam annotation: Domain name=Pollen_allerg_1; Domain location=77-160; Score=21.0; E_value=4e-05; Accession=PF01357.11; Description=Pollen allergen
MMMMNQVRCKIPQFCDENGAYVVVTDYGEGDRTDFIMSPRAYSRLGSNADASAELFKYGVVDVEYRRVPCRYGGYNLLVKVHEQSRNPHYLAIVILYLGGTYDVTAVELWQEDCQEWRRMRRAFGTVFDAENPPRGDIKLRFQLGGDAQQYWVQSKNVISGNWEAGVVYDSEIQLG

SEQ ID NO: 125446 - protein, 274 aa, Glycine max
  Coding DNA Sequence Number=SeqID_8668
  Gene Ontology: Mol. function=amino acid transporter activity; Cellular component=membrane; Biological process=amino acid transport
  Homolog annotation: Hit_ID=Q9LZ20; Match level="QueryCoverage=85%, HitCoverage=53%, E-value=2e-28, Identity=30%"; Hit description=Amino acid transport-like protein
MIRSSTYTNTIICTPDLLRGVVNGAATVYFSYIGYDSASTLAEEIKDPFKSLPIGIMGSILITTILYCLMALSLGMMAPYNKFNYSSGVCTASIALFTELGIIIELVNIRTLLVFYLVANALIYRRYVITSHTPPIHTLLFQFLFSLGALGFSLSWKFNQQQWGLPLFGGLMITITAFYHHKVPHHTHADDADWCVPFMPWPPALSIFLNVFLITTLKLLSFQRFAMWACFITLFYVLYGVHSTYQAEEETEIGSNQLNSSSSNLQTKVEVQVL

SEQ ID NO: 125447 - protein, 68 aa, Glycine max
  Coding DNA Sequence Number=SeqID_8669
MRMRSPLKARACSPLQARMCCPLMARTYGPLKIDCPFEKGDNSCNPILSFANLSGNSLRVYVLFDLVT

SEQ ID NO: 125448 - protein, 569 aa, Glycine max
  Coding DNA Sequence Number=SeqID_8670
  Gene Ontology: Mol. function=sequence-specific DNA binding; Cellular component=nucleus; Biological process=regulation of transcription, DNA-dependent
  Homolog annotation: Hit_ID=Q8W4H1; Match level="QueryCoverage=95%, HitCoverage=99%, E-value=1e-108, Identity=45%"; Hit description=GATA transcription factor 28
  Pfam annotation: Domain name=GATA; Domain location=7-42; Score=62.0; E_value=1.9e-15; Accession=PF00320.17; Description=GATA zinc finger
MGKQGPCYHCGVTSTPLWRNGPPEKPVLCNACGSRWRTKGTLANYTPLHARAETDDYDDQRVSRIKSISINKKKEVALLKRKQNHDNVMSGGFAPDYNQGYQKVVDEDISNRSSSGSAISNSESCAQFGYGGMDASDLTDSLANLGPAQSVVWDAMVPSKKRTCVGRSKPSSVEKLTKDLCTILHEQQSYFSASSEEDLLFESDTPMVSVEIGHGSVLIRHPSYIAREEESEASSLSVDNKQCPMSEAYSCSGGILMHNDSSRLKSSSLEVEKIGNSTGQGVLQEQLKRHVFVHSLWHNLYDKSQHERVQILGNHESPLCSIDLNDVVNYEEFLRILTNEEQQQLLKLLPVVDTAKLPDSLKVMFNSSQFKENLTYFQQLLSEGVFDISLLGAKPEDCKTLKILALSNLSKSKWVEHHNFLKKYKNKAVKSNTMGSTGTASINVLNNRASTNVANIKRMCDSRNQNFPELKTIMRSPKRMITKASFECKEAVEDGACYSPKHLFALPPDASSLLLDSFNFVEESGDQDLLLEVPSNTSFPQAELLHPTLSLGAQASTGSSSVYSNLVHH

SEQ ID NO: 125449 - protein, 262 aa, Glycine max
  Coding DNA Sequence Number=SeqID_8671
  Subcellular localization annotation: CTP_CleavageSite=63; ConfidenceScore=5.10e-01
MSATRGATDAFSGVSRHVNTSVKNAVTNLLLPVHFDFALRKLGANNVEVGVGCGVGLAVKPVVLNQIQSCFVHLVGAFPQSLQSAVSTVNTNQSSAGSMMQLATKSTDQVSQGQPEPQPVQIGSDFENNPLRGTAVGSAFGSRTEKVISNFLQNPLLKGEGGGLDEAILRYIEGCTFAVRKDDASDGNFYVLKHQQIIEKLVEENERLRRILMEDLKIPSRKLEASSSGRTITRELARNTDYKLIVEDYQFPSTQCSPSHLQ

SEQ ID NO: 125450 - protein, 253 aa, Glycine max
  Coding DNA Sequence Number=SeqID_8672
  Subcellular localization annotation: CTP_CleavageSite=78; ConfidenceScore=5.07e-01
MTKMIGLIPGLPFGWGALPMPEPSKSAQSKVPTNQISAESKMQLATKSADQISQGMQQATKSVDQISQGSMTQLATKSASQISQGLVGPQPTTKIDLAFDYKALKEAAVDSASDTQTENFPQNPSLKGDGGRLDEVAGLVQPENKLLQTVMKQRQIIDELVEENEKLCRILQGKDLKMPSSKLEASSSDSNIQTFPSSEVQDKITAGVSRPPGDADGTLSTSKAENQGISPTSKEENDGTLPISKGENVDKKE

SEQ ID NO: 125451 - protein, 176 aa, Glycine max
  Coding DNA Sequence Number=SeqID_8673
  Gene Ontology: Mol. function=structural molecule activity; Cellular component=protein storage vacuole; Biological process=lipid transport
  Homolog annotation: Hit_ID=Q9LVU1; Match level="QueryCoverage=83%, HitCoverage=67%, E-value=1e-56, Identity=71%"; Hit description=VAMP (Vesicle-associated membrane protein)-associated protein-like
  Pfam annotation: Domain name=Motile_Sperm; Domain location=6-113; Score=125.9; E_value=1.1e-34; Accession=PF00635.16; Description=MSP (Major sperm protein) domain
MTASQLISVSPDELRFHFELEKQTFCDLKVLNNSENYVAFKVKTTSPKKYFVRPNTAVVQPWDSCIIRVTLQAQREYPPDMQCKDKFLLQSTTVNPNTDVDDLPPDTFNKESGNSVEELKLRVAYISPTSPEGSSEDDASKNSQSFDTSSLESPRGLGPYAKKLHILETEKLKKPD

SEQ ID NO: 125452 - protein, 366 aa, Glycine max
  Coding DNA Sequence Number=SeqID_8674
  Gene Ontology: Mol. function=transferase activity
  Homolog annotation: Hit_ID=Q1SFG3; Match level="QueryCoverage=66%, HitCoverage=54%, E-value=2e-14, Identity=27%"; Hit description =Transferase
  Pfam annotation: Domain name=Transferase; Domain location=20-366; Score=-143.6; E_value=0.00053; Accession=PF02458.6; Description =Transferase family
MEVHENGGSPRQSQSLSELQIVTMMSVPPLKMTEPRAVRKVLVSEDNTRAIHGCYQVVMYYENLKEKEHGWCLAGLIVESLARVLLDHPLLAGRLQRREDTGFEIVANDSGIRLLEACYPTTLSHFLHLNEEQHHLVFWKEIDTQYPQFSPLFYVTNFECGGYSIGISCSLLLAEVFLVENFLGKWAEIHMNMSPQHEEIQTPIFHHPRLKNPESLPPDIISRTQRQNGVQSMVFTITTEDANFSMELWRELAMLCVKEAEQKLSTNLGSEFSLVVKESSEVAKVESCSMNGWSVEGMRVKHEMSASRWEEFGVYEVAFFEGNKPVQVSCWIDSVSDGYAMVVPLPYLKHKNACAVIVVSPPLSSL

SEQ ID NO: 125453 - protein, 482 aa, Glycine max
  Coding DNA Sequence Number=SeqID_8675
  Gene Ontology: Mol. function=oxidoreductase activity; Cellular component=chloroplast; Biological process=electron transport
  Homolog annotation: Hit_ID=Q9ZSN8; Match level="QueryCoverage=73%, HitCoverage=86%, E-value=1e-130, Identity=61%"; Hit description=CTF2A
  Pfam annotation: Domain name=DAO; Domain location=77-393; Score= -56.2; E_value=0.032; Accession=PF01266.14; Description=FAD dependent oxidoreductase
  Pfam annotation: Domain name=FAD_binding_3; Domain location=75-408; Score=-77.5; E_value=4.1e-06; Accession=PF01494.9; Description=FAD binding domain
  Pfam module annotation: Pfam domain module=DAO::FAD_binding_3; Domain location=77-393::75-408
DGHYAPLSFHDRNAYGVAAATNHNWTEHIMATTTTTSPFVFLKCHTSPPCHTETLFTRTSYKAIKPQSQTDDVREEQVVVVGAGIADLATALSLHRLGVLSLVLEQAESLRTGGTSLTLFKNGWMVLDAIGAANDLRTQFLEIQGLIWFTISAVQDGGEVRGWEGTTRLQFQTRGSKVRAVERRVLLETLASQLPRDSVQYSSQLQRIEASPNGDTLLELVDGSKLLARIVIECDGIRSPIAKWMGFPEPKYVGLASYPDAQYFGPRVNYIYGRRLRAGFVPVSPTKVYWFICFNSPSPGPTITDSLELKKQAKELVKNWPSELLNMVDSTPDDTVIKTPLVDRWLWPAISPASAGRVVVVGDAWHPMTPNLGQGACCALEDSVVLAKKLARAINLENPVVCSVRNNIVIPKLVSLGPLLEHTNFTCEAEDDGAEENEERDKMDSVLGVKDNDVDVLRQTLPFHDLCIVISSCVALLIGHTA

SEQ ID NO: 125454 - protein, 115 aa, Glycine max
  Coding DNA Sequence Number=SeqID_8676
MPAPRKMRCGTEKCEKSEASTQSYSYAVWPINKATQEDITMQRSWNGSVWRKTSTSLSLTPNTCYPHTIPSPTLPSETSLVSVQLKTLSILSLSSFSSAPSSSAPPPTTTLHKSR

SEQ ID NO: 125455 - protein, 883 aa, Glycine max
  Coding DNA Sequence Number=SeqID_8677
  Gene Ontology: Mol. function=nucleoside-triphosphatase activity; Cellular component=integral to membrane; Biological process =proteolysis
  Homolog annotation: Hit_ID=Q1SP62; Match level="QueryCoverage=99%, HitCoverage=100%, E-value=0.0, Identity=60%"; Hit description =Peptidase M41; Ribosomal protein S19/S15; DNA repair protein RadA; L- Aspartase-like
  Pfam annotation: Domain name=AAA; Domain location=452-639; Score =302.3; E_value=9.2e-88; Accession=PF00004.19; Description=ATPase family associated with various cellular activities (AAA)
  Pfam annotation: Domain name=AAA_2; Domain location=449-596; Score= -25.1; E_value=0.00073; Accession=PF07724.4; Description=ATPase family associated with various
  Pfam annotation: Domain name=AAA_5; Domain location=452-587; Score= -3.6; E_value=0.0034; Accession=PF07728.4; Description=ATPase family associated with various
  Pfam annotation: Domain name=Peptidase_M41; Domain location=646-842; Score=-50.4; E_value=1.5e-07; Accession=PF01434.8; Description =Peptidase family M41
  Pfam module annotation: Pfam domain module=AAA::AAA_2::AAA _5::Peptidase_M41; Domain location=452-639::449-596::452-587::646-842
  Subcellular localization annotation: CTP_CleavageSite=35; ConfidenceScore=5.13e-01
MASHCFLRFPPSSFSLNPKSKRLPKPRYHPSIFSRIQTPNPDEDDKVPNDNRIDFLKLSVTLTVISASLPKPAAAATTKVKKRSPKKQSAKKPEGLSPEELKTWTSGLPVVSDRLPYSEIIELKKSGKLKHVIKPNSAKLRQRGEAVLVVLDDSRVLRTVLPSLESHSKFWDSWDELKIDSVCVNAYTPPIKSPELPTSLLANIWVPPFVQKFIAYVFEERQTKPKKESKKAAEFREMRMQLQREKEEELRKSREERETMDRNMKAQKKEEGKRRKREIRKRKYKESLRQASDRNKKMAYFWSDLANNSNVANALGVLFFYIFYRTVVLSYRKQKKDYEDRLKIERAEAEERRKMRELEREMEGIEGDDEEGEQGKGEENAYLKMAKQFMKSGARVRRAQNKRLPQYLERGVDVKFSDVAGLGKIRLELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVCLDGFEGRGEVITIASTNRPDILDPALVRPGRFDRKIYIPKPGLIGRIEILKVHARKKPMAEDVDYMAVASMTDGMVGAELANIIEVAAINMMRDSRTEITTDDLLQAAQMEERGMLDRKERSSETWKQVAINEAAMAVVAVNFPDLKNIEFVTIAPRAGRELGYVRVKMDSVKFNQGMLTRQSLLDHITVQLAPRAADELWFGSGQLSTIWAETADNARSAARTFVLGGLSEKYHGMSNFWVSDRINEIDSEAMQIVNSCYERAKEILEQNRTLMDALVNELVEKKSLTKQEFFHLVELHGSLKPMPPSILDIRVAKCREFQKLIGSGKETSLSSHA

SEQ ID NO: 125456 - protein, 265 aa, Glycine max
  Coding DNA Sequence Number=SeqID_8678
  Homolog annotation: Hit_ID=Q337Z8; Match level="QueryCoverage=34%, HitCoverage=91%, E-value=2e-11, Identity=38%"; Hit description =Expressed protein
  Pfam annotation: Domain name=DUF1677; Domain location=134-251; Score =175.0; E_value=1.9e-49; Accession=PF07911.4; Description=Protein of unknown function (DUF1677)
  Subcellular localization annotation: CTP_CleavageSite=59; ConfidenceScore=5.49e-01
MAHVNLAEFHYQYILAATTTKCGSSLGSKISFSKKSGKSSRTLKLTFAFLRSTHGCNVRFSETRRATTNRTVPSNLLNNCGTRISASILLKPHLEESIDRVQISFLDHSANYTNISFELTKEGIDLTLPPITEVVDAKCECCGMSEECTPEYIERVRDKFLGKWVCGLCAEAVKEELEKNGGKKEEALSSHMSACVRFNKYGRAFPVLFQAEAMKEMLKKNKMEGRRAKSFNPRDKGGQKKGGIARSSSCIPAITREMNGLTLAN

SEQ ID NO: 125457 - protein, 195 aa, Glycine max
  Coding DNA Sequence Number=SeqID_8679
  Gene Ontology: Mol. function=electron carrier activity; Cellular component=anchored to membrane; Biological process=electron transport
  Homolog annotation: Hit_ID=Q1SP63; Match level="QueryCoverage=98%, HitCoverage=99%, E-value=7e-48, Identity=52%"; Hit description=Blue (Type 1) copper domain
  Pfam annotation: Domain name=Cu_bind_like; Domain location=38-124; Score=111.5; E_value=2.4e-30; Accession=PF02298.8; Description =Plastocyanin-like domain
MASRLFVLCTCVIIFMAATNTCVVEASVQFKVGGGFGWHEPAGNNNTDQFYIQWAERNRFQVGDALVFEYQNDSVLSVEKLDYMNCDASNPITAFDNGNSTFNLDRPGNFYFISGTDDHCKNGQKILVDVMHPHSILKSPPPISLSPSLPPEGFPPMAPPPSDDQTLEASSASVLLTTIFMSLFVTFVSVMLLAF

SEQ ID NO: 125458 - protein, 647 aa, Glycine max
  Coding DNA Sequence Number=SeqID_8680
  Gene Ontology: Mol. function=calcium channel activity; Cellular component=integral to membrane; Biological process=detection of mechanical stimulus during sensory perception of sound
  Homolog annotation: Hit_ID=Q1SP65; Match level="QueryCoverage=99%, HitCoverage=100%, E-value=0.0, Identity=66%"; Hit description=Ankyrin
  Pfam annotation: Domain name=Ank; Domain location=103-134; Score=3.8; E_value=9; Accession=PF00023.20; Description=Ankyrin repeat
  Pfam annotation: Domain name=Ank; Domain location=137-169; Score =21.2; E_value=0.0037; Accession=PF00023.20; Description=Ankyrin repeat
  Pfam annotation: Domain name=Ank; Domain location=171-203; Score =23.7; E_value=0.00067; Accession=PF00023.20; Description=Ankyrin repeat
  Pfam annotation: Domain name=Ank; Domain location=205-238; Score =28.3; E_value=2.7e-05; Accession=PF00023.20; Description=Ankyrin repeat
  Pfam annotation: Domain name=Ank; Domain location=239-273; Score=7.8; E_value=2.3; Accession=PF00023.20; Description=Ankyrin repeat
  Pfam annotation: Domain name=Ank; Domain location=275-308; Score =31.9; E_value=2.2e-06; Accession=PF00023.20; Description=Ankyrin repeat
  Pfam annotation: Domain name=Ank; Domain location=35-67; Score=18.2; E_value=0.03; Accession=PF00023.20; Description=Ankyrin repeat
  Pfam annotation: Domain name=Ank; Domain location=69-99; Score=17.3; E_value=0.057; Accession=PF00023.20; Description=Ankyrin repeat
  Pfam module annotation: Pfam domain module=Ank::Ank::Ank::Ank::Ank::An k::Ank::Ank; Domain location=103-134::137-169::171-203::205-238::239 -273::275-308::35-67::69-99
MNPKFYNAVKSNDITTFLSLVKENGEILHQITADSLSTPLHLASRYGCTEIVSEIVRLCPDMVSAENKNLETPIHEACRQENVGVLKLLLDANSTAICKLNQNGKSACFLACRHGNLDMLNLLLNLSEMGGPEATGFDQSCIHIAASRGHTDVVRELLNKWSELTQVIDDNGNSPLHHACNGGHREIAWILLRRDPNLVLQYNNNGYTPLHLAVMKGKVSVLQDFVSSIATSLNHLTREEETVFHLAVRYGLCDALEFLVHVSNGTNLLHFQDRYGNTVLHLAVLGGRYKMAEFLINKTKVDVNARNCEGVTALDILDQAKDSAENRQLQATLIRAGGRRSIQSSPFSRETDKTNSVSPVASSLSMSWRYTTNPVELPNQNEMVAYDCTSPPQLGRSTNSRSPSQPQVSERIEDTTYKSYYCSPRNLGKHKQQNKTKAENLNQLYYTQSRRNKHYEMHKEAILNARNTITIVAVLIATVTFAAGINPPGGVYQEGPMRGKSMVGKTTAFKVFAISNNIALFTSLSIVIVLVSIIPFRRKPQIRLLTITHKVMWVAVAFMATGYVAGTWVILPHSPEMQWLSVVLLAVGGGSLGTIFIGLSVMLVDHWLRKSRWKKTMKESVDVAADYQKESENSDFESSYLQGYHSY

SEQ ID NO: 125459 - protein, 678 aa, Glycine max
  Coding DNA Sequence Number=SeqID_8681
  Homolog annotation: Hit_ID=Q66LI1; Match level="QueryCoverage=97%, HitCoverage=78%, E-value=1e-137, Identity=38%"; Hit description=CENP- C
MEKEGDALVDPLASYWGLSLFPQPSLPPSKPYNSDQDLHIIHTHLRSMALRSPAKLMQQAKSIVDGNPQLFNTENLNDPTSQNTNVAEEDGEFRRNPRPGLGLKRPRFSMKPTKKPSVESLLPTLDLDSLKDPADFFMAHERLENAKREIQKQLGGASFESDQDKAAARPRQRRPGLLGNDQLSIKYKHRYPKETSDDVLSSQETLGSRSLAPVTENTDKGESCMASLEKEVIDSSGTEGNKLDELLDGLLHCNSEDLEGDGAMTLLQERLQIKPIALEKFSVPDFPDKQMVDLKSLQGNKSKPRKALSDIDNLLKGMNMNKKTPLKKAVQCPGQQLASPTPPRSPFASLSLLQRHISRSKQSVDPFSAHEIDNLSSKNYSLTHTVNPELNLAGSGNLSNELNAHMIEDVHAVGKTSTVLDTDRNGTNTSEIPKEDYSGKSSNKWNAPSTEDIIAVGGNSLPEDTVRNGTSTSQKFIVDNSREPKFDVNIVSNEPHVDMDVDVGASGMGDNVDRSNIEAHMIEDDIAVGKTSTVLDTDINSIHTSEISKEDNSGKSSNNLNVPSIDNIVAADGTSLAEDAARNCTSTFQKSMVDNSRDPRLDVTIDSHESHVDMGVDVGVSGVADRVMDDTKDRSNIESENIQTFTASIPTDDTNLNVLNSLGMYKLTCFRAISRMQI

SEQ ID NO: 125460 - protein, 76 aa, Glycine max
  Coding DNA Sequence Number=SeqID_8682
MQEQSSKGKGIAVEPESSPPIFVPTPSLSQSSDYDPGNSTCLTPTKRISCQQTSSDFDSDEHAQYQLSTNKHIKAE

SEQ ID NO: 125461 - protein, 301 aa, Glycine max
  Coding DNA Sequence Number=SeqID_8683
  Gene Ontology: Mol. function=metalloendopeptidase activity; Cellular component=extracellular region; Biological process=proteolysis
  Homolog annotation: Hit_ID=Q99132; Match level="QueryCoverage=94%, HitCoverage=81%, E-value=1e-126, Identity=73%"; Hit description =Extracellular metalloprotease precursor
  Pfam annotation: Domain name=Peptidase_M4; Domain location=6-131; Score=110.0; E_value=6.9e-30; Accession=PF01447.9; Description =Thermolysin metallopeptidase, catalytic domain
  Pfam annotation: Domain name=Peptidase_M4_C; Domain location=133-300; Score=119.7; E_value=8.2e-33; Accession=PF02868.6; Description =Thermolysin metallopeptidase, alpha-helical domain
  Pfam module annotation: Pfam domain module=Peptidase_M4::Peptidase_M4_ C; Domain location=6-131::133-300
MAEHPHTASAASTAQPGSVLRAIYDAGNTQNLPGTLIREEGQPGNGDVAADEAWNYLGITYDFYWQIYQRNSLDNKGLKLDGTVHYGREYQNAFWNGQQMVFGDGDGEIFNRFTIAIDVVAHELTHGVTETEAGLIYFQQAGALNESMSDVFGSLVKQYHLKQSADQADWIIGEGLLAAGIKGSGLRSMSAPGTAYDDPLLGKDPQPADMDHYIDTREDNGGVHLNSGIPNRAFYLAATALGGFAWERAGQAWYDTLCDKELPQDADFSTFARFTVQHAAKRFDNTVAQAIQSAWHEVGVR

SEQ ID NO: 125462 - protein, 237 aa, Glycine max
  Coding DNA Sequence Number=SeqID_8684
  Gene Ontology: Mol. function=exodeoxyribonuclease VII activity; Cellular component=exodeoxyribonuclease VII complex; Biological process=DNA catabolic process
  Homolog annotation: Hit_ID=Q6D286; Match level="QueryCoverage=28%, HitCoverage=14%, E-value=5e-28, Identity=92%"; Hit description =Exodeoxyribonuclease VII large subunit
MSDSLTDGYVRKYRPAYQSRAAASAVRAIYGGLSTIYAAEKIITPYGCASSVVVTPSPDSPPSHHPAGYAADRRIGGDAKAARQRRQRTYAFQLCCQPGSATAVTAAERAEYVPAAAGIAGAAAGDPAGDAPGATAGRPPPADDAAAGSAWFAGVPGAAADAAVADDAAAGLQTAQQLDLVAAHQFGSGRRRRRAQIGNKVGDGDIGFMPNGADDWQAAGKDGPRHALVVEAPQIFQ

SEQ ID NO: 125463 - protein, 159 aa, Glycine max
  Coding DNA Sequence Number=SeqID_8685
  Subcellular localization annotation: CTP_CleavageSite=57; ConfidenceScore=5.13e-01
RCPHVANKFAAQPAGRCPSLPEICCTPAGRCPQFAARRPAGARIAPKTSGATSFCPRLLAPWAESPAPWLGRIAPKTSGATSFCPRLLAPWAESPAPWLGRIAPKTSGATSFCPRLLAPWAESPAPWLGRIAPKTSGATSFCPRLLAPWAESPAPWLGR

SEQ ID NO: 125464 - protein, 712 aa, Glycine max
  Coding DNA Sequence Number=SeqID_8686
  Gene Ontology: Mol. function=copper ion binding; Cellular component =cytosol; Biological process=metabolic process
  Homolog annotation: Hit_ID=Q9XHP4; Match level="QueryCoverage=95%, HitCoverage=100%, E-value=0.0, Identity=89%"; Hit description =Peroxisomal copper-containing amine oxidase
  Pfam annotation: Domain name=Cu_amine_oxid; Domain location=289-690; Score=773.9; E_value=9.5e-230; Accession=PF01179.10; Description =Copper amine oxidase, enzyme domain
  Pfam annotation: Domain name=Cu_amine_oxidN2; Domain location=40-160; Score=12.7; E_value=0.00073; Accession=PF02727.6; Description=Copper amine oxidase, N2 domain
  Pfam annotation: Domain name=Cu_amine_oxidN3; Domain location=165 -269; Score=177.6; E_value=3.1e-50; Accession=PF02728.6; Description =Copper amine oxidase, N3 domain
  Pfam module annotation: Pfam domain module=Cu_amine_oxid::Cu_amine _oxidN2::Cu_amine_oxidN3; Domain location=289-690::40-160::165-269
MDKFFYGNVQFVQSSDMSAWGGTVLFGIGITVMVRAQTSHPLDPLTAAEISVAVATVRAAGATPEVRDSMRFIEVDLVEPEKQVVALADAYFFPPFQPSLLPRTKGGPVIPTKLPPRKARLVVYNKRSNETSIWIVELREVHAATRGGHHRGKVVSSTVVPDVQPPMDAVEYAECEAVVKDFPPFREAMKKRGIEDMDLVMVDPWCAGYHSEVDAPSRRLAKPLIFCRTESDCPMENGYARPVDGIHVLVDMQNMVVLEFEDRKLVPLPPADPLRNYTSGETRGGVDRSDVKPLQIIQPEGPSFRVNGHFIEWQKWNFRIGFTPREGLVIHSVAYIDGSRGRRPVAHRLSFVEMVVPYGDPNDPHYRKNAFDAGEDGLGKNAHSLKKGCDCLGYIKYFDAHFTNFYGGVETIENCVCLHEEDHGILWKHQDWRTGLAEVRRSRRLTDGKIEAEIKLTGILSLGSLQPGETRKYGTTIAPGLYAPVHQHFFVARMDMAVDCKPGEAFNQVVEVNVKVEKPGDNNVHNNAFYAEEKLLKSELEAMRDCDPLSARHWIVRNTRTVNRTGHLTGYKLVPGSNCLPLAGSEAKFLRRAAFLKHNLWVTPYARDEMHPGGEFPNQNPRVGEGLATWVKQNRSLEEADIVLWYVFGVTHIPRLEDWPVMPVERIGFMLMPHGFFNCSPAVDVPPNPSDLDDKENGLPAKPIQNGLIAKL

SEQ ID NO: 125465 - protein, 983 aa, Glycine max
  Coding DNA Sequence Number=SeqID_8687
  Gene Ontology: Mol. function=RNA-directed DNA polymerase activity; Cellular component=chromatin; Biological process=chromatin assembly or disassembly
  Subcellular localization annotation: CTP_CleavageSite=61; ConfidenceScore=5.28e-01
MNTLTQKINDLLNRVTPIMSPSPSSTSSPSSPFFEYHGTPENERLTIASFYMEGRALTWFQWMTGNGQFTSWSTDIGDKERGISAPTADVNPGRGLGTFARRKASRCPSSTQVTRPTRDSRTATPALPPRTGTLPPLLPLSGHQAPPPLKRLSPEEIASRRECGLCFTYDEKYHRGHRCASRVFLLIAEEGETPNPHIIVLDPPLDSSVQVEPSDPGPTQISFHSLAGQLAPETLSIHNFIQQELVTLSHLPCRTTSVPLRVMVGNGQHLQCTSVPWLKLLGPILTDYNPLSMQFIHEGRVVELKGDTNGTLNIITPPHFRRMARSQAKGVYCHISLFPEAVTILQDIPPAIQPILIKFTHLFQQPWCLPPERDIDHHIHLLPQSTPINMRPYRYPHFQKKSDGLWQFFVDYRAPNAITVRDRFPIPTIDELLDELGGAKCFSKLDLLQGVEPLASKVDAIQQWPTPRMVRAVRSFLGLAGFYRRFIRDYASIAAPLVHVTTLAEFNWSPQAQAVFDQLKQALSQALVLALPNFDLPFTIETDALGVGMGVVLSQRYHPIAFFSKPFPPMLLRASAYVCKQFAITTAVKKWRQYLLGHRLTIITNHKSLKELLTQVIQTPEQHISLTHLMGYEYQIQYRAGAHNQAADALSRSPLASKGPSHDSHTAIGVPYHPHRQSHGYCENDKPLAGKFRMVESTIGRYKLRIPMSRLPAWLPPFRGNTIILVVWENFTACPTTWFLTETLVCEQILAIIVFPEWNATADELRLSPTKRQPNEATGTTPFKITFGCIPFNFPEYIAGSSTLDVVDKMLTNREETFQAIRKKLLRAQERMKLTANTKRREVLERIGPVAYRLKLSKEAHIHSVFHCSLLKTFKGSPDCILKAELPSQFVQHQPIISLLALLDYRRASKNAPWEVLVQCEGLPPDDTSWENWEQLCEDYHLEDKVNFQGPTDDTKEEEITSRGKKDIQTRMQKHNKGGTDSS

SEQ ID NO: 125466 - protein, 62 aa, Glycine max
  Coding DNA Sequence Number=SeqID_8688
MVVSPGATRPAQDIKEALLGGNLLCFSSHSGTHLVDHDPKNLNKTSTSSEGSHTSQNICMRV

SEQ ID NO: 125467 - protein, 145 aa, Glycine max
  Coding DNA Sequence Number=SeqID_8689
MSMEALFGKLLAYEHELIQQSHVEEIKKKRKGITLKKQLAKKKGNKDRKQKKAYIASEDNAFTSSDSYSEEEVANVYLMADSMDDSSTIEETKVNSEYEEVWEAFNETHEEAQRLAVSINNLRSNLKLHITKLTSTQNELDKPRQ

SEQ ID NO: 125468 - protein, 231 aa, Glycine max
  Coding DNA Sequence Number=SeqID_8690
  Gene Ontology: Mol. function=RNA-directed DNA polymerase activity; Cellular component=intracellular; Biological process=RNA-dependent DNA replication
MLIALSGKCQSSIICRLGIYEPVEHNNPALSPNFESPVYEAEEEEDDEIPEELARLLEYEKKTIRPHEEVVEVINLGTKEDKKEVKIGASLEATVKRGVIELLKEYADVFAWSYQDMPGLDPRIVEHRLPLKPECPPVKQKLRRTRPDMALKIKEEVQKQINAGFLVTSEYPQWLANIVPVPKRDGKVRMCVDYRDLNKASPKDDFPLPHIDVLVDNTAKSKVFSFMDGFS

SEQ ID NO: 125469 - protein, 226 aa, Glycine max
  Coding DNA Sequence Number=SeqID_8691
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=2e-31, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSTSEDYMSSTSEDYTFSPLEDYMSLPYEGYTASPFEDYTPSPSEDYTSSASEDYTSSPSEDCTGLQALAFVGLHAPTLKGLLILTFRGLHVLTFSGLHAFALTGLHVLTYRGLHNLAFRGLGALAFKGVHILPLRGLHALAFVGLHTLTFKGVHILNFRGLYIVAIRGLHVLAFRGLHVLPFRGQHDLPFRGLHALALTGLHVLTFRGLHNLAFRGLDALAFRG

SEQ ID NO: 125470 - protein, 124 aa, Glycine max
  Coding DNA Sequence Number=SeqID_8692
MRLPGKESLLMKSPITINEILDVSISFLNDHLEETLGSTKIEEIHSKCINLAQGKDYGESGFWLKVCRMARHDTCRGLVWLKDKRDAPHYFHDTNAKMMIWKFYAKLVMHAPMRTLKCQIFMVM

SEQ ID NO: 125471 - protein, 79 aa, Glycine max
  Coding DNA Sequence Number=SeqID_8693
MDFPSNLYFLEAIKAKVALREVENLGESDNFNKDILRVMASPLVARMFYSITCFTRPIGTWMSEESIGVERIVKGDITC

SEQ ID NO: 125472 - protein, 162 aa, Glycine max
  Coding DNA Sequence Number=SeqID_8694
MEEGYATNKPPLFKGVNLSRKWRPQVTALRALKTLDTMSLEEPVGTLKGKSLALSAQKAKKAPSSEESSSRPLSKSVSKALSMENSSEEEFDEDDELAFISTKIRKMCKNKSGSRLKKSSKKCPELEKSKDKYKHFKSKDKKSLMSTWEDLNDTTSDEEGEE

SEQ ID NO: 125473 - protein, 83 aa, Glycine max
  Coding DNA Sequence Number=SeqID_8695
MEITQAEECPQLQTGHIPENSTTMENLNLWHVQADNVEDMEETREEEFSTVISKGNKKKMNAKQKASSSNKIANHFSVGKKQP

SEQ ID NO: 125474 - protein, 112 aa, Glycine max
  Coding DNA Sequence Number=SeqID_8696
  Gene Ontology: Mol. function=mismatched DNA binding; Biological process=mismatch repair
  Homolog annotation: Hit_ID=O04716; Match level="QueryCoverage=91%, HitCoverage=7%, E-value=3e-28, Identity=60%"; Hit description=DNA mismatch repair protein MSH6-1
  Pfam annotation: Domain name=MutS_V; Domain location=1-110; Score= -160.5; E_value=0.0023; Accession=PF00488.12; Description=MutS domain V
MLSSATHNSLVALDELGRRTTASYGQEYLVRKVQYCGLFCTHYHRLAVDYLKDPKLFVLVKFYLCHMACQVGGGIAGLYEVTFLYRLTPGAWPKSYSVNVAQMDLKLKACYK

SEQ ID NO: 125475 - protein, 98 aa, Glycine max
  Coding DNA Sequence Number=SeqID_8697
MYPPLFSLNNLVDVPSTRIDPQEMYPLLFSVNNPSRCTLYLYHKGCTLKSVKTKFLGGRHKRIQAVSPSFFWKREKRDTKRIQAVSPWRILFGKGRRE

SEQ ID NO: 125476 - protein, 61 aa, Glycine max
  Coding DNA Sequence Number=SeqID_8698
MYFGLIRTKIWSTGLQWTDDGDGDDISGNTNDGNSDDNSGDTNNDKDAVEFNTKGFESESF

SEQ ID NO: 125477 - protein, 75 aa, Glycine max
  Coding DNA Sequence Number=SeqID_8699
MGYIEVYSVQRKPWHEKGCMIVIKKNEKRKSWAWKRLYDLQKRKRCVLHSLESKNIQALVVSLRLQGNANVVQLF

SEQ ID NO: 125478 - protein, 153 aa, Glycine max
  Coding DNA Sequence Number=SeqID_8700
MMLAVWSAMIRLNDRILLPRSSNLAQASEEDLILMWAFLTGRQIDWAHLRSFAIGAGAVTSFGYRKDRNGQWLKKDALPPQDERTPSPPPQREDSALMNEVLSELRGLRSYVGDRFDSLDTHFAGMDIRLTQLEEDVGYIRQSFDLPPPPPST

SEQ ID NO: 125479 - protein, 119 aa, Glycine max
  Coding DNA Sequence Number=SeqID_8701
GKSDDMQGYLMVICTFCHLETASPMTCGGASEPIDTQRLTSSSAPFVIQRRRGYLMVIHTFCHPETASPMTCEGNLGFYFRHPETFKPNNAQDSSLLSRDDQGRWHAVTNVVICTFPED

SEQ ID NO: 125480 - protein, 129 aa, Glycine max
  Coding DNA Sequence Number=SeqID_8702
  Subcellular localization annotation: CTP_CleavageSite=48; ConfidenceScore=5.44e-01
MPISPCGSISWSVPSWHRDRAHKTPSGPGGVQQGPGVSSFGYGPLSVLQGARSSPARSCHRDVGKDRARNTPSGPGEVQKGPGVSSSGYGPLSVLGVPVAPSKVIRPAINRTFIEKYYAPRQVQGEASQ

SEQ ID NO: 125481 - protein, 52 aa, Glycine max
  Coding DNA Sequence Number=SeqID_8703
MGSGNAMWLDSHVDLNESSFPRRCNSSYFGNGKIFGARTQEEGLIRIILTWF

SEQ ID NO: 125482 - protein, 128 aa, Glycine max
  Coding DNA Sequence Number=SeqID_8704
MEILVVVVLVDAYDTFDRRCEKSSARIVCCTPVLYVWLLKARTQEITWLPKLKISSEEEAKVPEESKDVQALKVKLERTQVVKEKFKTTAIRVRKECDELRDVNVATAEALERETKRARKKEWGRNKF

SEQ ID NO: 125483 - protein, 157 aa, Glycine max
  Coding DNA Sequence Number=SeqID_8705
MSNRKYESSYEKLKKKRKVEKLSESQRGALDKFFIIHKNDAEASSIGENVIEQPLIDHTDNEENVIEQPPIDNTDNGVEKSPRDDTENGENVIEQPPINNTDNTNSHNFNQELEDNILEIGVEGNVEHNNTSSEVPTNIYDPGLWKNIDGKFRDLMI

SEQ ID NO: 125484 - protein, 100 aa, Glycine max
  Coding DNA Sequence Number=SeqID_8706
  Gene Ontology: Mol. function=protein kinase activity; Biological process=protein amino acid phosphorylation
  Homolog annotation: Hit_ID=Q7CL48; Match level="QueryCoverage=99%, HitCoverage=28%, E-value=6e-36, Identity=81%"; Hit description =Putative periplasmic binding protein of ABC transporter
MLSTTPVFAADKYEIAVVAKVTGIPWFNRMEVGVNEAAKKLDVNAYQTGPSTPDPAAQVKVIEDLIAKNVNAIIVVPNDAQVLEPGAEKSARQRHRGADP

SEQ ID NO: 125485 - protein, 84 aa, Glycine max
  Coding DNA Sequence Number=SeqID_8707
  Subcellular localization annotation: CTP_CleavageSite=48; ConfidenceScore=5.61e-01
MPISPCKSISWSVSSRHGDRTHKTPSGPGKVQQGPGVSSSGYGPLSVLQGARTPPARSRHHRDRACKTPSGPEEVQQGLGVVKL

SEQ ID NO: 125486 - protein, 52 aa, Glycine max
  Coding DNA Sequence Number=SeqID_8708
MESSPGAQGRKRKGGVSHRCKPAGSQTGEIELPMAGNSQSIERLATESPEVA

SEQ ID NO: 125487 - protein, 110 aa, Glycine max
  Coding DNA Sequence Number=SeqID_8709
MPTAYARRQRQLERVVKDPPAIVEELHDKERQQEAPVEDPPTNVEGFPGESHDTFVLRDYENHIAPRIWNGKLNNGEVCHKHRSAQSISIWFPSPQLWSHVSHITHDLKN

SEQ ID NO: 125488 - protein, 399 aa, Glycine max
  Coding DNA Sequence Number=SeqID_8710
  Gene Ontology: Mol. function=catalytic activity; Cellular component =mitochondrial inner membrane; Biological process=metabolic process
  Homolog annotation: Hit_ID=UPI000068E911; Match level="QueryCoverage =99%, HitCoverage=88%, E-value=0.0, Identity=82%"; Hit description =acetyl-CoA carboxylase, biotin carboxylase
  Pfam annotation: Domain name=ATP-grasp; Domain location=72-238; Score= -67.0; E_value=0.0049; Accession=PF02222.12; Description=ATP-grasp domain
  Pfam annotation: Domain name=Biotin_carb_C; Domain location=291-397; Score=230.4; E_value=4.1e-66; Accession=PF02785.9; Description =Biotin carboxylase C-terminal domain
  Pfam annotation: Domain name=CPSase_L_D2; Domain location=72-283; Score=317.2; E_value=2.8e-92; Accession=PF02786.7; Description =Carbamoyl-phosphate synthase L chain, ATP binding domain
  Pfam annotation: Domain name=CPSase_L_chain; Domain location=1-70; Score=29.0; E_value=5.4e-06; Accession=PF00289.12; Description =Carbamoyl-phosphate synthase L chain, N-terminal domain
  Pfam annotation: Domain name=Dala_Dala_lig_C; Domain location=72-262; Score=-76.0; E_value=9.4e-05; Accession=PF07478.3; Description=D-ala D-ala ligase C-terminus
  Pfam annotation: Domain name=GARS_A; Domain location=71-249; Score= -107.8; E_value=0.0078; Accession=PF01071.10; Description =Phosphoribosylglycinamide synthetase,
  Pfam annotation: Domain name=RimK; Domain location=70-264; Score= -45.2; E_value=0.00073; Accession=PF08443.2; Description=RimK-like ATP-grasp domain
  Pfam module annotation: Pfam domain module=ATP-grasp::Biotin_carb _C::CPSase_L_D2::CPSase_L_chain::Dala_Dala_lig_C::GARS_A::RimK; Domain location=72-238::291-397::72-283::1-70::72-262::71-249::70-264
FADEAVCIGPAMSKDSYLKIPNIIAAAEITNADAIHPGYGFLSENANFSRICQKNGIKFIGASPEQIEKMGDKANAKATMKAAGVPCVPGSDGLIESYEHAVKVAEETGYPVMIKATAGGGGKGMRAVWKAEDLKEHWDSAIQEAVAAFGNGGMYMEKLIEEPRHIEIQVAGDQYGKACHLSERDCSVQRRNQKLTEETPSPFMTDELREKMGAAAVKAAEFIGYEGVGTIEFLVDKHRNFYFMEMNTRIQVEHPITEQVIDYDLIREQILLAAGTPISGINYYPKLHSIECRINAEDPYADFRPSPGKITGLNIPGGHGIRVDTHVYSGYTIPSNYDSMIAKLITTAQTREEAIAKMRRALEEFYIEGVKTTIPFHRQLMDDENYLAGNYTTKFMEDF

SEQ ID NO: 125489 - protein, 88 aa, Glycine max
  Coding DNA Sequence Number=SeqID_8711
  Gene Ontology: Mol. function=structural constituent of ribosome; Cellular component=ribonucleoprotein complex; Biological process =translation
  Homolog annotation: Hit_ID=Q2QW49; Match level="QueryCoverage=66%, HitCoverage=12%, E-value=2e-09, Identity=55%"; Hit description =Ribulose bisphosphate carboxylase large chain, putative
MTGLGPVAQRIRARGYEPRCRGFESLLAHNRPKKGRIFPSGGRKIMIGLADPKLWNFPGLWNKGVSRTYTEVLTAILKYRRTEQNGIR

SEQ ID NO: 125490 - protein, 39 aa, Glycine max
  Coding DNA Sequence Number=SeqID_8712
MIQVGKDDPKLYLKDLDYMLGLTLALKVKVVPFSEVYML

SEQ ID NO: 125491 - protein, 110 aa, Glycine max
  Coding DNA Sequence Number=SeqID_8713
MASMMDAMLGMRRLMENNAVAAAAAAVSSAAEADPTLPATVHHPIPNVVGRERSTLGHISNPHSGYNRVAYPYGLPTNYTPPVLRDDAGHVPPPILEGEPPQQPNEIHKD

SEQ ID NO: 125492 - protein, 193 aa, Glycine max
  Coding DNA Sequence Number=SeqID_8714
IRKENAELRDVNIATTKALEQETKRARSEEHGRNKFRGALWSSNSELKLRREERDQSRVDSLILKNELRICLRSKRSLSQRLCETETNMLAIISKYQEELNLATAHDHKMADEYARVYAKKEAKGRVMDSLHQEATMWTDQFALTLNGSQELPRLLAKAKAMADTYFAPEEIHGLLSYCQHMIDLMAHIIRNR

SEQ ID NO: 125493 - protein, 300 aa, Glycine max
  Coding DNA Sequence Number=SeqID_8715
  Homolog annotation: Hit_ID=UPI00005F9E10; Match level="QueryCoverage =25%, HitCoverage=20%, E-value=4e-26, Identity=75%"; Hit description =COG1649: Uncharacterized protein conserved in bacteria
MLPVRVSDHGRMRERHSAVPSGFTWKNTVLIPRLCSLSSLAVSACCCWRIRSAGLAVTEDIGGQSRRDTVVSQTPRTGSVCAAGLAGTGGLVGDGNGVTSDFGGSEAQLASNSTADSRRATRLMWVTERHNVKTLAKMNAAAALSRVPHLTGVLTMQYEDLYRRIGQIIFSCGPDGAQVLVVQAELFADEEGGQFQFNYLDENGEPDWFEPDARAIGDLITAGFRARHGERYERSATISSLFLRAARLRCTIWLATSTSSVNSPVAIISERCCALNSIDVSTPTMNTMVAHVRPGNSHMR

SEQ ID NO: 125494 - protein, 47 aa, Glycine max
  Coding DNA Sequence Number=SeqID_8716
MTPSLSPLSVGFFIIVHQCQYVFGTLVLRRHHLRVLSASVSRDCPLR

SEQ ID NO: 125495 - protein, 191 aa, Glycine max
  Coding DNA Sequence Number=SeqID_8717
  Gene Ontology: Mol. function=binding; Cellular component =intracellular; Biological process=embryonic development ending in seed dormancy
  Homolog annotation: Hit_ID=Q7XHS8; Match level="QueryCoverage=81%, HitCoverage=54%, E-value=2e-40, Identity=31%"; Hit description =Putative pentatricopeptide (PPR) repeat-containing protein
  Pfam annotation: Domain name=PPR; Domain location=127-161; Score =13.5; E_value=0.19; Accession=PF01535.11; Description=PPR repeat
  Pfam annotation: Domain name=PPR; Domain location=37-71; Score=19.8; E_value=0.0096; Accession=PF01535.11; Description=PPR repeat
  Pfam annotation: Domain name=PPR; Domain location=92-126; Score=30.2; E_value=7.2e-06; Accession=PF01535.11; Description=PPR repeat
  Pfam module annotation: Pfam domain module=PPR::PPR::PPR; Domain location=127-161::37-71::92-126
MDIVGSRNGVPLPVSKENTAEYVCQWLIVAIGECDEEPYITMIMGYGSVENFNEAYNLLERQKRKGCILNRKVEEALKILEAMKMDAAPNLTSYNILIDRLCKEGELEVALKVQDSTKEAGLFPNIITVNIMIDRLCKAERLDEACSTFLGLDHKVCTTESVTVCSLIDGLARHGKLNDAYMLYEKMLDSG

SEQ ID NO: 125496 - protein, 138 aa, Glycine max
  Coding DNA Sequence Number=SeqID_8718
  Gene Ontology: Mol. function=chitin binding; Cellular component =extracellular region; Biological process=chitin metabolic process
  Homolog annotation: Hit_ID=UPI0000612705; Match level="QueryCoverage =83%, HitCoverage=93%, E-value=8e-11, Identity=30%"; Hit description =UPI0000612705 related cluster
MRGTVHEPRANLGADQKFSHKGGPLGTSTLSFRGPNILLFRGPNILIFRGSNILIFRGLHVLAFRGLHVLAFRGLHVLAIRGLHVPTFRGLHAFAFRGLHVPLFKGLHALTLRGRHALTFRGLHVLAIIELHSLAFKR

SEQ ID NO: 125497 - protein, 50 aa, Glycine max
  Coding DNA Sequence Number=SeqID_8719
MQVSSPGRVELAWLSNHCTKRVKKGEREGDGPRPMVHSEIMGHATLPPFP

SEQ ID NO: 125498 - protein, 78 aa, Glycine max
  Coding DNA Sequence Number=SeqID_8720
MRALILLEICIPLGGYGTLEELLEVITWAQLGIHDKPVYKCLNKMEEAKPTMKPRENIWITQELPMFIAYQNQPFKAS

SEQ ID NO: 125499 - protein, 106 aa, Glycine max
  Coding DNA Sequence Number=SeqID_8721
  Subcellular localization annotation: CTP_CleavageSite=44; ConfidenceScore=5.62e-01
MTNANCPQESLHSVSNGNLRFDTAQTLVSRFLLFSRTRVRASSSLMKRKSKLGAANTIGTKLWLLLLLHDCKSILVLMTRVGRSLCFCPFEASNLAYLKKILMFNL

SEQ ID NO: 125500 - protein, 100 aa, Glycine max
  Coding DNA Sequence Number=SeqID_8722
MVERGRFDHIEERLRAIEGGGDHVFADMVELYLVFDMVIPSKFKVPDFDKYKGTTCPKNHLKLYCRKMGAYAKDEKLLMHFFQESLIGATVIWYTNLEPS

SEQ ID NO: 125501 - protein, 150 aa, Glycine max
  Coding DNA Sequence Number=SeqID_8723
KEHALWHPYQTRARARVMSEIEEVQERRKVDMEAMKEQMATMMEAMMSMKKILEVNAAVVAATSTVVEVDPTPPSSLNQINHPTSDMIDQGGKEFGSTGGPHFVQVQNKHAFPPYGLPPKYTPPNVAHNSDENVDNSTPILIESQQPCWI

SEQ ID NO: 125502 - protein, 134 aa, Glycine max
  Coding DNA Sequence Number=SeqID_8724
MDDDGVRAENVAAKDVVDTLGDEVAFHVVVGEMTGRDVRLSETPANEVSKVMRTSPTSKGLCHFGDKARLTGALSKGGKMHGVATNEGISTSHVDKSGALAPTYPPSKRKSDLRSSFLRVNQAILFTWKLDFAG

SEQ ID NO: 125503 - protein, 158 aa, Glycine max
  Coding DNA Sequence Number=SeqID_8725
  Homolog annotation: Hit_ID=Q1SYR3; Match level="QueryCoverage=49%, HitCoverage=3%, E-value=2e-10, Identity=41%"; Hit description=RNase H, putative
  Subcellular localization annotation: CTP_CleavageSite=24; ConfidenceScore=5.64e-01
MPNQPQRPPQHHPQNPFPTQLRPSANLNPNANTNPRRKFPERKPTEFTPILMSYANLLPSLLSNQMDIVSSRKLYQPPFPQWYNPNATCAYHGGVPGHFVEQCVAFKHKLIGEPGGRREMSGVEIDKGCVDSKTGDPCLMHSRALHDVEMFPIAEELL

SEQ ID NO: 125504 - protein, 161 aa, Glycine max
  Coding DNA Sequence Number=SeqID_8726
MAVPKSEKMQRQDETNKKQAVPLGVENNDGLWWLMVAVGDGESSWNFRNGFGRKKEEEMTHLLKDSNGQIMDKCLVKSQTKFREDPMVNKGWAALLTHSKHLLKDLNGQIMDKCLVKLKTKVREDPTVNEGWAAFLPRQLDVAFSRSFIKRLPPEASSWLL

SEQ ID NO: 125505 - protein, 242 aa, Glycine max
  Coding DNA Sequence Number=SeqID_8727
RDVRRHVGEVLLYALWLSLLVPIGTTMSRGRGDLTSRVCAKFFGGKRAKRVNCSRFPPIAIPRYEWVSMKVNLYPTWFQTHESIKELKRKVDMMTSDDTKLFIVEPCSIEERVSMWASKEVMKGYDYKNLKSLSVDDQTQVDSVKVEIINLDGLEVASGGAELGNTIEWPVEVLEKDKVVEKEKEAEVVQKSSVTEKVAEASTWPGFTVTMSPRWLGNFIGRWGIEMIVPRAFNVVLPIRIL

SEQ ID NO: 125506 - protein, 129 aa, Glycine max
  Coding DNA Sequence Number=SeqID_8728
  Subcellular localization annotation: CTP_CleavageSite=54; ConfidenceScore=5.20e-01
MPLLSLIFVFPLLLLKSFLFLAAHQTCLRKTTISDLFLSFPAETQNSLSKTTIPVSLTVGFSCGPRFSSAHPHHWDLQDNIHGERKRNRTKIVQVEASIPSLRLGTLLEQLEEKTGGISGNARDAAITF

SEQ ID NO: 125507 - protein, 182 aa, Glycine max
  Coding DNA Sequence Number=SeqID_8729
  Gene Ontology: Mol. function=RNA-directed DNA polymerase activity; Cellular component=membrane; Biological process=RNA-dependent DNA replication
MEKGLSGKNRGPESQDEQQILSWFPPRAVRSNSIANDSELLATLTMLLRSEGSPISIDWGVQWYPHSMLGSSSTHSPLGIIDVLLCSLTRMTLFVASTCLLAWGCSAEEGVCFNPLGEIVHHGEEEFDLAFGYRKWFENVHSPHGERPRGGDVMELLRQRVVDMVELLTFFTLFDILGANCP

SEQ ID NO: 125508 - protein, 68 aa, Glycine max
  Coding DNA Sequence Number=SeqID_8730
MFRGNNDDEFEFDGGFDFDKEEALYKELETLIHSENTAPSMMFPLEDATHVHSGDSDSDGGSDNNKLQ

SEQ ID NO: 125509 - protein, 110 aa, Glycine max
  Coding DNA Sequence Number=SeqID_8731
MAFEFSGIKSNCNGVAIITYAGLAGQDVWKEFYQYFRESKFIHIMSIDFIILSTFAPFWVYNDMTARKRSDKGSWLLPLSLIPFLGPGLYLLLRPSLSTVAISQTPVEPE

SEQ ID NO: 125510 - protein, 94 aa, Glycine max
  Coding DNA Sequence Number=SeqID_8732
  Subcellular localization annotation: CTP_CleavageSite=57; ConfidenceScore=5.31e-01
MGVQIAFGKLGYSRTFWKLGYLRRKQPSSLGRAGRQPLPPFPINRRREVVPKENPCRGASVMLSRCFCEQIHEGFPPFFTVLHSFFVRSLFFNR

SEQ ID NO: 125511 - protein, 115 aa, Glycine max
  Coding DNA Sequence Number=SeqID_8733
MNETLDVSISFLNDHLEETLGSTKIEENHSKCINLTQVGNLALSVLPFPLLFLFSAWREGRGQGLTFSPWVKVYDKLGFWLKACRTAGHDICQGLASGSGIKGMSYIIFMIHMQQ

SEQ ID NO: 125512 - protein, 85 aa, Glycine max
  Coding DNA Sequence Number=SeqID_8734
MGFGWCTTRLGINGLRGIQFPLAMDDDGVGAENVAAKDVVDTLGDEVAFHVVAGEMTGRDVRLSETPANEVSKVVVIEDAKNDRV

SEQ ID NO: 125513 - protein, 111 aa, Glycine max
  Coding DNA Sequence Number=SeqID_8735
MKPTISKTLIHINRANNGLVGQKILGLSQAWGRACKYIYQKETDLKTTFVVVATNKVGSALFNRKKRGSKVLKLAKDKMDVVDLDVGLGVAHKANVSVASPNKDHRGDGHS

SEQ ID NO: 125514 - protein, 169 aa, Glycine max
  Coding DNA Sequence Number=SeqID_8736
MSRSYPSYSPLLPSTFDKDFFDDDMDMGWNVRRVVKSSELLHLPLESVEMNWIDDEIWGTRSKFDISVMNELCKTMWLTCDRNGGHFFVPHRLHYEKKKVALTLRSVNGHKIFEILQISYKYYKDEYFWELHLMVEGKMPQNSLYIGLRIITEMKLMPTMSTMMIFQRT

SEQ ID NO: 125515 - protein, 248 aa, Glycine max
  Coding DNA Sequence Number=SeqID_8737
  Gene Ontology: Mol. function=RNA-directed DNA polymerase activity; Cellular component=chromatin; Biological process=chromatin assembly or disassembly
MEAFCDSNKPDKSEVPDKTETGERAGHCFGGDGQVDEINSFLRTQASIYSKNAANVLVKEIVKLPGIPPSIVLDQDQVFLNQFWRELLTLAGMRLTQWPNWFSLAEFWFNTSYNSAPNISPFQALYGNGIDPPLSLKGTTIPSKVEDMNKLTQESGSDEATSQKNIDVWNFKNGMGLHQGTIAYKLELPEHSNIHPVIHILLLKKVKGSQRDSQPLPPVLNYRRPFLNPYFHLEDTMAPLEGNIVLDL

SEQ ID NO: 125516 - protein, 178 aa, Glycine max
  Coding DNA Sequence Number=SeqID_8738
MGLRKRGRDWRIALSNHYAWLQTRGWRMNENAIHGAPKQGREWRIALSNHYAWLQKMGGGCKNKNVIHGAPKKGREWRIALSNHYAWLQLVGGGFMNENAFHGATKKGREWRIALSNHYAWLQTRGCRMHERKRNSWGSEKRGREWRIAIRNHCAWLQTRGWRMHERKRNSVGLRKEG

SEQ ID NO: 125517 - protein, 64 aa, Glycine max
  Coding DNA Sequence Number=SeqID_8739
MRVQIARRPTWAFQDVPPEVGYVGEGKHPYQNALFTKELRRSDFLITIEGYVGAREIPLSTTKR

SEQ ID NO: 125518 - protein, 175 aa, Glycine max
  Coding DNA Sequence Number=SeqID_8740
KADMKAMKEKMATMMEAMMSMKKIMEANAVVVAATSAVAKVNPMPPSGLNQMNHPTSDMVGKDLGSTGGPMMCKFKTSTPSCHMACLPRRMSISFAPILIESQQPQSDHAHVSTHGGNTWNAPPQSISPTTIPLAFHTGLKPSCYGRNGKVGSSRGKAQVPDFDKYKGTTYPKNH

SEQ ID NO: 125519 - protein, 99 aa, Glycine max
  Coding DNA Sequence Number=SeqID_8741
MKRALINIHKFGILVKGELPGNHITSETSKRVGLRPQKETTPENLAFHGFKQKTQLKTNVNESRRRSKNEIVIRSRKRKIALRTQKHQSRKTKTLKQKL

SEQ ID NO: 125520 - protein, 116 aa, Glycine max
  Coding DNA Sequence Number=SeqID_8742
MLATGWWWKVKALTNITHILLKLSDASIHSCKPCINSINAAVQGIKTHTNEGCGDGERSSAACAGASFFTQEPSLSLRYPKEEITFAPIEKDLLTLTKASESRGDIKDVVKNKVIE

SEQ ID NO: 125521 - protein, 97 aa, Glycine max
  Coding DNA Sequence Number=SeqID_8743
  Subcellular localization annotation: CTP_CleavageSite=23; ConfidenceScore=5.49e-01
MAQKADDGVFRKTQPFPESFRKKCSSGSNQTSSGRTLLPEDFRKTSSGNFPEEVVHPEEFRNTRTSGRTFKVPEDLSGRTPSSRMFPEEPLLPEVIL

SEQ ID NO: 125522 - protein, 141 aa, Glycine max
  Coding DNA Sequence Number=SeqID_8744
  Homolog annotation: Hit_ID=Q8S8G6; Match level="QueryCoverage=41%, HitCoverage=14%, E-value=3e-12, Identity=59%"; Hit description =Expressed protein
NYLISYHEHVAKVESKKVLDVDDEGKCVNSMQIVPLEVPLEVLAPCSQPPQQHYHGHAVFASTKRGVLGVGSWVSKEGTTNILGVREKGVEGWGRGERGEEEPAGLGWKMQRRERSKPGNLKERSLAVTAEQKREARVWRK

SEQ ID NO: 125523 - protein, 128 aa, Glycine max
  Coding DNA Sequence Number=SeqID_8745
  Gene Ontology: Mol. function=drug transporter activity; Cellular component=membrane; Biological process=multidrug transport
  Homolog annotation: Hit_ID=Q1T635; Match level="QueryCoverage=49%, HitCoverage=12%, E-value=1e-09, Identity=50%"; Hit description=Multi antimicrobial extrusion protein MatE
MGSALETLCGQAYDAGQSTMLGVYMQRLWVILFVTALILLPLYILSPPILRLFGQTAEISDAVGFRHSCWRNPYSVITAGEIPQRVTPTRLAKYVHVGYANCNAEKYPCMHHSPMHPTTCTHCNNSWS

SEQ ID NO: 125524 - protein, 40 aa, Glycine max
  Coding DNA Sequence Number=SeqID_8746
MNSRFQVVFDPKFQVLTEGNTSLHVLKKIEQLVFPKDAQL

SEQ ID NO: 125525 - protein, 110 aa, Glycine max
  Coding DNA Sequence Number=SeqID_8747
MGRAEGVQEKMKDDMEAMKEQMATMMEAMMSMRKIMEANAVVVAATSAVTKVNSMPPSGLNQMNHTTLAMVGKDLGSTNGPMMCKFKTSTPSRHMACLPTYTSQCGVHSQ

SEQ ID NO: 125526 - protein, 737 aa, Glycine max
  Coding DNA Sequence Number=SeqID_8748
  Gene Ontology: Mol. function=nucleic acid binding; Cellular component= spliceosome; Biological process=mRNA processing
  Homolog annotation: Hit_ID=Q10M01; Match level="QueryCoverage=98%, HitCoverage=100%, E-value=1e-128, Identity=42%"; Hit description =Zinc finger C-x8-C-x5-C-x3-H type family protein, expressed
  Pfam annotation: Domain name=RRM_1; Domain location=355-423; Score =20.3; E_value=0.0019; Accession=PF00076.12; Description=RNA recognition motif. (a.k.a. RRM, R
  Pfam annotation: Domain name=zf-CCCH; Domain location=223-248; Score =23.3; E_value=0.00088; Accession=PF00642.15; Description=Zinc finger C-x8-C-x5-C-x3-H type (and similar)
  Pfam module annotation: Pfam domain module=RRM_1::zf-CCCH; Domain location=355-423::223-248
MDSYEATRIVFSRIQNLDAENASKIMGLLLLQDHGEKEMIRLAFGPEALVHSVILKARKDLGLPSNSPPTPSTPPSPSPFISRQNSNTSSRLSVSGINLPPPLTIPNPSASWPTMSELQTDLVAGSSTSLSSLPFYANGGSDPIDEFQLQDQLSFLNDGSNTSISHKNNPDLFYPTYSDFSSSPTTAADPTLFPSYGWGGSLHRRSCSVNDACLGTEDPNSGLGWKPCLYFARGYCKNGTSCRFLHGGLGDADAAMVGSPSKIEMMEQCHELLRSKSAQQQRLAAASQLMSSSTFPYSPKCMNFLLQQQQNDTQRAAAAALMMSEDLHKFGRSRLERNDFSLNSPGMVNPASRQIYLTFPADSTFREEDVSNYFSIYGPVQDVRIPYQQKRMFGFVTFVYPETVKLILSKGNPHFVCDARVLVKPYKEKGKVPDKKLQQQQVDRGDFSPCGTPTGLDARDHQFDLQLGGRMFYNTQDMLWRRKLEEQADLQQALELQSRRLMGLQLLDIKKHHQRALCTGSPIPSPTHSPNMFNQNLVPSFHITSEAPKAALGLNLVYFLGMEWIGFDLCYLIPESGSTSAPAGTASVSTGQQSVNISVGKEVMVNGEDGYDEGNGRQSSSHDDCDLQEWYKNCSHLEYRAPEYLEHNLPDSPFASPTKATGPGGFMAPFSNGPNEAIDADASAASANSKFGTGTLLPAASALDMGTFKSFNCQIPRFSSGHGTIGMFAGTGGPIGI

SEQ ID NO: 125527 - protein, 509 aa, Glycine max
  Coding DNA Sequence Number=SeqID_8749
  Gene Ontology: Mol. function=hydrolase activity; Biological process =aromatic compound metabolic process
  Homolog annotation: Hit_ID=Q9FFZ1; Match level="QueryCoverage=85%, HitCoverage=90%, E-value=1e-157, Identity=60%"; Hit description =Arabidopsis thaliana genomic DNA, chromosome 5, P1 clone:MAC12
  Pfam annotation: Domain name=Abhydrolase_1; Domain location=167-434; Score=42.8; E_value=1.2e-09; Accession=PF00561.10; Description =alphabeta hydrolase fold
  Subcellular localization annotation: CTP_CleavageSite=59; ConfidenceScore=5.22e-01
MDFLSCGSGPCCQAVDMKWKLVGKCLNSRQARFPSVGNRSGSVRFHDNKELQRDFGSLSALEGSKRTNCKAYSESYDGYVIGGEEDVADISGVEEPATNNVVIPGLPDGSNGAPISSCFWEWKPKLNVHYEKAGCENVDSPHVLFLPGFGVGSFHYEKQLRDLGRDTRVWALDFLGQGLSLPFEDPAPHYNKEGATSNGNASSWGFGDETEPWATKLVYSIDLWQDQVRYFIEEVIGEPVYIVGNSLGGYVALYSAARNPHLVKGVTLLNATPFWGFLPNPIKNPGLAKFLPWAGTFPLPSNVKRLTELVWEKISDPASIAEVLNQVYAENSTNVDSVFSRIIETTRHPAAAAAFASIMFAPQAELSFSEALSRCQKSNVPICLMYGKEDPWVKPLWGLQVKRQVPEASYYQISPAGHCPHDEVPEVINFLLRGWIRNLESEGSISLPLLDGLDNLKQANARELEFMKEGSKKSVMVRFFDSKFSLWDRIRSYINPRFKLRNSATKSQI

SEQ ID NO: 125528 - protein, 425 aa, Glycine max
  Coding DNA Sequence Number=SeqID_8750
  Gene Ontology: Mol. function=nucleoside transporter activity; Cellular component=membrane; Biological process=transport
  Homolog annotation: Hit_ID=Q4W6L4; Match level="QueryCoverage=90%, HitCoverage=92%, E-value=1e-134, Identity=60%"; Hit description =Equilibrative nucleoside transporter 1
  Pfam annotation: Domain name=MFS_1; Domain location=29-410; Score= -38.0; E_value=0.017; Accession=PF07690.6; Description=Major Facilitator Superfamily
  Pfam annotation: Domain name=Nucleoside_tran; Domain location=130 -414; Score=297.1; E_value=3.4e-86; Accession=PF01733.8; Description =Nucleoside transporter
  Pfam module annotation: Pfam domain module=MFS_1::Nucleoside_tran; Domain location=29-410::130-414
MALTESCLLLPSGSGRNKNRVPEDKWDMAYIVYFTLGLGYLLPWNAFITAVDYFSYLYPDASVDRIFAVVYMLIGLVGISLIIFYSHKSNAYVRINVGLALFVVSLLIIPLLDAFYLKGRVGLYSGFYVTAAAVGLSAVADALVQGSIVGCAGELPERYMQAVVAGTAGSGVLVSALRIFTKAVYPQDASGLQKSANLYFSVSIVIVFVCMVFYNMVHKLPVMKYYKELKVEAVTANEDNGPLTGAVWRSTVWNIVGRIKWYGFGIVLIYIVTLAIFPGYITEDVHSQILKDWYPILLIAGYNVFDLVGKCLTAVYLLQNAKVAIGGCIARLLFFPLFLGCLHGPKFFRTEIPVTILTCLLGLTNGYLTSVLMILIPKIVKLQHAETAGILGFGSSDQAVCLNLGTLVRVLWLHSIRSQNWDEFP

SEQ ID NO: 125529 - protein, 876 aa, Glycine max
  Coding DNA Sequence Number=SeqID_8751
  Gene Ontology: Mol. function=ATP-dependent helicase activity; Cellular component=nucleus; Biological process=ER to Golgi vesicle -mediated transport
  Homolog annotation: Hit_ID=Q94LY4; Match level="QueryCoverage=94%, HitCoverage=84%, E-value=0.0, Identity=51%"; Hit description=Sec31p
  Pfam annotation: Domain name=WD40; Domain location=30-69; Score=8.8; E_value=3.4; Accession=PF00400.22; Description=WD domain, G-beta repeat
  Pfam annotation: Domain name=WD40; Domain location=74-113; Score =10.1; E_value=2.4; Accession=PF00400.22; Description=WD domain, G -beta repeat
  Pfam module annotation: Pfam domain module=WD40::WD40; Domain location=30-69::74-113
MLPTVPELDNLPENRFCYLCYALPSLKLCFLALAFAPSIMYCVIAMSWCPNDSSYLLTCGKDSRTICWDMISGEVIAYELPAGTNWNFDVHWYPRIPGVISASSFDGKIGIYNIKGCRQNGIGENDFGAVPLRAPKWYKRPTGVSFGFGGKLVSFHPRASAAGSPAGASEVYVHNLVTENGLVSRSSEFEAAIQNGERSEEERETWGFLKVMLEDDGTARTKLLSHLGFNVPSEAKDTVNDDLSQEVNALGLEDTTVDNVGHVATNETTIFSTDNGEDFFNNLPSPKADTPVSTSAGNFAVVENANGSEKIQDDVEVEESSDPSFDDSVQHALVVGDYKGAVMQCISANKWADALVIAHVGNASLWESTRDQYLKMVRSPYLKIVSAMVSNDLLSLVNTRPLKFWKETLALLCSFAQRDEWTMLCDTLASKLMGAGNTLAATLCYICAGNIDKTVEIWSRSLSNETEGKSYVDLLQDLMEKTIVLALATGQKRFSASLCKLVEKYAEILASQGLLTTAMEYLKLLGSEELSPELTILKDRIALSTEPEKDFKTTAFESSQSHSGSYYGADNSNYNSNYYQEPVTTQVQHGVSGIQYPDSYQQPFDPRYGRGYGAPTPPQQPQQPNLFVPPQTTQVVQTPQPTFSNTAVAPPPLRTFDPQTPPMLRNVEQYQQPTLGSQLYNTTNPPYQPTPPVPSQVALSHGQNLSQVVAPTPNPMGYMPVSGSGGVQRPGVGSIQPPSPPQVQPVQPPAAPPPTLQTADTSKVPGHQMPIVTTLTRLFNETSDALGGSRANPAKRREIEDNSKRLGGLFAKLNSGDISKNASDKLLQLCQALDNGDFGTALQIQVLLTTTEWDECQSWLGSLKRMIKTRQSARLG

SEQ ID NO: 125530 - protein, 121 aa, Glycine max
  Coding DNA Sequence Number=SeqID_8752
MDKSLKVGEDEWRERERGEQNFEREKRENEATTRDGVVEDPLTAVEEFNEEQQQPPIEEGVTDVEGFLGGPNDISILRDFKNHELPELKLSSHGRKMTKFGRLALEIEGLVTASGLSPLIA

SEQ ID NO: 125531 - protein, 71 aa, Glycine max
  Coding DNA Sequence Number=SeqID_8753
  Gene Ontology: Cellular component=nucleus
  Homolog annotation: Hit_ID=Q94LY4; Match level="QueryCoverage=92%, HitCoverage=6%, E-value=3e-24, Identity=70%"; Hit description=Sec31p
VWDLKKQKPVISFADSVRRRCSVLQWNPDVATQLVVASDEDSSPSLRLWDMRNTISPIKEFVGHTRGNDSC

SEQ ID NO: 125532 - protein, 202 aa, Glycine max
  Coding DNA Sequence Number=SeqID_8754
  Homolog annotation: Hit_ID=Q5XM22; Match level="QueryCoverage=57%, HitCoverage=89%, E-value=3e-24, Identity=39%"; Hit description =Resistance-like protein HAAS-2
MASLLYLSIIGVFHSFEQLHVDDAVDMLVELLEVSTAEARAETIQCHGSYVRLSWLQDVYQTKIDACHWIVAVRAYLLHMLGCTLFANKSTTHVHVVFLNALRDLMQSGTYAWGAAALVHMYDNLNECWIYELFPSVGSAIAAEDYDERISGACRWTSGKALPVSMYHRHLNKLALDVAQPGDPPRISSIQQYDTFVEPDVP

SEQ ID NO: 125533 - protein, 211 aa, Glycine max
  Coding DNA Sequence Number=SeqID_8755
  Homolog annotation: Hit_ID=P49208; Match level="QueryCoverage=48%, HitCoverage=49%, E-value=3e-36, Identity=76%"; Hit description=50S ribosomal protein L1, chloroplast precursor
  Pfam annotation: Domain name=Ribosomal_L1; Domain location=119-211; Score=-51.5; E_value=6.2e-06; Accession=PF00687.11; Description =Ribosomal protein L1pL10e family
  Subcellular localization annotation: CTP_CleavageSite=3; ConfidenceScore=5.03e-01
MASCSAPPSLMLVHPQDLSRSQRTTFSLYPLLFKPSKCLHIEPKSRTCHALVAALAAEVQVPLTVHDTEEDDGSDGSTATSAATTTTTTTKPKKGKAALPLKRDRTRSKRFLEIQQLRERKKEYDLKTAISLVKETAKTKFVETVEAHFRLNIDPKYNDQQLRATVNLPKGTGKPVKVAVLTQGKVLIYMNLCGTAQIGSHIILDSEFLSN

SEQ ID NO: 125534 - protein, 525 aa, Glycine max
  Coding DNA Sequence Number=SeqID_8756
  Gene Ontology: Mol. function=serine carboxypeptidase activity; Cellular component=cellulose and pectin-containing cell wall; Biological process=proteolysis
  Homolog annotation: Hit_ID=Q9FEU4; Match level="QueryCoverage=95%, HitCoverage=96%, E-value=0.0, Identity=69%"; Hit description =Putative serine carboxypeptidase precursor
  Pfam annotation: Domain name=Peptidase_S10; Domain location=79-514; Score=673.9; E_value=1.2e-199; Accession=PF00450.12; Description =Serine carboxypeptidase
MGKASSTCALLSLLILSLFVAEIYGNRQVQALNKLHKSTKFRGNSQIDRSEFEVEELVYDDIAHSQEGLKEKDRIESLPGQPPVSFSQYGGYVTVDKVAGRAFYYYFVEAQRSKQTLPLLLWLNGENGSILVLSADHKPVASVIAGPGCSSLGYGAMQELGPFRVNSDGKTLHRNIFSWNKVANVLFLESPAGVGFSYSNKSKDYDNNGDKKTAADNYLFLVNWLERYPEYKDRDFYIAGESYAGHYVPQLAHTILYHNKKANKKIINLKGILIGNAVINEETDSDGLYDYLASHAIISDKAAYLNKACQSSSSKIQESVCDAAGDEVGDDIEYIDLYNIYAPLCKNANLTSLPKRNSIVTDPCSEYYVYAYLNRKDVQEALHANVTNLKHDWEPCSDVITKWVDQASTVLPLLHEFLNNSLRVWIFSGDTDGRVPITSTKYSVKKMNLPIKTAWHPWFSYGEHNKAFGVTQVGGYVEIYKGGLRLATVREAGHQVPSYQPARALTLIKYFLDGTPLPGPPKRKD

SEQ ID NO: 125535 - protein, 547 aa, Glycine max
  Coding DNA Sequence Number=SeqID_8757
  Gene Ontology: Mol. function=metal ion binding; Cellular component =intracellular; Biological process=thiamin biosynthetic process
  Homolog annotation: Hit_ID=Q2QU89; Match level="QueryCoverage=89%, HitCoverage=65%, E-value=1e-123, Identity=46%"; Hit description =Pentatricopeptide, putative, expressed
  Pfam annotation: Domain name=PPR; Domain location=105-139; Score =11.3; E_value=0.35; Accession=PF01535.11; Description=PPR repeat
  Pfam annotation: Domain name=PPR; Domain location=171-205; Score =42.9; E_value=1.1e-09; Accession=PF01535.11; Description=PPR repeat
  Pfam annotation: Domain name=PPR; Domain location=273-307; Score =41.1; E_value=3.9e-09; Accession=PF01535.11; Description=PPR repeat
  Pfam annotation: Domain name=PPR; Domain location=308-342; Score=0.6; E_value=6.4; Accession=PF01535.11; Description=PPR repeat
  Pfam annotation: Domain name=PPR; Domain location=346-380; Score=2.2; E_value=4.1; Accession=PF01535.11; Description=PPR repeat
  Pfam annotation: Domain name=PPR; Domain location=70-104; Score=3.5; E_value=2.8; Accession=PF01535.11; Description=PPR repeat
  Pfam module annotation: Pfam domain module=PPR::PPR::PPR::PPR::PPR::PP R; Domain location=105-139::171-205::273-307::308-342::346-380::70-104
MASQCQLDSLLQKCTSLIRMKQLQAHLITTGKFQFHPSRTKFLELCSISPAGDLSFAAQIFRLIETPSTNDWNAVLRGLAQSPEPTQALSWYRAMSRGPQKVDALTCSFALKGCARALAFSEATQIHSQLLRFGFEVDILLLTTLLDVYAKTGDLDAAQKVFDNMCKRDIASWNAMISGLAQGSRPNEAIALFNRMKDEGWRPNEVTVLGALSACSQLGALKHGQIIHAYVVDEKLDTNVIVCNAVIDMYAKCGFVDKAYSVFVSMSCNKSLITWNTMIMAFAMNGDGCKALEFLDQMALDGVNPDAVSYLAALCACNHAGLVEDGVRIREACDIINSMPMVPDVVLWQSLLGACKTHGNVEMAEKASRKLVEMGSNSCGDFVLLSNVYAAQQRWHDVGRVREAMKIRDVRKVPGFSYTTEIDGKIHKFVNGDQSHPNSKEIYAKLDEIKFRARAYGYAAETNLVLHDIGEEDKENVLNYHSEKLAVAYGAGELATVVYLFQIITLLGIEIDLCLSKVRHELDDPGIMAFLLDPLKLMTTQQHSSHY

SEQ ID NO: 125536 - protein, 124 aa, Glycine max
  Coding DNA Sequence Number=SeqID_8758
  Subcellular localization annotation: CTP_CleavageSite=36; ConfidenceScore=5.24e-01
MTQKANLFKGKAKKKSIPPNRHGKVPVTRKGKRFVKPSKVTKDMDTDREVSKFINHCNEIKAATLATKDGGQLGIIKPPQEPAIVIVDCSISEVTEEALFYQFNKSDYVNFRFTYYMMLGLYTR

SEQ ID NO: 125537 - protein, 683 aa, Glycine max
  Coding DNA Sequence Number=SeqID_8759
  Gene Ontology: Mol. function=pepsin A activity; Cellular component =cellulose and pectin-containing cell wall; Biological process =proteolysis
  Homolog annotation: Hit_ID=Q6QJL5; Match level="QueryCoverage=62%, HitCoverage=92%, E-value=4e-96, Identity=46%"; Hit description =Aspartic protease
  Pfam annotation: Domain name=Asp; Domain location=85-455; Score= -125.1; E_value=3.2e-06; Accession=PF00026.14; Description=Eukaryotic aspartyl protease
  Subcellular localization annotation: CTP_CleavageSite=61; ConfidenceScore=5.58e-01
MPSSHILFSLLSFLSIIITTFSSSTPNTITLHLSPLFTNHPSSSSHPFHTLKLAVSTSITRAHHLKNHKPNKSLETPVHPKTYGGYSIDLEFGTPSQTFPFVLDTGSTLVWLPCSSHYLCSKCNSFSNTPKFIPKNSSSSKFVGCTNPKCAWVFGPDVKSHCCRQDKAAFNNCSQTCPAYTVQYGLGSTAGFLLSENLNFPTKKYSDFLLGCSVVSVYQPAGIAGFGRGEESLPSQMNLTRFSYCLLSHQFDDSATITSNLVLETASSRDGKTNGVSYTPFLKNPTTKKNPAFGAYYYITLKRIVVGEKRVRVPRRLLEPNVDGDGGFIVDSGSTFTFMERPIFDLVAQEFAKQVSYTRAREAEKQFGLSPCFVLAGGAETASFPELRFEFRGGAKMRLPVANYFSLVGKGDVACLTIVSDDVAGSGGTVGPAVILGNYQQQNFYVEYDLENESKEVDDEPNVDDRDYDDDNGNGYVEELAIGRLKFFHFRLCKSFLWGDTTDERRAHWICWERICSPKEIGDLGLRQACHVNDAFMMKVAWELCSKNDALYQISVWDKFVTGCEGNVEDDELIWRDSDKGVLDIPSAYRMIANLDGRQIIPIFNLMTLKFLCPLSKKEPEPMMHCLRDCEELGDELYKAGGYNHHHTEASMLRWRPPNLGFVCLNVGGAWTVHGPKAACGGC

SEQ ID NO: 125538 - protein, 116 aa, Glycine max
  Coding DNA Sequence Number=SeqID_8760
  Gene Ontology: Mol. function=oxidoreductase activity, acting on single donors with incorporation of molecular oxygen, incorporation of two atoms of oxygen
  Homolog annotation: Hit_ID=Q9SKM8; Match level="QueryCoverage=94%, HitCoverage=61%, E-value=4e-30, Identity=74%"; Hit description =Expressed protein
MQKQEVSLDFYTKVLGFVLIERPQALDFEGAWLFNYGVGIHLVQSKQEDQNLPSDTEHLDPQDNHISFQRESGSNGEKVEGEGSEVHEKDSGGRRWIKFSSMTQMGSWWKYATARI

SEQ ID NO: 125539 - protein, 688 aa, Glycine max
  Coding DNA Sequence Number=SeqID_8761
  Gene Ontology: Mol. function=catalytic activity; Cellular component =cytoplasm; Biological process=positive regulation of protein modification
  Homolog annotation: Hit_ID=Q9FJ46; Match level="QueryCoverage=98%, HitCoverage=97%, E-value=0.0, Identity=62%"; Hit description =Ubiquitin activating enzyme E1-like protein
  Pfam annotation: Domain name=Shikimate_DH; Domain location=348-477; Score=-26.6; E_value=0.068; Accession=PF01488.10; Description =Shikimate  quinate 5-dehydrogenase
  Pfam annotation: Domain name=ThiF; Domain location=353-507; Score =106.0; E_value=1.1e-28; Accession=PF00899.11; Description=ThiF family
  Pfam module annotation: Pfam domain module=Shikimate_DH::ThiF; Domain location=348-477::353-507
MEALLQFAPMQSSVDEGFWHRLSSLKLNKLGIDHSPIPLFGFYAPCSHSQVSNHLTVLAESLPSELSEASLIPEPSRGNRNRCSVPGILYNTNTVESFHALDKSDLLKKEAAKIWDDILTGKAVEDCSVLSTFLVISFADLKKWTFNYWFAFPALMLDPPATVVNLKPASQWFSAAEAESLSAACNEWRSSKSKTVTIDPNSRATVRLLKDWEACQSNAHKVSYFTLTLILFGFYDPCHLPNNPGWPLRNFLALISARWNLNSVQFFCYRENRGFADMRLSLVGEALITVPQGWKDTVPSAVGWELNKGRKAPRCISLAQSMDPTRLAISAADLNLKLMRWRALPSLNLNALSSMKCLLLGAGTLGCQVARMLMAWGVRKITLVDNGRVAMSNPLRQSLYTLDDCLNGGEFKATAAVESLKRIFPAVEAEGIVMAIPMPGHPVQSQEQDSVLDDCKRLCDLIDAHDSVFLLTDTRESRWLPTLLCANTNKITVTAALGFDSFLVMRHGAGPLSADMPVNNANGKHRLGCYFCNDVVAPTDSTSNRTLDQQCTVTRPGLAPIASALAVELLVGILHHPQGIFAEGDINNSVTGATEQPLGILPHQIRGSLSQFSQMTLIGYSSSSCTACSHTVVSEYRNQGMEFILQAINYPTFLEDVTGLTELMKSATSLSLDWDKEIDEEEDCVEIQ

SEQ ID NO: 125540 - protein, 169 aa, Glycine max
  Coding DNA Sequence Number=SeqID_8762
  Gene Ontology: Mol. function=structural constituent of ribosome; Cellular component=chloroplast thylakoid membrane; Biological process=translation
  Homolog annotation: Hit_ID=Q9LY66; Match level="QueryCoverage=87%, HitCoverage=41%, E-value=9e-63, Identity=80%"; Hit description=50S ribosomal protein L1, chloroplast precursor
  Pfam annotation: Domain name=Ribosomal_L1; Domain location=1-148; Score=181.2; E_value=2.6e-51; Accession=PF00687.11; Description =Ribosomal protein L1pL10e family
EKFDEAKNAGADLVGGEDLIEQIKAGFMEFDKLIASPDMMPKIYRPDNFSVASLGKILGPRGLMPNPKAGTVTPNIPQAIAEFKQGKVEYRADKTGIVHLPFGKADFPEEDLLVNLLAAVKSVEANKPSGAKGVYWKSAHICSAMGPSIRYFTLQPPVFIVLNTIAMAE

SEQ ID NO: 125541 - protein, 451 aa, Glycine max
  Coding DNA Sequence Number=SeqID_8763
  Gene Ontology: Mol. function=chromatin binding; Cellular component =chromatin; Biological process=chromatin assembly or disassembly
  Homolog annotation: Hit_ID=Q1SAV4; Match level="QueryCoverage=85%, HitCoverage=98%, E-value=1e-118, Identity=53%"; Hit description =Integrase, catalytic region
  Pfam annotation: Domain name=Chromo; Domain location=351-397; Score =14.6; E_value=0.018; Accession=PF00385.14; Description='chromo' (CHRromatin Organisation MOdifier
  Pfam annotation: Domain name=rve; Domain location=45-201; Score =105.9; E_value=1.2e-28; Accession=PF00665.16; Description=Integrase core domain
  Pfam module annotation: Pfam domain module=Chromo::rve; Domain location=351-397::45-201
MSESHNGASHTHLDDVKRFVANCVDCQVTKYETQKVAGLLCPLPVPSRPWEDLSLDFIIGLPAYQGHTTILVIVDRFSKGVHLGTLPTAHTAHMVATLFINNVVMLHGIPRSLVSDRDPLFVSKFWRELFKASGTQLRMSSAYHSQSDGQTEALNRVIEQYLRAFVHRRPGLWGKLLPWVEWSHNSSWNASTGSTPYEITFGRKPFTFPAYITGSSNLDAVDQMMVDRDETFQLIRRKLLKAQATMKKHADVHRREVTYKEGDWVLLKLKPHRQSTVKGSPNTTGKLTKRFFGPFQVLQRIGPVAYKLQLQETSQIHPVFHCSMMKPFRGPPDQLPKLELPTDSDEDSSVVFPLAILDYRRASQDAPWQVLVQWRGLSPDDTSWEDWPTLCSTYHLEDKVVFQGVKDVTNPESENTSTKAEHEGNIAKQEVQVEVRPKRRIVKPSHLNDYV

SEQ ID NO: 125542 - protein, 331 aa, Glycine max
  Coding DNA Sequence Number=SeqID_8764
  Gene Ontology: Mol. function=GPI anchor binding; Cellular component =anchored to membrane
  Homolog annotation: Hit_ID=Q336X8; Match level="QueryCoverage=90%, HitCoverage=61%, E-value=2e-77, Identity=52%"; Hit description =Expressed protein
MGCSQDANFYKGSLCCQLILFFIWLPTFQDVTAREIHADHRRISSLLELAKEPPSGESALFDPIEISPAVLPKFPYPTESWPPMYPTFPTRYEPVLTGKCPVNFSHSDISSILDKTASDCSGPLAALVGNVICCPQFSSLIHIFQGFFSMKSDHLVLPNAVADHCFSDIISILASRGANSTIPTLCSIKSSNFTGGSCPVKDDSTFEKTVNTSKLLEACSTVDPLKECCRPVCQPAIMDAALQISGRQMMINNDENMAGEVNHTDYLNDCKSVVYSYLSKKLSFEAANTAFRILSACKVNKGILFNCFILNVIYFKFREVVSGMANHLIRE

SEQ ID NO: 125543 - protein, 130 aa, Glycine max
  Coding DNA Sequence Number=SeqID_8765
  Gene Ontology: Mol. function=GPI anchor binding; Cellular component =anchored to membrane
  Homolog annotation: Hit_ID=Q336X8; Match level="QueryCoverage=82%, HitCoverage=24%, E-value=9e-20, Identity=47%"; Hit description =Expressed protein
MLRGGGVMTNIYELCDVDLKDFSIQGCLLRSLPGDVIFDNSSGFSFTCDLSDNIAAPWPSSSSSFASMSLCAPEMSLPALPTSSQTLKNNGCTSDGVGLLVLIFSSFIFSTLLQADARLAAKVYYGSNRD

SEQ ID NO: 125544 - protein, 83 aa, Glycine max
  Coding DNA Sequence Number=SeqID_8766
  Gene Ontology: Mol. function=tRNA binding
  Homolog annotation: Hit_ID=Q01CQ8; Match level="QueryCoverage=66%, HitCoverage=20%, E-value=2e-12, Identity=66%"; Hit description=[J] KOG2241 tRNA-binding protein
  Pfam annotation: Domain name=tRNA_bind; Domain location=5-58; Score =14.9; E_value=6.5e-06; Accession=PF01588.10; Description=Putative tRNA binding domain
MSYISFKKKGKKVIVLSNLKPRNMRGVKSCGMLMAASDAKHENVELLFPPEEATPGERIWFGTEDEKDNQPDAATPNQAIALP

SEQ ID NO: 125545 - protein, 414 aa, Glycine max
  Coding DNA Sequence Number=SeqID_8767
  Gene Ontology: Mol. function=RNA-directed DNA polymerase activity; Biological process=RNA-dependent DNA replication
MHWERVGLSREGVGRREREEFNIFVSDMELEDIAIVGRRFTWYRPNERAKSKTNRVLLPREWLNTWLKNKQHILNRRILGHCAVLLKDDSIDWGPKPFKTLDCWLEDRRFGAFVKETWGVEIQGYGAYVLKEKLKLLKLKAWNKNQFGNIQKRQKLIEEEMNCLDKKEEEDKFWTSWLMMKRLSALNYKRNYGWLWAINWRRKKYSLKGLRVKEPVGVKEKVKRFFCEKYSEDMRKLRRRFRIVFYEHGVLPRRSNSSFISLIPKVENLLHLREFRPISIVGVMYKIPAKRLAKLLPKIIDERKNTFLRGRFLLHSALVANEVIEEVKRKNSTCLIFKVDCEKAYDSVNWEFLVYMLRRLGFCHKWVMWIRECLATSFVSSLVNGSPTSEVKLEKDLRQGDPLAQFLTTIKAMG

SEQ ID NO: 125546 - protein, 234 aa, Glycine max
  Coding DNA Sequence Number=SeqID_8768
  Gene Ontology: Mol. function=methyltransferase activity; Cellular component=mitochondrial outer membrane; Biological process=metabolic process
  Homolog annotation: Hit_ID=Q43445; Match level="QueryCoverage=87%, HitCoverage=60%, E-value=1e-94, Identity=74%"; Hit description=S -adenosyl-L-methionine:delta24-sterol-C- methyltransferase
  Pfam annotation: Domain name=Methyltransf_11; Domain location=17-91; Score=48.0; E_value=3.1e-11; Accession=PF08241.2; Description =Methyltransferase domain
  Pfam annotation: Domain name=Sterol_MT_C; Domain location=100-229; Score=267.2; E_value=3.2e-77; Accession=PF08498.1; Description =Sterol methyltransferase C-terminal
  Pfam module annotation: Pfam domain module=Methyltransf_11::Sterol_MT_ C; Domain location=17-91::100-229
MNCNINIPMIPTTKYGIECLFCNLCSSTSITGLNNNEYQITRAKADFMKMPFPDNNFDAVYAIEATCHAPDVYACYKEIFRVLKPGQLFAAYEWCMTEAFDPNNEEHQKIKEEIEVGDGLPDIRLTTKCVEALKQAGFEVIWEKDLAVNSPVPWYFHLDASHFSLSTFPLTSIGRFFTRSLIRALEFVRLAPRGSLKVQEILQRAADGLLEGGKKEIFTPMYFFLARKPNFGGQ

SEQ ID NO: 125547 - protein, 298 aa, Glycine max
  Coding DNA Sequence Number=SeqID_8769
  Gene Ontology: Mol. function=methyltransferase activity; Cellular component=mitochondrial outer membrane; Biological process=metabolic process
  Homolog annotation: Hit_ID=Q43445; Match level="QueryCoverage=98%, HitCoverage=91%, E-value=1e-151, Identity=78%"; Hit description=S -adenosyl-L-methionine:delta24-sterol-C- methyltransferase
  Pfam annotation: Domain name=CMAS; Domain location=36-292; Score= -157.7; E_value=0.0002; Accession=PF02353.10; Description =Cyclopropane-fatty-acyl-phospholipid synthase
  Pfam annotation: Domain name=Methyltransf_11; Domain location=99-197; Score=104.2; E_value=4e-28; Accession=PF08241.2; Description =Methyltransferase domain
  Pfam annotation: Domain name=Methyltransf_12; Domain location=99-195; Score=38.8; E_value=1.8e-08; Accession=PF08242.2; Description =Methyltransferase domain
  Pfam annotation: Domain name=Sterol_MT_C; Domain location=206-293; Score=139.5; E_value=8.9e-39; Accession=PF08498.1; Description =Sterol methyltransferase C-terminal
  Pfam annotation: Domain name=Ubie_methyltran; Domain location=34-257; Score=-113.6; E_value=0.00039; Accession=PF01209.9; Description =ubiECOQ5 methyltransferase family
  Pfam module annotation: Pfam domain module=CMAS::Methyltransf _11::Methyltransf_12::Sterol_MT_C::Ubie_methyltran; Domain location =36-292::99-197::99-195::206-293::34-257
MNLASGVGGKIEKSQILSAVEKYEKYHVCHGGQEEERKANYTDMVNKYYDLSTSFYEFGWGQSFHFAHRWKGESLQESIKRHEHFLALQLGLKPGQKVLDVGCGIGGPLREISRFSSTSVTGLNNNEYQITRGEALNRIAGVDKTCNFVKADFMKMPFQDNSFDAVYAIEATCHAPDAYGCYKEIFRVLKPGQYFAAYEWCMTDAFDPNNEEHQRIKAEIEIGDGLPDIRLTTKCAEALKQAGFEVKGLEYVGFAPKGSLRVQEFLEKAADGLVEGGKKEIFTPMYFFLARKPESSDY

SEQ ID NO: 125548 - protein, 52 aa, Glycine max
  Coding DNA Sequence Number=SeqID_8770
PRRQIEAATASRVQEHEARDVAPMKLAGKKLFAVMQLFTFGYSWRLRIMLPH

SEQ ID NO: 125549 - protein, 181 aa, Glycine max
  Coding DNA Sequence Number=SeqID_8771
  Homolog annotation: Hit_ID=Q1SMF0; Match level="QueryCoverage=54%, HitCoverage=19%, E-value=4e-11, Identity=38%"; Hit description =Tetratricopeptide-like helical
MRWTKNNGCIIVSCLKKLICIENEKDAGVKIEHVDCFDAFNTSQLFATRDKVLCWARSVAHEIGFVAVIMRSDTNIGVRGRASFLLIACERSGEYRPKKNDLVRTCTSSRKCECPFKLRAKAILGGEGWMEMKGGGCTTARLGELRLPRRAGYFSPKLSGGLGEPEASLGEPEASLGEPGA

SEQ ID NO: 125550 - protein, 167 aa, Glycine max
  Coding DNA Sequence Number=SeqID_8772
MAFLGETSSQTIVNSRLAFIFPNGSIIHNESGVYFQSSTPIPIRVPNDYGFETLKSKIHDTLQLTNDQYLDEIYYRQSFVDIGNQFAFWSMQLKNDDDVNTITPDDILNLLQATMTPTHDALLYYNGRWNMSCQDDFVGYSFTGKNPKRFNIPSECSIDGLKDVIKQ

SEQ ID NO: 125551 - protein, 69 aa, Glycine max
  Coding DNA Sequence Number=SeqID_8773
MNIVFGMKSNLSLDAWDKPMLEGQEKTRFCYKSDALNETPTQIRPSYCYNNCAQLERLLYCFLESGLGD

SEQ ID NO: 125552 - protein, 82 aa, Glycine max
  Coding DNA Sequence Number=SeqID_8774
MGIRWSNSQRAPSRPGGPLDGANGRPGRCGEDGGRGGHGEDSILEKGKKDPCNNHEHETSERRDVKGPAGLQWCRDNHEIIN

SEQ ID NO: 125553 - protein, 330 aa, Glycine max
  Coding DNA Sequence Number=SeqID_8775
  Gene Ontology: Mol. function=nutrient reservoir activity; Cellular component=cellulose and pectin-containing cell wall
  Homolog annotation: Hit_ID=Q43557; Match level="QueryCoverage=87%, HitCoverage=88%, E-value=3e-84, Identity=48%"; Hit description =Unidentified precursor
  Pfam annotation: Domain name=DUF642; Domain location=46-330; Score =517.0; E_value=2.1e-152; Accession=PF04862.3; Description=Protein of unknown function, DUF642
MSETFIFTLSLVMLCAASAFAAVPHRLPEVYLKNGNFEEKPNPKYLKKTRLIGKYALPKWEISGHVEYISGGPQPGGASRTCAQDELLRISVPPQSGDVPLRTLYSLNGDVIAWGFRPTSSVAKVILHNPGIQEDPACGPLLDAVAIAEFCSPKPARANFVKNPGFEEGPFPIFNSTNGVLLPPEQEDHVSPLPGWMIESLKAVKFIDAKHFDVPFGQGAVELIGGRESVIAQILRTVPNKVYNMKLTIGDARNGCHGSMMVEAFVAKDTLKVPFKSEGKGKFKTVSFKFRAIENRTRITFYSSFYHTRIHDYGSLCGPVIDQVIVYPVA

SEQ ID NO: 125554 - protein, 533 aa, Glycine max
  Coding DNA Sequence Number=SeqID_8776
  Gene Ontology: Mol. function=transporter activity; Cellular component= membrane; Biological process=transport
  Homolog annotation: Hit_ID=Q9FM07; Match level="QueryCoverage=99%, HitCoverage=100%, E-value=0.0, Identity=80%"; Hit description =Permease 1
  Pfam annotation: Domain name=Xan_ur_permease; Domain location=38-445; Score=172.7; E_value=9.4e-49; Accession=PF00860.11; Description =Permease family
MAGGGAAPQPKQDEHQPHPVKDQLPNVSFCITSPPPWPEAILLGFQHYLVMLGTTVLIPSSLVPQMGGGNEEKAKVIQTLLFVAGINTFFQTFFGTRLPAVIGGSYTFVPTTISIVLAGRYSDVVNPQEKFERIMRGTQGALIVASTLQIVLGFSGLWRNVVRFLSPLSAVPLVALSGFGLYELGFPVLAKCVEIGLPEIIILVVFSQYIPHMMKGERPIFDRFAVIFSVAIVWIYAHLLTVGGAYRNSAPKTQITCRTDRAGIIGGAPWIRIPYPFQWGAPTFEAGEAFAMMAASFVALVESTGAFIAVSRYASATPIPPSVLSRGVGWQGVGVLLSGIFGTGNGSSVSVENAGLLALTRVGSRRVVQISAGFMIFFSILGKFGAVFASIPAPIVAALYCLFFAYVGSAGLSFLQFCNLNSFTTKFILGFSIFMGFSIPQYFNEYTAFKGYGPVHTRARWFNDMINVPFQSEAFVAGMLALLLDVTLRKKDNQTRKDRGMHWWDRFRSFKTDTRSEEFYSLPFNLNKFFPSV

SEQ ID NO: 125555 - protein, 115 aa, Glycine max
  Coding DNA Sequence Number=SeqID_8777
  Homolog annotation: Hit_ID=Q6IM91; Match level="QueryCoverage=34%, HitCoverage=72%, E-value=6e-10, Identity=67%"; Hit description=DVL10
MGEGELANSHAVVIDLQCVVILHFPTPLFVVGCGKSNNVTPRVGAHMDKDRNFDALIAETQVRVKGLIGNSVVVPAEEHGYAASEDVEARLLLLCNQIASFSKACFPARLGESHA

SEQ ID NO: 125556 - protein, 78 aa, Glycine max
  Coding DNA Sequence Number=SeqID_8778
  Subcellular localization annotation: CTP_CleavageSite=32; ConfidenceScore=5.26e-01
MWKNDENSGNGKKLKAPSKKNKMNRTSPRETTCQQRNAMQLVLGRFLGPRPTPHGGQENVKKECEDVEEKEKERASSS

SEQ ID NO: 125557 - protein, 170 aa, Glycine max
  Coding DNA Sequence Number=SeqID_8779
  Homolog annotation: Hit_ID=O65060; Match level="QueryCoverage=91%, HitCoverage=80%, E-value=7e-47, Identity=52%"; Hit description =Hypothetical protein Sb26
  Pfam annotation: Domain name=2OG-FeII_Oxy; Domain location=1-113; Score=10.7; E_value=0.011; Accession=PF03171.10; Description=2OG -Fe(II) oxygenase superfamily
MMFNRVPDGNSLSSWCGWHTDHGSLTGLTCSMFTRDGVEIACPDSAAGLYIRTRNNQIVKVVYGKDDIAYQIGETTEILSGGYLCATPHCVQAPKGEESSGIERSTFALFMQPDWDEKLNFPEEVHIHKEMIRPEPAASLVLKELIPSNAALTFGEYSEMLLDKYYHQKQ

SEQ ID NO: 125558 - protein, 59 aa, Glycine max
  Coding DNA Sequence Number=SeqID_8780
  Subcellular localization annotation: CTP_CleavageSite=38; ConfidenceScore=5.05e-01
MGMRMKLLFRGHRGIEGSPPLSVPFLIQRQPHTLTLSRQVTFSVMQLLPLSNFEFQFLT

SEQ ID NO: 125559 - protein, 145 aa, Glycine max
  Coding DNA Sequence Number=SeqID_8781
MRPRMTINFDCRCAIIGKTTFGQISLAKTGKHRKRNIQRLNQTKPNSNKIFKKLSTKLQETTHPDLSENQKFSLLKLELKKPTKSQRTKTSDCSGNVRIRSLRRARERKFAVKLGRREFSLHVRSQHSDSRWGNMIERKEENSEK

SEQ ID NO: 125560 - protein, 66 aa, Glycine max
  Coding DNA Sequence Number=SeqID_8782
MKKMFKSWKCVSKVSWILMVHRGQGMLDAILPPRTLDKRLQENWAKDVREDLRILVNLRVDFEPMG

SEQ ID NO: 125561 - protein, 894 aa, Glycine max
  Coding DNA Sequence Number=SeqID_8783
  Gene Ontology: Cellular component=nucleus; Biological process =regulation of progression through cell cycle
  Homolog annotation: Hit_ID=Q6YXW5; Match level="QueryCoverage=99%, HitCoverage=98%, E-value=1e-154, Identity=35%"; Hit description =Cyclin-like protein
MSVISRNIWPVCGSLCCFCPALRERSRHPIKRYKKLLADIFPRTPDEEPNERMISKLCEYASKNPLRVPKAYSSLVDEKNMIGREDPTKGGQLDFPVKINHQQSQPLFASSLLSIIQILLDQPRQDEVQILGCQTLFDFVNNQRDGTYMFNLDGFILKLCNLAQEMGDDAKVQLLRAAGLQVLSSMVWFMGEFTHISAEFDNVVSVVLENYGDVKQDSQNENAMRLYSWRVVVNDRGEVNVPVDNATNPGFWSRVCIQNMAKLAKEGTTVRRVLESLFRYFDDTNRWSPEHGLALSVLLNMQSIIENSGHNTHLLLSILVKHLDHKNVLKNPKMQLDIVGVITHLAQQTRSQQSVAIIGPVIDTMAVLLENMSNITVMARTLIAAAFPEALFHQLLLAMVHADHETRVGAHRIFSVVLVPSSVCPQPSSSGTPMTKAAGIQRMLSRNVSVFSSSSALFEKLERKQNSLSEDSHTDGNVNDNSILNRLKSTYSRTTSTRKSAMISAESTDNKNSKVHNSSMMNRLKSSYSRATSAKKPQIPTTVEENTTNTSNKQQVLPIRLSSHQINLLLSSIWAQSIYPLNTSENFEAIAHTYSLVLLVARSKVDPFLQLVNDSKLQAVIDTDRQPSKVYGSKEDDEDALKALSAIRLTENQSKESFATMIVQSLGKSSNESSILREQLLNDFSPDDACPLGAQLSAETTGNMYQSGLKEDKLPDMVDISLFTIDDDIPPCGLESQANSDPQQQPSQNLSLLSVDDILGSVSETTHQVGRISISTPFDMPYKEMALHCEALLMGKQQKMSTFMGTHPMQGYFSFRIPAPEYNQQKDESSNSSVQQTLPSSGNPFLDSNFDSNSYHTLPDTSPRLCATAYQHQAAFFQLPASRPYDNFLKAAGC

SEQ ID NO: 125562 - protein, 208 aa, Glycine max
  Coding DNA Sequence Number=SeqID_8784
  Homolog annotation: Hit_ID=Q00WL9; Match level="QueryCoverage=70%, HitCoverage=86%, E-value=1e-13, Identity=34%"; Hit description=[S] KOG4401 Uncharacterized conserved protein
MEGGNNSSSNNNPEELAVGCLLSIRTTLGDEFEGQVVTFDRPSNILVLQEPSKPSPRRNLRLLKANYIKDFTFLGHAQDPLDPNTCFLDLTALQQREDVAVRQAEADAERIGVGVTSEAQSIFDALSKTLPVRWDKTVIVVMNEVRVSSPYHSESVVGGTPAANDRVKKVLWSQLRLHLHFDQKNCKKLRANLDFERKRLQLRSSGGQ

SEQ ID NO: 125563 - protein, 304 aa, Glycine max
  Coding DNA Sequence Number=SeqID_8785
  Gene Ontology: Mol. function=solute:hydrogen antiporter activity; Cellular component=integral to membrane; Biological process =regulation of pH
  Homolog annotation: Hit_ID=Q2QLJ1; Match level="QueryCoverage=89%, HitCoverage=33%, E-value=5e-31, Identity=31%"; Hit description =Sodium/hydrogen exchanger family protein, expressed
MVVACNGAHFLLKHYSQPRVASDIMVGLIMGNIPFLRELYEEFNKTFGFIIDFGMMCYMFALGIEMDPYMLFKRPTKDAQVAYAAILCTFIICCSMTPLFRYFTHQHGLAFTLSLSALVSSTASPVLTRLITSLKIGKSDIGSLVIGAGMHSDFLCSLLLSVGYIFMPSDAYCIGTKKDKTLLTIITVSIVIVAQTMFTAVVSPVFMAWVNNENPEGKPMKGSHLILSIAFVVMICASSTLYDYSPVLSAFMTGICLPREGRVSKWVVSKINSLLTTIFFPVFFLWMGYVADITKFDPGDPTRG

SEQ ID NO: 125564 - protein, 890 aa, Glycine max
  Coding DNA Sequence Number=SeqID_8786
  Homolog annotation: Hit_ID=O04365; Match level="QueryCoverage=28%, HitCoverage=75%, E-value=3e-09, Identity=27%"; Hit description=Omega secalin
  Subcellular localization annotation: CTP_CleavageSite=54; ConfidenceScore=5.07e-01
MQHSQPQIQQPVQKYPVPQSQVHAQLQPNAPIQHHSQLPVPPHQPVTPNVQTPVQNAMSHSVTGHHSYPQPLPHPNMQPRVPQHTMHMHPQSGHQPQAQHPVQMQNQFPPQIPTARPNQSHAMFPNQQQPALLPSSVQGQTTPPLQQQSLYTHNQQPGQINQRPTLPPVQQIPQQPFAQHQMPMPSHLQPQGPAHSFPKHAYPQAQGNTAGRPLVPNYAGHLQPFAQSANTIPVRPGQNGAGYLPENQKLLVGANNQVQLPSELQSRAPESIERQGNVVEQQTDSASGKLGKVFKDLDNVSGSSNELKSEKVEADLQPTEVGNKQNSEDPDSLKTSVPNTNAVENGDSVNKNLGMAEAAESNWKPSSGATPGVQNDSNEHSVQGNEFQDGHLPKIETKLPLSETDKLHNDDNPEPSVSQSNGGFAKLSHSAAFTDQSKHQQPIINYGPPSVQQRSSAMLASQLPHPTVPNQPLSSVHSSTLIRNHGTAPALHSGQLLTENFPPTMLKQPQDSGIQFNNPGRSLQPQSLGPPPPFNQVHGPPFHAGASNLSRLGGPQLGAPLPGDMHGRMTANLPPHAPEGFGLQDERFKPLHALNQQNIERREFDDDLKKFSRLPLNSEPVSKFGNYSLGTHEAGKRPVGIHDDVIKKSGSALHPGYFGPGPGYARHHMDGIAPRSPVSEYAEMSSRRLGLHSGSLVGKSGIDDFDDRVARRFGEFRDSRFPHLPSHLRRDDFDGFGNFRMGEYPRSGDFVGQDEFAGHFRRGEHLGPHNFPRHLQHGEPIGFGAHPGHMRAVELDGFRSFESFSKGGRPGHPQLGEPGFRSSFSLTGFPNDAGFLTGDIRSFDNLRRKKASSMGWCRICKVDCETVEEPSMDEGNKTHNTGIEGRGNKH

SEQ ID NO: 125565 - protein, 833 aa, Glycine max
  Coding DNA Sequence Number=SeqID_8787
  Homolog annotation: Hit_ID=Q9FGV5; Match level="QueryCoverage=92%, HitCoverage=94%, E-value=4e-66, Identity=28%"; Hit description =Arabidopsis thaliana genomic DNA, chromosome 5, TAC clone:K16F13
MGTETVWNSQSNWNTVWGSIRDCITFQSDDDDDSESTPTPFLLHSPSPDSPPCEIKITFAEKHELRQIYVRSTARVYEIYYAPNSRTNNDYLSTVRCGFAVRDDQVLRFPSIQNLSDDNINKSEDDWVEVKVPDSPSQTKPYPNSAKTSVSQDLYEATAEINDANPCISVTLRLLSLQSKGRVYVDEIYVFADPVESADSESHIENSSSSSLMAMFLPSMQLSKTTELSNLNALRKENQHFPGDGLEVTLPSDSVIKTQLKGNTSITDPQEVKLNEVKGGWVGPSQPDALSEDARIESNHAAVPSQTDKMDNTFSVVPSKIAEMENNDTALPFQFAKTKCNCSAIPSQGSIPESNHGDCLGDNVERALEQLLSRMDRIEEICLGFQEKMVMPMSSIEARLQQVEQQLDTLTKKFQTSALPSCPRISALDASCIESDANSCENCPDYTVTRENESDEKNLHTEVPYVSALMSDSENTTQLLPGLVVTAPEFLDGEDEEGDASGQETNSSKDKGKQSTDDAICSALANFLFSFSLESPEYTKRLSVKAPEFSNEDDDDHESNSEIAKNDPVHLTESEEFSHIQVLASSYTLENSEKIDPDSNDKFSKKTAQESEENDQLYSAEGDQDEACVNTGCIDSFEEDKSGKINDQKSDISDELLDNQTPLGHSITEEGPSAGTELTVAAEVPRKTFHENIIENVLGFALASSVVDFENPILDVKFISQRSSTERFLEDLLVGTQDQKTSSSDQSLKESNDDLSVKEQLKSNGDVSVEEQSNLISIEDGELVIPASDSHFAVDKDLCTSSITASVNNEVDNLPLPEDHKRKRDQITGSSFI

SEQ ID NO: 125566 - protein, 60 aa, Glycine max
  Coding DNA Sequence Number=SeqID_8788
MIVDIIEDVNPRHLRPLIAEEDVNKAQDEFKNKEKEVCKAPLPAMEDKPKEDATKVMDNP

SEQ ID NO: 125567 - protein, 96 aa, Glycine max
  Coding DNA Sequence Number=SeqID_8789
MDDVHVDDVIVMMLFPDEWSRYILELSQQRGGSLHVLERVNDNAYKIDLPGQMLPKKEGMMKTLKLKIGTRTRWTNDWSQSQKGRGHPTTSCNNNC

SEQ ID NO: 125568 - protein, 225 aa, Glycine max
  Coding DNA Sequence Number=SeqID_8790
MTISTQHQAIKAIPTDAIVHLPHPWDPSQEVEPPKSEFQKKVHLWMPITKLLPVHPTDHNLTQEKCLSLGNLHAQMYARDQPTTYPPCLHISRATNVKIVVDKVCPCLPVWDAAKNKGFRKLGPSRTNSYGRTLRKRPLLVMMEGIMLSIVKSLKCYIQLRSITLMMLASTLQSMLTTTCLRSMPKEDVVVVAMKEDVASAQDEVYAKVMDDTIVRGVIIDLTNT

SEQ ID NO: 125569 - protein, 944 aa, Glycine max
  Coding DNA Sequence Number=SeqID_8791
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=97%, HitCoverage=96%, E-value=0.0, Identity=36%"; Hit description =Tyrosine protein kinase, active site
  Pfam annotation: Domain name=LRRNT_2; Domain location=26-69; Score =47.9; E_value=3.3e-11; Accession=PF08263.3; Description=Leucine rich repeat N-terminal domain
  Pfam annotation: Domain name=LRR_1; Domain location=122-144; Score =13.5; E_value=0.79; Accession=PF00560.23; Description=Leucine Rich Repeat
  Pfam annotation: Domain name=LRR_1; Domain location=146-165; Score =7.4; E_value=12; Accession=PF00560.23; Description=Leucine Rich Repeat
  Pfam annotation: Domain name=LRR_1; Domain location=179-201; Score =1.0; E_value=1.8e+02; Accession=PF00560.23; Description=Leucine Rich Repeat
  Pfam annotation: Domain name=LRR_1; Domain location=203-225; Score =10.0; E_value=3.9; Accession=PF00560.23; Description=Leucine Rich Repeat
  Pfam annotation: Domain name=LRR_1; Domain location=227-249; Score =15.9; E_value=0.15; Accession=PF00560.23; Description=Leucine Rich Repeat
  Pfam annotation: Domain name=LRR_1; Domain location=251-273; Score =7.7; E_value=10; Accession=PF00560.23; Description=Leucine Rich Repeat
  Pfam annotation: Domain name=LRR_1; Domain location=275-297; Score =8.9; E_value=6.1; Accession=PF00560.23; Description=Leucine Rich Repeat
  Pfam annotation: Domain name=LRR_1; Domain location=299-321; Score =8.1; E_value=8.8; Accession=PF00560.23; Description=Leucine Rich Repeat
  Pfam annotation: Domain name=LRR_1; Domain location=323-345; Score =1.3; E_value=1.7e+02; Accession=PF00560.23; Description=Leucine Rich Repeat
  Pfam annotation: Domain name=LRR_1; Domain location=347-369; Score =9.7; E_value=4.4; Accession=PF00560.23; Description=Leucine Rich Repeat
  Pfam annotation: Domain name=LRR_1; Domain location=371-393; Score =13.6; E_value=0.7; Accession=PF00560.23; Description=Leucine Rich Repeat
  Pfam annotation: Domain name=LRR_1; Domain location=395-417; Score =18.6; E_value=0.023; Accession=PF00560.23; Description=Leucine Rich Repeat
  Pfam annotation: Domain name=LRR_1; Domain location=419-441; Score =15.7; E_value=0.16; Accession=PF00560.23; Description=Leucine Rich Repeat
  Pfam annotation: Domain name=LRR_1; Domain location=443-465; Score =7.9; E_value=9.3; Accession=PF00560.23; Description=Leucine Rich Repeat
  Pfam annotation: Domain name=LRR_1; Domain location=467-489; Score =15.6; E_value=0.18; Accession=PF00560.23; Description=Leucine Rich Repeat
  Pfam annotation: Domain name=LRR_1; Domain location=491-514; Score =3.6; E_value=62; Accession=PF00560.23; Description=Leucine Rich Repeat
  Pfam annotation: Domain name=LRR_1; Domain location=516-538; Score =19.5; E_value=0.012; Accession=PF00560.23; Description=Leucine Rich Repeat
  Pfam annotation: Domain name=LRR_1; Domain location=540-563; Score =11.7; E_value=1.9; Accession=PF00560.23; Description=Leucine Rich Repeat
  Pfam annotation: Domain name=LRR_1; Domain location=73-96; Score=2.5; E_value=98; Accession=PF00560.23; Description=Leucine Rich Repeat
  Pfam annotation: Domain name=LRR_1; Domain location=98-120; Score =13.3; E_value=0.89; Accession=PF00560.23; Description=Leucine Rich Repeat
  Pfam annotation: Domain name=Pkinase; Domain location=668-936; Score =158.2; E_value=2.1e-44; Accession=PF00069.15; Description=Protein kinase domain
  Pfam annotation: Domain name=Pkinase_Tyr; Domain location=668-936; Score=130.9; E_value=3.5e-36; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::Pkinase::Pkinase _Tyr; ...
  Pfam module annotation: Pfam domain module=Domain location=26-69::122- 144::146-165::179-201::203-225::227-249::251-273::275-297::299 -321::323-345::347-369::371-393::395-417::419-441::443-465::467 -489::491-514::516-538::...
  Pfam module annotation: =540-563::73-96::98-120::668-936::668-936
MTNHACYSCLLARLVLFLALFQGTSAQTQAQALLRWKQSLPAQSILDSWVINSTATTLTPCSWRGITCDSQGTVTIINLAYTGLAGTLLNLNLSVFPNLLRLDLKENNLTGHIPQNIGVLSKLQFLDLSTNFLNGTLPLSIANLTQVFELDLSRNDITGILDPRLFPDESDRPQSGLIGIRNLLFQDTLLGGRIPNEIGNIRNLTLLALDANNFFGPIPSSLGNCTHLSILRMSQNQLSGPIPPSIGNLTNLTDVRFQINNLNGTVPRELGNLSSLIVLHLAENNLVGELPPQVCKSGRLVNFSAAYNSFTGPIPRSLRNCPALYRVRLEYNRLTGYADQDFGVYPNLTYMDFSYNRVEGDLSANWGACKNLQYLNMAGNGVSGNIPGEIFQLDQLRELDLSSNQISGEIPPQIVNSSNLYELSLSDNKLSGMVPADIGKLSNLRSLDISMNMLLGPIPDQIGDIYNLQNLNMSNNNFNGTIPYQVGNLASLQDFLDLSYNSLSGQIPSDLGKLSNLISLNISHNNLSGSIPDSLSEMVSLSAINLSYNNLEGPVPEGGVFNSSHPLDLSNNKDLCGNIQGLRPCNVSLTKPNGGSSNKKKVLIPIAASLGGALFISMLCVGIVFFCYKRKSRTRRQKSSIKRPNPFSIWYFNGRVVYGDIIEATKNFDNQYCIGEGALGKVYKAEMKGGQIFAVKKLKCDEENLDVESIKTFKNEVEAMSETRHRNIVKLYGFCSEGMHTFLIYEYMDRGNLTDMLRDDKDALELDWPKRVDIVKGVANALSYMHHDCAPPLIHRDISSKNVLLSSNLEAHVSDFGTARFLKPDSPIWTSFAGTYGYAAPELAYTMAVTEKCDVFSYGVFAFEVLTGKHPGELVSYIQTSTEQKINFKEILDPRLPPPVKSPILKELALIANLALSCLQTNPQSRPTMRNIAQLLAMDTADMR

SEQ ID NO: 125570 - protein, 71 aa, Glycine max
  Coding DNA Sequence Number=SeqID_8792
MSMEGHKKKLAEDVTLKVLVGKVFEEIILESLKTLFTKKVQRKAAEEATMFDVDGELMPDEVTAQTNKEKA

SEQ ID NO: 125571 - protein, 95 aa, Glycine max
  Coding DNA Sequence Number=SeqID_8793
MVPNGPKASKGGSWRSPVVNRDGGGGWGRGITTGVMDETPKVSNVAIAEEVEHNAIETSSKLSTTSNKATSRDKGELDVVIVYSTNSSPTPLNYA

SEQ ID NO: 125572 - protein, 103 aa, Glycine max
  Coding DNA Sequence Number=SeqID_8794
MSSSCMVSFLSRWFSILAFLLDSASDSLVALAKATTSFLLMGGEVGLGASYGGRTMEGEGIGYQASSLESVCDHVGAGVEYISELWMSKRDEQRIVKLQWIQT

SEQ ID NO: 125573 - protein, 416 aa, Glycine max
  Coding DNA Sequence Number=SeqID_8795
MYRGVPVACRTRSKRGRVVGSGLIMGQKKKKVHDHEPVSLKRVRVSERGFDCSGGHAGDPIVIGDSGDDVSEAEEGLRHTEKRFLVEKEWKSEEGKRCSVFVDKVDNFGNDDYACVPENRVILPDDSYGDNQSEKEHCADKSGSDDSFLCLTESEDGATSDEDFQVDYDENDCCSSSEDSDSSSYDDDERGGYSKTVKERVRKVEGETESSGVCKRKGGRKDNEEGEQWIGADCASATSSKSEIYKQEARNAAQKHESKRVKSANVDAEVFGDHWKSSGCSMPSEAEALEHRKKRDTGHQSASLQKKTEYSTMIKKNLDDHEGKKHHHVKGDSAKVVTKKDRKGRKHKYGFNSNKCEKVRVVDDETGDKDELHEVLRMPSRTKNRCFKLFNECFWGKNDSVKDDSNQLEEKDDDFG

SEQ ID NO: 125574 - protein, 984 aa, Glycine max
  Coding DNA Sequence Number=SeqID_8796
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=92%, HitCoverage=96%, E-value=0.0, Identity=39%"; Hit description =Tyrosine protein kinase, active site
  Pfam annotation: Domain name=LRRNT_2; Domain location=68-111; Score =46.3; E_value=1e-10; Accession=PF08263.3; Description=Leucine rich repeat N-terminal domain
  Pfam annotation: Domain name=LRR_1; Domain location=115-138; Score =2.5; E_value=98; Accession=PF00560.23; Description=Leucine Rich Repeat
  Pfam annotation: Domain name=LRR_1; Domain location=140-162; Score =13.3; E_value=0.89; Accession=PF00560.23; Description=Leucine Rich Repeat
  Pfam annotation: Domain name=LRR_1; Domain location=164-186; Score =13.5; E_value=0.79; Accession=PF00560.23; Description=Leucine Rich Repeat
  Pfam annotation: Domain name=LRR_1; Domain location=188-207; Score =10.0; E_value=3.8; Accession=PF00560.23; Description=Leucine Rich Repeat
  Pfam annotation: Domain name=LRR_1; Domain location=221-243; Score =1.0; E_value=1.8e+02; Accession=PF00560.23; Description=Leucine Rich Repeat
  Pfam annotation: Domain name=LRR_1; Domain location=245-267; Score =12.9; E_value=1.1; Accession=PF00560.23; Description=Leucine Rich Repeat
  Pfam annotation: Domain name=LRR_1; Domain location=269-291; Score =14.2; E_value=0.49; Accession=PF00560.23; Description=Leucine Rich Repeat
  Pfam annotation: Domain name=LRR_1; Domain location=293-315; Score =7.7; E_value=10; Accession=PF00560.23; Description=Leucine Rich Repeat
  Pfam annotation: Domain name=LRR_1; Domain location=317-339; Score =8.2; E_value=8.3; Accession=PF00560.23; Description=Leucine Rich Repeat
  Pfam annotation: Domain name=LRR_1; Domain location=341-363; Score =8.1; E_value=8.7; Accession=PF00560.23; Description=Leucine Rich Repeat
  Pfam annotation: Domain name=LRR_1; Domain location=365-387; Score =1.4; E_value=1.6e+02; Accession=PF00560.23; Description=Leucine Rich Repeat
  Pfam annotation: Domain name=LRR_1; Domain location=389-411; Score =11.2; E_value=2.3; Accession=PF00560.23; Description=Leucine Rich Repeat
  Pfam annotation: Domain name=LRR_1; Domain location=413-435; Score =13.7; E_value=0.66; Accession=PF00560.23; Description=Leucine Rich Repeat
  Pfam annotation: Domain name=LRR_1; Domain location=437-459; Score =16.8; E_value=0.078; Accession=PF00560.23; Description=Leucine Rich Repeat
  Pfam annotation: Domain name=LRR_1; Domain location=461-483; Score =18.6; E_value=0.023; Accession=PF00560.23; Description=Leucine Rich Repeat
  Pfam annotation: Domain name=LRR_1; Domain location=485-507; Score =7.5; E_value=11; Accession=PF00560.23; Description=Leucine Rich Repeat
  Pfam annotation: Domain name=LRR_1; Domain location=509-531; Score =14.9; E_value=0.29; Accession=PF00560.23; Description=Leucine Rich Repeat
  Pfam annotation: Domain name=LRR_1; Domain location=533-556; Score =2.3; E_value=1e+02; Accession=PF00560.23; Description=Leucine Rich Repeat
  Pfam annotation: Domain name=LRR_1; Domain location=558-580; Score =18.7; E_value=0.021; Accession=PF00560.23; Description=Leucine Rich Repeat
  Pfam annotation: Domain name=LRR_1; Domain location=582-605; Score =13.8; E_value=0.62; Accession=PF00560.23; Description=Leucine Rich Repeat
  Pfam annotation: Domain name=Pkinase; Domain location=708-976; Score =153.5; E_value=5.5e-43; Accession=PF00069.15; Description=Protein kinase domain
  Pfam annotation: Domain name=Pkinase_Tyr; Domain location=708-976; Score=107.4; E_value=4.3e-29; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::Pkinase::Pkinase _Tyr; ...
  Pfam module annotation: Pfam domain module=Domain location=68 -111::115-138::140-162::164-186::188-207::221-243::245-267::269 -291::293-315::317-339::341-363::365-387::389-411::413-435::437 -459::461-483::485-507::509-531::...
  Pfam module annotation: =533-556::558-580::582-605::708-976::708-976
MHICHRYFESDRNDGYGIYIFEVNKCNYCQTNKQFLNIKMNNHTCYACFAIPATLLLVLMVLFQGTVAQTQAQTLLRWKQSLPHQSILDSWIINSTATTLSPCSWRGITCDSKGTVTIINLAYTGLAGTLLNLNLSVFPNLLRLDLKENNLTGHIPQNIGVLSKLQFLDLSTNFLNGTLPLSIANLTQVFELDLSRNNITGTLDPRLFPDGSDRPQSGLIGIRNLLFQDTLLGGRIPNEIGNIRNLTLLALDGNNFFGPIPSSLGNCTHLSILRMSENQLSGPIPPSIAKLTNLTDVRLFKNYLNGTVPQEFGNFSSLIVLHLAENNFVGELPPQVCKSGKLVNFSAAYNSFTGPIPISLRNCPALYRVRLEYNQLTGYADQDFGVYPNLTYMDLSYNRVEGDLSTNWGACKNLQVLNMAGNEISGYIPGEIFQLDQLHKLDLSSNQISGDIPSQIGNSFNLYELNLSDNKLSGIIPAEIGNLSNLHSLDLSMNKLLGPIPNQIGDISDLQNLNLSNNDLNGTIPYQIGNLRDLQYFLDLSYNSLSGEIPTDLGKLSNLISLNMSHNNLSGSIPHSLSEMFSLSTINLSYNNLEGMVPKSGIFNSSYPLDLSNNKDLCGQIRGLKPCNLTNPNGGSSERNKVVIPIVASLGGALFISLGLLGIVFFCFKRKSRAPRQISSFKSPNPFSIWYFNGKVVYRDIIEATKNFDNKYCIGEGALGIVYKAEMSGGQVFAVKKLKCDSNNLNIESIKSFENEIEAMTKTRHRNIIKLYGFCCEGMHTFLIYEYMNRGNLADMLRDDKDALELDWHKRIHIIKGVTSALSYMHHDCAPPLIHRDVSSKNILLSSNLQAHVSDFGTARFLKPDSAIWTSFAGTYGYAAPELAYTMEVTEKCDVFSFGVLALEVLTGKHPGDLVSSIQTCTEQKVNLKEILDPRLSPPAKNHILKEVDLIANVALSCLKTNPQSRPTMQSIAQLLEMEIADII

SEQ ID NO: 125575 - protein, 44 aa, Glycine max
  Coding DNA Sequence Number=SeqID_8797
SDEMGPRWRVVLIGREQPPCKSKRGIRVIFRNKLGDAPRCHNYL

SEQ ID NO: 125576 - protein, 731 aa, Glycine max
  Coding DNA Sequence Number=SeqID_8798
  Gene Ontology: Mol. function=nucleic acid binding; Cellular component= nucleus; Biological process=regulation of transcription, DNA-dependent
  Homolog annotation: Hit_ID=Q9LK10; Match level="QueryCoverage=98%, HitCoverage=60%, E-value=1e-173, Identity=47%"; Hit description =Similarity to DNA repair protein
  Pfam annotation: Domain name=DEAD; Domain location=140-373; Score= -45.5; E_value=0.039; Accession=PF00270.19; Description=DEADDEAH box helicase
  Pfam annotation: Domain name=Helicase_C; Domain location=562-641; Score=64.7; E_value=3e-16; Accession=PF00271.21; Description =Helicase conserved C-terminal domain
  Pfam annotation: Domain name=ResIII; Domain location=136-367; Score= -14.2; E_value=0.00072; Accession=PF04851.6; Description=Type III restriction enzyme, res subunit
  Pfam annotation: Domain name=SNF2_N; Domain location=142-543; Score =7.9; E_value=1.5e-08; Accession=PF00176.13; Description=SNF2 family N-terminal domain
  Pfam module annotation: Pfam domain module=DEAD::Helicase _C::ResIII::SNF2_N; Domain location=140-373::562-641::136-367::142-543
MKKEPIENLEFEKELDILWGEMDMLLRGEEIGSQVDNIGTNEARENEENSASQCKHDTIFNEEIGIYCRWCGWIATEIKYITPPFVDSERCCRRVSSGGGNTSQFDGDLFNDPGDDSEAVWSHNEGTVWDLIPDIKQSLYPHQQEGFEFIWTNLAGTTDLAKLKRVDPCSEGGCIVSHAPGTGKTRLTMVFLQTYLQSFPKCLPIIIAPANILLTWEDELRKWNIGIPFHNLNNSELSGKEKLINEVDWSGNQKQNKDAIRMVKLCSWYKEKSILLISYNLYEKLAGSTAEGDGKKEKKNNKMKKKKKRARPREYIESGMGKVLRDYPGLLVLDEGHTPRNQNSYIWKVLSESRTKKRILLSGTPFQNNFLELYNILCLMKPSFPDSIPQELKKFCQSRQMQERKDVSWDWEPVSSGNTADEKIKLLKLLMNPFVHVHKGSILQKNLPGLRDCVLVLKPDILQQETLESIEYSQSALNFEHKLALVSVHPSLFLNCSLSKKEESVVDKGKLEKLRLNPYGGVKTKFLFEFIRLCDAVNEKVLIFSQFIDTLCLIKDQLESAFNWSVGTEVLYMYGKLDHKQKQSLIRSFNDSNSQAKVLLASIKASSEGINLIGASRVVLLDVVWNPSVERQAICRAYRLGQKRVVFTYHLLAQGTPECTKYCKQAEKNRLSELVFSNRNAESHKLKSSGVMLEDIEDRVLDLMVQHKKLKDMFGECLVQPKERYLETLGP

SEQ ID NO: 125577 - protein, 99 aa, Glycine max
  Coding DNA Sequence Number=SeqID_8799
  Subcellular localization annotation: CTP_CleavageSite=41; ConfidenceScore=5.69e-01
MATPPSVPPPPPTNVASQSSSTLKWTRKATRLRSLATRPARAERQVDVTYENWKQVPTAQKDLIWEDIQRSFVGGIYVVIMSFINVEFLQDVRKKAQAI

SEQ ID NO: 125578 - protein, 275 aa, Glycine max
  Coding DNA Sequence Number=SeqID_8800
  Gene Ontology: Mol. function=oxidoreductase activity; Cellular component=cell; Biological process=flavonoid biosynthetic process
  Homolog annotation: Hit_ID=Q9FJK0; Match level="QueryCoverage=99%, HitCoverage=87%, E-value=1e-107, Identity=66%"; Hit description =Aldose reductase-like protein
  Pfam annotation: Domain name=Aldo_ket_red; Domain location=1-247; Score=296.9; E_value=3.9e-86; Accession=PF00248.11; Description =Aldoketo reductase family
MGYRHFDTAKIYGSEPALGKALNEAICEEEVEREDIFLTSKLWGSDHHNPVSALKQTLENLGMEYLDMYLVHWPVKLKPWVNYPVPNEDDFEKLDLETTWAGMEKCLEMGLCRCIGVSNFSSKKIECLLDYASTPPAVNQVEMHPMWRQGRLRKTCGDHKIHVSAYSPLGGPGNAWGSTAVVNHPIIRSIAFKHKATPAQVALKWGLSKGSSVIVKSFNQERMKENIGSFDLKLDNEDILEIEKLEEMKIMRGEFHVNETTSPYRTIQELWDDEI

SEQ ID NO: 125579 - protein, 347 aa, Glycine max
  Coding DNA Sequence Number=SeqID_8801
  Gene Ontology: Mol. function=protein binding; Cellular component =nucleus; Biological process=negative regulation of ethylene mediated signaling pathway
  Homolog annotation: Hit_ID=Q9FLR4; Match level="QueryCoverage=90%, HitCoverage=63%, E-value=4e-79, Identity=58%"; Hit description =Arabidopsis thaliana genomic DNA, chromosome 5, P1 clone:MBK20
  Pfam annotation: Domain name=LRR_1; Domain location=119-141; Score =2.8; E_value=87; Accession=PF00560.23; Description=Leucine Rich Repeat
  Pfam annotation: Domain name=LRR_1; Domain location=168-193; Score =3.3; E_value=70; Accession=PF00560.23; Description=Leucine Rich Repeat
  Pfam annotation: Domain name=LRR_1; Domain location=195-219; Score =2.4; E_value=1e+02; Accession=PF00560.23; Description=Leucine Rich Repeat
  Pfam annotation: Domain name=LRR_1; Domain location=246-270; Score =2.3; E_value=1.1e+02; Accession=PF00560.23; Description=Leucine Rich Repeat
  Pfam annotation: Domain name=LRR_1; Domain location=272-296; Score =5.5; E_value=27; Accession=PF00560.23; Description=Leucine Rich Repeat
  Pfam annotation: Domain name=LRR_1; Domain location=65-88; Score=3.5; E_value=63; Accession=PF00560.23; Description=Leucine Rich Repeat
  Pfam module annotation: Pfam domain module=LRR_1::LRR_1::LRR_1::LRR _1::LRR_1::LRR_1; Domain location=119-141::168-193::195-219::246 -270::272-296::65-88
QPRHFMHLDSNSFPNWCFFEDNMLPVEVIDNGLTSLASGCPNLRRLHVIGTTEIGLLTVAEECSTLQELELQRCSDNVLRGIAACGNLQILKLVGHVDGFYDSVVSDIGLTILAQGCKRLVKLELSGCEGSFDGIKAIGKCCQMLEELTFSDHRMDDGWLAAISYCENLKTLRFQSCKKIDPNPGMEEYLGCCPALERLHLQKCQLRDRKSVVALFSVCRAVREIVIQDCWGLDNSMFSLAMICWRVKLLYLEGCSLLTTEGLESVIHSWKDLQSLRVVSCKNIKDNEISPALATLFTTLKELRWSPDTKSLLPSSVKGITMGKKGGVLEETMLPLSVGQLWHFKML

SEQ ID NO: 125580 - protein, 552 aa, Glycine max
  Coding DNA Sequence Number=SeqID_8802
  Homolog annotation: Hit_ID=Q9FII8; Match level="QueryCoverage=72%, HitCoverage=86%, E-value=1e-139, Identity=63%"; Hit description =Similarity to ATP/GTP nucleotide-binding protein
MKREKEKEKGVAVTSPVSGEDSDDKQRPSFPSVRFSSRNASSKYDFVKVKVWLGDNADHYYVLSRFLLSRMLTVTKIPNHVAIKIALELKKLLTDNSLLDVSQSDLEVNLFKKCSKRVLFVQLMERRGYGEEYINRYKMMTRFHHQRVPLVILVCGTACVGKSTIATQLAQRLNLPNVLQTDMVYELLRTSTDAPLASTPVWARDFSSSEELITEFCRECRVVRKGLAGDLKKAMKDGKPIIIEGIHLDPSIYLVDDDNKSPSGVHSENKEINPAFMTLDDNATAQIKDIHVGSSDESNGGSRILSSDEGVSADQVDVVSNSMASMGLTESIPEHKVASLRELETDKTTISRAKSGPKPIIVPIVLKMAEFDHKALLEEWISARTFNDKCPDLDNEKLIANLKTIQDYLCSFTSQGLTVVNVSATTFPQTLDWLHGYLLQISPLSLFFRNDFKFLSVHRARLFIRGNCTTYDKESVLFLHCTSMRIHRWFLDSTSLCKWMMLENNLSNQKVRKIMFKAINSTDRQPYYGLALQYMIIDDILFCEQDHGLGKR

SEQ ID NO: 125581 - protein, 558 aa, Glycine max
  Coding DNA Sequence Number=SeqID_8803
  Gene Ontology: Mol. function=protein serine/threonine kinase activity; Cellular component=integral to membrane; Biological process=protein amino acid phosphorylation
  Homolog annotation: Hit_ID=Q9FII5; Match level="QueryCoverage=97%, HitCoverage=90%, E-value=0.0, Identity=46%"; Hit description =Receptor protein kinase-like protein
  Pfam annotation: Domain name=LRR_1; Domain location=117-140; Score =9.2; E_value=5.4; Accession=PF00560.23; Description=Leucine Rich Repeat
  Pfam annotation: Domain name=LRR_1; Domain location=22-43; Score=4.2; E_value=47; Accession=PF00560.23; Description=Leucine Rich Repeat
  Pfam annotation: Domain name=LRR_1; Domain location=45-67; Score =10.7; E_value=2.9; Accession=PF00560.23; Description=Leucine Rich Repeat
  Pfam annotation: Domain name=LRR_1; Domain location=69-91; Score =15.2; E_value=0.23; Accession=PF00560.23; Description=Leucine Rich Repeat
  Pfam annotation: Domain name=LRR_1; Domain location=93-115; Score =16.7; E_value=0.083; Accession=PF00560.23; Description=Leucine Rich Repeat
  Pfam annotation: Domain name=Pkinase; Domain location=244-519; Score =139.0; E_value=1.3e-38; Accession=PF00069.15; Description=Protein kinase domain
  Pfam annotation: Domain name=Pkinase_Tyr; Domain location=243-519; Score=94.5; E_value=3.2e-25; Accession=PF07714.7; Description =Protein tyrosine kinase
  Pfam module annotation: Pfam domain module=LRR_1::LRR_1::LRR_1::LRR _1::LRR_1::Pkinase::Pkinase_Tyr; Domain location=117-140::22-43::45 -67::69-91::93-115::244-519::243-519
YFNISGNSFGTSLPASIWNATNLAIFSAASSNITGQIPDFIGCQALYKLELQGNSINGTIPWDVGHCQKLILLNLSRNSLTGIIPWEISALPSITDVDLSHNSLTGTIPSNFNNCSTLENFNVSFNSLTGPIPSTGIFPNLHPSSYSGNQGLCGGVLAKPCAADALSAADNQVDVRRQQPKRTAGAIVWIVAAAFGIGLFVLVAGTRCFHANYNRRFGDEVGPWKLTAFQRLNFTAEDVLECLSMSDKILGMGSTGTVYRSEMPGGEIIAVKKLWGKQKENIRRRRGVLAEVEVLGNVRHRNIVRLLGCCSNKECTMLLYEYMPNGNLDDWLHGKNKGDNLVADWFTRYKIALGVAQGICYLHHDCDPVIVHRDLKPSNILLDAEMEARVADFGVAKLIQTDESMSVIAGSYGYIAPEYAYTLQVDEKSDIYSYGVVLMEILSGKRSVDAEFGDGNSVVDWVRSKIKSKDGIDDILDKNAGAGCTSVREEMIQMLRIALLCTSRNPADRPSMRDVVLMLQEAKPKRKLLDGVLGRCAGDNVVVGGDIPLPQKPIADQC

SEQ ID NO: 125582 - protein, 206 aa, Glycine max
  Coding DNA Sequence Number=SeqID_8804
  Gene Ontology: Mol. function=two-component sensor activity; Cellular component=chromosome; Biological process=DNA metabolic process
  Homolog annotation: Hit_ID=Q1SRL7; Match level="QueryCoverage=54%, HitCoverage=68%, E-value=7e-47, Identity=82%"; Hit description=SMC6 protein-related
  Pfam annotation: Domain name=SMC_N; Domain location=69-204; Score= -108.8; E_value=0.0012; Accession=PF02463.9; Description=RecFRecNSMC N terminal domain
  Subcellular localization annotation: CTP_CleavageSite=56; ConfidenceScore=5.07e-01
MARKFHEAPIICLSPLFLISYDLLASPLVTAVRRGSSDSKLVSSSSTLTPETKTTMEDKGRGAGESRGIVKQLRLENFMCHSKHETEFGNHVNFITGQNGSGKSTILAALCVAFGCRAKETQRTSTLKDFIKTGATDAVIQVEIQNEGEGAFKPEIYGPVIIVERRISESTSSATLKDHQVDNTLIFMRYRAHPVSKHHYEVKQMD

SEQ ID NO: 125583 - protein, 390 aa, Glycine max
  Coding DNA Sequence Number=SeqID_8805
  Gene Ontology: Mol. function=protein serine/threonine kinase activity; Cellular component=integral to membrane; Biological process=protein amino acid phosphorylation
  Homolog annotation: Hit_ID=Q9FII5; Match level="QueryCoverage=88%, HitCoverage=53%, E-value=1e-89, Identity=31%"; Hit description =Receptor protein kinase-like protein
  Pfam annotation: Domain name=LRRNT_2; Domain location=29-76; Score =28.6; E_value=2.3e-05; Accession=PF08263.3; Description=Leucine rich repeat N-terminal domain
  Pfam annotation: Domain name=LRR_1; Domain location=105-127; Score =9.8; E_value=4.2; Accession=PF00560.23; Description=Leucine Rich Repeat
  Pfam annotation: Domain name=LRR_1; Domain location=129-151; Score =14.7; E_value=0.33; Accession=PF00560.23; Description=Leucine Rich Repeat
  Pfam annotation: Domain name=LRR_1; Domain location=153-175; Score =8.9; E_value=6.2; Accession=PF00560.23; Description=Leucine Rich Repeat
  Pfam annotation: Domain name=LRR_1; Domain location=177-199; Score =7.7; E_value=10; Accession=PF00560.23; Description=Leucine Rich Repeat
  Pfam annotation: Domain name=LRR_1; Domain location=201-223; Score =15.7; E_value=0.16; Accession=PF00560.23; Description=Leucine Rich Repeat
  Pfam annotation: Domain name=LRR_1; Domain location=225-247; Score =15.5; E_value=0.19; Accession=PF00560.23; Description=Leucine Rich Repeat
  Pfam annotation: Domain name=LRR_1; Domain location=249-271; Score =15.5; E_value=0.19; Accession=PF00560.23; Description=Leucine Rich Repeat
  Pfam annotation: Domain name=LRR_1; Domain location=273-295; Score =11.9; E_value=1.7; Accession=PF00560.23; Description=Leucine Rich Repeat
  Pfam annotation: Domain name=LRR_1; Domain location=297-319; Score =13.5; E_value=0.77; Accession=PF00560.23; Description=Leucine Rich Repeat
  Pfam annotation: Domain name=LRR_1; Domain location=321-343; Score =15.2; E_value=0.24; Accession=PF00560.23; Description=Leucine Rich Repeat
  Pfam annotation: Domain name=LRR_1; Domain location=345-367; Score =11.1; E_value=2.4; Accession=PF00560.23; Description=Leucine Rich Repeat
  Pfam annotation: Domain name=LRR_1; Domain location=369-388; Score =3.7; E_value=58; Accession=PF00560.23; Description=Leucine Rich Repeat
  Pfam annotation: Domain name=LRR_1; Domain location=81-103; Score =13.0; E_value=1.1; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1; Domain location=29-76::105-127::129-151::153-175::177-199::201 -223::225-247::...
  Pfam module annotation: Domain location=249-271::273-295::297 -319::321-343::345-367::369-388::81-103
MKPFLLFLITFSFLCQTHLLLVLSATTPLSLQLIALLSIKSSLLDPLNNLHDWDPSPSPSNPQHPIWCSWRAITCHSKTSQITTLDLSHLNLSGTISPQIRHLSTLNHLNLSGNDFTGSFQYAIFELTELRTLDISHNSFNSTFPPGISKLKFLRHFNAYSNSFTGPLPQELTTLRFLEQLNLGGSYFSDGIPPSYGTFPRLKFLDIAGNALEGPLPPQLGHLAELEHLEIGYNNFSGTLPSELALLYNLKYLDISSTNISGNVIPELGNLTKLETLLLFKNRLTGEIPSTIGKLKSLKGLDLSDNELTGPIPTQVTMLTELTTLNLMDNNLTGEIPQGIGELPKLDTLFLFNNSLTGTLPQQLGSNGLLLKLDVSTNSLEGPIPENVCK

SEQ ID NO: 125584 - protein, 146 aa, Glycine max
  Coding DNA Sequence Number=SeqID_8806
  Gene Ontology: Mol. function=lipid transporter activity; Cellular component=integral to membrane; Biological process=nuclear division
  Homolog annotation: Hit_ID=Q6V5H8; Match level="QueryCoverage=95%, HitCoverage=29%, E-value=4e-49, Identity=65%"; Hit description =Nuclear division RFT1-like protein
LYAVQWHLLVTCILFLSREGFRRACLRMDLKCDGTSMGDVVKLMKVVWMSFPLGIFITVVVCLFVFWWQQISYSSPHGQAILINGFACILELLAEPVYILSQNLVLLELRLMVETVATLSWCLTMYFLIVKQTGIVRALVILSHIF

SEQ ID NO: 125585 - protein, 151 aa, Glycine max
  Coding DNA Sequence Number=SeqID_8807
MEMEQRHHLNLVFFNQARRHFQRKQKNINIQGDERTFSQFKKSTWKSFRHLQLALSMSREHVSVHVFSQLCTMKTIMGIKGILSTDEHFLRMKGILKRRERYGKAHVCEVWSGAKKNIGRGRGHATVHSSSWDPIGALACWRVLSWAPQPL

SEQ ID NO: 125586 - protein, 289 aa, Glycine max
  Coding DNA Sequence Number=SeqID_8808
  Homolog annotation: Hit_ID=Q9FKH0; Match level="QueryCoverage=73%, HitCoverage=73%, E-value=1e-19, Identity=31%"; Hit description =Arabidopsis thaliana genomic DNA, chromosome 5, TAC clone:K11J9
  Subcellular localization annotation: CTP_CleavageSite=66; ConfidenceScore=5.55e-01
MFCRRLGAPDSISSSLQQSLLRVSSSTSSHTRKIKSSLKHVYLSSSHNNMNLSPLPNLSPLPSFFPDSHAQNDGDGDAIFGPVPSDSDVENALITLQQVFGSASRQYVRNVDEVDHVTNTSLVDQVFSDGSETDWKEPSLSSYNPRMLQTDVFDKVTFAVHLLQSDACVQRMVKSLSSDKSLWDAVLKNESVRELRSTITAERDRSSNETVDNESPNTKNVFMRISDAAKGKLMEAIQKIMKMMKNLFQSTRHWKYAGKSNLSKDKLRVSVMLSIMIFLMVVVDRFYLI

SEQ ID NO: 125587 - protein, 295 aa, Glycine max
  Coding DNA Sequence Number=SeqID_8809
  Gene Ontology: Mol. function=small protein conjugating enzyme activity; Cellular component=cytoplasmic ubiquitin ligase complex; Biological process=protein modification process
  Homolog annotation: Hit_ID=Q9FKG9; Match level="QueryCoverage=99%, HitCoverage=84%, E-value=1e-106, Identity=68%"; Hit description =Autophagocytosis protein AUT1-like
  Pfam annotation: Domain name=Autophagy_C; Domain location=203-295; Score=79.9; E_value=7.8e-21; Accession=PF03987.6; Description =Autophagocytosis associated protein, C-terminal domain
  Pfam annotation: Domain name=Autophagy_N; Domain location=6-173; Score=198.7; E_value=1.3e-56; Accession=PF03986.4; Description =Autophagocytosis associated protein, N-terminal domain
  Pfam module annotation: Pfam domain module=Autophagy_C::Autophagy_N; Domain location=203-295::6-173
MVLTQKLHEAFKGTVERITGPRTVSAFKEKGVLSVSEFVTAGDNLVAKCPTWSWLSLAVDLCVLFSNRESGDPGKRKPYLPPEKQFLITRNVASYLTVPCLRRAASVEEEYEAAGGEVLLDDEDNDGWLATHGKPKGMYYLYWTGGFLEISKKGSIKQIHSYMGAEEGEDIPDMAEFDDTSNVENDPATLQSTYLVAHEPDDDNILRTRTYDISITLVTDLVIPCSILWQSRMLLQPELVLEDVSQDHARKTVTIEDHPHLPGKHASIHPCRHGAVMKKIIDVLMSRGVEPEVDK

SEQ ID NO: 125588 - protein, 522 aa, Glycine max
  Coding DNA Sequence Number=SeqID_8810
  Gene Ontology: Mol. function=binding; Cellular component=nucleus; Biological process=protein kinase C activation
  Homolog annotation: Hit_ID=Q1SFH7; Match level="QueryCoverage=96%, HitCoverage=94%, E-value=1e-163, Identity=56%"; Hit description =Tetratricopeptide-like helical
  Pfam annotation: Domain name=PPR; Domain location=131-165; Score=5.6; E_value=1.6; Accession=PF01535.11; Description=PPR repeat
  Pfam annotation: Domain name=PPR; Domain location=195-229; Score =46.1; E_value=1.2e-10; Accession=PF01535.11; Description=PPR repeat
  Pfam annotation: Domain name=PPR; Domain location=298-332; Score =29.4; E_value=1.3e-05; Accession=PF01535.11; Description=PPR repeat
  Pfam annotation: Domain name=PPR; Domain location=333-367; Score=4.5; E_value=2.2; Accession=PF01535.11; Description=PPR repeat
  Pfam annotation: Domain name=PPR; Domain location=369-403; Score =14.1; E_value=0.16; Accession=PF01535.11; Description=PPR repeat
  Pfam module annotation: Pfam domain module=PPR::PPR::PPR::PPR::PPR; Domain location=131-165::195-229::298-332::333-367::369-403
MSPSRCVVGLLEQCSSMREMKQIHGHAITHGLARFAFISSKLLAFYARSDLRYAHTLFSHIPFPNLFDYNTIITAFSPHYSSLFFIQMLNAAVSPNSRTFSLLLSKSSPSLPFLHQLHSHIIRRGHVSDFYVITSLLAAYSNHGSTRAARRLFDQSPYKNVACWTSLVTGYCNNGLVNDARNLFDAIPERERNDVSYSAMVSGYVKNGCFREGIQLFRELKDRNVKPNNSLLASVLSACASVGAFEEGKWIHAYVDQNKSQCYYELELGTALIDFYTKCGCVEPAQRVFGNMKTKDVAAWSAMVLGLAINAKNQEALELFEEMEKVGPRPNAVTFIGVLTACNHKDLFGEALKLFGYMSDKYGIVASIEHYGCVVDVLARSGKIEEALEFIKSMEVEPDGVIWGSLLNGCFLHNNIELGHKVGKYLVELEPGHGGRYVLLSNVYATMGKWEAVLETRKFMKDRGVPAVSGSSFIEIHQTVHKFLVHDNNHHCGSYPAEVYRVLNHLGNKLEDYSKSNEIIVF

SEQ ID NO: 125589 - protein, 251 aa, Glycine max
  Coding DNA Sequence Number=SeqID_8811
  Gene Ontology: Mol. function=DNA-directed RNA polymerase activity; Cellular component=DNA-directed RNA polymerase III complex; Biological process=transcription from RNA polymerase III promoter
  Homolog annotation: Hit_ID=UPI0000E47267; Match level="QueryCoverage =70%, HitCoverage=46%, E-value=4e-09, Identity=28%"; Hit description =PREDICTED: similar to Polymerase (RNA) III (DNA directed) polypeptide D, 44kDa
  Pfam annotation: Domain name=RNA_pol_Rpc4; Domain location=137-246; Score=103.9; E_value=4.6e-28; Accession=PF05132.5; Description=RNA polymerase III RPC4
MDPDQGSSKARKLKFKPRNLKPVRTPKTEADDKQKEDSAVPRALSRRQDQNYACMIEVTDDDDDTTDASARKIKREYKEPWDYENSYYPTTLPLRKPNSGDPEILDEKEFGEAASSAEYDENTVNSAAELGLLKKSQQQRMLFFKFPTLPLVKQTNKGKEKIGKSTVSQEATKSKSALEELPRGYMGKMLVYKSGAIKLKLGETMFDVSPGSNSVSVQDIVAVNTAQKQCCNLGELRKRVVVVPDLDSIEL

SEQ ID NO: 125590 - protein, 255 aa, Glycine max
  Coding DNA Sequence Number=SeqID_8812
MAKSYKNLQAKLQELQSILDEALLLGPDIQSQDSISNDIKHKLAFIGNLLTAEVASHHPSKPHHLHHISERLSTMERDFHHWDSFRSLPCNDFDKDSICSCTDSCLNDDETDLIAFEDPEKLLLDSNCEKAMVEYSGAVAEATGYVDEEKQRGEMNNGSNKLASFDYEDAEDFFEDFAGDKELAEFDGALLRKTEKEGKKDNDLEREESRNSTFGERCSTLAAGVVIGMILMGFIMVNISACFHYVQEASYAIPT

SEQ ID NO: 125591 - protein, 780 aa, Glycine max
  Coding DNA Sequence Number=SeqID_8813
  Gene Ontology: Mol. function=nucleic acid binding; Cellular component= integral to membrane; Biological process=RNA splicing
  Homolog annotation: Hit_ID=Q9LU44; Match level="QueryCoverage=97%, HitCoverage=96%, E-value=0.0, Identity=63%"; Hit description =Similarity to transcription or splicing factor
  Pfam annotation: Domain name=KH_1; Domain location=241-315; Score =29.9; E_value=8.9e-06; Accession=PF00013.19; Description=KH domain
  Pfam annotation: Domain name=RRM_1; Domain location=467-538; Score =89.1; E_value=1.4e-23; Accession=PF00076.12; Description=RNA recognition motif. (a.k.a. RRM, R
  Pfam annotation: Domain name=zf-CCHC; Domain location=348-365; Score =17.9; E_value=0.0011; Accession=PF00098.13; Description=Zinc knuckle
  Pfam annotation: Domain name=zf-CCHC; Domain location=374-391; Score =15.5; E_value=0.0028; Accession=PF00098.13; Description=Zinc knuckle
  Pfam module annotation: Pfam domain module=KH_1::RRM_1::zf-CCHC::zf -CCHC; Domain location=241-315::467-538::348-365::374-391
MDAVDSTPNPPPLPTYDPSEYHNPPQHQSETGQNGNGTNLGKPSENGSQVAADNNGLNPQISKPLLSEGLTRSGTDRDQSGGEEETTSKRRRRSRWDPQPESNEQSGGDSGTGPKKRKSRWADDDPKPVIQLPDFMGGIEFDPEIQALNSRLLEISRMLQSGLPLDDRPEGARSPSPEPIYDNMGIRINTREYRARERLQKERQEIISQIIKKNPAFKPPVDYRPPKLQKKLYIPMKEYPGYNFIGLIIGPRGNTQKRMEKETGAKIVIRGKGSVKEGRLQQKRDLKPDPSENEDLHVLVEAETPESLEAAAGMVEKLLQPVDEVLNEHKRQQLRELAALNGTIRDEEYCRLCGEPGHRQYACPTRTSTFKSEVVCKHCGDGGHPSIDCPVKGATGKKMDDEYQNFLAELGGSVPESATKQTSTLAIGAGTSGSNPPWANNSGTAGSAPQAGLGAAAIKKEIDDTNLYIGYLPPTLDDDGLIQLFQQFGEIVMAKVIKDRMSGLSKGYGFVKYADITMANNAILAMNGYRLEGRTIAVRVAGKPPQPVVPPGPPASAVPTYPVPSQPLGAYPSQQYAAGGPIGTAPPGSYGGTPVPWGPPVPPPYAPYAPPPPGSTMYPPMQGQPMPPYGVQYPPPVPTGPPGAPSQPATSSEVQQSYPPGVQSDNSTSTQSIPANVYGNSGPPMPPQPTYPASYGYPPYYNAVPPPPPPSAPMPVSTSDQSHNIANVPWASNSLVPPPASSADNQSQSIGNVPRAANPSVPPPASSADSEYEKFMAEMK

SEQ ID NO: 125592 - protein, 52 aa, Glycine max
  Coding DNA Sequence Number=SeqID_8814
MRIKQIVLERKSEPSVRELAMTVARRRWWNRLGTATVDLSGFALGLCRACFF

SEQ ID NO: 125593 - protein, 279 aa, Glycine max
  Coding DNA Sequence Number=SeqID_8815
  Gene Ontology: Mol. function=extracellular ligand-gated ion channel activity; Cellular component=membrane; Biological process=transport
MQRSVKILSVFVGPCFVAECAYKIWWYASGASQIPFLGNVYVSDAVACILELWSWLYRTTVIFLVCVLFRLICHLQILRLRDFARFFHVDSDVASVMTEHLRIRRHLRIISHRFRAFILLALLLVTGSQLACLLVTTKHTQDMNIYKTGELALCSVTLLSALCILLRSATKITHKAQAITGLAAKWHVCATLDSFDGVVTEGETPMAPQSSHETVFPNVGTDGESETDEAGDEEDEIDTTKLIPSYAYSTISYQKRQALGNYFNSFLTHPLYFLNYIHV

SEQ ID NO: 125594 - protein, 71 aa, Glycine max
  Coding DNA Sequence Number=SeqID_8816
  Gene Ontology: Mol. function=oxidoreductase activity; Cellular component=membrane; Biological process=metabolic process
  Homolog annotation: Hit_ID=Q394B6; Match level="QueryCoverage=98%, HitCoverage=41%, E-value=1e-18, Identity=57%"; Hit description=Short- chain dehydrogenase/reductase SDR
  Subcellular localization annotation: CTP_CleavageSite=64; ConfidenceScore=5.71e-01
MAGSTSSRTKPDGDNCSNARTIATTSCRLVTARRRSRKPSRSASAMPLSANLDAPNATSGRPLRGSAEVEP

SEQ ID NO: 125595 - protein, 172 aa, Glycine max
  Coding DNA Sequence Number=SeqID_8817
MDADDCDAQCQAQRSDDDTHAPGLQDHAQREFIEHARVQAPAQPDACQHLQRGLEAGRQKILGAGELVSGQQAGTQAGQAAAPAAEQSADQQDVEAEVQLDHALGVAGHEPGVEQVDQAQRHAHVQAAAFNGMASATGGDQQHADHADHRRGLQQVQRQAGQGAVQDLGRDP

SEQ ID NO: 125596 - protein, 83 aa, Glycine max
  Coding DNA Sequence Number=SeqID_8818
STLEDPTAIIDECKEKLNLAATHEQRLEDEYAKISVERSQELPRLLAKAKAMADTYSAPEEIHGLLSYCQHMIDLMDHMIRNH

SEQ ID NO: 125597 - protein, 113 aa, Glycine max
  Coding DNA Sequence Number=SeqID_8819
MDNKCSELGVASPRRMGAGTEGGRADANVDGVDVEGVEEGGAEEDGTSDHLPLNLWVPRKETEGSSRFQQFFLTYAKLMAGLKLSKVKESEVTPRALHKAVMRAGKPSLEESC

SEQ ID NO: 125598 - protein, 182 aa, Glycine max
  Coding DNA Sequence Number=SeqID_8820
  Gene Ontology: Mol. function=metal ion binding; Cellular component =integral to membrane; Biological process=ubiquitin cycle
  Homolog annotation: Hit_ID=Q9C965; Match level="QueryCoverage=95%, HitCoverage=43%, E-value=4e-72, Identity=68%"; Hit description =Putative RING zinc finger protein; 53384-54880
  Pfam annotation: Domain name=zf-C3HC4; Domain location=123-163; Score= 41.0; E_value=4.1e-09; Accession=PF00097.15; Description=Zinc finger, C3HC4 type (RING finger)
MALDCFFAVWFVVGNVWIFGGHTSPSDAPQLYSCIGYAMPFILCATICCCLPCIISVLGIREDFSQNRGATVESINALPIFKFKLKNNENGDDQDVNAAIDEGGILAAGTEKERMISGEDAVCCICLAKYADDDELRELPCSHFFHVMCVDKWLKINATCPLCKNEVGTSNGGSPSAWNSST

SEQ ID NO: 125599 - protein, 456 aa, Glycine max
  Coding DNA Sequence Number=SeqID_8821
  Gene Ontology: Mol. function=ATP-dependent helicase activity; Cellular component=cytoplasm; Biological process=translation
  Homolog annotation: Hit_ID=Q84W89; Match level="QueryCoverage=98%, HitCoverage=71%, E-value=1e-173, Identity=68%"; Hit description=DEAD- box ATP-dependent RNA helicase 37
  Pfam annotation: Domain name=DEAD; Domain location=180-360; Score =237.3; E_value=3.3e-68; Accession=PF00270.19; Description=DEADDEAH box helicase
  Pfam annotation: Domain name=GRP; Domain location=38-110; Score= -22.6; E_value=0.015; Accession=PF07172.2; Description=Glycine rich protein family
  Pfam annotation: Domain name=ResIII; Domain location=176-355; Score= -28.7; E_value=0.012; Accession=PF04851.6; Description=Type III restriction enzyme, res subunit
  Pfam module annotation: Pfam domain module=DEAD::GRP::ResIII; Domain location=180-360::38-110::176-355
  Subcellular localization annotation: CTP_CleavageSite=45; ConfidenceScore=5.21e-01
MRTSWADSADNSAIGSGITNASACPSRGAYVPPHLRNRALSSEVPLAAASHPAVALGNDRVNHSGPAPHQGGGYFKPDHGRQQQQGYGSGFQSGGGGGWNGRGVGRDRGRREANPFENVEAEDQSFSEQENTGINFEAYDDIPVETSGENVPLPVNSFAEIDLGVALNQNIQRCKYVKPTPVQRYAIPISLAGRDLMACAQTGSGKTAAFCFPIISGIMREQYAQRPRVARTAYPLALILSPTRELSCQIHDEAKKFSYQTGVKVVVAYGGAPITQQLRELERGVDILVATPGRLVDLLERARLSLQMIRYLALDEADRMLDMGFEPQIRKIVEQMDMPPPGMRQTLLFSATFPKEIQALASDFLSRYVFLAVGRVGSSTDLIAQRVEYVLESDKRSHLMDLLHAQRETGVNGKQGLTLVFVETKKGADALEHCLCVNGFPAASIHGDRTQQWPGA

SEQ ID NO: 125600 - protein, 68 aa, Glycine max
  Coding DNA Sequence Number=SeqID_8822
MGETFYKLFNYGQRISLEVKTEHMHCNFSKRQEEYDLEVKMGEDVIPHRDNTKKRSGRYKVGSVVGKG

SEQ ID NO: 125601 - protein, 72 aa, Glycine max
  Coding DNA Sequence Number=SeqID_8823
MVVLEGEYGAGEWIEITPDWESRVEPREKLKDDMAVVKDVGEGCRGEVVVGDVVVGNEIGVGDDENGERGTI

SEQ ID NO: 125602 - protein, 223 aa, Glycine max
  Coding DNA Sequence Number=SeqID_8824
  Gene Ontology: Mol. function=metal ion binding
  Homolog annotation: Hit_ID=Q9C965; Match level="QueryCoverage=95%, HitCoverage=51%, E-value=8e-39, Identity=43%"; Hit description =Putative RING zinc finger protein; 53384-54880
MDVTSLGSNSNTQTDQHPLLMEQPETHNGHQHVIDITRNGEALTTSSRNDQYSEMHLPQNEDQAAGDAQNSSHQTSSSSAPRLNSRNSASLRRGEGYGHHGRSPLNSGLWISVELVVTVSQIIASIVVLSLSRNENPQAPLFAWIVGYASGCVATLPILYWRFRNRNQSNEQDTSQASQGSSGSNPPDRSYNSIHVSHVSDEENGHATRSASRNTIMPGAFTS

SEQ ID NO: 125603 - protein, 110 aa, Glycine max
  Coding DNA Sequence Number=SeqID_8825
MGDYFMMPMVAGCEGTFLCITTMLTYANIVEHIREFLKKVEGGVQNQQHSAFQFSQTQQHLEGKERLVPSNFTKLNNIFKGKKDPNKEVKNSNNIILIITFKNYSSFPKL

SEQ ID NO: 125604 - protein, 150 aa, Glycine max
  Coding DNA Sequence Number=SeqID_8826
  Gene Ontology: Mol. function=protein dimerization activity; Cellular component=nucleus; Biological process=regulation of transcription, DNA-dependent
  Homolog annotation: Hit_ID=O24541; Match level="QueryCoverage=78%, HitCoverage=63%, E-value=3e-39, Identity=71%"; Hit description=Auxin- induced protein 22C
  Pfam annotation: Domain name=AUX_IAA; Domain location=6-145; Score =98.4; E_value=2.2e-26; Accession=PF02309.7; Description=AUXIAA family
MEKEGVGLEITTELRLGLPGGELPDKNEKMKKRVFSEINQGDENSSSEEDRKIQTKNQVVGWPPVCSYRKKNTINETKMYVKVSMDGAPFLRKIDLAMHKGYSELALALEKFFGCYGIGRWFLFLDLLNKEEEKHWDSISREKSVYIMNT

SEQ ID NO: 125605 - protein, 85 aa, Glycine max
  Coding DNA Sequence Number=SeqID_8827
MIIKFEIGRIPIWYNVKLLTVAWLVLPQFAGAAKYITERQHLYDNHQQQRKKSPNNGGKAKKFFEFVTPKKKSNAVFVDPSHVIV

SEQ ID NO: 125606 - protein, 79 aa, Glycine max
  Coding DNA Sequence Number=SeqID_8828
MARRISLIVKINDIEDTWRLAIRITKICFIQKNVGGGFWEMILMDEKGHKIRATMNILNLTDGKINSKREKLILFRTLR

SEQ ID NO: 125607 - protein, 351 aa, Glycine max
  Coding DNA Sequence Number=SeqID_8829
  Gene Ontology: Mol. function=RNA binding; Cellular component =cytoplasm; Biological process=regulation of transcription
  Homolog annotation: Hit_ID=Q9LU22; Match level="QueryCoverage=91%, HitCoverage=75%, E-value=1e-99, Identity=56%"; Hit description =Arabidopsis thaliana genomic DNA, chromosome 3, P1 clone: MYA6
MGVKIIMPTSKEEDFVTIEGISVNSVNSASEKIQAIIDETVNSRNLDYSHFISLPLAIHPELVNKLISFQHSILGIGSCMDENTYTESDSNEDEGTTTDTKEVDQLSKENSGVAVELKANDNSESVKVNLTNIPLVSYAPKASKSSAPSDLGIDKSIFIKPKTFHLTVLMLKLWNNERIKTASEVLQSISSKVMEALDNRPLSIRLKGLECMKGSLAKARVLYAPVEEIAKVIIDAYVEAGLVLENDAKQKLKLHATVMNARHRKRNKNTWTRKVDSFDARGIFKQYGSEDWGQYLIREAHLSQRFSFDENGYYHCCASIPFPENMQEKDLNGSFTKYTKLIYLQKKLPGV

SEQ ID NO: 125608 - protein, 184 aa, Glycine max
  Coding DNA Sequence Number=SeqID_8830
WKFDFSISDVRRMVCTNQADMTGRLLAGSLAFECHIMHYLIMRILLPRSSNLAQALRSNAPLPYPHLITLFLQHFNVPLNSEPFVKVKRSFSIGVNVVSSFGYRKKRDGSWVKKDAPVQAAEDRSPSPPLQRDDSSSLMHNILDRLDGLHTFVSERFDSLDNRIDAMDARFARMDTRITKLEED

SEQ ID NO: 125609 - protein, 68 aa, Glycine max
  Coding DNA Sequence Number=SeqID_8831
  Subcellular localization annotation: CTP_CleavageSite=30; ConfidenceScore=5.08e-01
MMGSAPAQQQMSYYDHVQTRLCIHSVAAFAAMRVVSAAWNAPVVAVRRLPNFQETFVKFMFHHYCCMK

SEQ ID NO: 125610 - protein, 65 aa, Glycine max
  Coding DNA Sequence Number=SeqID_8832
  Homolog annotation: Hit_ID=UPI000045BC60; Match level="QueryCoverage =97%, HitCoverage=81%, E-value=1e-15, Identity=64%"; Hit description =COG1511: Predicted membrane protein
  Subcellular localization annotation: CTP_CleavageSite=38; ConfidenceScore=5.65e-01
MAWDLGFRVQGSGFRVQGSGFRVQGSGFRVQGSGFRVQGSGFRVQGSGFRVQGSGFRVQGSGFRV

SEQ ID NO: 125611 - protein, 71 aa, Glycine max
  Coding DNA Sequence Number=SeqID_8833
MKRSLRKLGVLAVEKHERDRRNIMPLSQLEELAQATQNSQSPWENWALAFLRKPPCMTTKKAVLYPSLTYP

SEQ ID NO: 125612 - protein, 120 aa, Glycine max
  Coding DNA Sequence Number=SeqID_8834
  Subcellular localization annotation: CTP_CleavageSite=45; ConfidenceScore=5.24e-01
MRNLAHRFSFDSNAKPTLFRILYLSNGSSVGLGLKSLFVLHGNATASRSSETTYGGILDETFMSDLHLLKSPPDGTTNNRQWDIGKPIAGQRSCTEPSKQTQAQICYVEELTKLIFRLYI

SEQ ID NO: 125613 - protein, 1928 aa, Glycine max
  Coding DNA Sequence Number=SeqID_8835
  Gene Ontology: Mol. function=DNA binding; Cellular component=beta -galactosidase complex; Biological process=DNA integration
  Homolog annotation: Hit_ID=Q1SS72; Match level="QueryCoverage=71%, HitCoverage=97%, E-value=0.0, Identity=46%"; Hit description =Integrase, catalytic region
  Pfam annotation: Domain name=RVP; Domain location=580-674; Score= -12.8; E_value=0.07; Accession=PF00077.10; Description=Retroviral aspartyl protease
  Pfam annotation: Domain name=rve; Domain location=783-943; Score =144.6; E_value=2.6e-40; Accession=PF00665.16; Description=Integrase core domain
  Pfam annotation: Domain name=zf-CCHC; Domain location=448-465; Score =11.3; E_value=0.013; Accession=PF00098.13; Description=Zinc knuckle
  Pfam annotation: Domain name=zf-CCHC; Domain location=483-500; Score =11.4; E_value=0.013; Accession=PF00098.13; Description=Zinc knuckle
  Pfam module annotation: Pfam domain module=RVP::RVT_2::Retrotrans _gag::rve::zf-CCHC::zf-CCHC; Domain location=580-674::1145-1367::279 -394::783-943::448-465::483-500
EVYESMLTRYRERGRSRSGKAENISLQHLQIARDEYDEEATLFVFRLKSLKQGQSWSLLTQAARHHAAQKAVKSLETVEPHVKSVTEQHHIDYQFIGIEGEDEDEDEDEDDVDHDDDSHDENDDGELSFDYAQNECEQDDSTLENSMKPSQQTSINTSRQLIAHAAGDGQVYGDGKLSRFRGKEVRVLLRIRSSSHYPQKSTMNETSINNMESYLYLHPSENPATALVSPVLDSTNYHSWSRSMVTALSAKNKVEFIDGSAPEPLKTDRMHGAWCRCNNMVVSWIVHSVATSIRQSILWMDKAEEIWRDLKSRYSQGDLLRISDLQQEASTMKQGTLTVTEYFTCLRVIWDEIENFRPDPICSCNIRCSCNAFTIIAQRKLEDRAMQFLRGLNEQYANIRSHVLLMDPIPTISKIFSYVAQQERQLLGNTGPGINFEPKDISINAAKTVCDFCGRIGHVESTCYKKHGVPSNYDARNKSNGRKACTHCGKIGHTVDVCYRKHGYPPGYKPYSGRTTVNNVVAVESKATDDQAQHHESHEFVRFSPEQYKALLALIQEPSAGNTALTQPKQVASISSCTVNNPTNPGMSLSLSASLTSWILDSGATDHVTCSLHNLHSHKRINPITVKLPNGQYVHATHSGTVQLSSNITLHDVLYIPSFTFNLISISKLVSSINCELIFSSTSCVLQEMNNHMKIGIVEAKHGLYHLIPNQLTTKAVNSTITHPRCNVIPIDLWHFRLGHPSAERIQCMKTYYPLLRNNKNFVCNTCHYAKHKKMPFSLSNSHASHAFDLLHMDIRGPCSKPSMHGHKYFLTIVDDCSRFTWVHLMKSKAETRQVIMNFITFIETQYNGKVKIIRSDNGIEFFMHHYYASKGIIHQTTCVETPEQNGIVERKHQHLLNITRALLFQASLPPSFWCYALPHATYLINCIPTPYLHNISPYEKLHKHPCDISNLRVFGGLCYINTLKANRQKLDARAHPCIFIGFKTHTKGYLVYDLHSNDVTVSRNVTFYEDHFPYYSETQHINSEHSAPSPGPFSGKNLDPQIENCSSQPTISVPSSNEPSNEQPLPHLRRSTRAKNTPTYLQDYHRDLASSTPNTSAIVRYPLSSVLSYSRLSPAHRNFVMSISLTAEPTSYTEASRHDCWIKAMKVELQALQSNNTWRLTPLPPHKTAIGCRWIYKIKYRTDGSIERHKARLVAKGYTQMEGLDYLDTFSPVAKLTTVRLLLAIAALNQWHLRQLDVNNAFLHGELDEEVYMQIPPGLSVDNPQLSNADHSLFLRFTGVITTILLVYVDDIILTGNNIAEIQTMITLLDREFRIKDLGDLKFFLGLEIARTSKGIHLCQRKYTLDILSDSGMLGCKPNSTPMDYSTKLQADSGSLLSAESSSSYRRLIGKLIYLTNTRPDITYAVQQLSQYMATPTNVHLQAAFRILRYLKGTPGSGLFFAATGTPQLRAFSDSDWAGCKDSRKSTPGYLVYLGSSLVSWQSKKQSTVSRSSSEAEYRALASTTCELQWLTFLLQDFRATFIQPATLYCDNQSTIQIATNPVFHERTKHIEIDCHIVRQKLNSALIKLLPVSSSLQLADIFTKALTGNVSHVDTRPPQENLDRLCRNSFSFKVRSASQSAPLFVDNKRDSSEKLRQMRPTLSRKFNSYVLPTPVDAKSSISMRSSNQVPLKIKTNLNEPMKNLWHSSPLEQKKYENIFGDGGLSGPNAQSVLKESNSNTAYSRLPPPLIDGNLSSSHDYITAYSKKIKRHAFSGPLVSNAWPTKPVSLESVQLFSGPLLRTSIPQPPSSSPKVSPSASPPLSSSPKINELHELPRPPTISPSDSKLLGLVGHSGPLVSRGPQLSAANYLVTSNAASPLPMPASAMARSFSTSYRGAKVAAIHDSRPLEDPNKSTISEDIDSPPLMQIALSTSQPSSDGSDTVAQAV

SEQ ID NO: 125614 - protein, 340 aa, Glycine max
  Coding DNA Sequence Number=SeqID_8836
  Gene Ontology: Mol. function=nucleoside-triphosphatase activity; Cellular component=microtubule; Biological process=cell division
  Homolog annotation: Hit_ID=Q7XJI8; Match level="QueryCoverage=100%, HitCoverage=72%, E-value=2e-89, Identity=87%"; Hit description =Katanin
  Pfam annotation: Domain name=AAA; Domain location=229-340; Score =59.5; E_value=1.1e-14; Accession=PF00004.19; Description=ATPase family associated with various cellular activities (AAA)
MSGLKEHLKLAREYAVEGLYDTSVIFFDNAVAQINKHLNSNSVEDPLVRAKWMKVKKALCEETEVVKQLDAERRAFKETTRSPSQSSSFVFQPLDNYPTTSPPPPPPHDPDVWRPPSPDDARRPTRPTARSKDGAWAARGSARPAPRAAKPNSRVSTGTGKKGKDNNKYEGPDGELAEMLERDVLETSPAVRWDDVAGLTQAKSLLEEALVLPLWMPEYFQGIRRPWKGVLMFGPPGTGKTLLAKAVATECGTTFFNVSSATLASKWRGESERMVRCLFDLARAYAPSTIFIDEIDSLCNARGASGEHESSRRVKSELLVQLDGVNNSSTNEDGTRKIVM

SEQ ID NO: 125615 - protein, 89 aa, Glycine max
  Coding DNA Sequence Number=SeqID_8837
MACGGVREKVMKEQTINSILMEETRSSNRNKSIVIDIEQGGQAATYGVLLANSRSKSFISPYSGDKVKVIEVASIFRASHLVIKCSLTN

SEQ ID NO: 125616 - protein, 300 aa, Glycine max
  Coding DNA Sequence Number=SeqID_8838
  Gene Ontology: Mol. function=oxidoreductase activity; Cellular component=membrane; Biological process=transport
  Homolog annotation: Hit_ID=Q00YY6; Match level="QueryCoverage=78%, HitCoverage=75%, E-value=4e-25, Identity=33%"; Hit description =Homology to unknown gene
  Subcellular localization annotation: CTP_CleavageSite=41; ConfidenceScore=5.54e-01
MALRGLSAVAVTASIRPPGPRFRVDSGTSRIPSSGCRISVRCKAVGESRQGSLEETVVYEGIYGPWTIDDSDVREVILYRSGLVTAAASFVVAGSAAFFPDTLKQNVDLLYVLGSGGLGLSLLLIHIYVSEIKRALQALWGLGVVGSATTYFCLAQPANKNLIQYVVDNPSAVWLVGPLFAALTGLVFKEGLCYAKLEAGLLTFVIPILLLGHLKNLQTGLMDDGVKLTLLASWMTLFVIFAGRKFTQPIKFISSLILGLMLNIKLKDDIGDKSVFMFNSLPGDERKALLEKLEQQKIQN

SEQ ID NO: 125617 - protein, 221 aa, Glycine max
  Coding DNA Sequence Number=SeqID_8839
  Homolog annotation: Hit_ID=Q40156; Match level="QueryCoverage=38%, HitCoverage=13%, E-value=1e-07, Identity=36%"; Hit description =L.esculentum protein with leucine zipper
MDISSQNNDVGITEGKKEEVWQVVEYVDAFLLSSGEHVLDCVHVLPNLLERMVNKYNSGRNKFGEEPKDDKSFLNVVDHIFKLSTCNTCNIALDQTSSILEKTMSFLSAIPTKYPPLGQDQDNQEFPFNFSTQKISIFNKISTTMIATGYKIECCMAFANFRQGDFKIELQRFGHRNMKMEDVYKMPWESLEGEITTWNQVIWHCTTVLFNTEQRLYDSVP

SEQ ID NO: 125618 - protein, 353 aa, Glycine max
  Coding DNA Sequence Number=SeqID_8840
  Gene Ontology: Mol. function=oxidoreductase activity; Cellular component=cytoplasm; Biological process=gibberellic acid mediated signaling
  Homolog annotation: Hit_ID=O22377; Match level="QueryCoverage=99%, HitCoverage=95%, E-value=1e-164, Identity=76%"; Hit description =Gibberellin 3 beta-hydroxylase
  Pfam annotation: Domain name=2OG-FeII_Oxy; Domain location=203-303; Score=145.8; E_value=1.2e-40; Accession=PF03171.10; Description=2OG -Fe(II) oxygenase superfamily
MPSLSEAYRSHPVHVQHKHPDLNSLQELPESYTWTHHGHDDHTNSPASNESVPVIDLNDPNASKLIHHACTTWGAYQVLNHGIPMSLLQDIQWVGETLFSLPSHQKHKAARSPDGVDGYGLARISSFFPKLMWSEGFTIVGSPLEHFRQLWPQDYDKYCDFVMQYDEAMKKLVGKLMLLMLDSLGITKEDLKWAGSKGQFEKTCAALQLNSYPTCPDPDRAMGLAAHTDSTLLTILYQNNISGLQVHRKGVGWVTVPPLSGGLVINVGDLLHILSNGLYPSVLHRVLVNRIQRRLSVAYLCGPPPNVEICPHAKLVGPNKPPLYKAVTWNEYLGTKAKHFNKALSTVRLCAPS

SEQ ID NO: 125619 - protein, 140 aa, Glycine max
  Coding DNA Sequence Number=SeqID_8841
  Gene Ontology: Mol. function=transmembrane receptor activity; Cellular component=exocyst; Biological process=exocytosis
  Homolog annotation: Hit_ID=Q9FFX6; Match level="QueryCoverage=90%, HitCoverage=16%, E-value=1e-20, Identity=42%"; Hit description =Putative leucine zipper protein
MTLREDIVGEFYLEPCTKELAYETTTTKDMIIEAIVAMFCDLKNSIKNDNERIHVLNSAIHPLTRYVMNYLKYACEYKDTLEQVFEQGQGVNIEGIEIQNHKSVHEEVEDVGTPKNSPFTGQLMTIMDLGCKCRKEIKVV

SEQ ID NO: 125620 - protein, 290 aa, Glycine max
  Coding DNA Sequence Number=SeqID_8842
  Gene Ontology: Mol. function=hydrolase activity; Cellular component =cytosol; Biological process=cAMP biosynthetic process
  Homolog annotation: Hit_ID=Q2QRA2; Match level="QueryCoverage=97%, HitCoverage=56%, E-value=1e-105, Identity=67%"; Hit description =Amidohydrolase family protein, expressed
  Pfam annotation: Domain name=Amidohydro_1; Domain location=5-273; Score=42.2; E_value=1.7e-09; Accession=PF01979.10; Description =Amidohydrolase family
MARAVGLLGLRACLTQSTMDSGHGLPPSWATRTTHQCIQSQKDNYHKYHNTAQGRIRIWFAIRQIMNSTPRLLIQTRDAATQLNTGIHMHVAEIPHENQLVMDVHKIDHGTVTYLDKINFLQNNLLAAHSVWIDNNEISLLSRAGVKVSHCPAAAMRMLGFAPVREMLDAGICVSLGTDGAPSNNRMSIDCTSNPHQTVKLRESLARMENTGQYTFYKIPRRGVYANGTTDPTALPAETILRMVTVNGAKSVLWDDELGSLEVGKKADIVVVDPSSWSMVPVHDWYELIT

SEQ ID NO: 125621 - protein, 335 aa, Glycine max
  Coding DNA Sequence Number=SeqID_8843
  Gene Ontology: Mol. function=peptidyl-prolyl cis-trans isomerase activity; Cellular component=chloroplast; Biological process=protein folding
  Homolog annotation: Hit_ID=Q75M32; Match level="QueryCoverage=75%, HitCoverage=67%, E-value=7e-52, Identity=77%"; Hit description =Putative peptidylprolyl isomerase
  Pfam annotation: Domain name=Pro_isomerase; Domain location=83-332; Score=293.2; E_value=4.9e-85; Accession=PF00160.11; Description =Cyclophilin type peptidyl-prolyl cis-
  Subcellular localization annotation: CTP_CleavageSite=65; ConfidenceScore=5.38e-01
MAAAFTSTSATLRLSNVGESRGLQLRKCNPNPNKLKVMGGFGGCSGVAVGVRERKGIGRVRVRVRASSSSDEAVSAQSKVTQKVFFDVSIGNPVGKLVGRIVIGLYGDDVPQTAENFRALCTGEKGFGYKGSTFHRVIKDFMIQGGDFDKGNGTGGKSIYGRTFKDENFNLSHTGPGVVSMANAGPNTNGSQFFICTVKKSECKTDSVLTVTASLNAQQQTNSEIRTKELRETMIYSKREREWDGLYEIAQPNLENRAHKIKKMLPQSCPDPSDEYSTRYLAWEQTPWLDQRHVVFGQVLEGMDIVRLIESQETDRGDRPTKKVTISDCGELPNA

SEQ ID NO: 125622 - protein, 189 aa, Glycine max
  Coding DNA Sequence Number=SeqID_8844
METNLYTNDDTILCRVFPISLEGATLTWYGGLPPRSIDSFDTLIERFSVQYATSRSHCMTLAALASLRQADDESLRKFIGKFGRTVVQIRNLNTEIKLHSMLLALHPSKFVDNLCKKLPGSMDEPHERAKGYIQIEEMSKFWNEVYQVKQKCERWKANTKTYLHKSDKRHKLDKCQPLSKRPGMSVRYP

SEQ ID NO: 125623 - protein, 286 aa, Glycine max
  Coding DNA Sequence Number=SeqID_8845
  Gene Ontology: Biological process=D-gluconate metabolic process
  Homolog annotation: Hit_ID=P63020; Match level="QueryCoverage=60%, HitCoverage=91%, E-value=2e-87, Identity=89%"; Hit description =Protein gntY
  Pfam annotation: Domain name=Fe-S_biosyn; Domain location=104-189; Score=68.4; E_value=2.4e-17; Accession=PF01521.11; Description=Iron -sulphur cluster biosynthesis
  Pfam annotation: Domain name=NifU; Domain location=206-275; Score =23.4; E_value=9e-07; Accession=PF01106.8; Description=NifU-like domain
  Pfam module annotation: Pfam domain module=Fe-S_biosyn::NifU; Domain location=104-189::206-275
  Subcellular localization annotation: CTP_CleavageSite=58; ConfidenceScore=5.06e-01
MGAAAQILARNRTQGDAGTAAFVKIINKAPPAAAAAYRSGAERAAASPPRLAARHVLSARARKSNLRGAFRLEMAVRGRHILLIDDVVTTGSTRTHRMPVPYLVERRRWAYYNQEDGTQIRVFVINPGTPTAECGVSYCPPDAVEATDTELKFDKLSAYVDELSAPYLEDAEIDFVTDNLGSQLTLKAPNAKMRKVSDDAPMVERVEYLLQAQINPQLASHGGRVSLMEITDEGYAILQFGGGCNGCSMIDVTLKDGIEKELLAAFPELKGVRDLTEHQRGEHSYY

SEQ ID NO: 125624 - protein, 585 aa, Glycine max
  Coding DNA Sequence Number=SeqID_8846
  Homolog annotation: Hit_ID=Q6CZL4; Match level="QueryCoverage=38%, HitCoverage=90%, E-value=1e-112, Identity=89%"; Hit description =Glycerol-3-phosphate regulon repressor
  Pfam annotation: Domain name=CoA_trans; Domain location=367-563; Score=-46.0; E_value=0.071; Accession=PF01144.13; Description =Coenzyme A transferase
  Pfam annotation: Domain name=DeoR; Domain location=364-520; Score =249.1; E_value=9.1e-72; Accession=PF00455.13; Description=Bacterial regulatory proteins, deoR family
  Pfam annotation: Domain name=GntR; Domain location=286-348; Score =4.2; E_value=0.024; Accession=PF00392.11; Description=Bacterial regulatory proteins, gntR f
  Pfam annotation: Domain name=HTH_11; Domain location=295-346; Score =18.5; E_value=0.00082; Accession=PF08279.2; Description=HTH domain
  Pfam annotation: Domain name=HTH_DeoR; Domain location=295-351; Score= 105.4; E_value=1.7e-28; Accession=PF08220.3; Description=DeoR-like helix-turn-helix domain
  Pfam annotation: Domain name=Rhomboid; Domain location=195-294; Score= -31.7; E_value=0.04; Accession=PF01694.12; Description=Rhomboid family
  Pfam module annotation: Pfam domain module=CoA_trans::DeoR::GntR::HTH_ 11::HTH_DeoR::Rhomboid; Domain location=367-563::364-520::286 -348::295-346::295-351::195-294
PVLVMCYHGNSSKGAAQFLLSQGFSDVYSIDGGRHRQPLIDRLKEGEHRMMRITQFNQPRMAQAFVDYMATRGVTLRIERESHYVIVLDDDSKLEMVENELAQFVRDPNHPRYQAASWHSGTTDSGLRYERGNIWANIRERAGPLTLTIMIACVAVFILMQIVGDDVPRAAALLAAAHSVQPDVVVVSRWCGREAPRQRQAVRYHADSALLSGWMQAKFTGVLFGGLSGVVYALMGYCWLRGKRDPESGIYLERGLIGFAIVWLVIGWYGAFGLSIANAAHVTGLLERDVKQTQRHDAIIDLVRRQGYVSTEELVDHFEVSPQTIRRDLNDLADQNKIQRHHGGAALPSSSENTAWQDRKMMWSAEKARIAERVASQIPDGATLFIDIGTTPEAVAHALLNHNNLRIVTNNLNVAILLMAKPDFRVIIAGGEVRTRDGGIMGEATLDFISQFRLDYGILGISGIDMDGSLLEFDYHEVRTKRAIIENSRCVMLVVDHSKFGRNAMVNLGNMSLIDYLCASMRTCDAPGHRAYCKVAIDGDQAAAARLFSLLLHFPVAFFSVRGLTYSFRFALARVYRFGCKGMHY

SEQ ID NO: 125625 - protein, 90 aa, Glycine max
  Coding DNA Sequence Number=SeqID_8847
MKGRVNLGLEGESMVLTYEKGWAVPERKTNDQSEQKVISRDLIWARLDEGKCGFRNLHFMQNFAVKLCSRILHKCRKILCFAGCGKSSAE

SEQ ID NO: 125626 - protein, 1444 aa, Glycine max
  Coding DNA Sequence Number=SeqID_8848
  Gene Ontology: Mol. function=nucleoside-triphosphatase activity; Cellular component=integral to membrane; Biological process=transport
  Homolog annotation: Hit_ID=Q76CU2; Match level="QueryCoverage=97%, HitCoverage=96%, E-value=0.0, Identity=66%"; Hit description =Pleiotropic drug resistance protein 1
  Pfam annotation: Domain name=ABC2_membrane; Domain location=1174 -1386; Score=258.7; E_value=1.2e-74; Accession=PF01061.14; Description=ABC-2 type transporter
  Pfam annotation: Domain name=ABC2_membrane; Domain location=496-709; Score=215.7; E_value=1e-61; Accession=PF01061.14; Description=ABC-2 type transporter
  Pfam annotation: Domain name=ABC_tran; Domain location=170-394; Score= 67.4; E_value=4.5e-17; Accession=PF00005.17; Description=ABC transporter
  Pfam annotation: Domain name=ABC_tran; Domain location=892-1076; Score=92.4; E_value=1.4e-24; Accession=PF00005.17; Description=ABC transporter
  Pfam annotation: Domain name=PDR_assoc; Domain location=714-778; Score=130.9; E_value=3.6e-36; Accession=PF08370.2; Description=Plant PDR ABC transporter associated
  Pfam module annotation: Pfam domain module=ABC2_membrane::ABC2 _membrane::ABC_tran::ABC_tran::PDR_assoc; Domain location=1174 -1386::496-709::170-394::892-1076::714-778
MENDSSLRVSSSIRRDASDIFSPSSFEEDDEEALKWAALDKLPTYNRLKKGLLITSNGEVNEIDVTDMGTQRRKEVLERLVRDAEEDNEKFLLKLRERIDRVGVSIPTIEARFEHLNVEAEAYVGSRALPTFFNFIVNTVESYLNYLHILSSKKKHVTILKDVSGIVKPCRMTLLLGPPSSGKTTLLLALAGKLDPDLKVSGRVTYNGHGMNEFVPQRTAAYISQDDVHIGEMTVRETLAFSARCQGVGSRYDMLSELSRREIVTDIKPDPNIDIYMKAIASEGQEANQMMTEYVLKILGLEMCADIVVGDEMLRGISGGQRKRVTTGEMLVGPTNALFMDEISSGLDSSSTVQIIKCLRQMVHILDGTAVISLLQPEPETYELFDDIILLSDGQIVYQGPREFVLEFFESKGFRCPERKAVADFLQEVTSRKDQQQYWIHKDEPYSFVSVNEFAEAFRCFHVGRKLGDELAVPFDKTKNHPAALTTKKYGVNKKELLKANFSREYLLMKRNAFVYIFKLSQLALMAVVAMTVFLRTEMHKDSVDNGGVYTGALFFSIVMILFNGMADISMTVAKLPIFYKQRDLLFYPAWAYAIPGWILKIPITLAEVVVWVSITYYVIGFDPSVARFFKQYLLLLLLGQMASALFRTIAAIGRNMIIANTFGSFAIVTLLTLGGFILSREDVKKWWIWGYWISPIMYEQNAMMVNEFLGQSWSHVLPNSTESLGVEVLKSRGFFTHASWYWIGAGALLGFVVLLNITFTLALTYLNPPEMSRAVIFKESHGNRNKDRTLDDIRLSLRLTGNAPSSNLEIGNLDDNGTESMSSRSASVRPKAAVESSHRRKRGMVLPFEPHSLTFDGITYSVDMPQEMKNQGVVEDRLVLLKGVSGAFRPGVLTALMGVSGAGKTTLMDVLAGRKTGGYIEGSITISGYPKNQETYAQISGYCEQNDIHSPHVTIYESLLYSAWLRLSPEVNSETRKMFIEEVMELVELNLLREALVGLPGVSGLSTEQRKRLTIAVELVANPSIIFMDEPISGLDARAAAIVMRTVRNIVDTGRTIVCTIHQPSIDIFEAFDERGGREIYVGPLGRHSNHLVEYFEQRIEGVGKIKDGHNPAAWMLEITTPAREMDLNVDFSDIYKNSVLCRNKALVAELSKPAPGSKELHFPTQYAQPFFVQCKACLWKQHWSYWRNPPYTAVRFLFTTFVALMFGTMFWDLGSKTKQDLFNAIGSMYNAILFLGIQNALSVQPVVAIERTVFYRERAAGMYSAIPYALAQVVIELPYIFVQAVTYGIIVYAMIGFEWTASKFFWYLFFMYFTFLYFTFYGMMTVAVTPNQHIASIVATAFYGIWNLFSGFVVPRPSIPVWWRWYYWACPVAWSLYGLVASQFGDITSAVELNETVKEFLRRYFGYRDDFVGVAACVVVGFAVLFATIFAFSLKVFNFERR

SEQ ID NO: 125627 - protein, 758 aa, Glycine max
  Coding DNA Sequence Number=SeqID_8849
  Homolog annotation: Hit_ID=A0EHS3; Match level="QueryCoverage=48%, HitCoverage=13%, E-value=1e-07, Identity=18%"; Hit description =Chromosome undetermined scaffold_97, whole genome shotgun sequence
MAEAEDYGFLPEEMAVNENLGYPKAFAKLCRDRGFGPYSHGPPFSFIPYALSEDEAETAKDLDEIFPIIDPKAKATSKPKIFVSVLWKQLRHLGNAGFDPAVIRVDGYGNVLYYHADSASPLAWDVDHWFPCSRGGLTVLSNLRLLQRQACKRKKNKLEFLVPWWDFQLGISVNQFLMMIVVFATCRHRAFSFLFYEGENQELNASQIVDSHSFPQHFFALKEEVGLAPASIVESRREPCDALALRQLDYNKKPMPMSPAIVAARKRNGSLLKENEDPDFVKNPYQAIVMARDSLKQREETTKKQAEIQKLDDEVNEMKLKNEEEKLTIQDLEMALIKRRRKAEKCRRLAEAQSSYRTMLEKMIRDTMHHVIYKEQVRLNQAASNALMARLEAQRAICDAAEKDLHKKYKQRDDIEKQIRPEWEQGRKRSRIDDATYEERDSKPALYLPGPRPRTPLRKELRVFLEEEQRSSEVDLSANEEQKREEKVEQKREEKVEQKQEEKVEKLKMPANNDPEEKLEEHTRSSVALDEENSIEQRLQKLKISEGKRSYGISFSGLHKTEIEEDEETRKQRGKGNVEKWLQMLLENGQQQEGTDPQETSENASCGTEEKIIQQLNQKFPQKELKISKVSDSDYKEKQLQLLQDRNGWTEKEDRIENEARNIIPTGYKNYSGEACIGEGNCTPNVEGMERKEQHKKEKRLPRSESARSLRRIPSSPSLLLGIKKGVDYIWKKPTASDDADLAASNSFLRSSIKTIKK

SEQ ID NO: 125628 - protein, 125 aa, Glycine max
  Coding DNA Sequence Number=SeqID_8850
  Gene Ontology: Mol. function=RNA-directed DNA polymerase activity; Biological process=DNA integration
  Homolog annotation: Hit_ID=Q19PP0; Match level="QueryCoverage=96%, HitCoverage=7%, E-value=2e-13, Identity=40%"; Hit description=TIR -NBS-LRR type disease resistance protein
MASAMAIYSASEDDLETVGCLTSCFSRILERVQRKGSNILESLSMSKAYLLWYKAIPSLDLTTSNPKKNELAYIFNDELLIQIGFNCTDFNKVVSCQEQIICINQDKNRPRCRDFSEQGIICLGR

SEQ ID NO: 125629 - protein, 152 aa, Glycine max
  Coding DNA Sequence Number=SeqID_8851
  Gene Ontology: Mol. function=signal transducer activity; Biological process=response to light stimulus
  Homolog annotation: Hit_ID=Q9C941; Match level="QueryCoverage=98%, HitCoverage=51%, E-value=8e-40, Identity=46%"; Hit description =Putative non-phototropic hypocotyl; 25081-26618
  Pfam annotation: Domain name=NPH3; Domain location=2-108; Score= -80.5; E_value=2.9e-05; Accession=PF03000.5; Description=NPH3 family
MVRVDATYRVELENRISWQLDQASLKELMIPSFSHTCGTLLDVAKLVDCYLDEAAVDANLTLSEFITLAGALPSHARAAADGLYRAIDTYLKVLFSEQTKLHCHIDWSGSFNSLRSPNGGLDPPGRCLSKREMNAQQMEIKKLKEDVYRLQS

SEQ ID NO: 125630 - protein, 507 aa, Glycine max
  Coding DNA Sequence Number=SeqID_8852
  Gene Ontology: Mol. function=oxidoreductase activity; Cellular component=nucleus; Biological process=metabolic process
  Homolog annotation: Hit_ID=UPI000061042D; Match level="QueryCoverage =77%, HitCoverage=60%, E-value=4e-61, Identity=38%"; Hit description =dihydrouridine synthase 3-like
  Pfam annotation: Domain name=Dus; Domain location=347-506; Score= -127.7; E_value=0.085; Accession=PF01207.8; Description =Dihydrouridine synthase (Dus)
  Pfam annotation: Domain name=zf-CCCH; Domain location=118-146; Score =9.1; E_value=0.083; Accession=PF00642.15; Description=Zinc finger C -x8-C-x5-C-x3-H type (and similar)
  Pfam annotation: Domain name=zf-CCCH; Domain location=79-108; Score =17.9; E_value=0.0057; Accession=PF00642.15; Description=Zinc finger C-x8-C-x5-C-x3-H type (and similar)
  Pfam module annotation: Pfam domain module=Dus::zf-CCCH::zf-CCCH; Domain location=347-506::118-146::79-108
EEPRDEGQQGGSVEQSPEQLVARAIAPVKKDFLRPPPVRSSSPNDGVSIPNDNNKTSVLAKEKKSKRQLKRERRLEQKSARNLCPEIAKTGDVSSCPYKDKCRFSHDLEAFKAQKPADLEGQCPFFKSGGACPYGLGCRFSSTHEDGVPSANLNGLKNNSEVNGLSKHVQKLLWKNKMSFSKADAQLKSLGLVGTSKSKRNDLENKDEGDTGSNKCDHSDYSGSCVVTSDSCCKLECPEEVMKDDDNDIDGKSESDVLCPQKRRKIAENCGPMDAENEGHRFIFDSICVTWLHTAETGVSVTEQIVERSCTKSEPEAGTDALTPETDLSLKLHSREKKLIDFREKLYLAPLTTVGNLPFRRVCKVLGADVTCGEMAMCTNLLQGQASEWALLRRHSSEDLFGVQICGAYPDTVARTVELIEQECTIDFIDINMGCPIDIVVNKGAGSALLTKPMRMKSIVEVASGTAEKPITIKVFAVLNTTELDTMIYVTPINILIAYSLSSSVFW

SEQ ID NO: 125631 - protein, 161 aa, Glycine max
  Coding DNA Sequence Number=SeqID_8853
  Gene Ontology: Mol. function=oxidoreductase activity; Cellular component=nucleus; Biological process=metabolic process
  Homolog annotation: Hit_ID=UPI0000E24EDE; Match level="QueryCoverage =95%, HitCoverage=34%, E-value=4e-53, Identity=65%"; Hit description =PREDICTED: dihydrouridine synthase 3-like isoform 3
MVARGALIKVSITLVQLTILIYFSLSLSIMSHPWIFTEIKEQRHWDISSGERLNILKDFVNFGLEHWGSDTKGVETTRRFLLEWLSYTFRYIPVGLLDVVPQRLNWRPPSYYGRDELETLMASDSAADWIRISEMLLGKVPDGFTFAPKHKSNAYDRAENG

SEQ ID NO: 125632 - protein, 646 aa, Glycine max
  Coding DNA Sequence Number=SeqID_8854
  Gene Ontology: Mol. function=catalytic activity
  Homolog annotation: Hit_ID=Q5VQE5; Match level="QueryCoverage=97%, HitCoverage=98%, E-value=0.0, Identity=54%"; Hit description =Alpha/beta hydrolase-like
  Pfam annotation: Domain name=Abhydrolase_1; Domain location=391-630; Score=55.5; E_value=1.8e-13; Accession=PF00561.10; Description =alphabeta hydrolase fold
MAARGGQCFEKLRRFVRTVFFVAALVASLLVTSLPVLVAVMDVLVPCVLISNFTCVKCYGFKEHLRRYAFKSSLTDIPLVSVIRSFIIICVYSICDSPALSHGPYLGTVTLSSFVSIVLLSVKACVFTVNSQIEAEATVSSTRQRLHLKKSWGMPVLFLSSVAFALGHIVVAYRTSCRARRKLMFHRVDPEAVLLCKSVFTGYQKVPRSPVPSEGRTPKSDSEMKRRPFGAARDEELPIRVLADSESLFIPCQGLTLHYKLSLPGSPPLNMSSAFCSTSSMAGGLPKLNRQLTFISPKVHRQLYRSYSNQFHGSSLYAPLLDGPVTSPHLVEEIPVLHLDEIPEDDETYKSKLEQNLEDIGQVGIVLIHGFGGGVFSWRHVMTPLARQSNCTVAAFDRPGWGLTSRLSREDWEKKELPNPYKLESQVDLLLSFCSEIGLSSVVLIGHDDGGLLALMAAQRVQSSMNSFNVTVKGVVLLNVSLSREVVPSFARILLHTSLGKKHLVRPLLRTEITHVVNRRSWYDATKLTTEVLTLYKAPLYVEGWDEALHEIGKLSSETILSAKNADLLLQAVKDIPMLVIAGAEDSLVSMKYCQAMASKFVNSRLVAISGCGHLPHEECPKALLEAISPFINDKLFFSVYNSQSQ

SEQ ID NO: 125633 - protein, 45 aa, Glycine max
  Coding DNA Sequence Number=SeqID_8855
MVAVKHIAKGTMPTHYTYTYWSKALSYVRVTCGVVKLLAGYGKFA

SEQ ID NO: 125634 - protein, 82 aa, Glycine max
  Coding DNA Sequence Number=SeqID_8856
  Subcellular localization annotation: CTP_CleavageSite=7; ConfidenceScore=5.01e-01
MRVHCNQASQRPSMITDSPPLLMFPRTRSPVESPIVATYPLVGGRCETHGCIFQGRKTRGVATNVYLRKTSEKPEKDVVYEL

SEQ ID NO: 125635 - protein, 168 aa, Glycine max
  Coding DNA Sequence Number=SeqID_8857
  Gene Ontology: Mol. function=structural constituent of ribosome; Cellular component=ribonucleoprotein complex; Biological process =translation
  Homolog annotation: Hit_ID=Q9BBQ0; Match level="QueryCoverage=61%, HitCoverage=85%, E-value=6e-49, Identity=94%"; Hit description =Chloroplast 50S ribosomal protein L14
  Pfam annotation: Domain name=Ribosomal_L14; Domain location=34-154; Score=181.9; E_value=1.6e-51; Accession=PF00238.10; Description =Ribosomal protein L14pL23e
MSRNVRRGGQIWVRIFPDKPVTVRPTENTYGFRKRFSRILADNSGARELMCIRILGASNRRYAYIGDIVVAVIKQAVPNTNLERSEVIRAVIVRTCKELKRSNGIIIQYDDNAAVVIDQEGNPKGTRIFCAIARELRQLNFTKNSFISTQGIIRRNCAMDTLFFCEID

SEQ ID NO: 125636 - protein, 43 aa, Glycine max
  Coding DNA Sequence Number=SeqID_8858
MRKLIKERMENKVANFVGLNKVKWWLDRNIEMAITEATGLQMR

SEQ ID NO: 125637 - protein, 60 aa, Glycine max
  Coding DNA Sequence Number=SeqID_8859
MGKRPQLTDELRVLSSMNGPTMIPSGEELEKSYAGVDMLKFLVDLFHKNLFQLNRAPWVI

SEQ ID NO: 125638 - protein, 34 aa, Glycine max
  Coding DNA Sequence Number=SeqID_8860
MTILADYQGSVNLKVQNMKFVESASPKASIQTTK

SEQ ID NO: 125639 - protein, 87 aa, Glycine max
  Coding DNA Sequence Number=SeqID_8861
MHPPPSSPEPPRIDCHSCILHHQVGAPRIDCLALFVHPPPSYSKPHVLIVIHASSVIKYGAFEKEEGETGVTYFKLFWVETIVIEIN

SEQ ID NO: 125640 - protein, 121 aa, Glycine max
  Coding DNA Sequence Number=SeqID_8862
  Homolog annotation: Hit_ID=UPI000044A741; Match level="QueryCoverage =59%, HitCoverage=17%, E-value=5e-09, Identity=53%"; Hit description =PREDICTED: similar to Ac1147, partial
MGGGAWPFLVGEAICLIIAIVGLQRGIPSKRESSARVDYVPALCTHRPSLLPIEWSGEVFGLRRREPAEGSLSMPHNQIDPRTCLFIYRREGGDDHGAPCARPPRLRDKHKPRRFVRQGTQ

SEQ ID NO: 125641 - protein, 82 aa, Glycine max
  Coding DNA Sequence Number=SeqID_8863
MGDGCIYEEAERDRSRGFMWSVGAKGSPRVFWGMCICVRTWWEQNHWSSLFYVGPPNANVDMDPISHPHSHCSQIDQLHSPL

SEQ ID NO: 125642 - protein, 172 aa, Glycine max
  Coding DNA Sequence Number=SeqID_8864
  Gene Ontology: Mol. function=cytochrome-c oxidase activity; Cellular component=mitochondrial envelope; Biological process=electron transport
  Homolog annotation: Hit_ID=Q0KKQ3; Match level="QueryCoverage=90%, HitCoverage=93%, E-value=1e-49, Identity=64%"; Hit description =Cytochrome c oxidase subunit Vb
  Pfam annotation: Domain name=COX5B; Domain location=46-160; Score =53.1; E_value=9.4e-13; Accession=PF01215.9; Description=Cytochrome c oxidase subunit Vb
  Subcellular localization annotation: CTP_CleavageSite=35; ConfidenceScore=5.41e-01
MWRRLFSSSNLKSLHTALSPSRPRLAAPLLTRHVTAHSGASSVKRRVEDVVPIATGHEREEIQADLEGRDILEINHPVGPFGTKETGTNTMYKIGIISTPKVIHEAPAVVKSYFDRRIVGCPGDEGEDEHDVVWFWLEKGKPKECPVCSQYFKLEVVGPGGDPYGHGDHDHH

SEQ ID NO: 125643 - protein, 495 aa, Glycine max
  Coding DNA Sequence Number=SeqID_8865
  Gene Ontology: Mol. function=inorganic anion exchanger activity; Cellular component=integral to membrane; Biological process=anion transport
  Homolog annotation: Hit_ID=Q9XI23; Match level="QueryCoverage=98%, HitCoverage=71%, E-value=1e-170, Identity=63%"; Hit description =Boron transporter-like protein 2
  Pfam annotation: Domain name=HCO3_cotransp; Domain location=2-371; Score=-321.8; E_value=0.00031; Accession=PF00955.11; Description =HCO3- transporter family
MVSEFNVPEEGDPTMEKYQFHWLYANGLLGIIFTFGLLYTSLKSRRARSWLYGTGWFRSFIADYGVPFMVVVWTALSFIVPSKVPSGVPRRLTSPLAWESTSLHHWTVIKDMGEVSLAYIFAAFIPALMIAGLYFFDHSVASQMAQQKEFNLRKPSAYHYDILLLGLTTLLCGLIGLPPSNGVLPQSPMHTKSLAVLKKQLIRRKMVKSAKESIRQKASKSEIYGKMQAVFIEMDSCPDNHLVVKELEDLKEVVLNGEDKGLNNKSTFDPEKHIDAYLPVRVKEQRVSNLLQSLLVGASVFAMPAIKKIPTSVLWGYFAYMAIDSLPGNQFWERILLLFVTPSRWYKLLEGDHASFVESVPYKYIVFFTLFQCVYFLVCFGVTWIPIAGILFPLPFFLLITLRQHILPKLFKPHHLRELDAAEYEEIVGAPALSFNKSFREVESPLVGSKEIGNAEILDELTTNRGELKVRTVSFGEERNCQVYPDENGSPLTDF

SEQ ID NO: 125644 - protein, 207 aa, Glycine max
  Coding DNA Sequence Number=SeqID_8866
  Gene Ontology: Mol. function=protein serine/threonine kinase activity; Cellular component=membrane; Biological process=protein amino acid phosphorylation
  Homolog annotation: Hit_ID=Q6I5Q6; Match level="QueryCoverage=71%, HitCoverage=34%, E-value=8e-35, Identity=50%"; Hit description =Putative serine/threonine protein kinase
  Pfam annotation: Domain name=Pkinase; Domain location=62-205; Score= -106.5; E_value=0.032; Accession=PF00069.15; Description=Protein kinase domain
  Pfam annotation: Domain name=Pkinase_Tyr; Domain location=62-207; Score=-121.0; E_value=4.8e-05; Accession=PF07714.7; Description =Protein tyrosine kinase
  Pfam module annotation: Pfam domain module=Pkinase::Pkinase_Tyr; Domain location=62-205::62-207
  Subcellular localization annotation: CTP_CleavageSite=60; ConfidenceScore=5.04e-01
MSCFSCFVSRGKDVRRVEIDNGSRSATSSSEGKGKKSVSNKGTSTAAASFGFRELAEATRGFKEVNLLGEGGFGRVYKGRLSTGEYVAVKQLIHDGRQGFHEFVTEVLMLSLLHDSNLVKLIGYCTDGDQRLLVYEYMPMGSLEDHLFEFLGSVIETPSTTATAMGLVVVACVIHPLVIFDFAIAAILLFATHFSGFGVCYMPLFGI

SEQ ID NO: 125645 - protein, 367 aa, Glycine max
  Coding DNA Sequence Number=SeqID_8867
  Gene Ontology: Mol. function=protein serine/threonine kinase activity; Cellular component=chloroplast; Biological process=protein amino acid phosphorylation
  Homolog annotation: Hit_ID=P43293; Match level="QueryCoverage=90%, HitCoverage=84%, E-value=1e-106, Identity=57%"; Hit description =Probable serine/threonine-protein kinase NAK
  Pfam annotation: Domain name=Pkinase; Domain location=45-325; Score =161.0; E_value=3.1e-45; Accession=PF00069.15; Description=Protein kinase domain
  Pfam annotation: Domain name=Pkinase_Tyr; Domain location=45-325; Score=114.7; E_value=2.7e-31; Accession=PF07714.7; Description =Protein tyrosine kinase
  Pfam module annotation: Pfam domain module=Pkinase::Pkinase_Tyr; Domain location=45-325::45-325
  Subcellular localization annotation: CTP_CleavageSite=19; ConfidenceScore=5.07e-01
MGNCFRKTTNNPRPSPPVSATRNFRPDTNLINYTLDELKSATRNFRPDTVLGEGGFGRVFKGWIDKNTFKPSRVGVGIPVAVKKSNPDSLQGLQEWQSEVQFLGKFSHPNLVKLIGYCWEENHFLLVYEYMQKGSLESHLFRSGPEPLSWDIRLKIAIGAARGLAFLHTSEESVIYRDFKSSNILLDGDFNAKLSDFGLAKFGPVNGISHVTTRVMGTYGYAAPEYMATGHLYVKSDVYGFGVVLLEMLTGRAALDTNQPAGMQNLVECTMSCLHDKKRLKEIIDPRMNEQYSLRAAFQIAQLVLKCLETDPKKRPSTKEVLGTLEKARAIKYKPKGKKVCQTSQRRSPSIHYNNGYPKSRTNSPPQ

SEQ ID NO: 125646 - protein, 208 aa, Glycine max
  Coding DNA Sequence Number=SeqID_8868
  Homolog annotation: Hit_ID=Q94HA7; Match level="QueryCoverage=26%, HitCoverage=17%, E-value=6e-17, Identity=78%"; Hit description =Putative ethylene-responsive protein
MGEILGLEVAEGLGNYIPTPIHLMEAKKEYEVDHLTTPTGTSFSQLLFGDHDDDYDECALGLAVDQSYTRSPFFSIHKAPQLLCFANHQYQGDVLLPETNVTPQNLSSLLVTPLLLALPPATTPTPPSIPYLSLMKEKLGERIAALQQLVSPFGKTDTTSVLHEAIGYIRFLHDQVPVLCSPYLESSPSSYHQNQHVSPIPSFIKISM

SEQ ID NO: 125647 - protein, 227 aa, Glycine max
  Coding DNA Sequence Number=SeqID_8869
  Gene Ontology: Mol. function=serine esterase activity; Cellular component=membrane fraction; Biological process=fatty acid metabolic process
  Homolog annotation: Hit_ID=UPI000034F493; Match level="QueryCoverage =85%, HitCoverage=76%, E-value=7e-83, Identity=76%"; Hit description =carboxylic ester hydrolase
  Pfam annotation: Domain name=Abhydrolase_2; Domain location=1-191; Score=22.6; E_value=1.1e-09; Accession=PF02230.7; Description =PhospholipaseCarboxylesterase
MQIKWICPTAPTRPVAILGGFPCTAWFDVGELSEDGPDDWEGLDASAAHIANLLSTEPADVKVGIGGFSMGAAIALYSSTCFAMGRYGNGIPYPLNLRTVVGLSGWLPGSRSLRNKIEVSHEARRRAASLPILLCHGISDDVVLCKYGEKSAQSLCSAGFRYVAFKSYDGLGHYTVPREMDEVCTWLSSRLGLEGAVKERAAIPLKRMLDNDVAMLSINYAAASNNV

SEQ ID NO: 125648 - protein, 187 aa, Glycine max
  Coding DNA Sequence Number=SeqID_8870
  Homolog annotation: Hit_ID=Q2HVX5; Match level="QueryCoverage=63%, HitCoverage=43%, E-value=3e-39, Identity=67%"; Hit description =Biotin/lipoyl attachment
  Pfam annotation: Domain name=Biotin_lipoyl; Domain location=110-176; Score=17.9; E_value=7.9e-06; Accession=PF00364.12; Description =Biotin-requiring enzyme
  Pfam annotation: Domain name=zf-RanBP; Domain location=6-37; Score =10.0; E_value=0.064; Accession=PF00641.9; Description=Zn-finger in Ran binding protein and others
  Pfam module annotation: Pfam domain module=Biotin_lipoyl::zf-RanBP; Domain location=110-176::6-37
  Subcellular localization annotation: CTP_CleavageSite=30; ConfidenceScore=5.10e-01
MAAPQLSGDWYCGAANCGAHNFASRSSFFECAAVNNDSAADTSRSRAFGGAGTAWKSGDWIFNRSEGSEEVKSSGLTSELIPNLIEPVDPIPSSGSIQRFLNKAADEGLVIIQSPKGRRAPPSCKEKQNVEEGQVICYIEQLGGELPIESDVSGEVIKILQKDGDPVGYGDALVAILPSFPGIKKLQ

SEQ ID NO: 125649 - protein, 90 aa, Glycine max
  Coding DNA Sequence Number=SeqID_8871
  Gene Ontology: Mol. function=protein disulfide oxidoreductase activity; Cellular component=mitochondrion; Biological process=cell redox homeostasis
  Homolog annotation: Hit_ID=Q1PCR8; Match level="QueryCoverage=48%, HitCoverage=37%, E-value=4e-15, Identity=84%"; Hit description =Glutaredoxin
  Subcellular localization annotation: CTP_CleavageSite=56; ConfidenceScore=5.10e-01
MATSLSNILFKGIAARSFTAPVSFISFHPSWRGRKGEYLVEWNRFHSISNWPTFPQVFIKGEFIGGSDIVLNMHQTGELKEKLKDIMSKQ

SEQ ID NO: 125650 - protein, 153 aa, Glycine max
  Coding DNA Sequence Number=SeqID_8872
MDAEEAQKQLTHYNFKEAELSDKNKLVVKKTEMCRRFRRGVSVHGRTSHFLHSSTLLPNPYRLKEDKQAWSQVGKLRYSSPESKRMRTSAAAPSDGCCYAEQWIMQTSAATNASTSTVATKNEPSCPVKLIFKNNDLQRISGIYAEQTGWTSE

SEQ ID NO: 125651 - protein, 221 aa, Glycine max
  Coding DNA Sequence Number=SeqID_8873
  Homolog annotation: Hit_ID=Q2QLN8; Match level="QueryCoverage=71%, HitCoverage=71%, E-value=3e-23, Identity=38%"; Hit description =Expressed protein
  Pfam annotation: Domain name=NUC189; Domain location=103-171; Score= -0.1; E_value=0.0037; Accession=PF08162.2; Description=NUC189 domain
MQRFTVRVAELSPITILRYADQGQVADGILHDVHLSEPTMGEKLAALSLPDKNKFRRDKEQDSSDPTKPPSADSVHVLLGQALNADGRTLLLDCLYTQDEKVITKSIAQLNPSNVLKFLHPLISINESRGAILACTLPWLSVLFYSMQLIESRVWTFESAVHLSSCVDIHYTGVADEEVDEGQTVPVIYEDDSSEESGDLETDEAFEVFSDIEESNDMMSE

SEQ ID NO: 125652 - protein, 101 aa, Glycine max
  Coding DNA Sequence Number=SeqID_8874
  Homolog annotation: Hit_ID=Q9XET0; Match level="QueryCoverage=99%, HitCoverage=94%, E-value=2e-15, Identity=92%"; Hit description=Seed maturation protein PM30
MASHRQSYEAGQTKGRTEEKTNQMMGNNGEKTQEIAQAAKDKTQQTAQAAKEKAQQNTDEGIGPVREGQHQRVPAADRGEGEGRCPRCYRDCEANPWLGPA

SEQ ID NO: 125653 - protein, 322 aa, Glycine max
  Coding DNA Sequence Number=SeqID_8875
  Gene Ontology: Mol. function=nucleic acid binding; Biological process= DNA integration
  Homolog annotation: Hit_ID=Q1RWN2; Match level="QueryCoverage=98%, HitCoverage=35%, E-value=5e-26, Identity=38%"; Hit description =Peptidase S8 and S53, subtilisin, kexin, sedolisin; Integrase, catalytic region; Zinc finger, CCHC-type
MSSKNFVQPVIPHFDGHYNHWNGVATPSDDVVLTYAQQKEYEVMKLKDLKAKNYLFQAIDRSILETIFCKDTSKEIWDSMKKKYQGSSRVKRAQLQALRRDFEVLQMKEVHEQKMNRSSTMEEHALKASTNTHSNNSRGRGRGRGRGRGRGDRGNRDFSNNSKDNNDQFQGNEKGKSSNFIEEKKVETLLMAVEDAKDSETKIWYVETGCSNHMSGMMGKGDIKIKARNGFVETTSNVLHVPDLKSNLLSVGQLQEKVIKMNSGRLFPLKIESIHSSLMAKDTVSTWSWHYRYGHLSFSGLKTLEQKNMVIGLPQITAPSRL

SEQ ID NO: 125654 - protein, 457 aa, Glycine max
  Coding DNA Sequence Number=SeqID_8876
  Gene Ontology: Mol. function=nucleic acid binding; Cellular component= intracellular; Biological process=DNA integration
  Homolog annotation: Hit_ID=Q1RSG2; Match level="QueryCoverage=84%, HitCoverage=46%, E-value=3e-52, Identity=47%"; Hit description =Integrase, catalytic region; Zinc finger, CCHC-type
MTSEKAWSGRKPTVDHFKIFGCIAYAHILDKKISKLDDKGEKCIFLGVSDQSKAYKLYNPATKKIIISRDVVFDEERFWENNIDETKQILANFDEDNEDEEFQTRDLEEQRIPAITVEDERPQRARRRLAWMSDCEVTGIEDPITHSALFSNCDPTTFKSAIKEEKWRKVMDDEIDSIERNDTWELCDLPNGHNTIRVKWVFKTKLKENGEMDKYKACLVAMAQNAGPIFQLDVKSAFLHGYLEEQVHGESYRNAFTCAKRILCYLQGTREFELFYKRGENFNLLGFTDSDYAGDSDDKKSTFGYIFMMGFAAISWSSRKQPIVTLSTTKAKFVAASACAYQAIWLRNILEEVHFKQQGPTLIYCDNSSTIKLSKNPIMHGRNKHIDGESSKWIEKRNPSSDDGAKKTTEATGQTKKPINEDINASADAFIKNFRQQLLIQRLQSIENYDQMLARGH

SEQ ID NO: 125655 - protein, 415 aa, Glycine max
  Coding DNA Sequence Number=SeqID_8877
  Gene Ontology: Mol. function=polygalacturonase activity; Cellular component=amyloplast; Biological process=carbohydrate metabolic process
  Homolog annotation: Hit_ID=Q2HVV9; Match level="QueryCoverage=93%, HitCoverage=91%, E-value=0.0, Identity=78%"; Hit description =Glycoside hydrolase, family 28
  Pfam annotation: Domain name=Glyco_hydro_28; Domain location=78-404; Score=268.2; E_value=1.7e-77; Accession=PF00295.8; Description =Glycosyl hydrolases family 28
MKSLRYCSTSTFIIIFIHINILVTHAEGVDPVIQLPRSGLKRTRTRSKWVLSVGDYGAKGDGLHNDTEAFLEAWKIACSLSGFISVVFPYGKTFLVHPVDIGGPCRSKITLRISGTIVAPQDPVVWHGLNQRKWLYFHGVNHLTVDGGGRINGMGQEWWARSCKINSTNPCHPAPTAMTFHRCKDLKVRNLMLINSQRMHLSFTNCMRIVASHLKVLAPAFSPNTDGIHISATKGVEVRDSVIRTGDDCISIVRNSSRVWIRNISCGPGHGISLGKSKKWEKVQNVIVDGVYLYNTDNGVRIKTWQGGSGFASKITFQHILMENVSNPIIVDQYYCDSRNPCKNEELQPLKKQSNFPVVMPFHVKDYISKIFFLHHASEEILALSAGKLMALHGVSYILLPVSQAVTIVLDRMLG

SEQ ID NO: 125656 - protein, 585 aa, Glycine max
  Coding DNA Sequence Number=SeqID_8878
  Homolog annotation: Hit_ID=Q6YRM6; Match level="QueryCoverage=85%, HitCoverage=81%, E-value=1e-75, Identity=35%"; Hit description=Zinc finger (C3HC4-type RING finger) protein family-like
  Pfam annotation: Domain name=DUF23; Domain location=292-535; Score =82.2; E_value=1.6e-21; Accession=PF01697.17; Description=Domain of unknown function
  Pfam annotation: Domain name=Glycos_transf_2; Domain location=297 -472; Score=-9.9; E_value=0.011; Accession=PF00535.16; Description =Glycosyl transferase
  Pfam module annotation: Pfam domain module=DUF23::Glycos_transf_2; Domain location=292-535::297-472
  Subcellular localization annotation: CTP_CleavageSite=79; ConfidenceScore=5.07e-01
MRRRPRTSFLVSLLSILTFASFSLYLSRNAISTWRPYSDLRKLNAVTNHLVLHNRNKNNIFNNQFSRQTRRVSSIKDTLLSTVSVLIPDWEILVIVAPNTPLSSSDTPHCLFPNNASSPAKFSGVLPFTNRTTFKCDLPEPVRRRRMFSQPMLVTSPTSETEFPSPAPELLKWNFLVYESFSTENDVVVFAKGVNHRNGDNRSPEELRCVFDLGSGVLNVAVTSSVQEVFRCPHPDPSELDFDSHYGLPNRIGISLEIVSENTVVPSVAYYIPKPGLKPKLMTNDLSVQARPKYFLCACTMVYNVAKVLREWVMYHAKVGVENFILYDNASDDDLYAVIDELRKQGYNISTLFWIWPKTQEAGFSHSVVYSKSKELCSWIMYVDVDEFVFSPSWGHETENSVVVPSLKKLLAREIIKGGTRVGQVSMRCMEFGPSGQRRHPEEGVTQGYTCRRRGEQRHKSMVLVEAVDPSLRNVIHHFQVNERKGFMSKQVSVEEGLVNHYKYQAWDEFKSKFRRRVSAYVVDWKQEINPNSKDRTPGLGFQAIEPKDWTHRFCEVRDQRLKSLTRAWFRSVTPNGYRMAWQTN

SEQ ID NO: 125657 - protein, 373 aa, Glycine max
  Coding DNA Sequence Number=SeqID_8879
  Homolog annotation: Hit_ID=UPI000065F62C; Match level="QueryCoverage =26%, HitCoverage=9%, E-value=4e-16, Identity=43%"; Hit description =Homolog of Homo sapiens "BRD1 protein
  Pfam annotation: Domain name=Bromodomain; Domain location=155-240; Score=94.6; E_value=3.1e-25; Accession=PF00439.15; Description =Bromodomain
MGEVSESTTTKRKKKGRPSLLDLQKRSLKKEQQNHHQQRQSNNSNSANSHNNKNKTNKNAVPHDDDEDERKEKKHKLLVGLNSHLQNPTLFPNSQPFNSDPNKRRKTIDPLQTDWKVPKATDSKHGSQGESGPTTPLPDKKLLLFILDRLQNWVFDVLYCSQPSRRKDTHGVFSEPVDPEELPDYHDIIKHPMDFGTVRKKLDDGLYTDLEHFEIDVFLICSNAMQYNSSDTIYHRQARAMQEIARKDFENLRQDSDDDSEPQPKIVQKGRPPGKHSRKSLGLGMPPSERVGPESSSDATLASGADIGSGSNGYNLRKVPSKFQPTDSSARAYNSTFNSGGYTGCSDWENEFPGQYLYPHFLIVPFLLDSTRD

SEQ ID NO: 125658 - protein, 204 aa, Glycine max
  Coding DNA Sequence Number=SeqID_8880
MYDINSSLAPSFNYIIKLMVSILDFVKLMTQAQINVLRACSYFTYLCASPTEPLLGSNIKKSTLLGSSLFLGHTECNDLHLSPIIARAHHDHPNPPLCTRNNTDPTITNHRIIMHNSTLTTYVVVGDDRCHNFHMLARMRGGENIILEALGDVIEHCGKVQGEGVATNDDFLGTVNACNDNKFHGFSDLSVWVERENIELENEV

SEQ ID NO: 125659 - protein, 82 aa, Glycine max
  Coding DNA Sequence Number=SeqID_8881
  Gene Ontology: Mol. function=nucleic acid binding
  Homolog annotation: Hit_ID=Q2QQM2; Match level="QueryCoverage=69%, HitCoverage=34%, E-value=2e-13, Identity=68%"; Hit description =Expressed protein
MYFTIYAIATVVTVAEILKNNRLAVEKKIRTSTVDIKDDSRGRPVQKAKIEIVLGKTANFDELMAAAAAEDGENGDVEEQSA

SEQ ID NO: 125660 - protein, 61 aa, Glycine max
  Coding DNA Sequence Number=SeqID_8882
  Gene Ontology: Mol. function=12-oxophytodienoate reductase activity; Biological process=fatty acid biosynthetic process
  Homolog annotation: Hit_ID=Q8LAH7; Match level="QueryCoverage=75%, HitCoverage=12%, E-value=1e-13, Identity=78%"; Hit description=12 -oxophytodienoate reductase 1
MTLMKPNLLKDLVMIVLAPLTRTRSYNFMAQPHAALYYSQRTTKGGFLIGEASGVSDTAQG

SEQ ID NO: 125661 - protein, 240 aa, Glycine max
  Coding DNA Sequence Number=SeqID_8883
  Homolog annotation: Hit_ID=Q6T4Q2; Match level="QueryCoverage=21%, HitCoverage=56%, E-value=3e-23, Identity=98%"; Hit description =Putative senescence-associated protein
FCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRQNEREPTNGSLFWPNIVEEERDTGLIARPLCHLQYPVAYLSRLQRILPAARWELRFKASRRANPPHEGSPTARAFGGPRPPTAGRADIEGSKSNVAMNAWLPQASYPCGNFSDTSSFKFRRTKGSIGHAFTVRIRT

SEQ ID NO: 125662 - protein, 68 aa, Glycine max
  Coding DNA Sequence Number=SeqID_8884
MRLGALKTAWSYELGLAAASIVPSIVVDSLVVHPMKQGRSKEVPVGSSSHGVAAGSTELVVPPSNRGW

SEQ ID NO: 125663 - protein, 720 aa, Glycine max
  Coding DNA Sequence Number=SeqID_8885
  Gene Ontology: Mol. function=nucleic acid binding; Cellular component= mitochondrion; Biological process=metabolic process
  Homolog annotation: Hit_ID=Q2HUC3; Match level="QueryCoverage=88%, HitCoverage=97%, E-value=0.0, Identity=51%"; Hit description =Tetratricopeptide-like helical
  Pfam annotation: Domain name=PPR; Domain location=127-161; Score =15.3; E_value=0.11; Accession=PF01535.11; Description=PPR repeat
  Pfam annotation: Domain name=PPR; Domain location=163-197; Score =18.1; E_value=0.033; Accession=PF01535.11; Description=PPR repeat
  Pfam annotation: Domain name=PPR; Domain location=202-236; Score =16.6; E_value=0.081; Accession=PF01535.11; Description=PPR repeat
  Pfam annotation: Domain name=PPR; Domain location=237-271; Score =37.6; E_value=4.4e-08; Accession=PF01535.11; Description=PPR repeat
  Pfam annotation: Domain name=PPR; Domain location=272-306; Score =36.5; E_value=9e-08; Accession=PF01535.11; Description=PPR repeat
  Pfam annotation: Domain name=PPR; Domain location=307-341; Score =21.7; E_value=0.0026; Accession=PF01535.11; Description=PPR repeat
  Pfam annotation: Domain name=PPR; Domain location=342-376; Score =37.3; E_value=5.4e-08; Accession=PF01535.11; Description=PPR repeat
  Pfam annotation: Domain name=PPR; Domain location=377-411; Score =30.0; E_value=8.5e-06; Accession=PF01535.11; Description=PPR repeat
  Pfam annotation: Domain name=PPR; Domain location=412-446; Score =30.3; E_value=6.8e-06; Accession=PF01535.11; Description=PPR repeat
  Pfam annotation: Domain name=PPR; Domain location=447-481; Score =37.4; E_value=5e-08; Accession=PF01535.11; Description=PPR repeat
  Pfam annotation: Domain name=PPR; Domain location=482-516; Score =31.8; E_value=2.4e-06; Accession=PF01535.11; Description=PPR repeat
  Pfam annotation: Domain name=PPR; Domain location=517-551; Score =40.8; E_value=4.5e-09; Accession=PF01535.11; Description=PPR repeat
  Pfam annotation: Domain name=PPR; Domain location=552-586; Score =42.9; E_value=1.1e-09; Accession=PF01535.11; Description=PPR repeat
  Pfam annotation: Domain name=PPR; Domain location=587-621; Score =43.8; E_value=5.9e-10; Accession=PF01535.11; Description=PPR repeat
  Pfam annotation: Domain name=PPR; Domain location=622-656; Score =46.8; E_value=7.1e-11; Accession=PF01535.11; Description=PPR repeat
  Pfam annotation: Domain name=PPR; Domain location=92-126; Score=8.9; E_value=0.66; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR; Domain location =127-161::163-197::202-236::237-271::272-306::307-341::342-376::377 -411::412-446::...
  Pfam module annotation: Domain location=447-481::482-516::517 -551::552-586::587-621::622-656::92-126
MSKATLSRIKPRQHPKGSSSLPPRINYLVSDVIRILKTHQWQDSLESRFAESKVVVSDVAHFVIDRVHDAELALKFFDWASTRPFSCSLDGVAHSSLLKLLASFRVFPEIELVLENMKAQHLKPTREAFSALILAYGESGSLDRALQLFHTVREMHNCLPTVVASNSLLNGLVKSGKVDVALQLYDKMLQTDDGTGAVVDNYTTSIVVKGLCNLGKIEEGRRLVKDRWGKGCVPHVVFYNMIIDGYCKKGDLQCATRTLKELKMKGVLPTVETYGALINGFCKAGEFEAVDQLLTEMAARGLNMNVKVFNNVIDAEFKYGLVTKAAETMRRMAEMGCGPDITTYNTMINFSCKGGRIKEADEFLEKAKERGLLPNKFSYTPLMHAYCKQGDYVKAAGMLFRIAEIGEKPDLVSYGAFIHGVVVHGEIDVALMVREKMMEKGVFPDAQIYNVLMSGLCKNGRFPAMKLLLSEMLDRNVQPDVYVFATLMDGFIRNGELDEAIKIFKVIIRKGVDPGIVGYNAMIKGFCKFGKMTDALSCLNKMKNVHHAPDEYTYSTVIDGYVKQHDMSSALKMFGQMMKHKFKPNVITYTSLINGFCKKADMIRAEKVFRGMKSFDLVPNVVTYTTLVGGFFKAGKPEKATSIFELMLMNGCPPNDATFHYLINGLTNTATSPVLIEEKDSMENERSLILDFFTMMLSEGWDQVIAAYNSVIVCLCKHGM

SEQ ID NO: 125664 - protein, 1224 aa, Glycine max
  Coding DNA Sequence Number=SeqID_8886
  Gene Ontology: Mol. function=RNA-directed DNA polymerase activity; Cellular component=chromatin; Biological process=chromatin assembly or disassembly
  Pfam annotation: Domain name=Chromo; Domain location=1118-1165; Score= 24.6; E_value=0.00035; Accession=PF00385.14; Description='chromo' (CHRromatin Organisation MOdifier
  Pfam annotation: Domain name=RVP_2; Domain location=65-187; Score= -56.7; E_value=0.026; Accession=PF08284.2; Description=Retroviral aspartyl protease
  Pfam annotation: Domain name=RnaseH; Domain location=563-676; Score= -27.8; E_value=0.022; Accession=PF00075.14; Description=RNase H
  Pfam annotation: Domain name=rve; Domain location=812-968; Score =98.7; E_value=1.7e-26; Accession=PF00665.16; Description=Integrase core domain
  Pfam annotation: Domain name=zf-H2C2; Domain location=753-794; Score =27.5; E_value=4.6e-05; Accession=PF09337.1; Description=His(2) -Cys(2) zinc finger
  Pfam module annotation: Pfam domain module=Chromo::RVP_2::RVT _1::RnaseH::rve::zf-H2C2; Domain location=1118-1165::65-187::318 -484::563-676::812-968::753-794
MASRREKGLCFSCDEKYHRGHRCASKVFFFIADEEEPPDPPHITLPTSDPDNNPPDNSPTHSDTYPAQLSLNSLAGHLAPETLRFMATIAGHAVVLLVDGGSMHNFIQQQLVTLLGLSPTTTTPLRVMVGNGQQLDCDSVCQDVPISIHDTVFVVDLHILPISGANVVLGVQWLKSLGPVLTDYNTLSMQFFYNDKLVQLQGDIDASLNPLSPSQFRRLCRKQGPGFYYHITLLPPSPPTCLDHIPEAIRPLLSKYEALFQPPQTLPPPRATDHHIHLLPQATPVNVKPYRYPHYQKHEIETQVDAMLQQGLIQPSTSPFSSPVLLVKKHDGSWRFCVDYRALNALTIRDRFPIPTIDELLDELGGACCFSKLDLLQGYHQIRMHPDDVPKTAFRTHHGHYEFKVMPFGLCNAPSSFQATMNMLFRPYLRQFIIVFFDDILIYSSSLEDHLLHLDIAFQVEYLGHLVSHKGVEPLAMKVTAITHWPSPRSTKALRSFLGLAGFYRRFIKGYATIAAPLVKATTIDPFQWTAEAQFAFDRLKAALSSAPVLALPDFHLPFTVETDALGIGIGAVLSQQGHPITFYSKPFSTKLLRSSTYVRELFAITAAVKKWRQYLLGHRFTIITDHRSLKELLTQVIQTPEQHSYLARLMGYDYEIQYRSGSHNQAADALSRLPEHEASVSLLLSVPAPHFLTELHRQLDADPTYRQRRDDIRSSPATYPDLSISGALILHRGRIWLPRNFPLIPTLLTEFHATPTGGHAGITKTLARVSESFYWEGLRADVTHFVNKCVDCQYTKYETKKPVGLLCPLPAPHRPWEDLSLDFIVGLPPFQGHTVILVVVDRFSKGIHLGMLPQHHSAHSVVVLFIDIVVKLHGVPRSLVSDRDPLFVSQFWRDLFKLSGAHLRMSSAYHPQSDGQTEVLNRVIEQYLRVFVHRRPRSWGRLLPWAEWSHNTSWVAATGHTPYELTFGRKPPRFPDYLQGSSPIAAVDELLTDREETFRVIRKKLLKAQASMKAYVDTKRREVTYALDDWVLLRLRPYRQLSARDSQATTGKLAKRFYGPFKVLEKIGGAAYRLQLPEGTKIHPVFHYSLLKPFRGAPDDAKIAKLPATFIDNQPLITPSSILDYRKSPSNPENWEVLVQWDGLHLDDTSWEDWDQLRQRYHLEGKVILQGPRGDREVEHATQAGADIHEEVQTATEQQDTGVLAENKPKRRIAKPTYLRDYI

SEQ ID NO: 125665 - protein, 813 aa, Glycine max
  Coding DNA Sequence Number=SeqID_8887
  Gene Ontology: Mol. function=ubiquitin-protein ligase activity; Cellular component=ubiquitin ligase complex; Biological process =protein ubiquitination
  Homolog annotation: Hit_ID=Q2QU07; Match level="QueryCoverage=99%, HitCoverage=99%, E-value=0.0, Identity=65%"; Hit description =Armadillo/beta-catenin repeat family protein, putative, expressed
  Pfam annotation: Domain name=Arm; Domain location=139-179; Score =25.3; E_value=0.00022; Accession=PF00514.13; Description =Armadillobeta-catenin-like repeat
  Pfam annotation: Domain name=Arm; Domain location=181-221; Score =11.6; E_value=0.43; Accession=PF00514.13; Description=Armadillobeta -catenin-like repeat
  Pfam annotation: Domain name=Arm; Domain location=266-306; Score=6.2; E_value=2.1; Accession=PF00514.13; Description=Armadillobeta-catenin -like repeat
  Pfam annotation: Domain name=Arm; Domain location=307-346; Score=8.2; E_value=1.1; Accession=PF00514.13; Description=Armadillobeta-catenin -like repeat
  Pfam annotation: Domain name=Arm; Domain location=490-530; Score=4.1; E_value=3.7; Accession=PF00514.13; Description=Armadillobeta-catenin -like repeat
  Pfam annotation: Domain name=Arm; Domain location=590-631; Score =16.4; E_value=0.11; Accession=PF00514.13; Description=Armadillobeta -catenin-like repeat
  Pfam annotation: Domain name=Arm; Domain location=673-713; Score =10.4; E_value=0.61; Accession=PF00514.13; Description=Armadillobeta -catenin-like repeat
  Pfam annotation: Domain name=Arm; Domain location=718-759; Score=9.6; E_value=0.77; Accession=PF00514.13; Description=Armadillobeta-catenin- like repeat
  Pfam annotation: Domain name=HEAT; Domain location=144-181; Score =15.1; E_value=0.26; Accession=PF02985.12; Description=HEAT repeat
  Pfam annotation: Domain name=HEAT; Domain location=186-223; Score =2.7; E_value=20; Accession=PF02985.12; Description=HEAT repeat
  Pfam annotation: Domain name=HEAT; Domain location=312-348; Score =8.0; E_value=4.5; Accession=PF02985.12; Description=HEAT repeat
  Pfam annotation: Domain name=HEAT; Domain location=459-489; Score =0.9; E_value=34; Accession=PF02985.12; Description=HEAT repeat
  Pfam annotation: Domain name=HEAT; Domain location=595-633; Score =1.9; E_value=25; Accession=PF02985.12; Description=HEAT repeat
  Pfam annotation: Domain name=HEAT; Domain location=684-715; Score =12.2; E_value=1.4; Accession=PF02985.12; Description=HEAT repeat
  Pfam annotation: Domain name=HEAT; Domain location=768-803; Score =0.9; E_value=33; Accession=PF02985.12; Description=HEAT repeat
  Pfam annotation: Domain name=U-box; Domain location=31-107; Score =43.4; E_value=7.6e-10; Accession=PF04564.6; Description=U-box domain
  Pfam module annotation: Pfam domain module=Arm::Arm::Arm::Arm::Arm::Ar m::Arm::Arm::HEAT::HEAT::HEAT::HEAT::HEAT::HEAT::HEAT::U-box; Domain location=139-179::181-221::266-306::307-346::490-530::590-631::673 -713::718-759::...
  Pfam module annotation: Domain location=144-181::186-223::312 -348::459-489::595-633::684-715::768-803::31-107
MAASWDGANDPGSQSDDSFHFERLHIEPLYDAFVCPLTNQVMRDPVTLENGQTFEREAIEKWFKECRESGRKLVCPLTLHELRSTELNPSMALRNTIEEWTARNEVAQLDMAHRSLNMGSPENETLQALKYVQHICRRSRSNKHTVRNAGLIPMIVDMLKSSSRKVRCRALETLRVVVEEDDENKELLAEGDTVRTVVKFLSHELSKEREEAVSLLYELSKSATLCEKIGSINGAILILVGMTSSKSEDLLTVEKADKTLENLEKCESNVRQMAENGRLQPLLTQLLEGPPETKLSMATYLGELVLNNDVKVLVAGTVGSSLINIMKSGNMQSREAALRALNQISSCYPSAKILIEAGILSPLVNDLFAVGPNLLPTRLKEISATILASVVNSGEDFYSIPFGPDHQTLVSEDIVRNLLHLISNTGPAIECKLLQVLVGLTSFPTTVLSVVAAIKSSGATISLVQFIEAPQKDLRVASIKLLQNLSPHMGQELADALRGSVGQLGSLIKVIAENTGITEEQAAAVGLLADLPERDLGLTRQLLDEGAFVMVISRVIAIRQGEIRGTRFVTPFLEGLVKIVARVTYVLAEEPDAIALCRDHNLAALFIDLLQSNGLDNVQMVSATALENLSQESKNLTRLPEMPLPGFCASVFSCFSKKPVITGSCRLHRGICSLKETFCLYEGQAVLKLVGLLDHTNVNVVEAALAALSTLIEDGVDIEQGVAILCEAEGVKPILDVLLEKRTDTLRRRAVWAVERLLRTDDIAYEVSGDQNVSTALVDAFQHGDYRTRQTAERALKHVDKIPNFSGIFPNMG

SEQ ID NO: 125666 - protein, 217 aa, Glycine max
  Coding DNA Sequence Number=SeqID_8888
  Gene Ontology: Mol. function=sequence-specific DNA binding; Cellular component=nucleus; Biological process=regulation of transcription, DNA-dependent
  Homolog annotation: Hit_ID=Q9ZRZ4; Match level="QueryCoverage=88%, HitCoverage=71%, E-value=2e-60, Identity=63%"; Hit description=HB2 homeodomain protein
  Pfam annotation: Domain name=Homeobox; Domain location=82-143; Score =73.2; E_value=8e-19; Accession=PF00046.19; Description=Homeobox domain
MEAEHHHQTSNAGGIIGGLYVKVMTDDQMELLRQQISVYATICQQLVEMHKAVTTQQDLAGLRLGNLYCDPLMACSGHKITARQRWTPTPLQLQVLERIFDEGNGTPSKQKIKDITIELGQHGQISETNVYNWFQNRRARSKRKQLTPALNVVEPEVETEVEVESPKEKKTRAEGFQVQPYENSSPHRIKDMYIQSPDIGINLSVSLCLDKLLNEYL

SEQ ID NO: 125667 - protein, 153 aa, Glycine max
  Coding DNA Sequence Number=SeqID_8889
  Gene Ontology: Mol. function=serine-type peptidase activity; Cellular component=membrane; Biological process=signal peptide processing
  Homolog annotation: Hit_ID=Q9LW08; Match level="QueryCoverage=99%, HitCoverage=85%, E-value=1e-60, Identity=75%"; Hit description =Signal sequence processing protein; peptidase-like protein
  Pfam annotation: Domain name=Peptidase_S24; Domain location=25-97; Score=37.3; E_value=5.2e-08; Accession=PF00717.13; Description =Peptidase family S24
MIVTSALIIWKALMCITGSESPVVVVLSESMEPGFKRGDILFLHMNRDPIRAGEIVVFNVDGREIPIVHRVIMVHDRKDTGEVDVLTKGDKNDVDDRLLYVHGQLWLQRHHVMGRAVGFLPYVGWVTIIMTEKPIIKYILISALGLLVITSKD

SEQ ID NO: 125668 - protein, 74 aa, Glycine max
  Coding DNA Sequence Number=SeqID_8890
MATALELVDPPGCRNSMKVSDSKTYPLKNEERMKNDEERTKTFTDLLTETSRKRYGSTSAWIFFTETIFFTQNS

SEQ ID NO: 125669 - protein, 345 aa, Glycine max
  Coding DNA Sequence Number=SeqID_8891
  Gene Ontology: Mol. function=nucleic acid binding; Cellular component= beta-galactosidase complex; Biological process=DNA integration
MDVKSIFLNGLIEEEVCVDQSPAITKVMKEFEMSMMGELNFFLRLQVKKMKHGTFLSQTKYYIELIKKFGMERCKALTPMATSTYLDLDKKGKSVDESRYRGMIRSLFYLTASRPNIMLSVFLCARYQANPKGSHLIAVKMIIKYLKGTTNIALFTAKPEYIAAGSCYAQSLWMKQQLEDFGVNLDHIPLKCDNTSVINLTKNPIMHSRTKDRNKTSFSKRSCLKSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 125670 - protein, 112 aa, Glycine max
  Coding DNA Sequence Number=SeqID_8892
MQNTLQQQTEESSQLPPKVSFSGHKMGDLSDGQHHGGYLAVVPRSRPACTCSNRPGSVRCARHGYVVPGEKKRRVASKEILRRALTPPPKRLGLRWLNFRPTPSRLSNMSMA

SEQ ID NO: 125671 - protein, 118 aa, Glycine max
  Coding DNA Sequence Number=SeqID_8893
  Gene Ontology: Mol. function=structural constituent of ribosome; Cellular component=ribonucleoprotein complex; Biological process =translation
  Homolog annotation: Hit_ID=Q2QD65; Match level="QueryCoverage=76%, HitCoverage=73%, E-value=7e-38, Identity=87%"; Hit description =Ribosomal protein S12
  Pfam annotation: Domain name=Ribosomal_S12; Domain location=1-117; Score=149.5; E_value=8.7e-42; Accession=PF00164.15; Description =Ribosomal protein S12
  Subcellular localization annotation: CTP_CleavageSite=56; ConfidenceScore=5.08e-01
MDKLTLTRQFGIQFGSLGGIGKEFWNSGSKGDLSVNFSTITPKKPNSALRKVARVRLTSGFEITAYIPGIGHNLQEHSVVLVRGGRVKDLPGVRYHIVRGTLDAVGVKDRQQGRSSAL

SEQ ID NO: 125672 - protein, 51 aa, Glycine max
  Coding DNA Sequence Number=SeqID_8894
  Homolog annotation: Hit_ID=Q6Q2Z9; Match level="QueryCoverage=76%, HitCoverage=3%, E-value=8e-11, Identity=82%"; Hit description =Phosphoenolpyruvate carboxylase
MAIDLYIREVDGLRFELSMNQCSDKLSELAHEILKDYHVNLMVLLKPLILP

SEQ ID NO: 125673 - protein, 145 aa, Glycine max
  Coding DNA Sequence Number=SeqID_8895
  Gene Ontology: Mol. function=nucleoside-triphosphatase activity; Cellular component=integral to membrane; Biological process=transport
  Homolog annotation: Hit_ID=Q9SZR9; Match level="QueryCoverage=98%, HitCoverage=28%, E-value=1e-20, Identity=38%"; Hit description =Probable white-brown complex homolog protein 9
MYRLSSYFMSRVVADLQMELSLPSIFIHTLLLHVLVSQDLGASVMDQKMQPHCPHCSCCVSCLLVYISISYYNYQLFIASQYSNGETYPCSTGQCQVAEFPSIKQTGFHFNLQEQVMAASALVIMMIDYRLIAYVALMRIGVTKK

SEQ ID NO: 125674 - protein, 36 aa, Glycine max
  Coding DNA Sequence Number=SeqID_8896
MYKQNQKDFLSIIQLKKGAKDAIIIQEIHAKIITHS

SEQ ID NO: 125675 - protein, 93 aa, Glycine max
  Coding DNA Sequence Number=SeqID_8897
MTILVSILPLPQIVNPNISLHRSSHTPYVVLFALLSMFDLHPPWHPLMSTTITPLKLHAKPRNGLLPHPLSATMASFLSPGLVSGTYVLYQGK

SEQ ID NO: 125676 - protein, 349 aa, Glycine max
  Coding DNA Sequence Number=SeqID_8898
MDLAAIGAFLAYHHNKESPVIAVLADAYDTFDLRCKKSSVRIVCCTPALYVWLVSHVLHHEGRPVRPLQGHRMLPYERCAPEETIAPFVARGFNEGNAKILQRICKAWNTVERKDKELRGSSNGVISGYHKWLKARTQGITWLPKLRDPSKKEVEVPEESEKVKALKAELERTKVIKEKLKTTVTRVKKECDKLRDVNMTTTEALKRETKRAQKEEWSRNKYRGALWGSNNELKLRRVERDESRLESMYKEKVNLAASHGQRLEDEHAKVSALQMEREARERVIESLHGEVVKWMDRFSLTLNGSQELPRLLARAKAMADVYLAPDEVHGLFDYCQHMIELMSHIIRNC

SEQ ID NO: 125677 - protein, 161 aa, Glycine max
  Coding DNA Sequence Number=SeqID_8899
  Gene Ontology: Mol. function=oxidoreductase activity; Biological process=electron transport
  Homolog annotation: Hit_ID=Q8Y0N9; Match level="QueryCoverage=99%, HitCoverage=82%, E-value=5e-41, Identity=51%"; Hit description =Putative NADH dehydrogenase/NAD(P)H nitroreductase RSc1004
  Pfam annotation: Domain name=Nitroreductase; Domain location=1-139; Score=-10.2; E_value=0.0012; Accession=PF00881.14; Description =Nitroreductase family
LYDLIKLGPTGFNSQPARFLFIRSQAQKEKLAPHLSSSNREKALAAPLNLIVAYDTLFYHELTEQFPAYDARSFFEKSPDWILPTANLNATLQAGYLIIAARALGLSVGPMSGFNAANVDVTFFPDGQYKSFLLLNIGFTDGSSTRKRGPRLAFEKAVHIL

SEQ ID NO: 125678 - protein, 57 aa, Glycine max
  Coding DNA Sequence Number=SeqID_8900
MGNGFVKILQEKHKHVLSVPRSKLNKTEPIAFPHSSPSPHVPLLAFPLLHFHVRGGT

SEQ ID NO: 125679 - protein, 79 aa, Glycine max
  Coding DNA Sequence Number=SeqID_8901
MAYARALVAGYYPESVDDLICFADAFGASRLRCVFLVMKLVRQEERVVKTRKKETKFNIPKRGILSVSIYCLDYRSNEN

SEQ ID NO: 125680 - protein, 227 aa, Glycine max
  Coding DNA Sequence Number=SeqID_8902
MPDPKSNSQPKTLEKARRWLRLDCCWKLVSLPELPPSIEELALNGCKKFKSLLKLSPSLEELSLNECKKLVSLPELPPSLRALDLRNCWKLNLLHQQYLNNPKYCENEDYPHSGDEDHPDWDEEDCPDKHFIFPGDHVTDKCSKYDKKCEVYGHFSNLTFRFGLDFLHGLNFDKDIKGCGVFPVYATASELKLVNSSESIDWEQLGPASKGREDLARNNNLPLITSS

SEQ ID NO: 125681 - protein, 268 aa, Glycine max
  Coding DNA Sequence Number=SeqID_8903
  Homolog annotation: Hit_ID=Q9LSR1; Match level="QueryCoverage=91%, HitCoverage=19%, E-value=6e-80, Identity=61%"; Hit description =Arabidopsis thaliana genomic DNA, chromosome 5, BAC clone:F24B18
VFKPRALVDLDAAVSSALLINEDQWVGILVRPLNYSLKAAVLHIDTGPGLEIKELHVIEMETDADVQNDGAQIRTLNSDKKFERLTLHDGKIKFPNWASDTPSILWVLVCAISDTLSRGSSSATTRRESIVDGMRTIALKLVFGAFHNQIFERTLAVHFTYPFYVRTRVTDKCNDGTLLLQVILHSEVKATLAIYDAWLDLQDGFVHTGQTEGRPNSSFFPLIISPTSKAGILFSICLDKSNAEEFGSCNSIHCQRFLIGWLILFQVQ

SEQ ID NO: 125682 - protein, 224 aa, Glycine max
  Coding DNA Sequence Number=SeqID_8904
  Gene Ontology: Mol. function=RNA-directed DNA polymerase activity; Biological process=RNA-dependent DNA replication
MVRLMKQANVFPLKKTLKKFTLWEINRDKDILKEDFQASSRVLIINKDNGGHTLAINSTKTKVTMSIHKSTESALKNLEVQDEDSFVSKKKAIEKKGTDKNKDDVREVPYPVVPSKKEKDRHLARFLDIFRKLEMTMPFGEALHVVLQKILPSKHKDPGSVTIPCSIGEVIVGKTLIDSGASINLMPLSMCRRSGELEIMPTKMTLPLADCSITRPYEVIEDVL

SEQ ID NO: 125683 - protein, 566 aa, Glycine max
  Coding DNA Sequence Number=SeqID_8905
  Homolog annotation: Hit_ID=Q9LSR1; Match level="QueryCoverage=99%, HitCoverage=45%, E-value=0.0, Identity=75%"; Hit description =Arabidopsis thaliana genomic DNA, chromosome 5, BAC clone:F24B18
  Pfam annotation: Domain name=RbsD_FucU; Domain location=404-524; Score=-65.6; E_value=0.1; Accession=PF05025.4; Description=RbsD FucU transport protein family
MECIRNTLDRRVQFYEDEIRKLSEQRLMPVWNFCNFFILKESLAFMFEMAHLHEDALREYDELELCYLETVNMTGKQRDFGGADHGDDQAAFLNPGNKALTQIVQEDSFREFEFRQYLFACQSKLLFKLNRPIEAASRGYSFIISFSKSLALHERILPFCMREVWVTTACLVIIKATTSNYNDGHVAPDIEKEFFRLLGDLYSLARVKFMRLAYLIGYGTDIERSPVNSASLSLLPWPKPAVWPSVPVDASTEVLEKEKLILQTTSRIKHFGIQRKPLPLEPTVLLREANRRRASLSAGNVPEMFDSRQGPMDGSGFDASTRMSPQKALASTMSRTNSSPGNFDSSIDQPMRLAEIFIAAEHALKQTISHTELWKSLSSSEEFEQKYLELTKGAADNYHGSWWKRHGVVLDGEIAAVAFKHGHFDQAAKSYEKVCALYAGEGWQDLLAEVLPNLAECQKSLNDQAGYLLSCVRLLSLDEGLFLTKERQAFQSEVVRLAHSEMKDPVPLDVSSLITFSGNPGPPLELCDRDPGILSVTVWSGFPDDITLDSMSLTLNATYNTDEGVK

SEQ ID NO: 125684 - protein, 387 aa, Glycine max
  Coding DNA Sequence Number=SeqID_8906
  Gene Ontology: Cellular component=integral to membrane
  Homolog annotation: Hit_ID=Q69LX3; Match level="QueryCoverage=61%, HitCoverage=55%, E-value=3e-91, Identity=65%"; Hit description =Peroxisomal membrane protein-like
  Pfam annotation: Domain name=Mpv17_PMP22; Domain location=292-354; Score=11.3; E_value=8.2e-06; Accession=PF04117.3; Description=Mpv17 PMP22 family
  Subcellular localization annotation: CTP_CleavageSite=54; ConfidenceScore=5.47e-01
MASVHSTVAPRTFLPSIPKPRAPLHAAKFVAGGAHNFRRLSRNLILSGNKRAVAANSAAEEFDVISVQSDDITDQQEGVVVSRVEMEGGDCELATQVSGFGANEGLLSLEGFSSSSSSSSSLVGNESEEDMEKLIDRTINATIVLAAGTFAVTKLLTIDSDYWHGWTLYEILRYAPQHNWSAYEEALKTNPVLAKMMISGIVYSIGDWIAQCFEGKPLFEFDRARMFRSGLVGFTLHGSLSHFYYQFCEELFPYKEWWVVPAKVAFDQTAWSALWNSIYYTVVALLRRDPPMSILNELKATFFPMLTAGWKLWPFAHLITYGVIPVEQRLLWVDTIELIWVTILSTFSNEKSEARNSQSMVPSEVKSTSVYPPEIYDAECEKANYIR

SEQ ID NO: 125685 - protein, 257 aa, Glycine max
  Coding DNA Sequence Number=SeqID_8907
  Gene Ontology: Mol. function=hydrolase activity; Cellular component =extracellular space; Biological process=biological_process
  Homolog annotation: Hit_ID=Q4KU02; Match level="QueryCoverage=88%, HitCoverage=56%, E-value=1e-101, Identity=67%"; Hit description =Purple acid phosphatase
MGGAKSYSCFAVIAVALVLLLLNVAVVCNGGKTSTFIRKVEKTEDMPLHSDVFVAPSGYNAPQQVHITQGDQVGRAMIVSWVTVDEPGKSLVHYWSDASQHKRVAKGNHVTYRYFNYSSGFIHHCTLRDLEANGDLGQTFDSNKTLVHYESNPHKGQAVLYVGDLSYADNHPNHDNVRWDTWGRFVERSTAYQPWIWTTGNHELDYAPEIDETEPFKPFRHRYYVPYKASGSTEPFWYSVKIASAHIIVLASYSSLW

SEQ ID NO: 125686 - protein, 146 aa, Glycine max
  Coding DNA Sequence Number=SeqID_8908
FVISVCFCLDRTGLVYRIITRDWGTDSKALSSKAKGKEKEKKDSSKNIVEKENHFATKCDIIRAFLIKQSFYLLLSIIAIRLELEVIPQVKEFLDEGLVRKSLIPYAFLVPKIGIMRHRIPMIGGMMNVFSDATLFVKSSMHPTSS

SEQ ID NO: 125687 - protein, 116 aa, Glycine max
  Coding DNA Sequence Number=SeqID_8909
  Gene Ontology: Mol. function=transporter activity; Cellular component= integral to membrane; Biological process=transport
  Homolog annotation: Hit_ID=Q7N9C5; Match level="QueryCoverage=89%, HitCoverage=12%, E-value=5e-24, Identity=56%"; Hit description =Similar to outer membrane usher protein
MRVSPAGKLMRLQTLGLCISLALGVPSMAVFAAGDIQFNTDVLDVHDRENIDLSQFSRGGYIMPGTYGMVVHVNKNDLQEQQVPFYAPEDDPNGSRACVTQVLTGQLGLKEDALKG

SEQ ID NO: 125688 - protein, 159 aa, Glycine max
  Coding DNA Sequence Number=SeqID_8910
  Gene Ontology: Mol. function=sequence-specific DNA binding; Cellular component=fimbrium; Biological process=cell adhesion
  Homolog annotation: Hit_ID=Q93MT5; Match level="QueryCoverage=98%, HitCoverage=86%, E-value=2e-39, Identity=52%"; Hit description=MrfB
  Pfam annotation: Domain name=Fimbrial; Domain location=11-159; Score =87.0; E_value=5.7e-23; Accession=PF00419.10; Description=Fimbrial protein
ATAAGSLQGWGRVNMQGAIIDTACAIAIESRDQTIDMDVVPLADIIRDGQGRSKPFSIELVNCTLERPDPTLPDWKQFQVTFDGDNEGELFGVRGEASGIALRITDENGNIATPGVPLRAQDIITDTMQLNYHLRLVANQHALKAGNYFSAIRFKLDYF

SEQ ID NO: 125689 - protein, 399 aa, Glycine max
  Coding DNA Sequence Number=SeqID_8911
MAQRKLALCLSDGHSRGLCLQWLNYSVDDGGDIYTPEKGICRGSALSPKPGIGGCRGQKLRRWCVSMKTGGVCGQAGGAVPWPVLMDPKIVSCDDQYKNPCSANVQYYSAGVMMIDVLAVGQPNAANTGTLVHPVGVHCNTGNALVGNLPFKNCKWLSDDTHRPPLVGKCELKSPNSWTLTSDSDCSVRSTLLWGHYGAGPGGECVVFTNTIYPQAQGVVNTPWGAITATQAANSGNRFCSKPLPPNVTCELDLPNIIDHGEVRAGDSSKRVDEGQIKCGLTPKIDVLVNGDRDTEGVRISTTPLIVNPTTVRITTEITVSNSAVAGEHSATYVFVTGVIVDLATRGEISWAYGKLYVVDPDQYWVQGVIKAVSHYLDTTTGVKAKESAVTILQRRGCM

SEQ ID NO: 125690 - protein, 61 aa, Glycine max
  Coding DNA Sequence Number=SeqID_8912
MSSQFSYAGVIITGSINSNNGSVGVGIGADGTGSGNGGNGTGVVINGQEQSGSSVEQIKKD

SEQ ID NO: 125691 - protein, 100 aa, Glycine max
  Coding DNA Sequence Number=SeqID_8913
  Gene Ontology: Mol. function=actin binding; Cellular component=actin cytoskeleton; Biological process=actin cytoskeleton organization and biogenesis
  Homolog annotation: Hit_ID=Q1SZ88; Match level="QueryCoverage=97%, HitCoverage=5%, E-value=4e-45, Identity=93%"; Hit description=IMP dehydrogenase/GMP reductase
MKVPRVENKLRVFAFKMQFLSQVSELKRDLNIVNNASEQIRNSVKLKRIMQTILSLGNALNHGTARGSAVGFRLDSLLKLTDTRAKNNKMTLMHYLCKGV

SEQ ID NO: 125692 - protein, 158 aa, Glycine max
  Coding DNA Sequence Number=SeqID_8914
  Gene Ontology: Mol. function=actin binding; Biological process=actin cytoskeleton organization and biogenesis
  Homolog annotation: Hit_ID=Q1SZ88; Match level="QueryCoverage=69%, HitCoverage=6%, E-value=7e-45, Identity=84%"; Hit description=IMP dehydrogenase/GMP reductase
  Pfam annotation: Domain name=FH2; Domain location=1-156; Score= -148.1; E_value=0.084; Accession=PF02181.13; Description=Formin Homology 2 Domain
MMLYLGHFEDRDSTANVCSYTEYRISCIVLIGYYTISLPENCPAVLLNVLAEKLPELLDFHKDLGSLEAATKIQLKYLAEEMQAVSKGLEKVVQELTASKNDGPVSENFCQILMEFLSYAEAEVRSLAQLYANVGRNADALALYFGEDPARVPFEQGT

SEQ ID NO: 125693 - protein, 186 aa, Glycine max
  Coding DNA Sequence Number=SeqID_8915
  Gene Ontology: Mol. function=sequence-specific DNA binding; Cellular component=nucleus; Biological process=regulation of transcription
  Homolog annotation: Hit_ID=Q1SZ89; Match level="QueryCoverage=71%, HitCoverage=46%, E-value=8e-19, Identity=44%"; Hit description=WRKY DNA-binding domain, putative
  Pfam annotation: Domain name=WRKY; Domain location=37-76; Score= -15.2; E_value=0.052; Accession=PF03106.6; Description=WRKY DNA -binding domain
MKFEHLVQNTQTPSLARIANGLMEAQVNHTFPSQQRLTYGYSIREKKNRSMNSVQRCLHDKSIVVATYDGEHNHAAIHESSSSTSKGSSPVVNNLPLMTSILNDKEPMNIGLALSGWSQTDHRRHCEDAMQQNNNNGGSNIRIEEYVSSLIKNPDFSMSLAEAVVRTITGQQKQQDINLNLDLPEE

SEQ ID NO: 125694 - protein, 110 aa, Glycine max
  Coding DNA Sequence Number=SeqID_8916
MQFMGLRKRVENGELHQAITTHGSKLEGGGRMNENAIHRVPKKSLEWRIALRNHYAWLQTRGGGRMNEDAIHGALKKGCEWRIALRNHYAWLRTRGWRTHERKGNSWGSE

SEQ ID NO: 125695 - protein, 142 aa, Glycine max
  Coding DNA Sequence Number=SeqID_8917
MVIRTFCQPEASEPVNTQRLTSSSAPLSSRDGKSDDMRRYLMVIRTFCQPEASESIDMQRLTSSSAPLSSRDGESDDMWRYLMVIHTFCQPKASEPIDTQRLTSSSAPLSSRDGKSDDMRRYLGPLKSIKSTCNFTAFARTT

SEQ ID NO: 125696 - protein, 282 aa, Glycine max
  Coding DNA Sequence Number=SeqID_8918
  Gene Ontology: Mol. function=transcription factor activity; Biological process=regulation of transcription, DNA-dependent
  Homolog annotation: Hit_ID=Q1BII2; Match level="QueryCoverage=79%, HitCoverage=75%, E-value=5e-30, Identity=36%"; Hit description =Transcriptional regulator, LysR family
  Pfam annotation: Domain name=LysR_substrate; Domain location=42-247; Score=92.8; E_value=1.1e-24; Accession=PF03466.10; Description=LysR substrate binding domain
MVLFHREKKRLRLTDEGKRFLTEVTPFLQHHERLKEYAQHLQQGDVGRLDIGYVEAAIHSRLLPAALARLAPGAGIDVRLHALRSAQQIARLEAGAIDIAIVHTLPHDDADFVYKKIATEPVLLAMPASSALTAPVAADLHGRAWIADQENLNPAARARLLTACQRAGFQPDIRFEVNGPLAALACVEAGLGFTLIQHSLARIVPDNVILLPVPELALEIVLFASRPPWRRGKPERRCVSRRHPAALPANRTSGNQSRTPPAASAARAARPAPARRILPSSV

SEQ ID NO: 125697 - protein, 402 aa, Glycine max
  Coding DNA Sequence Number=SeqID_8919
  Homolog annotation: Hit_ID=Q0TI75; Match level="QueryCoverage=44%, HitCoverage=91%, E-value=9e-37, Identity=50%"; Hit description =Transcriptional regulator, TetR family
MPAITKPCGFAQLQRRQAEQQHGDGRQHAEDAAPVHHLQHHAAQHRRDDRRQAVDQHQQGEEAGQLMAGVQIAGDGARNHRATCAGDALQQTGDQQLVDGGREGAPQRSTQQQDQRQQQRAHAAQFVAVRAENQLADAQAEQPGGQAELCGGGGGIQFARHFRQGGQIEIGAQRPQRGQQAKHDGVRNGLLIQLAQQGRIGFLRGKDTVTGAFAHDGDKLHPGGDLFRAEIGIQPLQVVAHVAKQPRFRIAEHFGYHRVARGLGGHFQHQHVIGFALARLLKQRARRQRAGDQVDVIAKVFQPLHLAGDDAVDDLFDNRVFIGEIAIDLPDAELRALGDLRHAGGVEAVAAEAGFRRFDDLIAAGLHLGLFTVVGGEHLPDPLLRVSRVHISGCERSFSIVV

SEQ ID NO: 125698 - protein, 348 aa, Glycine max
  Coding DNA Sequence Number=SeqID_8920
  Gene Ontology: Mol. function=protein dimerization activity; Cellular component=endoplasmic reticulum; Biological process=proteolysis
  Homolog annotation: Hit_ID=Q6D580; Match level="QueryCoverage=58%, HitCoverage=51%, E-value=1e-71, Identity=69%"; Hit description =Putative peptidase
  Pfam annotation: Domain name=CSD; Domain location=282-348; Score =151.6; E_value=2e-42; Accession=PF00313.12; Description='Cold-shock' DNA-binding domain
  Pfam annotation: Domain name=OB_RNB; Domain location=285-331; Score= -5.1; E_value=0.09; Accession=PF08206.2; Description=Ribonuclease B OB domain
  Pfam module annotation: Pfam domain module=CSD::OB_RNB; Domain location=282-348::285-331
MQCADDLAGEIDSVDALLKFGGVLAFADDEDLEAIDVGVERPGAGGAGAGGQLRRVMQAKYRRNVIQRASVDQMPGTEEGLFRRLEEDAHRAGQVGLTRFEQVCGAEHHRGVKVVAAGVHHAAVLRAEGHVGDFVDRQGVNVTAQRDDRPLAAANLRHDAGFQRQRQQANARLLQPAGQPGGGGEFVIGKLRVLVQLTPIGDDFVCQLAAIASAWGRQRWGKRAGLAVRTLFAGAWRGLTWNGSLSQPVHPFTPGYTDFFTLYRISVIAVVDKILPACCTVIDTGSVKWFNESKGFGFITPEDGSKDVFVHFSAIVSNGFKTLAEGQRVEFEITNGAKGPSAANVTAI

SEQ ID NO: 125699 - protein, 225 aa, Glycine max
  Coding DNA Sequence Number=SeqID_8921
  Gene Ontology: Mol. function=chitin binding; Cellular component =extracellular region; Biological process=chitin metabolic process
  Homolog annotation: Hit_ID=UPI000044A8F0; Match level="QueryCoverage =79%, HitCoverage=99%, E-value=8e-26, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MIGPLNESISCFLTRVDLWVLEPIAFKGPSVLAIRGLHALTFRGLHVLPFRGLHALTFRGLHVLAFRGLHVLAIRWLHALTCRGLHVLAFRGLHVLAIRGLHVLTFRGQHTLAFIGLHALTFRELRVLALRGLRVLTFRGLHVLAIRGPHVLTYRGLHVLAFRGLHVLTFRGLHVVTFRGLHALTLRGLHVLAIRGSHALTLEGRTPSLQRAALPHLQRTTRPHL

SEQ ID NO: 125700 - protein, 67 aa, Glycine max
  Coding DNA Sequence Number=SeqID_8922
MESIKRFRSYQSRNQNREILDEWKERERERETTRNFELVEEEMRKKMWAAQVVFGIMRERFETTVTV

SEQ ID NO: 125701 - protein, 68 aa, Glycine max
  Coding DNA Sequence Number=SeqID_8923
MGDEMPLELVVLDLARRFLFSIFVELLQGCGEKDGSGGGLLLLTRFGSIGKTLFSPIRNYFPYAVSNL

SEQ ID NO: 125702 - protein, 145 aa, Glycine max
  Coding DNA Sequence Number=SeqID_8924
  Gene Ontology: Mol. function=hydrolase activity, acting on ester bonds
  Homolog annotation: Hit_ID=Q3JG61; Match level="QueryCoverage=57%, HitCoverage=31%, E-value=2e-27, Identity=64%"; Hit description =Hydrolase, alpha/beta fold family domain protein
STAQQRAQAHADDVHDFVLLAQLAVAARHHVHPVLDPHVQQVLGPAGVAGQRHAMGFHSRARQHLVQRAHVEFGAAQAMDQQRSGARRRHGALPATASSCQALRVAASRRARTWAKAITGAGAAAPPALPAGGKAKIGWQVMEHP

SEQ ID NO: 125703 - protein, 603 aa, Glycine max
  Coding DNA Sequence Number=SeqID_8925
  Gene Ontology: Mol. function=RNA-directed DNA polymerase activity; Cellular component=nucleus; Biological process=RNA-dependent DNA replication
  Homolog annotation: Hit_ID=Q1SQP0; Match level="QueryCoverage=47%, HitCoverage=63%, E-value=2e-42, Identity=36%"; Hit description=RNA -directed DNA polymerase
CGEDDEGFWGGRHGNSGGADPVMEETLEVISNKLSKVHDIWAEIGSTDVEKGEKVVIKMENIEKDVQKGRKQIEKEEESREEQIEEEKIGTRKKDKDMTTKENVRVGMRKNEKAAASKLWKLGTQMGLSNGCEKEVIEKKMEEKEKKDKKSRYSREENRGLKKHIVCSKRNILDHCPIVLKSEIMDWGPKPFREGNLYVKGEVKDFKGKFEVLEPKLLWNLKEKIKDVVAKINEVDIQDKEGNASDERLIGRKELISEFWKVATNYESLMQQKARSKWLKDGNGNPKFFHAMVVEKVLSKRFKRVLGKIIDERQSAFVGGRFLLDGVMVANEVMDEVKKDKKQQCLIFKVDFEKAYDSMRWKFLYYMLSKLGFCDLWIKWIKGCLESASLSVLVIGSPSEKIVKQKGLHQGDSLAPFLYLCVAKGLTGLTREAISKDLFQGIKSVVKIQREFLWWRNGDRGKIAWALLAKWKWRLFSNEESLGGKVIVFKYGESFKGGREEINKNRKWSQVDLWHQNLVGNESFASKYPRIFTVSEQKICNRRHGVLVSRVMDLELQVAKTMMHQAENDAWIWKSDSSGIFSVRNAYAVLAHQNFDAEEGNFF

SEQ ID NO: 125704 - protein, 115 aa, Glycine max
  Coding DNA Sequence Number=SeqID_8926
  Gene Ontology: Mol. function=sequence-specific DNA binding; Cellular component=nucleus; Biological process=regulation of transcription
  Homolog annotation: Hit_ID=Q1SZ92; Match level="QueryCoverage=96%, HitCoverage=35%, E-value=2e-28, Identity=60%"; Hit description=DNA -binding WRKY
  Pfam annotation: Domain name=WRKY; Domain location=1-23; Score=-16.0; E_value=0.064; Accession=PF03106.6; Description=WRKY DNA -binding domain
VQRSLEDPTILVTTYEGEHNHGHQRAEISLVSNQREAPPKGSSPVSSPTPTIRSAACPTVTFDLVKSGLVELESAQKSSIQQFLVQQMATSLTRDTNFTTALATAISGKILEAQW

SEQ ID NO: 125705 - protein, 119 aa, Glycine max
  Coding DNA Sequence Number=SeqID_8927
MAYHEDPQKNFMQDLLVGENDKLNLCRKVSWFATVWSIWLLRNAIIFNNESVDVEKISEMVKEIYCEGISRGGGGANSQSHAMTLKENGFRWWHARNFDNGKEPGCAGILFSLFAFSLG

SEQ ID NO: 125706 - protein, 131 aa, Glycine max
  Coding DNA Sequence Number=SeqID_8928
  Gene Ontology: Mol. function=sequence-specific DNA binding; Cellular component=nucleus; Biological process=regulation of transcription
  Homolog annotation: Hit_ID=Q1SZ92; Match level="QueryCoverage=94%, HitCoverage=46%, E-value=7e-28, Identity=57%"; Hit description=DNA -binding WRKY
MEYVDTSLNLNVDPSSMHMDGVLVEELRRLSCENKRLTGMLTHLCENYKALQKQLSQLINTNFEQLDPIESRKRKAESDQWCTNKFIGVNNAECSSITEDSFRKYKDFNSSPKVSKVLVKTEASNNSLVSS

SEQ ID NO: 125707 - protein, 144 aa, Glycine max
  Coding DNA Sequence Number=SeqID_8929
  Subcellular localization annotation: CTP_CleavageSite=77; ConfidenceScore=5.72e-01
MHHLLFPKHHCTTNSPPPSSNHTATDNTQSNPRSREKNQHTSRNPQQTQIQNSLTTYGRFSVRKTIFSVETTKFDVSFSRLGARRHPQPQPWSTTLPTSTMEVPSCIFNPNPFIDGIACGRNNVVSLAAVLCHDGVVDDKSVVV

SEQ ID NO: 125708 - protein, 76 aa, Glycine max
  Coding DNA Sequence Number=SeqID_8930
MENWRTALDNQFAGLQTRWWRMHCLAFNSWGSRLVGGGCMNDNQFMGLRIKVENGELANSARQSIRGDPDSLVEDA

SEQ ID NO: 125709 - protein, 150 aa, Glycine max
  Coding DNA Sequence Number=SeqID_8931
MIMRGQDICSSQEETTSSLSSSGSEDEVRGEESSEEVYPREEERTSLNLTIIPHPKPYKLQWLNEQGEMIVNQQVKAKGKEKKENDSSKQNVKKENNFATKGDIKRALLLKQSFYLFLSRETSLSTFIPLELEVIPQVKELLDEGLVRRA

SEQ ID NO: 125710 - protein, 84 aa, Glycine max
  Coding DNA Sequence Number=SeqID_8932
MRSLYFRGWHLVFVSGARSEVQVPLDQRLYEESGTTLKKIIVVLFEHLLLVISLQLNSRRRQIKLTRAGRNAPSGALPLTLNSY

SEQ ID NO: 125711 - protein, 65 aa, Glycine max
  Coding DNA Sequence Number=SeqID_8933
MSVKNLIGCLGVHDKTDHTLGDQSGSHYFVRMLQPWGIGTGLKTHSNWVYLPSRPRLERVRAPPS

SEQ ID NO: 125712 - protein, 53 aa, Glycine max
  Coding DNA Sequence Number=SeqID_8934
MGQLQRQAFRKAYGKIWDLTMAEVSTKAVASLAQYYDQPLRNWTAGSKLKMRW

SEQ ID NO: 125713 - protein, 80 aa, Glycine max
  Coding DNA Sequence Number=SeqID_8935
  Gene Ontology: Mol. function=1-acylglycerol-3-phosphate O -acyltransferase activity; Cellular component=integral to membrane; Biological process=phospholipid biosynthetic process
  Homolog annotation: Hit_ID=O80437; Match level="QueryCoverage=91%, HitCoverage=15%, E-value=9e-22, Identity=64%"; Hit description =Glycerol-3-phosphate acyltransferase 6
MVEPFAKTFLGADTVLGTELVVTASGRVTGLAKEPGVLVGVHKKEVILKEFGTNLPDLGLGDSVTDMNFLSICKIVKHEF

SEQ ID NO: 125714 - protein, 77 aa, Glycine max
  Coding DNA Sequence Number=SeqID_8936
  Subcellular localization annotation: CTP_CleavageSite=56; ConfidenceScore=5.59e-01
MSSSFYSIVPSPFPSPPAGAQSSPVSRQTPSGHGDKTLMRGSEDRLATDSTDRFPVAYKDWRSIRSWARCKTFSSRS

SEQ ID NO: 125715 - protein, 200 aa, Glycine max
  Coding DNA Sequence Number=SeqID_8937
  Homolog annotation: Hit_ID=Q1SPB9; Match level="QueryCoverage=99%, HitCoverage=50%, E-value=7e-14, Identity=24%"; Hit description =Transposase
DALNQIASEIDRLRYLGNNLSSCGCVMRSTHGLPCAYQGLCETEVTIKEEIEVISKRFDELDVAGKVNLKSKLREIAYPDHNSMCPPPSKYVDAFHSVQSSNSPVKRSASCSQPRQPTRIIPMLDQFASFFQGFIRDVVDVKADGNCGYRWSHEYMNLFGGTERFEQLKLSLLVDGFSKVSVDKWMDITDMGYVIASRYN

SEQ ID NO: 125716 - protein, 1075 aa, Glycine max
  Coding DNA Sequence Number=SeqID_8938
  Homolog annotation: Hit_ID=Q10NT0; Match level="QueryCoverage=99%, HitCoverage=97%, E-value=2e-71, Identity=37%"; Hit description =Expressed protein
  Pfam annotation: Domain name=DUF593; Domain location=697-790; Score =175.0; E_value=1.9e-49; Accession=PF04576.6; Description=Protein of unknown function, DUF593
MATNNFATMLHRNTNKMVVILVYAVLEWLLIALLLLNSLFSYLITKFAKCVGLQPPCLWCSRVDHVLQKEHGTHLHKDLVCEAHAAEISKLGYCSNHQRLAETHSMCEDCLASRPNQHENSFGMRHRIAFISWVSSHGKHENEDDIMRRCSCCNESLSSQLYPPYLLLKPSWGNEDYTGKGSLIVEEAIDDEKEGDKDLEFEFEFERNNGEEDRDDEGVADEHQILSDIESFILREVAEDRSSSVSNLHSDEKDAEKDEKEDDLIITELDPSGDHNFVSQFTSTMQGSLYGDRSLEVINMHFENYMDCDNHRLVPVKLIDSITSLNFESYKLKEDLREMEQKTQTQTFVNESPIEAQSSILEREGLLTVDEKAEKTSVRELESLENCITLELEGLKQNSVDEVHPHRITAGEAQTSLNSDKSIEADTEEPDDTQVDPPQSQEPGCSSECTEDESSSSDDDEVQNAFDKFIAQNNLSKPQSLSNDDNSMEAAMQEPENPQANLPPSEEPACSCQCISEDESSSSSDDDAEVQNAFDEFISQNHLSQSQSLSNDDISIESDMEEPENKRDNHPPSEEPACLSNIPEDQSSTSEDDTEASNAFDEFIAQNNLCPDKTGANDTEYAKMIEKTIAVEKIDEETSHESSKCSESYEVEEEKLPETPRSVDGLHYLHKRESVADDSVDGSVASEVECGDPVLTINLLKTALKTERRALSAVYQELEEERSASAVAANQTMAMITRLQEEKAAMQMEALQYQRMMEEQSEYDQEALQLLNELMMKREKEKQELEEELEEYRQKVMEYEAKEKLRVLRRMKDGSVRSRDSSSSCSNMNYTDELSIDLNREAQDEDNVLFNHEESSHINATDDTVSNMEEMALDCVKHVSALDDTLAEFEEERASILEQLKALEEKITTLGDNEEFLDDIKLIEHSSMYGDKDLNENCNFSSLEENGYSNGFSDDKHSLMGSLAKKLLPYLDAAENETEETYTFQGQLESESSDMQNSVPILEMDSMKTCIEEEVDRVYERLQALETDKEFLQHCMGSIQNGGEKGVDLLQEILQHLRDLKAVELRLKTLGNDPL

SEQ ID NO: 125717 - protein, 333 aa, Glycine max
  Coding DNA Sequence Number=SeqID_8939
  Gene Ontology: Mol. function=protein binding; Cellular component =integral to membrane; Biological process=ribosomal small subunit biogenesis and assembly
  Homolog annotation: Hit_ID=Q00UD0; Match level="QueryCoverage=90%, HitCoverage=38%, E-value=8e-46, Identity=39%"; Hit description=[J] KOG2154 Predicted nucleolar protein involved in ribosome biogenesis
  Pfam annotation: Domain name=CBF; Domain location=35-193; Score =136.8; E_value=6.1e-38; Accession=PF03914.7; Description=CBFMak21 family
MKVLVNLHQAVIPHLSNPIMLCDFLTRSYDVGGVVSVMALSSLFVLMTQYGLEYPNFYEKLYALLVPSIFMAKHRARFFQLLDSCLKSPLLPAYLAASFAKKLSRLLLSVPPSGALVITALIHNILRRHPSINCLVHREDGVDEGKGDHRTDEGMATNSDNAKTVAMPSQKSGIDHFNSSETDPKKSGAMIFKEIKSSSKLFLGGRVTFFSLVFYICFADDDLLEQGVLFGKLILFFTTTVLLPHGKFALSLGNDLTVRAKTTEVNVGDFSAGSYATILGAEISRRVKQVPLAFFKATPSSLFSETDFAGWTFKCEETPKMINDNNDSTKDLS

SEQ ID NO: 125718 - protein, 222 aa, Glycine max
  Coding DNA Sequence Number=SeqID_8940
  Gene Ontology: Mol. function=transferase activity; Biological process= D-ribose metabolic process
  Homolog annotation: Hit_ID=Q6VWJ5; Match level="QueryCoverage=97%, HitCoverage=69%, E-value=8e-89, Identity=66%"; Hit description =Fructokinase 3
MQHEQVGEDEFGYMLANILKENNVNNEGMRFDPGARTALAFVTLRSDGEREFMFYRNPSADMLLQEDELDLDLIRKAKIFHYGSISLITEPCKSAHIAAAKDAGVVLSYDPNLRLPLWPSADSAREGILSIWETADIIKEFCGRVKGLKVDAVDTTGAGDAFVAGILSQLAVDLSILQKEDELRDSLKFANVCGALTVTERGAIPALPTKEAVLNAMLKPVS

SEQ ID NO: 125719 - protein, 104 aa, Glycine max
  Coding DNA Sequence Number=SeqID_8941
  Gene Ontology: Mol. function=DNA binding; Cellular component=nucleus; Biological process=regulation of transcription, DNA-dependent
  Homolog annotation: Hit_ID=Q40173; Match level="QueryCoverage=96%, HitCoverage=36%, E-value=9e-49, Identity=90%"; Hit description=Myb -related transcription factor
  Pfam annotation: Domain name=Myb_DNA-binding; Domain location=14-61; Score=44.0; E_value=5.1e-10; Accession=PF00249.21; Description=Myb -like DNA-binding domain
MGRQPCCDKVGLKKGPWTAEEDKKLISFILTNGQCCWRAVPKLAGLLRCGKSCRLRWTNYLRPDLKRGLLSEYEEKMVIDLHAQLGNRHKPWSHVSHLGGKVGV

SEQ ID NO: 125720 - protein, 97 aa, Glycine max
  Coding DNA Sequence Number=SeqID_8942
MEDRRRVLANHFGGLQIRWWRIHECQSIHGAPNKSGEWRIGKNARQSIRGVPDSLVGGGCMNDNQFMGIRIKVENGGEANSARQSIRGAPDSLWEEA

SEQ ID NO: 125721 - protein, 97 aa, Glycine max
  Coding DNA Sequence Number=SeqID_8943
MSCVKIRNTSTVHHSYTSMLFIGCILSLKNKTNLIIVIKRKEHTLRRPYRTRARARVMGEVEEVQKQIKADMEAMMSMKKIMEANVVAVSTNSAVAK

SEQ ID NO: 125722 - protein, 57 aa, Glycine max
  Coding DNA Sequence Number=SeqID_8944
VLHGKIIGINPKDDDSTLDTCHAPFSTHMPNLNGEEEVDDVHANHNDHDEVELINIV

SEQ ID NO: 125723 - protein, 127 aa, Glycine max
  Coding DNA Sequence Number=SeqID_8945
MRIFLESVDKRVGDAIVNNPYIPKVVVDGKEVEKDFNSWTPEENMHDQYNVSAKNIFASILNLDKFYCASQCANAKEIWEILEVTREGTTKDLTTMTVATLFGKLREYELELERLRMKKKLTRRRRD

SEQ ID NO: 125724 - protein, 78 aa, Glycine max
  Coding DNA Sequence Number=SeqID_8946
MINANCQQESLYSISNGNLRFTHDEQNLYIKYWSLITNPIGISVLSLLAITVIEYSLVSTSPKSQIDSAKVSMPTLHW

SEQ ID NO: 125725 - protein, 102 aa, Glycine max
  Coding DNA Sequence Number=SeqID_8947
MVGSDIEALRSYGLPMTMMVDHDPYEFTMAIVGSLTLYWRAIVILLWSCYLPQSCIACPQAIIPVPNQNKFSQVKTPATKIPIYSTSKNSYNEALKIHSRIH

SEQ ID NO: 125726 - protein, 64 aa, Glycine max
  Coding DNA Sequence Number=SeqID_8948
MMNLVVLLVIMQGASSINGGMENDGEGIMTMLTMRVGATICDVGGSSNNLSSVENDCGDDKSDW

SEQ ID NO: 125727 - protein, 296 aa, Glycine max
  Coding DNA Sequence Number=SeqID_8949
  Gene Ontology: Mol. function=transferase activity; Biological process= DNA integration
  Homolog annotation: Hit_ID=Q1S0E3; Match level="QueryCoverage=54%, HitCoverage=21%, E-value=2e-15, Identity=31%"; Hit description =Peptidase S8 and S53, subtilisin, kexin, sedolisin; Zinc finger, CCHC- type; Peptidase ...
  Homolog annotation: Hit description=aspartic, catalytic; Polynucleotidyl transferase, Ribonuclease H fold
MQHRFDIVVLIDESKDTGNMNLEELQGPLEAHELRMNERSLERSGDQALEAQLTKKRASDMKKWKKGKTKPIKSGWISNQEKSKGKQKKKSDDEACVAQEDYDSDLVLLMATTCENLAQSKYWFLEIGCSNHMTNHKEWLSDLDTTRTSKVQFPDDRTLSAKASKQPKNSFKTNMQVRVTKVLAVVHFDVYGSLEVSSLRDFALDHGYGTFTMTMRIVSLHETSAQAPFKEVFLSHEDRSIHRNIGNFVQREKSLDVACGGKLMLKTPVDAIRIIEDKFSNPYNNSGDRCNDPPHR

SEQ ID NO: 125728 - protein, 151 aa, Glycine max
  Coding DNA Sequence Number=SeqID_8950
  Gene Ontology: Mol. function=nucleic acid binding
MAAVWMPLNGITITEIEPSIFLFRFYHNVDVQHVLNGGPWSLDKHMMILGAIKNGEDPAPVPLFSIPIWVQEHNLLVGFMSQVVGENLRNLTRKFLEYDEKNNANLLRSVMHIRQNNGDGGLGSDIRLDKRNNGENGGQKWLHEEGDNNHY

SEQ ID NO: 125729 - protein, 56 aa, Glycine max
  Coding DNA Sequence Number=SeqID_8951
MGVKQLLIEIPQIVENDLVDQVVDEEQQVPQEDHEATLRRSTMESSEQLEPRQEFV

SEQ ID NO: 125730 - protein, 82 aa, Glycine max
  Coding DNA Sequence Number=SeqID_8952
  Gene Ontology: Mol. function=protein dimerization activity; Cellular component=nucleus; Biological process=regulation of transcription, DNA-dependent
  Homolog annotation: Hit_ID=Q1SM50; Match level="QueryCoverage=39%, HitCoverage=5%, E-value=1e-12, Identity=87%"; Hit description =Deoxyribodipyrimidine photolyase, class 1
MGIDWCMGPKWFETCLLDYDPCSNYANWTYGSGKSKKYSIGTKGRGLHLTTENEFCEDKPNSGAKLHQLMDTNPRADVVAAG

SEQ ID NO: 125731 - protein, 70 aa, Glycine max
  Coding DNA Sequence Number=SeqID_8953
MVVRFVNNDFYEVKGEVEKSAIKRFYPKKDKATTSTNKNELGFQKEKWHRQDMSREYELCSGCLNLNSSN

SEQ ID NO: 125732 - protein, 271 aa, Glycine max
  Coding DNA Sequence Number=SeqID_8954
  Gene Ontology: Mol. function=histone-lysine N-methyltransferase activity; Cellular component=nucleus; Biological process=chromatin modification
  Homolog annotation: Hit_ID=Q1RZQ6; Match level="QueryCoverage=62%, HitCoverage=68%, E-value=9e-47, Identity=72%"; Hit description =Nuclear protein SET; SET-related region
  Pfam annotation: Domain name=SET; Domain location=94-220; Score =103.7; E_value=5.4e-28; Accession=PF00856.18; Description=SET domain
MVVIEDLERFLANKMMRTSASGILNFMDRLLIWCCTEERVMVFTMNMKEHVDPNLLHSGRVIVHIDFRFMIFQRLKQMVMGGGSGLLEDLCRPMNCHHCSMLHLQETGKRGFGIVVAKDIKVGEFVIEYVGEATYDLQVLPFWNMKQRGERNFYLCEINRDMVIDATYKGNKSRYTNHSCCPNTEMQKWIIDGETRIGIFATSDIQKDIYAFGKFWRCWSLRNYASMTGWLFYVSNYIVGLLHLVHIKIAIEVLLSASVSWVSDLPSLNFL

SEQ ID NO: 125733 - protein, 152 aa, Glycine max
  Coding DNA Sequence Number=SeqID_8955
MTMLPLALSRVRSYEKFTTAVINGTLQLLKKVCHVFGSSAYEVEFRSLAAAASDILCFNLFVKDYGFTEENMNDKGYGFQNSSICLVVNIGVASLLIEATTAIFVEVGASKATRMMTIEASSKYSIVHKLSNNITSCLSSIELEKFLMRTSS

SEQ ID NO: 125734 - protein, 105 aa, Glycine max
  Coding DNA Sequence Number=SeqID_8956
  Gene Ontology: Mol. function=nucleoside-triphosphatase activity
  Homolog annotation: Hit_ID=Q1SHI2; Match level="QueryCoverage=59%, HitCoverage=14%, E-value=9e-14, Identity=57%"; Hit description=AAA ATPase
MVSKDMGVVHEKAQVVLPLLVDFFGNNVNVLKVRTKDLTLVHLSDLENKGSGLVEPKECGFEKVVFDGLVGNVSRGRPSCRGGGSGLRSIDGEVALLLLVMAWEP

SEQ ID NO: 125735 - protein, 123 aa, Glycine max
  Coding DNA Sequence Number=SeqID_8957
  Gene Ontology: Mol. function=transition metal ion binding
MGDHLEDMICDLGQESFQQTHAPIYDTLQTDSKKPLYLKCNNSLMLLLAVLSLVNVKAKKILCLMGIEYQKIHACPNDCILYRHEFEEMLKCPRCGVSRYRVKDDEECSSDENSKKGPASESV

SEQ ID NO: 125736 - protein, 113 aa, Glycine max
  Coding DNA Sequence Number=SeqID_8958
  Homolog annotation: Hit_ID=Q1SDY9; Match level="QueryCoverage=73%, HitCoverage=23%, E-value=1e-07, Identity=38%"; Hit description =Peptidase S8 and S53, subtilisin, kexin, sedolisin; Zinc finger, CCHC- type
MRRQLKAYNLWEWRMLNHQLWKKIPLLLRIDPIVSKLPKEQRILPSCSQLWMREYEALKMNEAESIKDFMTKMMKVVNQIRSDCKIVDKLLVVLLERFDPRFLHLKSQRISPR

SEQ ID NO: 125737 - protein, 393 aa, Glycine max
  Coding DNA Sequence Number=SeqID_8959
  Pfam annotation: Domain name=Transposase_23; Domain location=218-288; Score=-2.9; E_value=0.0024; Accession=PF03017.5; Description =TNP1ENSPM transposase
MGSILSEPQRPFVGGCAKEGTGCLETKQFPSRVVSWGYEYLENKMMEEKKKKTLEEVAQSESIDTVIDPPSSIRRQVKWRMACTKKTSQMTSKATKEIADKIDSLEEQVSQGSFVAHGRHDVLTATIGRPEHPGRVPATKASVTIKQYFGSALRTSCSSSSMAPKDMEQLTQQIRDQLEELITEKGLALPPEPEVGPSTARVNTKESYVDPLGNDRDMGDSDKCGLYIEENLPRPVALGRLSEGSTTIHNIPLLHDQVKVGVEEVSDVDALVPMPTKEVKLVGQAHNNFLVWPRHLVRHLSEQGAEGLAKPTDRSDNDVDDPLYLITLTIPQLFLKPLQVMWDATVFGVHNDNFPLYIKHEDLSEIPHGGDAEPKLGILILLNYEFYGKVEEH

SEQ ID NO: 125738 - protein, 99 aa, Glycine max
  Coding DNA Sequence Number=SeqID_8960
  Subcellular localization annotation: CTP_CleavageSite=47; ConfidenceScore=5.09e-01
MDRVTSLLRLLPNTFRTVDVLVTSSFTLTKIKKHALRCPYRTRARARVMGKVEEVQEQMKADMEAMKEQMATMMEAMMSMKKIMEANAVAVAATSAVAM

SEQ ID NO: 125739 - protein, 49 aa, Glycine max
  Coding DNA Sequence Number=SeqID_8961
MTRTKKTSQVTSETTKEIGDKIIPWRSRLHRAALSPMDVRMYCLLPLGD

SEQ ID NO: 125740 - protein, 281 aa, Glycine max
  Coding DNA Sequence Number=SeqID_8962
  Gene Ontology: Mol. function=transporter activity; Cellular component= integral to membrane; Biological process=transport
  Homolog annotation: Hit_ID=P75798; Match level="QueryCoverage=68%, HitCoverage=77%, E-value=5e-76, Identity=64%"; Hit description=Inner membrane ABC transporter permease protein yliC
SWPPAIFNTAFYSNPQVDKDLADALKTTDRDQKARLYKDAQDRIWNDHPWIPLVVEQLLSANNKNLTGFYVMPDTSFNFDEADLNAGVPVRASAAGRPGAPDCRTGSGCLSGGAVDGVKAAGLCRNCRALFSYSVADAEQHGVGGTVWHGDRHRFGGMAQSLAGPHRHDAGGFRHLLSGVCAGYAADAGLFGGARLVADGGRRQLAALHSAVDYARCRRGRGRLYAHRTGQRGARIAGGGQTRAAQCHDSGGHHDGAAVRLSARRLDCGGSGVNWPGLAVC

SEQ ID NO: 125741 - protein, 230 aa, Glycine max
  Coding DNA Sequence Number=SeqID_8963
  Homolog annotation: Hit_ID=Q6ZQQ8; Match level="QueryCoverage=84%, HitCoverage=34%, E-value=9e-09, Identity=26%"; Hit description=CDNA FLJ46160 fis, clone TESTI4002141
MVISPHLCYPDTIESNGTQTQIMVIMHLLSSRGGEPDDMRRQLMVIRTPFCHPETIESGGTQREIMVILHLLSSRGGEADDLRRQIIVIRTPFCYLETIESGGTQRQIMVILQLLSSRGGEPDDMWRQIMVIRTLFRHPKTIESDGTQRQIMVILHLLSSTGCEPDGMRRQIMVIRTPFCHPETIESGGTQRQIMVILHLLSSRGGEPDDMWMTIMIIRLHLLSPEKRRL

SEQ ID NO: 125742 - protein, 263 aa, Glycine max
  Coding DNA Sequence Number=SeqID_8964
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=3e-28, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=14; ConfidenceScore=5.31e-01
MVRTCNPLKVRTCSCLKVRARSLLKVRTCSPVKVMGCNPLKARTCSPLKVMVHSPLKVRTCSPLKVRASNPLNARTCSPLKVRSFSPLKVRKCCPLKVRARNALKVRARSPLKVMACNPLKAMTCNPLKVRACSPLEAMTCSPLKVRACSTLNVRTCCPLKVRSCSPLKVRLRSPLKVRTCGPQRVRACNTLKVRTCSPLKVRVCSPLKVRMCNPMKVRACNPLKARTCSSLKVRVCSPLKVRTCSPLKVRARSPQKARTRST

SEQ ID NO: 125743 - protein, 87 aa, Glycine max
  Coding DNA Sequence Number=SeqID_8965
MSQNFTDYATIPFFLTSRILRNLTNCLTMLSFDFWHVTELHELPNDGCQVPRSGQTKLHATKQRSSDEIRVTIYSSLWITAYLVKDK

SEQ ID NO: 125744 - protein, 67 aa, Glycine max
  Coding DNA Sequence Number=SeqID_8966
  Subcellular localization annotation: CTP_CleavageSite=64; ConfidenceScore=5.32e-01
MWGYLRVTRTFCQPGASEPVDTHRLTSSSAPFAIQGQRVLLSSSRSIQAQRRARFFSAGQGRSSAMA

SEQ ID NO: 125745 - protein, 127 aa, Glycine max
  Coding DNA Sequence Number=SeqID_8967
MVFNRLHSWIATDKRLYYAYGSPDDIETWKTFRIQYSLPLVRMQAKQGNQSLAREELPLELHNRSCFLKWSLLSLCFRDSGWLLESLAIAIESGVDARNRVSGTSFFTLELRGRLAEWKLHPYGACT

SEQ ID NO: 125746 - protein, 148 aa, Glycine max
  Coding DNA Sequence Number=SeqID_8968
MEMITMIVDTLPVFYYEKWWATHLQVFTDERIKVGLKRDKFDHPALMNEKTGANKEDKKEGETHAAIAVPTWPSFPPTQQCHYSANKNPSPYPPPNYPQRPSLNQPQNPPSTQPMLNTTSGTNPKHQPRNEFYSEKTYRIHPNSGVLC

SEQ ID NO: 125747 - protein, 67 aa, Glycine max
  Coding DNA Sequence Number=SeqID_8969
MDGILISSVVLLADSRFTRPDMGFHPTKLNFVPSDADEAPLDVSICLHAFGIGGCGSFSGVKSCERE

SEQ ID NO: 125748 - protein, 170 aa, Glycine max
  Coding DNA Sequence Number=SeqID_8970
  Gene Ontology: Mol. function=protein binding; Biological process =xylan catabolic process
  Homolog annotation: Hit_ID=Q1S5Q9; Match level="QueryCoverage=78%, HitCoverage=15%, E-value=4e-25, Identity=45%"; Hit description =Leucine-rich repeat
  Pfam annotation: Domain name=LRR_1; Domain location=27-48; Score =11.6; E_value=1.9; Accession=PF00560.23; Description=Leucine Rich Repeat
  Pfam annotation: Domain name=LRR_1; Domain location=3-25; Score=14.3; E_value=0.45; Accession=PF00560.23; Description=Leucine Rich Repeat
  Pfam module annotation: Pfam domain module=LRR_1::LRR_1; Domain location=27-48::3-25
  Subcellular localization annotation: CTP_CleavageSite=44; ConfidenceScore=5.09e-01
MKLLESLDLSLNNISGQIPQSLSDLSFLSVLNLSYNNLSGRIPTSTQLQSFEELSYTGNPELCGPPVTKNCTDKEELTESASVGHGDGNFFGTSEFYIGMGVGFAAGFWGFCSVVFFNRTWRRAYFHYLDHLRDLIYVIIVLKRTRRASDLSIKFCFVFITHYCLLLSVL

SEQ ID NO: 125749 - protein, 75 aa, Glycine max
  Coding DNA Sequence Number=SeqID_8971
MYNTAFLHLFLHFHPFSFVCMFVFVAIKQYRSDKESYEGTNTEDPDVDFERLVKIVEDEEDEDWGIPPELKRMVE

SEQ ID NO: 125750 - protein, 74 aa, Glycine max
  Coding DNA Sequence Number=SeqID_8972
MTSMPYFGVIQQILEVDYSQLRVLVFKCNWVNGKFDLNNVSYKDESFIMVEKQNKCFISKIRVAQNGQWFYKEE

SEQ ID NO: 125751 - protein, 78 aa, Glycine max
  Coding DNA Sequence Number=SeqID_8973
MGLGIRFVGGGYTNSATQSVRGTLDSMAINSWGSRLDGGGCMNNNQFMGLQIRFEGGGYTNSSRHAIRGASHSMVEDA

SEQ ID NO: 125752 - protein, 85 aa, Glycine max
  Coding DNA Sequence Number=SeqID_8974
MESSNVKDKSSGKRKMSSEDTRSYFAWNLEMEHLCAKDRAIGLGAENALDEDDIMSKEANEEETIHSVSIDLEGSSSATRKKIRP

SEQ ID NO: 125753 - protein, 77 aa, Glycine max
  Coding DNA Sequence Number=SeqID_8975
  Subcellular localization annotation: CTP_CleavageSite=42; ConfidenceScore=5.39e-01
MNLGIPRSCGSACHRSLGTRGSTGFNKNRRKSLKVYQSHTARGEKVASAQDFVSNQRERTTLGCGFLFLVHLVTILY

SEQ ID NO: 125754 - protein, 259 aa, Glycine max
  Coding DNA Sequence Number=SeqID_8976
  Homolog annotation: Hit_ID=Q1RUD8; Match level="QueryCoverage=63%, HitCoverage=42%, E-value=8e-12, Identity=29%"; Hit description=IMP dehydrogenase/GMP reductase
MGIADGSSLMSSLQQGVWENLGFGHVGTDHISVRRDLRMPARRKDAIPFIGFYPSMARIAKVVKILKQELDRLKQNRNGVVGIPRKREWTSFIDILALLVFGTILFPNVDGLVDLAVIDAFLAYHHNKESPVITVLADAYDTFDLRCEKSSARIVCCMPALYVWLVSHIFHHEGRLERPLAGSPDGKKEGHECYARYPMRGAPSEDIITPFVARGFNEANAKILQRIRKAWNIVERKDKRLRGSSNGVIGGYHKWLKSR

SEQ ID NO: 125755 - protein, 129 aa, Glycine max
  Coding DNA Sequence Number=SeqID_8977
  Subcellular localization annotation: CTP_CleavageSite=32; ConfidenceScore=5.79e-01
MGSPPASTPPPPSPPPPSDASASPSAVKRTRKASRLRSLSTRPPGVERPVVHVDPATRKADGPHKKKLRTYLGIVARYKVGVTYENWKEVPTAQKDLIWEDIQAEFDIPEASDSRTKRKLLQTVGEGWK

SEQ ID NO: 125756 - protein, 125 aa, Glycine max
  Coding DNA Sequence Number=SeqID_8978
MTLPSAVHVFSTVESGDPRMSLPSAVCQFSILHFHSEPHECHCLALFIHPPPKEFGAMLHDCLSVDPLVQSSILHFFSEPHECHCLALSMCPPPSSLEPCKCHCLALFANSPFSTFIRSPLNVIT

SEQ ID NO: 125757 - protein, 103 aa, Glycine max
  Coding DNA Sequence Number=SeqID_8979
MDRSWMNESRINPEYEESVERFLQFASERGRPDEDGKYYCPCINFLNGRQQILDNIREHMLCDGIKRNYTTWIWHGLQSDSKKPFVSGVQEFLDAVAGGVKSG

SEQ ID NO: 125758 - protein, 36 aa, Glycine max
  Coding DNA Sequence Number=SeqID_8980
MAFSNALRSAAKLVASSESSLSNSGFKYRSRLRRIC

SEQ ID NO: 125759 - protein, 222 aa, Glycine max
  Coding DNA Sequence Number=SeqID_8981
  Homolog annotation: Hit_ID=Q9LU63; Match level="QueryCoverage=80%, HitCoverage=65%, E-value=3e-44, Identity=52%"; Hit description =Arabidopsis thaliana genomic DNA, chromosome 5, P1 clone:MWD22
  Subcellular localization annotation: CTP_CleavageSite=34; ConfidenceScore=5.38e-01
MAITGNLNFNLNLVLPVARHMACPPRVPSFLFTRGRGAWSPSLLVTRAIDANEFLGDFGARDPFPAELESSFGEKVLGYGNTEHKILIPTITALGLSQQECAPVSSAQPPISLDDAQTLIRKPYPCICKEAVSGFEPMTNKSPRHNFTAASGLALKLKVVGWRLVNEENGLKIQCLWKLRDFKCGVELINRISKVVEAEGHFPNIYLEQPNQVRAELWTASI

SEQ ID NO: 125760 - protein, 49 aa, Glycine max
  Coding DNA Sequence Number=SeqID_8982
MAKHESGIIVGVEGVLFPVACLLIFCSPECGGYNCIVSAYIYPSIRITA

SEQ ID NO: 125761 - protein, 80 aa, Glycine max
  Coding DNA Sequence Number=SeqID_8983
MKNEKFHTGQAFVGTGRDVTQKVTKKCQKRRRIEKLACLVSFQAMKNSSEDDKLKVKASSLQQLNLLLSSPITRAPTLFC

SEQ ID NO: 125762 - protein, 92 aa, Glycine max
  Coding DNA Sequence Number=SeqID_8984
MSTQSSFFSDAGPSNMMARTRFTAAFRVQKNIIEVPLSYHSQWRPYYPTYVLFDYNGTKHFIRVRKCGTRCFFADGLKEFRRTHDINDSVII

SEQ ID NO: 125763 - protein, 406 aa, Glycine max
  Coding DNA Sequence Number=SeqID_8985
  Homolog annotation: Hit_ID=Q1T2S5; Match level="QueryCoverage=84%, HitCoverage=87%, E-value=3e-46, Identity=36%"; Hit description =Cyclin-like F-box; F-box protein interaction domain; Galactose oxidase, central
  Pfam annotation: Domain name=F-box; Domain location=23-70; Score =38.4; E_value=2.5e-08; Accession=PF00646.23; Description=F-box domain
  Pfam annotation: Domain name=FBA_1; Domain location=244-388; Score= -42.5; E_value=0.01; Accession=PF07734.3; Description=F-box associated
  Pfam module annotation: Pfam domain module=F-box::FBA_1; Domain location=23-70::244-388
MLSFLPVWVLAKAKERGSSNMPNLTKTLPLELIREILLRLPVRSVLRFKCVCKSWLSLISDPQFAISHYDLAAAPSHRLLLRTYRFYVESIDIEAPLKNYFSAVHLLLPPSSPPRPLQLGEHNYHSACIDNHEILGSCKGFIVLYYKRNNDLILWNPSTGFHKRFLNFANELTYLLCGFGYDTSVDDYLLILIDLCESKNEESEDDDCKLEIAIFSFKTGNWVLFAEIHVSYKNFYYDDLRVGSLLNGALHWMVCYKDRKVPVIIAFDLIQRSLLEIPLLDHLTMKKYEAYSLSVMDGCLSVCYSVRGCGMIEIWVMKIYKVQSSWTKSVVIPTYGKPQDFFSPICITKDGGIFGSNYCGKLEKFNDKGELLEKLIYERVYCHSLVFVGKQGTYNDLGEASEDDQQ

SEQ ID NO: 125764 - protein, 80 aa, Glycine max
  Coding DNA Sequence Number=SeqID_8986
MEEGVGLQCQRKRGFKRRSKQKAKISRVHASRKRKSVGFKHKGLGFKADNEGASTKRQIRGRTRKDLVLPKDPLYTCEKR

SEQ ID NO: 125765 - protein, 106 aa, Glycine max
  Coding DNA Sequence Number=SeqID_8987
  Gene Ontology: Mol. function=DNA binding; Cellular component=nucleus; Biological process=regulation of transcription, DNA-dependent
  Homolog annotation: Hit_ID=Q6QAD8; Match level="QueryCoverage=91%, HitCoverage=42%, E-value=4e-41, Identity=69%"; Hit description=MYB transcription factor
  Pfam annotation: Domain name=Myb_DNA-binding; Domain location=52-97; Score=49.5; E_value=1.2e-11; Accession=PF00249.21; Description=Myb -like DNA-binding domain
MAGNMGWGVIEEEGWRKGPWTSEEDKLLILTKRNGKSCRLRWVNYLRSDHKKGQITPQEESIILELHARWGNRWSTIARSLPRRTDNEIKNYWRTHFKKKIRAHFS

SEQ ID NO: 125766 - protein, 83 aa, Glycine max
  Coding DNA Sequence Number=SeqID_8988
MNNIQDWERARVRRLPVAHHPCSGSWQKPCVVCRSILGLVCVMKDGGFFVIAKIVLFDGSIPVVETEALALYHANKLEGWPRF

SEQ ID NO: 125767 - protein, 97 aa, Glycine max
  Coding DNA Sequence Number=SeqID_8989
  Gene Ontology: Mol. function=acid phosphatase activity; Cellular component=cellulose and pectin-containing cell wall
  Homolog annotation: Hit_ID=Q9LU48; Match level="QueryCoverage=69%, HitCoverage=26%, E-value=1e-22, Identity=72%"; Hit description=Acid phosphatase
  Pfam annotation: Domain name=Acid_phosphat_B; Domain location=1-96; Score=-49.0; E_value=0.00018; Accession=PF03767.5; Description=HAD superfamily, subfamily IIIB (Acid
MVFDHEKFNNWVEKGVAPAIEPSLKLYEDVLNLGFKVILLTGRSERHRSVTVDNLINAGFKEWDQLILRRNLANNPLIPTSFFRWTIESAYLKSSWR

SEQ ID NO: 125768 - protein, 78 aa, Glycine max
  Coding DNA Sequence Number=SeqID_8990
LMDPSSPRLAIALSAHFPINRYAREAKEKFQGSVLEGIERIEREEEERRGNEVEALPNCDYDESLCGSLFGAFHATVS

SEQ ID NO: 125769 - protein, 94 aa, Glycine max
  Coding DNA Sequence Number=SeqID_8991
MKPRCCRIATMFNLNIVLCSLFFVRHSVATTGGANIEEEEAIDLKSNLLQVGGDDAILPRKGTITRAMSKRLQEDWARAAEEGPRVLMNLKVDF

SEQ ID NO: 125770 - protein, 127 aa, Glycine max
  Coding DNA Sequence Number=SeqID_8992
  Gene Ontology: Mol. function=actin binding; Biological process =cytoskeleton organization and biogenesis
  Homolog annotation: Hit_ID=Q94HU2; Match level="QueryCoverage=71%, HitCoverage=14%, E-value=5e-15, Identity=44%"; Hit description =Putative transposable element
MCVIVSSTRFLTFKDLAEMGIRAQLYPRSDDLKRIYKESTRPEASIRYITEETIQFCLEYIEKAKPIGPPESRHDERVEGKGSGELNVITLGLEELQQVHLYILNNNTEVVPYIVHHEALVKEVTQK

SEQ ID NO: 125771 - protein, 124 aa, Glycine max
  Coding DNA Sequence Number=SeqID_8993
  Gene Ontology: Mol. function=transition metal ion binding; Cellular component=cytoplasm; Biological process=proteolysis
MLPKENTLPKSYYQAKKVLCPMGMGYQKIHACPNDCILYKHKFEEMSKFPRCGVSRYKVKNDEECSSDENSKRAPQRRCCCICRSLQGLSVFLLMETMLKTLHGMQQGENAMEWSVIRIYVGRP

SEQ ID NO: 125772 - protein, 69 aa, Glycine max
  Coding DNA Sequence Number=SeqID_8994
MWYHFSVKNLVGRLGVHDRTFLTMGRPVRVTLFCENAPTMWDRHRLTGALKPDDPQGLHSEESIRASPS

SEQ ID NO: 125773 - protein, 437 aa, Glycine max
  Coding DNA Sequence Number=SeqID_8995
  Gene Ontology: Mol. function=signal transducer activity; Cellular component=spindle; Biological process=cell division
  Homolog annotation: Hit_ID=Q6Z8D3; Match level="QueryCoverage=89%, HitCoverage=85%, E-value=7e-94, Identity=43%"; Hit description =Putative WD-40 repeat protein
  Pfam annotation: Domain name=WD40; Domain location=167-205; Score =13.9; E_value=0.59; Accession=PF00400.22; Description=WD domain, G -beta repeat
  Pfam annotation: Domain name=WD40; Domain location=209-245; Score =19.2; E_value=0.015; Accession=PF00400.22; Description=WD domain, G -beta repeat
  Pfam annotation: Domain name=WD40; Domain location=250-288; Score =29.0; E_value=1.6e-05; Accession=PF00400.22; Description=WD domain, G-beta repeat
  Pfam annotation: Domain name=WD40; Domain location=295-336; Score =14.2; E_value=0.49; Accession=PF00400.22; Description=WD domain, G -beta repeat
  Pfam annotation: Domain name=WD40; Domain location=372-410; Score =26.7; E_value=8.4e-05; Accession=PF00400.22; Description=WD domain, G-beta repeat
  Pfam module annotation: Pfam domain module=WD40::WD40::WD40::WD40::WD4 0; Domain location=167-205::209-245::250-288::295-336::372-410
MWNLEHDWYSPKSLLSTPTHYDFPGDRFIPNRSLMDLDQAHSLLTNRTRKIQNKEFNDLYRQIVDEKLNLDSEGNPFKMLVFRGSPKSSRKSILHIDEMREEEAAALQNTSNQHYYRRRLPKKESRILDAPNIRNDFYSNIMDWGNNNILAIALDSDMYLWNSENKNVFKLFKATNNDFPTSVSWSEDTKYLAIGFMNSKLQLWDAETSKPIRILQGHGHRIATIAWNGQILTSGSHDKYIINHDVRARNNVISQVKAHKAEVCGLKWTRRSNMLASGGNENHIYVWDLVKMSSSNFLHCFKDHCAAVKALAWCPYDSSVLASGGGTEDSCIKLWNVCGLEWNRHHKELLSGHGFSTSAHHNQLCMWKYPSMTKVGGLDRHASRVLHLCQSPDGLTVVSAGADESLRFWDVFGPPVNNTSEISDLDNLLSLKVSPIR

SEQ ID NO: 125774 - protein, 133 aa, Glycine max
  Coding DNA Sequence Number=SeqID_8996
  Homolog annotation: Hit_ID=Q8RVE5; Match level="QueryCoverage=91%, HitCoverage=19%, E-value=2e-08, Identity=27%"; Hit description =Pentatricopeptide (PPR) repeat-containing protein-like
  Pfam annotation: Domain name=PPR; Domain location=95-129; Score=21.8; E_value=0.0025; Accession=PF01535.11; Description=PPR repeat
MVQLKGMKVKEKVSQELAYLANDVDFAILEGMVFQQDTQGALQLFKGRKEARILEVTQQNFGIMAKSGAETDEAGLVTKLLQEMKEWQRVECGVHDWNNVIHFFCKKRLMQDAEKALKNMRSLGQSPKAQTFW

SEQ ID NO: 125775 - protein, 48 aa, Glycine max
  Coding DNA Sequence Number=SeqID_8997
  Subcellular localization annotation: CTP_CleavageSite=26; ConfidenceScore=5.07e-01
MSRRLHNVSVGDFAKIFNRSSSFIVRSSSFFGLQPSCRNHVGNQKEVK

SEQ ID NO: 125776 - protein, 206 aa, Glycine max
  Coding DNA Sequence Number=SeqID_8998
  Gene Ontology: Mol. function=superoxide dismutase activity; Cellular component=chloroplast; Biological process=superoxide metabolic process
  Homolog annotation: Hit_ID=Q53D73; Match level="QueryCoverage=97%, HitCoverage=63%, E-value=6e-80, Identity=70%"; Hit description=Fe -superoxide dismutase 1
  Pfam annotation: Domain name=Sod_Fe_C; Domain location=39-162; Score =175.2; E_value=1.7e-49; Accession=PF02777.8; Description =Ironmanganese superoxide dismutases, C-term
MVILYNKGDILPAFNNAAQACMLAWNHDFFWESMKPGGGGRPSGELLKLIERDFGSLKKFLDEFKTAASAQFGSGWAWLAYKESRLDVGNVLNPLQSDEDKKLVVVKTPNAVNPLVWNYYYPLLTIDVWEHAYFIDFQNQRRDYISVFMDKLVSWDAVSSRLEQAKALIEEREREAERKRRDEEKPTSSEATPEIFSDSDADLDVE

SEQ ID NO: 125777 - protein, 76 aa, Glycine max
  Coding DNA Sequence Number=SeqID_8999
MWAIIDEYAKISAEREAREKVIDSLHQEATMENEKIGSYSEQESRTSPIASQGQSNGGHLLPPRGDPWTSQFIVSI

SEQ ID NO: 125778 - protein, 146 aa, Glycine max
  Coding DNA Sequence Number=SeqID_9000
MAISKAQVKGCCSQLPAPATLPLYLLHPYPCVPVTTALKSPVKPVEVATCHVSHLQRMCQWGWQFAWSLHAGPLGPSRLFLQKVVASGGSNLARLGELGGKLFPYFAINRGRSEEGRGSAFLALRIHLKLLRKIVSVEKIQAEALP

SEQ ID NO: 125779 - protein, 42 aa, Glycine max
  Coding DNA Sequence Number=SeqID_9001
MARECFPNEYMMWNCPSSVDEWHESSFSNARNDPEETCLKEI

SEQ ID NO: 125780 - protein, 151 aa, Glycine max
  Coding DNA Sequence Number=SeqID_9002
  Homolog annotation: Hit_ID=Q1T493; Match level="QueryCoverage=92%, HitCoverage=26%, E-value=8e-21, Identity=37%"; Hit description =Nucleic acid-binding, OB-fold, subgroup
  Pfam annotation: Domain name=DUF223; Domain location=40-135; Score= -3.0; E_value=0.0055; Accession=PF02721.5; Description=Domain of unknown function DUF223
MARISDKIRSIDGSKETLKLAVRITDLWFVGTPDKSEQAEMVFVDSEGDQIHAICKSDHLKSWKADLKENCTYVMHNFKVVKNDDQFRVCEHEYKLFFIGVTVVREADLHELPFKEFRFVEFANVVAGNFVSGLLVGGLSACFIEKYQGCF

SEQ ID NO: 125781 - protein, 96 aa, Glycine max
  Coding DNA Sequence Number=SeqID_9003
MQWSCGKQRQLATVTGGRWWRRRRLGVLGEGLGKKMEAKWLFYVVGCICILQDSARYYFKNPSGQKVQIWVARLQSKSEGDPTVTVSRIMVLLEQV

SEQ ID NO: 125782 - protein, 131 aa, Glycine max
  Coding DNA Sequence Number=SeqID_9004
MEKQIGRNSWQRIRKAWNVVERKDKELRGSSNGVIDSYHKWLKARMQGIIWLPKLKGPSGEEVEAPEESEEVQALKIELERMRVVKEKLKIVVTRVKKKCNKLRDVNMTMAEALERETKRARKEEWSMNKF

SEQ ID NO: 125783 - protein, 66 aa, Glycine max
  Coding DNA Sequence Number=SeqID_9005
  Subcellular localization annotation: CTP_CleavageSite=41; ConfidenceScore=5.16e-01
MVLVAAIAAALTSIIFFMLIMASIMVAIGSFMVSISVFICSCTSYTSPITLALARVRKECNEQCNQ

SEQ ID NO: 125784 - protein, 100 aa, Glycine max
  Coding DNA Sequence Number=SeqID_9006
MATMMEAMMSMKKIMEVNAAAIAATSTIAEPCLGYATEGQEVGGIPLQNTLEGPQYHPQPHPLHSTAGKNPHVMAKMGKLDHLEERLRAIEGGEDYAFVN

SEQ ID NO: 125785 - protein, 74 aa, Glycine max
  Coding DNA Sequence Number=SeqID_9007
MKDLFVTKLESNEVLLSPISLKVVEPLLFDSNSSRDGTNPPFQFPIWQFTNKGTKRQAITKDQQIEMKDKLIEF

SEQ ID NO: 125786 - protein, 88 aa, Glycine max
  Coding DNA Sequence Number=SeqID_9008
MAFGASVKFLKTLENPSRGASVKLLRLFREQFREDFMPFFVLQPNYVGLISSSQLRIHRSKSSAFVDHPKRSLMVQHLNVSLLSKTMR

SEQ ID NO: 125787 - protein, 107 aa, Glycine max
  Coding DNA Sequence Number=SeqID_9009
MAPPGSIPSAKQFRELVAWPGTQSFLHREDEGPTAQVPQNMEDESSEATIPKPFTIKEEAGNTQTTQVPVATLERSLEAILEAPTPAVDPSSPQYETNPSTHVLEIP

SEQ ID NO: 125788 - protein, 92 aa, Glycine max
  Coding DNA Sequence Number=SeqID_9010
MASPITCGGTLWSRTFCQPEASEPTDMQRLTLSSTPLSSRDGESDRQASPLTRGDKLWSSAYLCYPETIKYDSTQRQIMVIRTPLLSRDDQV

SEQ ID NO: 125789 - protein, 229 aa, Glycine max
  Coding DNA Sequence Number=SeqID_9011
  Gene Ontology: Mol. function=transcription factor activity; Cellular component=membrane; Biological process=regulation of transcription, DNA-dependent
  Homolog annotation: Hit_ID=Q7WG73; Match level="QueryCoverage=94%, HitCoverage=79%, E-value=2e-81, Identity=66%"; Hit description =Putative LysR-family transcriptional regulator
RTDRRRPGAVPRGPDAAAPGRGRAHAGAAGRRRPARPLAHRLRGVDAVPRPAGAAGVHAGRTAGRRARADRIEFARPDRGGAARRTGPGLHPCQPGAGRRGGARSVGRTLRGVPAAKPCAGRAAFVGLLRDCAVAVRGGGLHARGPPRGAPLAQRGFAGVAGTGRVDRAVVPVAQRPGGHPVHRVRAPGALGQPGDLAARGPVAAAGKGAGAGRAPVPRGLNGRPGVVS

SEQ ID NO: 125790 - protein, 86 aa, Glycine max
  Coding DNA Sequence Number=SeqID_9012
  Gene Ontology: Mol. function=electron carrier activity; Cellular component=cytoskeleton; Biological process=electron transport
  Homolog annotation: Hit_ID=Q9JKS4-3; Match level="QueryCoverage=90%, HitCoverage=13%, E-value=6e-11, Identity=46%"; Hit description =Isoform 3 of Q9JKS4
  Subcellular localization annotation: CTP_CleavageSite=51; ConfidenceScore=5.65e-01
MAEPLKKRNGTSRTCSPLKARKCSPLMARACSPLKARKCSPLMARACSPLKARMCSPLMARVCIPLKARACSPLKLRVLVPKGPPL

SEQ ID NO: 125791 - protein, 141 aa, Glycine max
  Coding DNA Sequence Number=SeqID_9013
  Gene Ontology: Mol. function=helicase activity
  Homolog annotation: Hit_ID=Q2R1R7; Match level="QueryCoverage=87%, HitCoverage=7%, E-value=7e-25, Identity=50%"; Hit description=AT hook motif-containing protein, putative
MPPDRQSITNAWKKKPKFAQLYIFDTENEVQNKINAMSQYSGIQSHIVSGLSHMLDQHNSHAKSFRMARDRLAGDQANNIKLQLIAARGKDGRVYNMPNVPEIAALIVGDFHPGSKRDIIVETQNGELQRIHELHASYPPL

SEQ ID NO: 125792 - protein, 109 aa, Glycine max
  Coding DNA Sequence Number=SeqID_9014
MEWFFRISHPFVTRTEETAAPRHPPPPHHEEFIEPPIPEVLVMTDLPTHSVVHCEGCQGMAQDLGAIVEDLERVINLRMVIEGTDLHDIMTRSLRRARGDTAYGSLRPR

SEQ ID NO: 125793 - protein, 53 aa, Glycine max
  Coding DNA Sequence Number=SeqID_9015
MTATSRLCLPSGHRTEKNSLIGAESSKLNSRISYRTKPPILPSRFLQVEGQGT

SEQ ID NO: 125794 - protein, 444 aa, Glycine max
  Coding DNA Sequence Number=SeqID_9016
  Gene Ontology: Mol. function=DNA binding; Biological process =regulation of transcription
  Homolog annotation: Hit_ID=Q1RY17; Match level="QueryCoverage=99%, HitCoverage=99%, E-value=1e-99, Identity=52%"; Hit description =Homeodomain-related
  Pfam annotation: Domain name=Myb_DNA-binding; Domain location=167 -217; Score=35.8; E_value=1.5e-07; Accession=PF00249.21; Description =Myb-like DNA-binding domain
MLAVSPLRSTRDEGGQGEILESVSIGTDDFADLSEGNLLESINFDDFFMGINDDGDVLPDLEMDPEMLAEFSLSTEDSEIASSSVSVANNNNDGNNIVTTTEKQDDEVIIIASNSSSDSGSSQGEEIVSKSDESEVVVNPSPKESEKGRKSSNHASRNNNQGKRKVKVDWTPELHRRFVQAVEQLGVDKAVPSRILEIMGIDCLTRHNIASHLQKYRSHRKHLLAREAEAARWSQRKQLLGAAGAGRGGGSKREVNPWLAPTMGFPPMSPMHHFRPLHVWGHHNMDQSFMHMWPKHPPYSPSPPAWPPRTAPSPPSPDPLYWHQHQLAPNAPTTGTPCFPQPLTTTRKYNENTQRFGSQTVPGIPPRHAMYQIVDPGIGIPASQPPPRPLVDFHPSKESIDAAISDVLSKPWLPLPLGLKAPALDGVMGELQRQGIPKIPPSCA

SEQ ID NO: 125795 - protein, 381 aa, Glycine max
  Coding DNA Sequence Number=SeqID_9017
  Gene Ontology: Mol. function=DNA binding; Biological process =regulation of transcription
  Homolog annotation: Hit_ID=Q5QMP4; Match level="QueryCoverage=67%, HitCoverage=86%, E-value=2e-84, Identity=57%"; Hit description=No apical meristem (NAM) protein-like
  Pfam annotation: Domain name=NAM; Domain location=150-291; Score =195.7; E_value=1.1e-55; Accession=PF02365.6; Description=No apical meristem (NAM) protein
MELWLAEKYFLLILLSFLVSLSPLFLVRARGRLGKTAILFSHAKESTKKTQPISLSLPRSILFRFLFHFFYSSIRGAYREEDIQKWNEGEIKEDNKEMTQCNYPQNSHSIIVERHKDSLIRTCPTCGLHVKCQEQFEFNDAAGIHDLPGLPAGVKFDPTDQEILEHLEAKVRSDIHKLHPLIDEFIPTLEGENGICCTHPEKLPGVSKDGLIRHFFHRPSKAYTTGTRKRRKVHTDADGSETRWHKTGKTRPVFISGKLKGYKKILVLYTNYRKQRKPEKTNWVMHQYHLGNNEEEKEGELVVSKVFYQTQPRQCGSLMKDLYPAKLSGEGVHEVTNHKNTGYVEYYNNSFVSYDQGDQHRSSTAQLVSHFPVHDGAPFIP

SEQ ID NO: 125796 - protein, 283 aa, Glycine max
  Coding DNA Sequence Number=SeqID_9018
  Gene Ontology: Mol. function=ligase activity
  Homolog annotation: Hit_ID=Q9FFH2; Match level="QueryCoverage=77%, HitCoverage=97%, E-value=2e-80, Identity=65%"; Hit description =Arabidopsis thaliana genomic DNA, chromosome 5, P1 clone:MLN1
  Pfam annotation: Domain name=Methyltransf_11; Domain location=129 -231; Score=-0.9; E_value=0.067; Accession=PF08241.2; Description =Methyltransferase domain
  Pfam annotation: Domain name=Methyltransf_12; Domain location=131 -229; Score=16.5; E_value=0.016; Accession=PF08242.2; Description =Methyltransferase domain
  Pfam module annotation: Pfam domain module=Methyltransf _11::Methyltransf_12; Domain location=129-231::131-229
MCGPSVYISGPIRVRPMNLNIPEPNSSLLAHNPKQTTIQHPPHLRCVLESKLHSPVRGRESMKFTDSPVIELAVNDAVLSLQQDNGSMHVGTTVWPCSLVLVKFAERWGPPSDNNPYARVLDFQGKRAVELGTGCGVAGMGLYLLGLTDLLLTDIAPVMPALKRNLKVNKPILRKALKHSVLYWNNPQQIAALNPPFDFVIATDVVYIPESVPSLVSAMETLVSDDGVVLLGYQLRAPEAHELFWELCQQVFHVEKVPHEHLHPDYAYEETDVYLLKKKNKKQ

SEQ ID NO: 125797 - protein, 492 aa, Glycine max
  Coding DNA Sequence Number=SeqID_9019
  Gene Ontology: Mol. function=nucleic acid binding; Cellular component= intracellular; Biological process=regulation of transcription
  Homolog annotation: Hit_ID=Q9FFH3; Match level="QueryCoverage=91%, HitCoverage=90%, E-value=1e-108, Identity=49%"; Hit description =Similarity to zinc finger protein ID1
  Pfam annotation: Domain name=RS4NT; Domain location=140-177; Score =14.0; E_value=0.044; Accession=PF08071.2; Description=RS4NT (NUC023) domain
  Pfam annotation: Domain name=zf-C2H2; Domain location=155-177; Score =21.6; E_value=0.0028; Accession=PF00096.16; Description=Zinc finger, C2H2 type
  Pfam annotation: Domain name=zf-C2H2; Domain location=182-203; Score =17.5; E_value=0.05; Accession=PF00096.16; Description=Zinc finger, C2H2 type
  Pfam annotation: Domain name=zf-C2H2; Domain location=79-101; Score =23.9; E_value=0.00056; Accession=PF00096.16; Description=Zinc finger, C2H2 type
  Pfam module annotation: Pfam domain module=RS4NT::zf-C2H2::zf -C2H2::zf-C2H2; Domain location=140-177::155-177::182-203::79-101
  Subcellular localization annotation: CTP_CleavageSite=26; ConfidenceScore=5.47e-01
MDDGEISNAFPHQNPSTAASNNQPPTLKRKRNLPGNPGNIFGFISFCLSTFSLLVIMIINPEAEVIVLSPKTLMATNRFVCEICLKGFQRDQNLQLHRRGHNLPWKLKQRTSKEVRKRVYVCPEKTCVHHHPSRALGDLTGIKKHFCRKHGEKKWKCEKCSKRYAVQSDWKAHSKTCGTREYKCDCGTIFSRRDSFITHRAFCDALAEETARVNAASNISNYSIMQNPLGPNMTTQFSSFFKPNSCSDQEPAPGNQTSNKGLSLWMTQTSQAHEAMANNNNLHEFHQLGSVTSPTAIYGTSGNPLASCSNPPPSNYQLNWVFGNKLSSNGSHQELTSTASLPLVNNIVKDNPNLQLISVPSLYSSQHQSHQASSANMSATALLQKAAQVGTTSSDPSSLFHGSIGLKCNSPGQDGNKFCGMYGSSSVLTTSHHGSEAENNNNNYSGDLSQIPPTKRRHVQNEESAWGQTRDFLGVGGANHLPPFINQRMDLI

SEQ ID NO: 125798 - protein, 142 aa, Glycine max
  Coding DNA Sequence Number=SeqID_9020
  Gene Ontology: Mol. function=protein disulfide oxidoreductase activity; Biological process=cell redox homeostasis
  Homolog annotation: Hit_ID=Q5QLR2; Match level="QueryCoverage=74%, HitCoverage=65%, E-value=3e-24, Identity=57%"; Hit description =Glutaredoxin-like
  Pfam annotation: Domain name=Glutaredoxin; Domain location=45-115; Score=43.4; E_value=7.9e-10; Accession=PF00462.14; Description =Glutaredoxin
MEQDKLGAVQINRYTKCKAEEEVLVSPKEKEGMKMVLNMVSENAVIVIARRGCCMSHVVKRLLLGLGVNPAVYEVEEKDEEGVATQLEATIRSDDGNTQQGKVQFPTVFIGGKLFGGLDRIMATHISGELVPILKKAGALWL

SEQ ID NO: 125799 - protein, 157 aa, Glycine max
  Coding DNA Sequence Number=SeqID_9021
MDNHSGISARQRDSKVSMTDLVSAEDDVNLRMSRGCRTRLTKGAEDEVSLYVLSGFSSYRQQKVYTDNHSGISARHRDSKDCRPRLTKGAEHDISLCVLSGFSSYRQQKVYTDNHSGFSARQRDSKVSMTDLVSAEDDVNLRVSTGLSAAIDEGRRR

SEQ ID NO: 125800 - protein, 203 aa, Glycine max
  Coding DNA Sequence Number=SeqID_9022
  Subcellular localization annotation: CTP_CleavageSite=75; ConfidenceScore=5.72e-01
MPCKKNLKQVLNHASKTNNNNNCCLFCHCGASSSASPTSTLFGMSHFSPPLSPSSSSSPPPSPLKPRNAVSPISRYSAVNVNPHHVVSYKDVFTELVNSLERLSFNEGSPVSGAKAPNFPWLDVSLNCEEQQQQQQNPFIVPSFGCEDQQQQNQFIFSPPSIQTPTNGKFCSNRFMGNDNNNKVVGGADVNGPDLAWVNELLM

SEQ ID NO: 125801 - protein, 161 aa, Glycine max
  Coding DNA Sequence Number=SeqID_9023
  Gene Ontology: Mol. function=nucleic acid binding; Cellular component= nucleus; Biological process=jasmonic acid mediated signaling pathway
  Homolog annotation: Hit_ID=Q1RY40; Match level="QueryCoverage=51%, HitCoverage=26%, E-value=1e-41, Identity=84%"; Hit description=Zinc finger, CCCH-type
MLPVKFSAGEVCVRKNTPFSCSSCHPYRPLSCTWKGAANIRTRHERIRMHHHGCTLHDDTPDRLFLSSGTAVGHGGVPFRPDVQKGSGKFPRLGMNSATLRHATRGCVASATGDSTDVATCNGVLAMQGGVAGQTSASPRVSGTAFAGEPAFAVQLKTPGP

SEQ ID NO: 125802 - protein, 215 aa, Glycine max
  Coding DNA Sequence Number=SeqID_9024
  Gene Ontology: Mol. function=transcriptional repressor activity; Cellular component=mitochondrion; Biological process=negative regulation of proteolysis
  Homolog annotation: Hit_ID=Q45Q23; Match level="QueryCoverage=97%, HitCoverage=77%, E-value=8e-81, Identity=70%"; Hit description=PHB2
  Pfam annotation: Domain name=Band_7; Domain location=37-210; Score =50.2; E_value=6.9e-12; Accession=PF01145.15; Description=SPFH domain Band 7 family
MNLKNMKVPNVRGGGGISALLKLGIVGGIGLYAAANSLYNVEGGHRAIVFNLVSKTSKIDMLFNVQVYPEGTHFIIPWFEKPVKIGLRVLTRPLPNQLPTVYRTLGENYNARVLPSIIHETLKAVVAQYNASQLITQREAVSREIRKILTERAANFNIALDDVSITSLTFGKEFTAAIEAKQVAAQEADRAKFVVEKAEQDKRSAVIRAQVTINF

SEQ ID NO: 125803 - protein, 233 aa, Glycine max
  Coding DNA Sequence Number=SeqID_9025
  Homolog annotation: Hit_ID=Q1S0F5; Match level="QueryCoverage=43%, HitCoverage=20%, E-value=5e-07, Identity=31%"; Hit description=IMP dehydrogenase/GMP reductase
MELGVRSFSKKFIEDKAQEYENKGEWMYFMSILDLLIYRVILFPSMIDQIDLAAVDAFLAYHYRRESPVVSIPSNVYYTLDLSWEKKSTRVVICCLPELYVWMVSCFVMLNAIQPLIARGSNKEDLGLHQQIRKVWDSPNRRDKELRKREEGVVGSYSQWLENRVREVKLLKKTNGEGVKIDVPIETEEVRKLKAELQKSMGTKEKLKGVVIRVRKECNRLRDISMSTTEALE

SEQ ID NO: 125804 - protein, 54 aa, Glycine max
  Coding DNA Sequence Number=SeqID_9026
MTKGVCTDNHLGISACHLTSWVRMTETVCMDNRLGISVCHLTSRVRMIEGTKDD

SEQ ID NO: 125805 - protein, 66 aa, Glycine max
  Coding DNA Sequence Number=SeqID_9027
MKAIAISTLLNCYYTPILMKEAFSLIAISGMQYGLAISSSGILKVVPKLTRSNGSCCVKCGKLIIV

SEQ ID NO: 125806 - protein, 153 aa, Glycine max
  Coding DNA Sequence Number=SeqID_9028
  Gene Ontology: Mol. function=nucleotide binding; Cellular component =intracellular; Biological process=small GTPase mediated signal transduction
  Homolog annotation: Hit_ID=Q40220; Match level="QueryCoverage=99%, HitCoverage=100%, E-value=7e-60, Identity=64%"; Hit description=Rac -like GTP-binding protein RAC2
  Pfam annotation: Domain name=Miro; Domain location=8-120; Score=20.0; E_value=6.3e-05; Accession=PF08477.3; Description=Miro-like protein
  Pfam annotation: Domain name=Ras; Domain location=8-136; Score=150.1; E_value=5.7e-42; Accession=PF00071.12; Description=Ras family
  Pfam module annotation: Pfam domain module=Miro::Ras; Domain location= 8-120::8-136
MSTARFIKCVTVGDGAVGKTCMLISYTSNTFPTDYVPTVFDNFSANVVIDGSTVNLGLWDTAGQEDYNRLRPLSYRGADVFLLAFSLLSRASYENISKKGEELKKEIGAAVYIECSSKTQQNVKAVFDAAIKVVLQPSKPKKKRKKNRTCVFL

SEQ ID NO: 125807 - protein, 303 aa, Glycine max
  Coding DNA Sequence Number=SeqID_9029
  Gene Ontology: Mol. function=transcription factor binding; Cellular component=intracellular; Biological process=regulation of transcription, DNA-dependent
  Homolog annotation: Hit_ID=Q9FJH0; Match level="QueryCoverage=69%, HitCoverage=95%, E-value=8e-89, Identity=80%"; Hit description=GTP -binding protein, ras-like
  Pfam annotation: Domain name=Arf; Domain location=2-171; Score=-65.8; E_value=0.00011; Accession=PF00025.11; Description=ADP-ribosylation factor family
  Pfam annotation: Domain name=MMR_HSR1; Domain location=11-126; Score =7.6; E_value=0.0002; Accession=PF01926.13; Description=GTPase of unknown function
  Pfam annotation: Domain name=Miro; Domain location=12-126; Score =77.4; E_value=4.6e-20; Accession=PF08477.3; Description=Miro-like protein
  Pfam annotation: Domain name=Ras; Domain location=12-173; Score =318.5; E_value=1.2e-92; Accession=PF00071.12; Description=Ras family
  Pfam module annotation: Pfam domain module=Arf::MMR_HSR1::Miro::Ras; Domain location=2-171::11-126::12-126::12-173
MGADEDYDYLFKLVLIGDSGVGKSNLLSRFTRNEFSLETKSTIGVEFATRSVPVDSKLVKAQIWDTAGQERYRAITSAYYRGAVGALIVYDVTRHVTFENVERWLKELRDHTEAYVVVMLVGNKADLRHLRAVSTEEATEYAEKENIYFMETSALESLNVGNAFVEVLTQIYNVVSRKTLETMDDDPNSKALPKGETIVIGTKDDDVSAGKSLSGLETTGTTDESGEPVPVRPRGRSEIASDPGSDRGWLCWIGLGGGGCGCGDKDAAMGFVGSGDGGVGDGGVGRRRRRRVVLVGFFVDVVE

SEQ ID NO: 125808 - protein, 184 aa, Glycine max
  Coding DNA Sequence Number=SeqID_9030
  Gene Ontology: Mol. function=cysteine-type endopeptidase activity; Cellular component=vacuole; Biological process=proteolysis
  Homolog annotation: Hit_ID=Q1SLA1; Match level="QueryCoverage=70%, HitCoverage=52%, E-value=1e-37, Identity=48%"; Hit description =Peptidase C1A, papain
  Pfam annotation: Domain name=Peptidase_C1; Domain location=77-184; Score=-91.8; E_value=4.4e-05; Accession=PF00112.13; Description =Papain family cysteine protease
MKTTITLSVPIINLLVLSNLWITASACPENSSDSEIRRKRYESWLKEYARKYGNKDQWEVHFEIYRTGFMYQKHGDLPKSIDWRRRGAVTHIKDQGHVGSCWAFSEVEGIKKIKTGKLVSLSEQQLIDCDRLGSFLILLSHCPLRRKPLVVPKIHLSSEPTSKPVNPTKDQQMKVKLSHIEVIN

SEQ ID NO: 125809 - protein, 52 aa, Glycine max
  Coding DNA Sequence Number=SeqID_9031
  Homolog annotation: Hit_ID=Q1SLA2; Match level="QueryCoverage=86%, HitCoverage=12%, E-value=2e-10, Identity=73%"; Hit description =Tetratricopeptide-like helical
MQMRGEHGSEELEGNQNVKSIGGQLVQGGRDGSFEGSCSRFCNEETERPERH

SEQ ID NO: 125810 - protein, 58 aa, Glycine max
  Coding DNA Sequence Number=SeqID_9032
MIPENYITIFGVPCAAQTTCEKIQALDVGRKGNKLQKLREENNSNAIGLSLADHRRIF

SEQ ID NO: 125811 - protein, 113 aa, Glycine max
  Coding DNA Sequence Number=SeqID_9033
  Homolog annotation: Hit_ID=Q1SLA2; Match level="QueryCoverage=99%, HitCoverage=34%, E-value=4e-40, Identity=72%"; Hit description =Tetratricopeptide-like helical
MGGAGCVPDSSSYGTVIGAMSRVRKTAKALDLMKQMVVQYGLTPDREHWEIWKAVEMIEFLEKEGNSVGFESYKLVIEGCFEKREYVLAAKAATGMTEKGFIYTIYQGQAENY

SEQ ID NO: 125812 - protein, 35 aa, Glycine max
  Coding DNA Sequence Number=SeqID_9034
MGKLPHPYTGVDVESKCVSGSDDIYTGMSVTFWLA

SEQ ID NO: 125813 - protein, 65 aa, Glycine max
  Coding DNA Sequence Number=SeqID_9035
MVVPSEIPCFFNSSKKMTHNKFYNMLKIDDEKSDVALAFSFCSCHTYACSEISIIYLLPISDNVN

SEQ ID NO: 125814 - protein, 225 aa, Glycine max
  Coding DNA Sequence Number=SeqID_9036
  Gene Ontology: Mol. function=RNA-directed DNA polymerase activity; Cellular component=membrane; Biological process=RNA-dependent DNA replication
  Homolog annotation: Hit_ID=Q1SRI1; Match level="QueryCoverage=94%, HitCoverage=33%, E-value=8e-31, Identity=34%"; Hit description=RNA -directed DNA polymerase
MIATAKSIKRLINAVLTALPIYFFSFFRVPQKIIEKLVNIQCRFLWGGGSEQKKIARVNWETVCLPKDKGGLGIKDQRMFNTALLGKWRWEIFQHNGELWTRILLSEYGGWRNLDGHRRSSYHSHWWKDLQLLNQQQQTIALKRQIEWRVGCGDKIKFWEDTWKVDDRPLMVKYASLYQISNQQQQTISLMGSHNDEGWEWNFSWRRNLFDNEATMAAEFMGLKG

SEQ ID NO: 125815 - protein, 121 aa, Glycine max
  Coding DNA Sequence Number=SeqID_9037
MEENAAHLFFNCSKTIPLWWESLSWVKTKAAFPHNPKEHFRQHTIGNAGGTKATRWKCWWVALTWTIWHHRNKTVFENQTFITSKVLDDALLLLWSWLRAMEKDFTLHYNQWSSQLRETFG

SEQ ID NO: 125816 - protein, 565 aa, Glycine max
  Coding DNA Sequence Number=SeqID_9038
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=P98205; Match level="QueryCoverage=89%, HitCoverage=49%, E-value=0.0, Identity=73%"; Hit description =Putative phospholipid-transporting ATPase 2
MIDCIPHPTTDDLISSMHLLVNIQAQDIHVGNIVWLRENDEVPCDLVLIGTSDPQGVCYIEGVIECPYPDKDIRRFDANMRLFPPFIDNDICPLTIKNTILQSCNETKMGMCRGIPEPKLTAMDAMIDKLTGAIFIFQIVVVLVLGIAGNVWKDTEAKKLWYVLYPHEGPWYELLVIPLRFELLCSIMIPISIKHYSQLFHLCQVSLDLVKSLYAKFIDWDHQMIDLETSIPSHATNTAISEDLGQVEYILTDKTGTLTENKMIFRRCCISGNFYGNENGDALKDVELLNAVSSGSSDVVRFLTVMAICNTVIPTQSKTGDILYKAQSQDEDALVHAAARLHMVYFNKSGNILEVKFNTSILQYEVLETLEFTSDRKRMSVVLKDCQNGKILLLSKGADEAILPYAHAGKQTRHFIEAVEQYAHLGLRTLCLAWRELKRDEYREWSLMFKEASSTLVDREWRVAEVCQRVEHDLEILGVTAIEDRLQDGVPETIKTLRKAGINFWMLTGDKQNTAIQIALSCNFISPGDSDLRHVAYCSFLVCMYVCHGESHLGRAAPYKDGSLP

SEQ ID NO: 125817 - protein, 216 aa, Glycine max
  Coding DNA Sequence Number=SeqID_9039
MLQFTCKSKLAGLAVIEDELGSFANLLHCQTMHLPFVYLGIPIAASPQSRNLASGHPKVQAKTLFVEAQELIHWMKDLSCQYESGACLEIFAKKFFVGEKEESRKIAWVLRSKYGEYNGKVREGHFMKGSKGWSGGTWGGVTKVRGQSHWFASKIKWLVGEGEELALPSDPASHEATLGSDSREQKKERKSIWSLWLYRNDIAFNNFNEGTDHGIG

SEQ ID NO: 125818 - protein, 369 aa, Glycine max
  Coding DNA Sequence Number=SeqID_9040
  Gene Ontology: Mol. function=phosphoprotein phosphatase activity; Cellular component=endoplasmic reticulum
  Homolog annotation: Hit_ID=Q1RY25; Match level="QueryCoverage=74%, HitCoverage=69%, E-value=3e-98, Identity=65%"; Hit description =Reticulon
  Pfam annotation: Domain name=Reticulon; Domain location=118-305; Score=-2.5; E_value=1.3e-06; Accession=PF02453.8; Description =Reticulon
  Subcellular localization annotation: CTP_CleavageSite=83; ConfidenceScore=5.79e-01
MDSSSHQQNPCLLITDKPTPTTRTSSPSSSSPVPSRNPHQITIPRRPSQHHAAAGVTGFRRGTTPLQNQSTPNGVPKEPSQIAAALRARDSRRKRFNLCGRESEEENGGDLDHVGQVVSDLIMWKDASKSTFWFGFCSLCLLSSCFTQGLNFSVFSALSQLGILLSGVSFFSNSICQRNEVEEKREIKLTEDDILRLAKLILPALNFAISRMRALFSGEPSMTLKVVPFLLLGAEYGHLITIRRLCAIGFVVSFSVPKLYSSYTVQINQRAEGLKSWLLDTWSACTHKKKVMASALMTFWNLSSIKTRIFTVFILLVLFRYLRQHVVLQLEDGEAKVGEKEQQKDSAMAEPEEKEPQQALVVKEQGRQN

SEQ ID NO: 125819 - protein, 537 aa, Glycine max
  Coding DNA Sequence Number=SeqID_9041
  Gene Ontology: Mol. function=transferase activity, transferring nitrogenous groups; Cellular component=cellular_component; Biological process=amino acid and derivative metabolic process
  Homolog annotation: Hit_ID=Q6K2Y8; Match level="QueryCoverage=99%, HitCoverage=82%, E-value=3e-87, Identity=55%"; Hit description =Putative nicotianamine aminotransferase A
  Pfam annotation: Domain name=Aminotran_1_2; Domain location=4-526; Score=119.3; E_value=1.1e-32; Accession=PF00155.11; Description =Aminotransferase class I and II
  Pfam annotation: Domain name=Beta_elim_lyase; Domain location=34-242; Score=-112.0; E_value=0.0036; Accession=PF01212.11; Description=Beta -eliminating lyase
  Pfam module annotation: Pfam domain module=Aminotran_1_2::Beta_elim _lyase; Domain location=4-526::34-242
PTDNPLFRTTTVAVDAITRAVHSFNFNCYPPTVGLPEAKRAVADHLTSNLPHKIISPENVFLTIGGTQAIDIILPSLARPGANILLPKPGYPHYELRATRCLLEIRHFDLLPERGWEVDLDSLEALADENTVAIVFISPSSPCGNVFTYEHLKRVAEIASKLGIFVISDEVYAHVTFGSKPFVPMREFSSIVPVITIGSFSKRWFIPGWRIGWIALCDPQGIFQKTGIVTKIIDNLEITSDPTTIVQGVCYFTTKRLPEKRVPPERDTWLDWTGRCDRGGRACLSGATSRAYLPGATSSGRAPGATTSGSLTGTSTSAELKRVKALYTGKYIALQICDDEDVETMIQSFEQQQEMPVIELCVEVDVAGNKDVSGAPPLVEVPARLPLVVVPGALPLLVAPGSQATCRVLVERAPQASIPGILEKTTDDFHSNNLNILREAANIFYDGCKEIPCLTCPHKPEGAMVVMVEINFSQLEGIVDDVQFCTKLAKEESVILFPGVAVGLKNWVRVSLAVDLSDLKDGLSRIREFSLRHAKMS

SEQ ID NO: 125820 - protein, 357 aa, Glycine max
  Coding DNA Sequence Number=SeqID_9042
  Gene Ontology: Mol. function=transferase activity, transferring nitrogenous groups; Cellular component=cellular_component; Biological process=amino acid and derivative metabolic process
  Homolog annotation: Hit_ID=Q6K2Y8; Match level="QueryCoverage=87%, HitCoverage=76%, E-value=6e-90, Identity=47%"; Hit description =Putative nicotianamine aminotransferase A
  Pfam annotation: Domain name=Aminotran_1_2; Domain location=5-340; Score=52.9; E_value=1.1e-12; Accession=PF00155.11; Description =Aminotransferase class I and II
MENGSEKWNFQGNKKLNASSISVRGAYNMLMERVNNSRDKKPLVLSAIANYLSSDLPYQLSPENVFLTIGGTQAIDIILPVLARPGANILLPRPGYPQYDSRASCCLLEVDLDSLEVLADENSVATVLINSSNPCGSVAEISRKLGIFVISDEIYAPVTYGNNPFVPMGVFSSIVPVITIGSLSKRWLVPGWRTGWIATCDPHGIFQKTGVVKKIISYLEITIDPPTFLQAAIPEILGKTKDEFLSKNLNILRGAANIFYDLCKEILCLTCPHKPVGAMCVMVEINFSQIKDIVDEMDFCAKLAEEESVLLPGVTVGLKNWLRISFAVHTSNLVEGLNRIKAFCLIYAKMPRSYVSW

SEQ ID NO: 125821 - protein, 83 aa, Glycine max
  Coding DNA Sequence Number=SeqID_9043
  Pfam annotation: Domain name=RALF; Domain location=11-74; Score=6.9; E_value=0.0039; Accession=PF05498.2; Description=Rapid ALkalinization Factor (RALF)
MAIMSKVVMGLVLCVLLVSAVLVQDAEASMVGHGAMQRDTFPGCSKRHPSNVACHLPIANDYRRDCEPGQRCRHQEAPKVIAR

SEQ ID NO: 125822 - protein, 159 aa, Glycine max
  Coding DNA Sequence Number=SeqID_9044
  Gene Ontology: Mol. function=DNA binding
  Homolog annotation: Hit_ID=Q5JML8; Match level="QueryCoverage=88%, HitCoverage=87%, E-value=3e-33, Identity=57%"; Hit description=DNA -binding protein-related-like
  Subcellular localization annotation: CTP_CleavageSite=51; ConfidenceScore=5.63e-01
MATPTTTKRKPVFVKVDQLKPGTNGHTLTVKVVSSKPVKTVTTRGGRSSVLAARPSRIAECLVGDETGTIIFTARNEQDCALNDINVVNSNIRLGQVDHMNAGATVILRNAKIDMFKGSMRLAVDKWGRIEPTDPAKFEVKEDNNLSLVEYELVNVVEE

SEQ ID NO: 125823 - protein, 146 aa, Glycine max
  Coding DNA Sequence Number=SeqID_9045
  Subcellular localization annotation: CTP_CleavageSite=87; ConfidenceScore=5.15e-01
MQGFSVVEPYTSSESVEPSLTLKFSDNEMASTAGAAARSIFRSCSSRRAAFRLGSEAKAARSPFRVASNQPLSQSTLRCPVELSFCVESMLPYHTATASALMTSMLSVSRHSYGWLPEGIVCAPTALQREDYLKIKKQGWDDMDLF

SEQ ID NO: 125824 - protein, 298 aa, Glycine max
  Coding DNA Sequence Number=SeqID_9046
MASFWNQLSFFLLLVLVISPQIQAREGKLFSLFSHFRTIYNVKDPLDKTNAESPALPPGPTPKPASAPELEPESAPTPAPSAEQEIGSTIPSGPAPEPEFFDSGEGYGLYGRGSYSQYPPTKETPTTTTTFQNELLNEDFNDESYKTGYPKTNLYNNNNEEYKNNDNTKEEYRNSYIGGYSDDFNRYSNNNNNNNNGKENYNNNYNGKENYYNNNDNYISNGYEEKREGMSDTRFLENGKYYYHVNSVKENYNLNGYESGRGSANENEGNYYEKSQYPNEFDTMEEYEKQQEEQGYTP

SEQ ID NO: 125825 - protein, 54 aa, Glycine max
  Coding DNA Sequence Number=SeqID_9047
MTYGFNEYDDDHTLNARFALSAPLGFFVDLLRARLGLAVERGVVLVKLRNSNHS

SEQ ID NO: 125826 - protein, 145 aa, Glycine max
  Coding DNA Sequence Number=SeqID_9048
  Gene Ontology: Mol. function=RNA-directed DNA polymerase activity; Cellular component=signal recognition particle, endoplasmic reticulum targeting; Biological process=RNA-dependent DNA replication
MIHRDPLVEYWNDLKSSLRKRYILSYYERELMDKLQSLRQGSMSVEEYRLQMEEERTSIARFLSGLNMEVRDKIELLPYRDLDELVQFCITGEQQLKRKPSSKSYGFRSYPRTDQAQGILGVAPSKHKEEKGKTIEKSTPKTSSQ

SEQ ID NO: 125827 - protein, 147 aa, Glycine max
  Coding DNA Sequence Number=SeqID_9049
GPHLTVKSTLENGGINRENNKDHISQSRGSALDGEETHWRMEESIGKITKITFPSQEGLLLTGPHLTVKNTLENGGFNRENNKDHISQSRGSALDGEEHMNSARQLIHGAPNKRREWRIALGNHYAWLQTRWWRNHERQSIHGAPKK

SEQ ID NO: 125828 - protein, 314 aa, Glycine max
  Coding DNA Sequence Number=SeqID_9050
  Gene Ontology: Mol. function=pyridoxal phosphate binding; Cellular component=cytosol; Biological process=amino acid metabolic process
  Homolog annotation: Hit_ID=Q74VQ6; Match level="QueryCoverage=88%, HitCoverage=87%, E-value=1e-113, Identity=77%"; Hit description=L -allo-threonine aldolase
  Subcellular localization annotation: CTP_CleavageSite=80; ConfidenceScore=5.02e-01
MAARCLALGAHAVVVGGAITRPQQITRRFVEAIGGRMRVSGPLLISTSRSRIHGPNLAASAGGWRRYSTLPRDVMFQRVEAGRRQDAGLTQPAAGHLAPAQRALNEGLAAAQQRSDRRAQPFRQANGEGVAVLHDLFQRQVQRHGGVEDARAVDMQRQLPLAGKPPRLLQVGLRQDSAADGVFQAQQPGAGEVDIVGFDGGGELVQRQRAVRVGLDRLRLDAAQHRCAAGLVFIVVRLLADQILVAALAVAQQRHQVGLGAAGQKQRRLFARQAHRLGLQRVDRRVIAVDVVADLCLSHRLAHGGAGAGDGVAA

SEQ ID NO: 125829 - protein, 97 aa, Glycine max
  Coding DNA Sequence Number=SeqID_9051
MKIKKRTKERKEGFPIKDRKEVKRGKEATLDQRKEENRKSPNPDCHSESFLTGNIPPHMNKEEKTETPSFLSKNADLEKILLISPMFPLRVCLKARS

SEQ ID NO: 125830 - protein, 127 aa, Glycine max
  Coding DNA Sequence Number=SeqID_9052
  Homolog annotation: Hit_ID=Q64EX4; Match level="QueryCoverage=58%, HitCoverage=17%, E-value=1e-20, Identity=54%"; Hit description=MtN19- like protein
MVNMEFISNAMILSFSILLLLPSTSYSLYQKPENHIKTAIFVTGSFEMGPGSIATKTFENIKFPKGHVGIKSFDAELVDQEGNSIPSYETYLHHWFAIKYHQNITMSPNPKLRRPEDAFFQKKRRHM

SEQ ID NO: 125831 - protein, 56 aa, Glycine max
  Coding DNA Sequence Number=SeqID_9053
MVEESFIKSVIKHTFATSSSLEELEDVDALSSKAMFRESFVFSSFEKFSKLLHHQA

SEQ ID NO: 125832 - protein, 107 aa, Glycine max
  Coding DNA Sequence Number=SeqID_9054
KLGRIDGDPVLRETRIWATWEYVSSVGGGQQGMVVVPGDMSRGSGDLGDVRRAPGSQQIKGTKTTKQGGLCGGWPAMNLIDMLKNEDMRLRWSLVIDYQGGVIDYQA

SEQ ID NO: 125833 - protein, 64 aa, Glycine max
  Coding DNA Sequence Number=SeqID_9055
MECLEGAWETLEGNTRFRFRGMIRFTATSLVHPDELGCMLQRTVEWILPTPTPYRLVEPVQVIE

SEQ ID NO: 125834 - protein, 180 aa, Glycine max
  Coding DNA Sequence Number=SeqID_9056
MASRKRKSATSRPQAQYDTKRFQSLEAWNRYTDNILDWRILPEKNVKIYHTEFDEFKAEMERRNLHKRLANLQDGSIDVAVVKEFYANLYSPEDQTPKQVRVRRHLIKIDADSLNTFLETPVVLEEGETQPTYSRFTRMRIDPQEFSTCLYIPGRGLVLNVEGHPWKLLRKDLTTLAQTW

SEQ ID NO: 125835 - protein, 109 aa, Glycine max
  Coding DNA Sequence Number=SeqID_9057
  Gene Ontology: Mol. function=RNA-directed DNA polymerase activity
MKSKSIDWGPKPFKVFDGWLKNKDYQKVVRDCWAHNQPLGWGGFALKCKLKTLKQWLKIWSKDNAGDLCNKVKQLQQNLNDLENSMPPQPSNQQVQELKEIQAGSMGKG

SEQ ID NO: 125836 - protein, 87 aa, Glycine max
  Coding DNA Sequence Number=SeqID_9058
MNCVFVHVSSTFEFGAMRSDCLVQFSVLNLFRSPENWVFVHLSSTFEFRAMGNDWLGQFFILNPFSEPRELCFRSCVFHLRIWSHAQ

SEQ ID NO: 125837 - protein, 115 aa, Glycine max
  Coding DNA Sequence Number=SeqID_9059
MGKVEEVQEQMKADMEAMKEKMASIMEAMMSMKKIMEANAVAVAATRVVAKTKIWEVQTPPYYVQIQNEHAFPPYGLPPNYTPPNVAYTPNENVDNSTPIPIESQQPQNVHAHVS

SEQ ID NO: 125838 - protein, 154 aa, Glycine max
  Coding DNA Sequence Number=SeqID_9060
MAEMGKLDHLEERLRAIEGGEDYDFAKLEELFLVPNIITPPKFKVLDFDKYKGTTCPKNHLKMYCQKMGAYAKDEELLIHSFQESLTGVAVTWYTNLEPSRVHSRKDLMVAFVRQCLNNSDMALDRIQLQNMCKKGHESFKEYAQRWRDLAAPS

SEQ ID NO: 125839 - protein, 69 aa, Glycine max
  Coding DNA Sequence Number=SeqID_9061
MQGYLMVTRTFRQPGANEPVDAQRLTLSPAPFVILTREVRDSESGGRRRYLMVIRGFRQPRGTNSTVSG

SEQ ID NO: 125840 - protein, 110 aa, Glycine max
  Coding DNA Sequence Number=SeqID_9062
  Homolog annotation: Hit_ID=Q1SKD7; Match level="QueryCoverage=97%, HitCoverage=27%, E-value=8e-08, Identity=30%"; Hit description =Ankyrin
MAPKKLSAKRSRRDAAAEGTSAAPEFDSHRFRSAEHQQCFKAIMGWSFHRERCVQLRDDEYMNFQEEIAHRHWTSLVTPMAKFDPDIVLGFYANAWPTEEGVRDMRSWVR

SEQ ID NO: 125841 - protein, 47 aa, Glycine max
  Coding DNA Sequence Number=SeqID_9063
MSTSSHRLGGSSPESYSLHPATVILLPRTSSPPIGDQPGSPKVFPTR

SEQ ID NO: 125842 - protein, 127 aa, Glycine max
  Coding DNA Sequence Number=SeqID_9064
MVGMLNCLDVVEAWRDLWGPGVERNEDKGYVGVRELSEGGQLGMVGLCVICGCGELTCTIAQPPPSTTCDGRAPGSQPIKEQRPQSKEACVVAGQLWILSNIWSMASGNRLPRVGNRLQGLKMKAGS

SEQ ID NO: 125843 - protein, 54 aa, Glycine max
  Coding DNA Sequence Number=SeqID_9065
MAAELGQHTVELSTLVTRAANDKSSDLLASLTYRQTYGSSQSVLLAQSRNIEIS

SEQ ID NO: 125844 - protein, 231 aa, Glycine max
  Coding DNA Sequence Number=SeqID_9066
  Gene Ontology: Mol. function=helicase activity; Cellular component =membrane; Biological process=protein amino acid phosphorylation
  Homolog annotation: Hit_ID=Q9LTU4; Match level="QueryCoverage=98%, HitCoverage=15%, E-value=4e-65, Identity=55%"; Hit description =Helicase-like protein
  Pfam annotation: Domain name=DUF889; Domain location=146-231; Score= -63.1; E_value=3.2e-07; Accession=PF05970.5; Description=Eukaryotic protein of unknown function (DUF889)
MPTDQQAKIYNQIIQAVNKNEGGMFFLYGYGGTGKTFIWKTLAASLRADNKIVIMDASSGIVSLLLPGGRTTHSKLKIHVPIFEDSTCNIHQGTQLTELLNEASLIIWDEAPMAYKFCFEALDQSLRDVIKAKSSSDKIFGGKVMIFGGDFRQILPVIPRGSRSDIVNATINSSYLWNHCHVLALSKNMRLEANIDATDREETLAFAQWILNIGDGIVGQQNDGYGSIEIP

SEQ ID NO: 125845 - protein, 115 aa, Glycine max
  Coding DNA Sequence Number=SeqID_9067
  Gene Ontology: Mol. function=methyltransferase activity; Biological process=metabolic process
  Homolog annotation: Hit_ID=Q338C6; Match level="QueryCoverage=96%, HitCoverage=25%, E-value=5e-23, Identity=50%"; Hit description =Expressed protein
MQAKLCVSENILVVPIPGPCALVSALSASGLPTDEFTFGNKLAKLNFVHYGILEPKMGVVTYNFVVGFLPKHSGSRRKRLMVSADQTTTQIFYVPPHKLSQFLDESSSIFGDARY

SEQ ID NO: 125846 - protein, 221 aa, Glycine max
  Coding DNA Sequence Number=SeqID_9068
  Homolog annotation: Hit_ID=Q6CQF3; Match level="QueryCoverage=25%, HitCoverage=59%, E-value=2e-08, Identity=72%"; Hit description =Kluyveromyces lactis strain NRRL Y-1140 chromosome D of strain NRRL Y- 1140 of Kluyveromyces lactis
MAARALGVPRHLRAPGGGVWAPHSARLETRTKESDMCASQRASKPVRRKEADWWDPPHTCRDPKDGELCLSGAKPEGNSGGERLIEPSSSWFPPKFSLRIAGARGASSIGPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGYGSAG

SEQ ID NO: 125847 - protein, 191 aa, Glycine max
  Coding DNA Sequence Number=SeqID_9069
  Gene Ontology: Mol. function=transcription factor activity; Biological process=regulation of transcription, DNA-dependent
  Homolog annotation: Hit_ID=Q48LH7; Match level="QueryCoverage=96%, HitCoverage=61%, E-value=7e-44, Identity=45%"; Hit description =Transcriptional regulator, LysR family
  Pfam annotation: Domain name=LysR_substrate; Domain location=1-189; Score=97.7; E_value=3.4e-26; Accession=PF03466.10; Description=LysR substrate binding domain
MPLLIPFCQQHPDVELSLTFSDRFIDLFDEGIDVAVRIGGSPDLPASLGYRPMGRERMVFCAAPDYLARAGRPTSESELLQHRAILYERVDGSTKPWLFTTEDGHPHWRQVPSRMALGDVDAQMQALCAGLGVAQMPSWLVRDALASGALEVIVPQQQPDGLPLSVIWPRRKQLLPKVDALLAALDGLQIR

SEQ ID NO: 125848 - protein, 177 aa, Glycine max
  Coding DNA Sequence Number=SeqID_9070
  Gene Ontology: Mol. function=transporter activity; Cellular component= integral to membrane; Biological process=transport
  Homolog annotation: Hit_ID=Q4IS91; Match level="QueryCoverage=99%, HitCoverage=96%, E-value=3e-44, Identity=58%"; Hit description =Binding-protein-dependent transport systems inner membrane component
MAGVAGYAADGRRVVAAGTADRFTDGGDSGGDRARRSVPQSAAQPAAGLAGEPVPLNPVFDSDGGADPVYPLDCRHYLRRLGGRGAADAGGDAVFCPHRGEARPGIVSGFTITLVTMINASAMAGAIGAGGLGDLAYRYGYQRFDMQVMLTVIVVLVALVTLLQLCGDRLSRRLNHR

SEQ ID NO: 125849 - protein, 92 aa, Glycine max
  Coding DNA Sequence Number=SeqID_9071
STLEDPTEDTPVSPRVALPQKGRLRQLATPLGIVFVRALYPGSWKSKEWRRIYGHARKLGEKLATQLAQASRVASSRSNSLLEESSGGPKWA

SEQ ID NO: 125850 - protein, 111 aa, Glycine max
  Coding DNA Sequence Number=SeqID_9072
  Gene Ontology: Mol. function=phospholipase C activity; Cellular component=membrane; Biological process=intracellular signaling cascade
  Homolog annotation: Hit_ID=Q1SH97; Match level="QueryCoverage=99%, HitCoverage=27%, E-value=3e-27, Identity=54%"; Hit description =Phosphatidylinositol-specific phospholipase C, X region
MPKSSDDCPSMDDMAQWNQHLVIFTSKSSKEHSEGIADKWKYVVESQYGHDGMKGGSCPNHGESSIMNTKSRSLVLMNHFLTSANASFACANNSTPLVSMLKTCHDAANDQ

SEQ ID NO: 125851 - protein, 451 aa, Glycine max
  Coding DNA Sequence Number=SeqID_9073
  Gene Ontology: Mol. function=serine-type endopeptidase activity; Biological process=proteolysis
  Homolog annotation: Hit_ID=Q5LB17; Match level="QueryCoverage=96%, HitCoverage=65%, E-value=3e-53, Identity=30%"; Hit description =Putative exported protein
MKQKDEFNAKDLYVRFLVRMDDASQRINAKLNNKMTGEERKAVIDAETKAIQAENSENGKYTVVVKDFFNGNEFYYFVYQDYKDIRLVGAPPSSLGKFGGDTDNWEWPRHTADFTVFRVYADAAGNPAEYSPSNTPLKPKHFLPVSLKGIKPGDFSMILGYPGRTNRYLTSYGIQQMVNKDYPAWVEASKLAMDVMKKYMDKDKATQLNYASQYASVANYWKNRQGTIDAVIKNGTITDKQKTEANFKQWALQPANIEYDGVLDDISIYYKQVSNRNVERNYATQLYRNAKYISLASQVGSVLKSYAEQDMAGRLAMKPKVEAAVKAAYENFNTKLEGEMLNSMVGLYQSRVDKDVASPTIMALDSKNLSNVAYSSIFANKTSVTNFILNPDRLKLDADPLLKIANGVTTDQSWFNESMPEKKFYPDANSTMRLTYGTVDKLPIRTDRTTS

SEQ ID NO: 125852 - protein, 195 aa, Glycine max
  Coding DNA Sequence Number=SeqID_9074
  Gene Ontology: Mol. function=DNA-directed DNA polymerase activity; Cellular component=extrachromosomal circular DNA; Biological process= DNA replication initiation
  Homolog annotation: Hit_ID=Q46775; Match level="QueryCoverage=99%, HitCoverage=63%, E-value=6e-84, Identity=80%"; Hit description=RepI
  Pfam annotation: Domain name=Rep_3; Domain location=1-194; Score =53.5; E_value=7.2e-13; Accession=PF01051.12; Description=Initiator Replication protein
MDNDFKTWVGIIHSFAKHKDKVIGDKVQLSFVEFAKLCGIPSSRSSKQLRERISPSLKRIASTTISFSSKSGDDAKEYITHLVQSAFYDTKKDIVILQADPKLFELYEFDHKVLLQLKAINALKRRESAQALYTYIESLPKNPAPISLARLRERLNLRSPVFSQNQTVRRAMEQLKEIGYLDYSEVQKGRSVYFQ

SEQ ID NO: 125853 - protein, 73 aa, Glycine max
  Coding DNA Sequence Number=SeqID_9075
  Gene Ontology: Mol. function=transcription factor activity; Cellular component=nucleus; Biological process=regulation of transcription, DNA-dependent
  Homolog annotation: Hit_ID=Q1SDP0; Match level="QueryCoverage=91%, HitCoverage=15%, E-value=4e-15, Identity=60%"; Hit description =Pathogenesis-related transcriptional factor and ERF
KQKLWGIGFMDFVGKMAVDGKVAEIENPDDAAVENGGTGVALTWPFVCHAQFGTPFEGSMPILSALSCQIFQQ

SEQ ID NO: 125854 - protein, 81 aa, Glycine max
  Coding DNA Sequence Number=SeqID_9076
MHENEWHGACLLFAPIWEPIGQYLGVSNNYSPTIHNSHGCFLEEKPKETGQNENLSSGVVFTLEEGISTSHVCLKGQQPIL

SEQ ID NO: 125855 - protein, 768 aa, Glycine max
  Coding DNA Sequence Number=SeqID_9077
  Gene Ontology: Mol. function=sugar porter activity; Biological process=transport
  Homolog annotation: Hit_ID=Q13UM5; Match level="QueryCoverage=50%, HitCoverage=87%, E-value=1e-125, Identity=53%"; Hit description=ABC sugar transporter, periplasmic ligand binding protein
  Pfam annotation: Domain name=DinI; Domain location=706-768; Score =67.0; E_value=5.9e-17; Accession=PF06183.3; Description=DinI-like family
  Pfam annotation: Domain name=MCPsignal; Domain location=1-168; Score =143.5; E_value=5.6e-40; Accession=PF00015.11; Description=Methyl -accepting chemotaxis protein (MCP) signaling domain
  Pfam annotation: Domain name=SBP_bac_1; Domain location=156-466; Score=128.1; E_value=2.5e-35; Accession=PF01547.15; Description =Bacterial extracellular solute-binding protein
  Pfam module annotation: Pfam domain module=DinI::MCPsignal::SBP_bac _1; Domain location=706-768::1-168::156-466
MEEIESSSKRIADINRVIDEIAFQTNLLALNAAVEAARAGEQGRGFAVVASEVRQLAQRSAGAAQEIKALIDASVGKVEAGSALVQRSGEMLNDINHGVARMVDIVGEIAVASRQQSSGIEQVNTAVIQMDGATQQNASLVQQANAASQTVSQHAGLLAATTLNIATIANGDMTIMQQLSSRYEQQHPDVKLQWHVMDDGALRQAVLAAMNSGDAKFDVITVGTYEAPLWGKKGWLAPLNNLPPEYDSDDLLTPVRKALSWQQTLYALPFYGESSMTYYRKDLFAAKGLTMPDDPDWTDIKNFAAKLTDPQHGIYGLCLRGQPGWGDNVALLTTMANAYGAQWFDDRWQPTLNSPEWREVLTDYLAMVKQDGPPDTASNSFGQILRLTAQGKCAMWIDSTVAAGLLINPQISLVADKLAFAPAPGGITRNGSHWLWSWALAVPANSPQRAAAVDFISWATSRQYIQQVADTVGWGAVPPGSRNSTYQQPNYQRLAPYAAQVRSAIESATVDQPTLNTVPYTGVQYVSIAGFDQMGNAVGQNLAALLQGKLTVDQTLEKNQQDVTRLQVAQQNPRMKTPEEYYAQARSLFFTAHPDFQSALDELSESDARAANMSLRELRAWHAERIYAAFLRQKKLDGMLFSIQLAEPDKAVAAQAIETYLKSHAEALGMTWEEFCIKNECYCTASGGVAGFPPPELIYDKRNVAGLPGAREMILQELEKRVQRVFPDLEVRVKPMERNAIKTDMSKNDKATIARIVEEMFDEAEMWL

SEQ ID NO: 125856 - protein, 181 aa, Glycine max
  Coding DNA Sequence Number=SeqID_9078
  Gene Ontology: Mol. function=structural molecule activity; Cellular component=flagellin-based flagellum; Biological process=ciliary or flagellar motility
  Homolog annotation: Hit_ID=Q56912; Match level="QueryCoverage=56%, HitCoverage=28%, E-value=6e-26, Identity=65%"; Hit description =Thermoregulated motility protein
  Pfam annotation: Domain name=Flagellin_C; Domain location=73-144; Score=133.0; E_value=8e-37; Accession=PF00700.11; Description =Bacterial flagellin C-terminus
FQVGSKDAEQISISIGASKGWDLYQANATANASNGGTYTAAATLKDNTGTAGNRKVDANGFDVLTATVKDANGAVTDGALTRIDTAIKAVDNQRSLLGASQNRFESTITNLNNTVNNLSAARSRIQDSDYATEVSNMSRAQILQQAGSSVLAQANQEIAEISGCFRNDAIDYNYGKGKHPP

SEQ ID NO: 125857 - protein, 183 aa, Glycine max
  Coding DNA Sequence Number=SeqID_9079
MDQKLKNGENMVFLLRIKNNDNAKSESKVPIGERRVKGRWGIPQLDNPIHSNRQEWFCIKLNLSLPFLVLILNHLSLSRSHSHYHSSFTLSLISLALVLALTYLHTILALAIISDFHSHSRALVLAITLVLSFSLSLTALLTLDAILPRKGPITRTMSKRLQEDWARAAEEGPRVLMNLRVDF

SEQ ID NO: 125858 - protein, 100 aa, Glycine max
  Coding DNA Sequence Number=SeqID_9080
KKEGVETRIIITERAGWTKSVSYLCFPLISDERYLAPFVAQYVKSRDVPKIKRKQAYAIRENSVMEKGFSLLGTSYSLEIAEENYFREENPSRGASVTFP

SEQ ID NO: 125859 - protein, 107 aa, Glycine max
  Coding DNA Sequence Number=SeqID_9081
KHKGYVSGSLSDEGKVGLGGDSGKSESSLEKGLVDRSDALDVDAKVDNMARCFRTNQRILVRKGNKDELGKTIGREQEEPPKFSNWPNEREVRWKGFGESHELIWKM

SEQ ID NO: 125860 - protein, 95 aa, Glycine max
  Coding DNA Sequence Number=SeqID_9082
MATKKNDKKKKGIALKASSSIHEENDKEDLKENNLEEDDDFSLFVKRFNKFLRNKGNQRRSNFHPKRKGEDSSLVPKYYVRDQPGYLRVDCPIYK

SEQ ID NO: 125861 - protein, 418 aa, Glycine max
  Coding DNA Sequence Number=SeqID_9083
  Gene Ontology: Mol. function=oxidoreductase activity; Cellular component=periplasmic space; Biological process=electron transport
  Homolog annotation: Hit_ID=Q1H2D9; Match level="QueryCoverage=88%, HitCoverage=80%, E-value=1e-152, Identity=68%"; Hit description=Twin- arginine translocation pathway signal
  Pfam annotation: Domain name=Cu-oxidase_2; Domain location=128-249; Score=92.9; E_value=9.7e-25; Accession=PF07731.4; Description =Multicopper oxidase
  Pfam annotation: Domain name=Cu-oxidase_3; Domain location=1-106; Score=158.8; E_value=1.4e-44; Accession=PF07732.5; Description =Multicopper oxidase
  Pfam module annotation: Pfam domain module=Cu-oxidase_2::Cu-oxidase _3; Domain location=128-249::1-106
MRANLWGYNGQSPGPTIEVVEGDRVRIFVTNRLPERTSVHWHGQRVPNGMDGVSGLTQPAIEPGKTFVYEFEARRPGTFMYHPHADEMMQMAMGMMGSWITHPKNPKFMPVDRDFVFLLNAYDIEPGSFTPKVNTMLDFNLWTFNSRAFPGIDPIVVRKDDRVRVRIGNLTMTNHPIHLHGHEFEVTGTDGGWVPKTARWPEVTSDIAVGQMRAIEFVGNELGDWAFHCHKSHHTMNAMGHSFPTMIGVKQGDLMKKITNLVPDYMPMGETGMSEMTDMSQMMDMPLPKNTLPMMMGNGQYGPLEMGGMFTTVKVRDGLARNDYKNPGDYNHPSGTVAHAVEIDLTKVERQNPHVESTVEVNVRKPINHSGMLPHVDGQQCGITSGQRCASSAGVDDIDRAIGFFHQPGPARTKVTNG

SEQ ID NO: 125862 - protein, 140 aa, Glycine max
  Coding DNA Sequence Number=SeqID_9084
  Homolog annotation: Hit_ID=O82275; Match level="QueryCoverage=23%, HitCoverage=44%, E-value=6e-08, Identity=72%"; Hit description =Expressed protein
MSESMHTCGWRWEPPCPTARTTKIVSLEGGAARVCMVARSTWTRTEDRWDLVDSAAVVVDIHMPLLLVHNSNSGVCVGVEEGSIACYGVVIRAIVEMQNGEYIASGGAVGLEKRRRWRQRQWGLEKLRWRMIYQKQQVFQ

SEQ ID NO: 125863 - protein, 38 aa, Glycine max
  Coding DNA Sequence Number=SeqID_9085
MSNTLPAHTHTDLSFIASSTCYCLSLRQCRHITKNVNR

SEQ ID NO: 125864 - protein, 50 aa, Glycine max
  Coding DNA Sequence Number=SeqID_9086
MDSVEGLDDDDDGLEKIMLEVFIPSGRLMLGAPSIIVGAPALKEKRLKYP

SEQ ID NO: 125865 - protein, 955 aa, Glycine max
  Coding DNA Sequence Number=SeqID_9087
  Gene Ontology: Mol. function=protein-tyrosine kinase activity; Cellular component=microtubule organizing center; Biological process= microtubule cytoskeleton organization and biogenesis
  Homolog annotation: Hit_ID=UPI00005DC1F3; Match level="QueryCoverage =99%, HitCoverage=92%, E-value=0.0, Identity=55%"; Hit description =EMB1427; tubulin binding
  Pfam annotation: Domain name=Spc97_Spc98; Domain location=2-811; Score=-98.4; E_value=4e-06; Accession=PF04130.4; Description=Spc97 Spc98 family
  Subcellular localization annotation: CTP_CleavageSite=45; ConfidenceScore=5.09e-01
ANSFRAKSGVYVSHLSQKSLHSLLNQFIHAATCLQLVAITLDKVETAMPKSPPTLNAFACSASACLERLRNIALKEETSTSNADGVTTPTLLGLANSLSSLCSGAEFLFQVVHEAIPAVYFEFGVSVPAAELAVHVLDYLHKKLDEVCLVQGGEEEAYQMVLYMYVGSLLPYIEGLDSWLFEGILDDPFGEMFFFTNKEVSVDEAEFWEKSYLLRRLQHSKLDSEFFSSTNYVNDSVPASNDKEMDRRDSISLSSTVKGKEPSIRDRPACPFFIKDLTKSIVSAGKSLQLMRHVPDCSVNCSKGSNYEIGNTKCLNYGLYPSQRMTGLTLPEVFSVSLVGLVGHGDHVCKYFWQDNWYESVSVSSNVSHVNEEKADNDNTEKLIAPPYSEKTWYKFLIDTLFQKRSADLKLKYKDINNDTRELRGARVIDDEVLLLRSYIENPVITVCQKNLGKHGDALKTLSLSRKFSLPSLNDEGLRKAIFGGESAAFSDSEGTNYTFGFHFGESEYLRSQDDRKLLEMLFPFPTILPSFQDDLPVSELLPFQRNSSLISRVLRWMQNVDLRITPLPLVIMQYCLTVYIQKQVDYIGVNMLLKLMNEWRFMDELAVLRAIYLLGSGLEWSYLGFSVFCVDILSCAGDLLQHFLTVIFNKLDKGEAWDDDFELNTILQESIRNSADCMLLSAPDSLVVSITKNRVDGDEEASTAGVLSTPRQSHANSFGINGLDMLKFTYKVPWPLELIANTEAIKKYNQVKRAKFVLDKVRRWMWKGKGSATNNRKHHWLVEQKLLHFVDAFHQYVMDRVYHSAWRELCEGMTAAKSLDEVIEVHEAYILSIQRQCFVVPDKLGALIASRINSILGIALDFYNIQQTLGSGGAVSAIKARCEMEVDRIEKQFDDCIAFLLRVLSFKLNVGHFPHLADLVTRINYNYFYMSANGNLMTASSSGSVTSRLGKAPG

SEQ ID NO: 125866 - protein, 209 aa, Glycine max
  Coding DNA Sequence Number=SeqID_9088
  Gene Ontology: Mol. function=electron carrier activity; Cellular component=membrane; Biological process=electron transport
  Homolog annotation: Hit_ID=Q69TG9; Match level="QueryCoverage=65%, HitCoverage=89%, E-value=9e-18, Identity=39%"; Hit description =Glycine-rich protein-like
  Pfam annotation: Domain name=Cu_bind_like; Domain location=37-133; Score=-21.2; E_value=0.011; Accession=PF02298.8; Description =Plastocyanin-like domain
MDATRILAQGVFVFLVITCVGAESEPRTILVGDSQGWQAGTNYTQWAIQNSPFHINDTLRAVFKYPGNSTTLAQSVYLLPNQWSYITCEFRGAKLLGNATEGDGEGFKVELNQLKPYYFASAEGNFYDCIAGLSKAALKYREVIVWECYLCIQHFLLGHPACRPSSSSSYSNGSLSSSSYGGSSSSSYGASSSSSSSYGASSSCHRSCS

SEQ ID NO: 125867 - protein, 136 aa, Glycine max
  Coding DNA Sequence Number=SeqID_9089
  Subcellular localization annotation: CTP_CleavageSite=2; ConfidenceScore=5.26e-01
MSCSTSRPLDVATSSSFNSTIQPLNFMRHFGNSEPPSTPKHKHSEPTPKPTETKPNPTLERRVQLTFNDYGERGRRICGVALQRGLKGKEEMWGHEREMSCCREGSGSRREQLREGGASWERRREVLGFGKEVQSH

SEQ ID NO: 125868 - protein, 67 aa, Glycine max
  Coding DNA Sequence Number=SeqID_9090
  Subcellular localization annotation: CTP_CleavageSite=29; ConfidenceScore=5.08e-01
MNIKGMTGTEGPGTLNPPSMRIRIFVSSTCVTVQSLQGPEFVAAPVLLLAIAARSKNLGNHCSKKTK

SEQ ID NO: 125869 - protein, 292 aa, Glycine max
  Coding DNA Sequence Number=SeqID_9091
  Gene Ontology: Mol. function=transporter activity; Cellular component= membrane; Biological process=oligopeptide transport
  Homolog annotation: Hit_ID=Q2HRU3; Match level="QueryCoverage=94%, HitCoverage=45%, E-value=7e-61, Identity=43%"; Hit description=TGF -beta receptor, type I/II extracellular region
  Pfam annotation: Domain name=PTR2; Domain location=88-292; Score= -64.9; E_value=0.0016; Accession=PF00854.12; Description=POT family
MGICRNMGTQPRVQRRLGGNRAALFVYAMEGLENMAFVANAVSLVTYFFGYMNFSLTKSATTLTNFLGTAFLLALVGGLISDTYLSRFKTCVLFACMELLGYGILTVQARFHQLRPIPCKDLAPTQMSQCEAATGGHAAILYTGLYLVALGTGGIKAALPALGADQFDEKDPKEAAQLSSFFNWFLFSLTIGAIIGVTFIVWIGVNLGWDWSFIVCTLTILFAIVFICMGNSLYRNNVPKGSPLIRIIQVFVAAFRNRKLPIPDNTDKLHEIHEKRGGDNFEILKRTDQFRL

SEQ ID NO: 125870 - protein, 55 aa, Glycine max
  Coding DNA Sequence Number=SeqID_9092
  Homolog annotation: Hit_ID=Q9FGQ4; Match level="QueryCoverage=92%, HitCoverage=30%, E-value=2e-07, Identity=52%"; Hit description =Arabidopsis thaliana genomic DNA, chromosome 3, TAC clone:K5K13
MRILVYDYLVDTAAFVQTRESINEFLTSVKQHDLAKAKVLSILNIGPAADFELYP

SEQ ID NO: 125871 - protein, 68 aa, Glycine max
  Coding DNA Sequence Number=SeqID_9093
MGHPTRSMHSTPHEHTLHTMYERGSKQVPKTMEGQCTSPPTNIHNIQRMNVAQSKCQRPWEVSALCPP

SEQ ID NO: 125872 - protein, 57 aa, Glycine max
  Coding DNA Sequence Number=SeqID_9094
MIQATGGNTQVVIRTNTFLLPRPVRSQAACGDAQWLFAPTHNSATPTYMFCYPSTIK

SEQ ID NO: 125873 - protein, 92 aa, Glycine max
  Coding DNA Sequence Number=SeqID_9095
MTSGDALRLSAPRHLETPSLIDKRRPMWSSVPFPKMSASSGQDSFGLTTSADPDPCVRWQADIPKYTQVIIRTKTTSADPNPCVRWQADMPK

SEQ ID NO: 125874 - protein, 93 aa, Glycine max
  Coding DNA Sequence Number=SeqID_9096
MGLYSPIGCPFPQQGIAPARHPVDPKKSNRFYGVPVAPKKIIRPPTNRAFIKKYCVPRQAQGETPQQPGDGRQWATDAPPSPLEFISAHPQKG

SEQ ID NO: 125875 - protein, 62 aa, Glycine max
  Coding DNA Sequence Number=SeqID_9097
MPTSPEGAQMTTLASARQSHLGSLNDEVRITVRCLRGLPALGSWAFAPTYPPMRNSDLRSSG

SEQ ID NO: 125876 - protein, 133 aa, Glycine max
  Coding DNA Sequence Number=SeqID_9098
  Homolog annotation: Hit_ID=Q6CQF3; Match level="QueryCoverage=42%, HitCoverage=59%, E-value=2e-08, Identity=72%"; Hit description =Kluyveromyces lactis strain NRRL Y-1140 chromosome D of strain NRRL Y- 1140 of Kluyveromyces lactis
RCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRVS

SEQ ID NO: 125877 - protein, 67 aa, Glycine max
  Coding DNA Sequence Number=SeqID_9099
MLCSRKNYVGLIFSSQLRNTCFPQINVGGNSARIPFLEDAPASHASPSRRRVGCDKCESILEVRYFL

SEQ ID NO: 125878 - protein, 102 aa, Glycine max
  Coding DNA Sequence Number=SeqID_9100
MKQKGKRKKDRKGRHVIVKKYKSFVKSKRIFWKQGTDAKSLFSGITEIRMDEFIKLMKEHNLETLGLIIIPSPKQRTAESPQGRANRMLKPDFPNKGMGKEK

SEQ ID NO: 125879 - protein, 283 aa, Glycine max
  Coding DNA Sequence Number=SeqID_9101
  Gene Ontology: Mol. function=hydrolase activity, acting on ester bonds; Cellular component=nucleus; Biological process=lipid metabolic process
  Homolog annotation: Hit_ID=Q10MG0; Match level="QueryCoverage=98%, HitCoverage=76%, E-value=2e-98, Identity=60%"; Hit description=GDSL -like Lipase/Acylhydrolase family protein, expressed
  Pfam annotation: Domain name=Lipase_GDSL; Domain location=3-262; Score=82.6; E_value=1.2e-21; Accession=PF00657.12; Description=GDSL -like LipaseAcylhydrolase
MGIGFTPPYLAPTTVGPVILKGVNYASGAGGILNLTGKLFGDRINFDAQLDNFANTRQDIISNIGVPTALNLFKRSIFSVAMGSNDFINNYLAPAVLIYEKNLASPELFVTTLVSRFREQLIRLFNLGARKIIVTNVGPIGCIPSQRDMNPTAGDGCVTFPNQLAQSFNIQLKGLIAELNSNQKGAMYEYADVYNILGDIHNNYEAYGFENPYSSCCSMAGRFGGLIPCGPTSIICWDRSKYVFWDPWHPTDAANVIIAKRLLDGENNDIFPMNVRQLIQYLT

SEQ ID NO: 125880 - protein, 129 aa, Glycine max
  Coding DNA Sequence Number=SeqID_9102
  Homolog annotation: Hit_ID=Q1S1X7; Match level="QueryCoverage=36%, HitCoverage=3%, E-value=8e-08, Identity=54%"; Hit description =Integrase, catalytic region; Zinc finger, CCHC-type; Peptidase aspartic, catalytic
MKEDTPLKEHLDELNSILMKLCDIDVKMEDKDLTMIQLVSLPSCYKNFGIKQGNLYILQRSTVTGFVFTISQFGSHVSNDSSDNFLWHLHLGHMSENVWIFRASKTYLKITRWNFFNFVSTISKGSNIK

SEQ ID NO: 125881 - protein, 201 aa, Glycine max
  Coding DNA Sequence Number=SeqID_9103
  Gene Ontology: Mol. function=hydrolase activity, acting on ester bonds; Biological process=lipid metabolic process
  Homolog annotation: Hit_ID=Q10MG0; Match level="QueryCoverage=89%, HitCoverage=49%, E-value=2e-58, Identity=60%"; Hit description=GDSL -like Lipase/Acylhydrolase family protein, expressed
  Pfam annotation: Domain name=Lipase_GDSL; Domain location=23-201; Score=17.4; E_value=6.7e-05; Accession=PF00657.12; Description=GDSL -like LipaseAcylhydrolase
MFRVFMVLLLFKIGLSNYVPASFVFGDSLLDVGNNNYIVSLAKANHDPYGIDFGMATGRFSNGRTVADVINQKLGLGFSPPYLAPTTTGSVVLKGVNYASGAGGILNNSGQIFGGRINFDAQIDNFANTREEIISLIGVPAALNLFKKALFTVALGSNDFLDNYLTPILSIPERVLVSPESFVATLVSRLRLQLTVILLKT

SEQ ID NO: 125882 - protein, 88 aa, Glycine max
  Coding DNA Sequence Number=SeqID_9104
  Subcellular localization annotation: CTP_CleavageSite=63; ConfidenceScore=5.03e-01
KPPYYLSHFDLPFLRSFWHLYSVCLWDKASLLGLTSGAARMPEAGGANEVRTRSRVQFSVTSRSKAIGNKATLLTEGHSGYSNHKEKE

SEQ ID NO: 125883 - protein, 64 aa, Glycine max
  Coding DNA Sequence Number=SeqID_9105
MSRVSPFMRRSAITALAASLGWHLQLAINLRGGIHHSVVMRVETEGREEGHKEGLGIESVGVMK

SEQ ID NO: 125884 - protein, 83 aa, Glycine max
  Coding DNA Sequence Number=SeqID_9106
  Gene Ontology: Mol. function=hydrolase activity, acting on ester bonds; Biological process=lipid metabolic process
  Homolog annotation: Hit_ID=Q10MG0; Match level="QueryCoverage=68%, HitCoverage=15%, E-value=3e-18, Identity=68%"; Hit description=GDSL -like Lipase/Acylhydrolase family protein, expressed
MDPTTQIDCQLQAVVVWFKCGDDGLGGFENPNSACCHLAGRFGGLIPCNRNSKVCEDRSKYVFWDTYHPSDAANAVIAERLIN

SEQ ID NO: 125885 - protein, 280 aa, Glycine max
  Coding DNA Sequence Number=SeqID_9107
  Gene Ontology: Mol. function=RNA-directed DNA polymerase activity; Cellular component=extracellular region; Biological process=RNA -dependent DNA replication
MCSFWKQQSMHWLKKGDMDTKYFHALASSQNKIKYIGWLEDEEGIYDPIIQKVAPKISYEDNVNLMRSFIREEFKEAIFQMQPDKDLVSDGFSPSFYQHFWSIYGEDVFLACQWIQQGEFPFSVNDINIVLIPKVDHPRGMKDFRPISLYNVVYKILAKVLTNRLSKVIDKCVSKEQYAFVLGRSIVDNALVASKIMHYFRNVIIVVLGVREGGGRGMSIFQIPQSTGDELQKESMGGGLALCQMFCGQEFLKPNTTQGGLYGSGFRAQSILYLVEHFLF

SEQ ID NO: 125886 - protein, 403 aa, Glycine max
  Coding DNA Sequence Number=SeqID_9108
  Gene Ontology: Mol. function=protein phosphatase type 2C activity
  Homolog annotation: Hit_ID=Q10S32; Match level="QueryCoverage=55%, HitCoverage=58%, E-value=2e-58, Identity=54%"; Hit description =Protein phosphatase 2C, putative, expressed
  Pfam annotation: Domain name=PP2C; Domain location=181-376; Score= -67.7; E_value=0.052; Accession=PF00481.12; Description=Protein phosphatase 2C
MGCWEEIQLRHTIEELLVEWHNNALETASDRETWSPPPQGFMKCNVDASFRQQANLNEGEVWTLASTITFSSILGLHTIIFEVDCKMIVDRIIKSTTMDKSELDSEHRARHHWEKRFRCWGPRVRVSERCGMLHALMSLIARCWKPFGHGDDAGNAAAGRECKDGLLWFRDIGKFAAGDFSMAVVQANQVIEDQSQIESGAFGTFVGVYDGHGGPDCSRYVCDNLFRNLQAILAESQSVVTSEAIHQAFRRTEEGFTALVSELWSSRPQIATTGTCCLVGVICRQTLFVASLGDSRAVLGRRVGNTGGMARFSCLRSTMRILRLSGRSLRNCTRMTPDCCPQTWSVESKGHYSETPSELAERRSGASVRRHVELHPSVRGAVIAAYHAVVLAGVEGLGHALRR

SEQ ID NO: 125887 - protein, 97 aa, Glycine max
  Coding DNA Sequence Number=SeqID_9109
MRILLIGQGSKNSKVVSQWGLLSWEPDLNIWGMRDNDDLETTCKISHGHSQVGTQASHLRHCDTTVGNLHKQTQRFPIMFFHQFNEFIHSYLGYSGK

SEQ ID NO: 125888 - protein, 236 aa, Glycine max
  Coding DNA Sequence Number=SeqID_9110
  Subcellular localization annotation: CTP_CleavageSite=77; ConfidenceScore=5.01e-01
MKEHQTSHKVFARSTENRHGRFKDFPSKKSNKAHYNSSKFISHSFFFRFLHLYSIFRVPFILFRQITDKSLNAAFASLSEDSVDLSPISEISFANHNEDVTNFLLEEPSSVTLVPSDLSPKKITDATEIIGSANSICNDELDSSRFNSVEAEITVNFLRNVKAPQFRRELMDGIIEYVISDLQTYTLPEERDQFAHLLSMKSRMLFLCTFIWVIGVSVLLFFTLDARGPYRGPTPT

SEQ ID NO: 125889 - protein, 54 aa, Glycine max
  Coding DNA Sequence Number=SeqID_9111
  Homolog annotation: Hit_ID=Q1RYT8; Match level="QueryCoverage=92%, HitCoverage=15%, E-value=6e-11, Identity=48%"; Hit description=IMP dehydrogenase/GMP reductase
MEELGLKFLTNNVVVDVNVFRSLMESRVGCDVGEPLNFTSGGSQCAIFNFNGGP

SEQ ID NO: 125890 - protein, 84 aa, Glycine max
  Coding DNA Sequence Number=SeqID_9112
MVRATFGLSLGSKIHALHWRFLLWTSMLLILGFGVSSTTRLCHKALPTKSFMVHHHIPILASSLRCRLGEEDLHHIFWECGSIV

SEQ ID NO: 125891 - protein, 145 aa, Glycine max
  Coding DNA Sequence Number=SeqID_9113
  Gene Ontology: Mol. function=4 iron, 4 sulfur cluster binding; Cellular component=integral to membrane; Biological process=protein -chromophore linkage
  Homolog annotation: Hit_ID=Q9TLQ6; Match level="QueryCoverage=99%, HitCoverage=30%, E-value=5e-45, Identity=48%"; Hit description =Photosystem I P700 chlorophyll a apoprotein A2
PAFNAGRSIWLPGWLNAVNENSNSLFLTIGPGDFLVHHAIALGLHTTTLILVKGALDARGSKLMPDKKDFGYSFPCDGPGRGVWAWMFLFGHLVWATGFMFLISWRGYWQELIETLAWAHERTPLANLIRWRDKPVALSIVQARL

SEQ ID NO: 125892 - protein, 93 aa, Glycine max
  Coding DNA Sequence Number=SeqID_9114
MKRYDSSQLILNFNVQMHCLLLQLIASQCPTKKTMIMRGQDIYSSQDEVTTSPFYSESEEAKGKESSEEIYPQEEGNLLMVRRLLGGQSSDLN

SEQ ID NO: 125893 - protein, 43 aa, Glycine max
  Coding DNA Sequence Number=SeqID_9115
MIFVDPDPRSQVPGGGFYSGHSETFKLDDARDSSLLGGDGQVR

SEQ ID NO: 125894 - protein, 208 aa, Glycine max
  Coding DNA Sequence Number=SeqID_9116
  Gene Ontology: Mol. function=transcription factor activity; Cellular component=membrane; Biological process=regulation of transcription, DNA-dependent
  Homolog annotation: Hit_ID=Q987N6; Match level="QueryCoverage=99%, HitCoverage=77%, E-value=3e-72, Identity=61%"; Hit description =Transcriptional regulator
TQPAYPETGTGGGVAAAGAHHAQRQYHRCRREPAAAGAPHAGGIRWITVLAARPRGHPRRDSDHRLPADGGVLLPAQRDGAQWNVANGVRHQLHGRQRSESRFRRTGRGPVRAGVPSRSSAGAQAQGGMGRPGRAPVDHRASHQRQPHAAGWCAGAREPQVELALRSDPPVYVTGHGRGRHRGVSAAEYGHAIWGSPHPGDARDRQPR

SEQ ID NO: 125895 - protein, 164 aa, Glycine max
  Coding DNA Sequence Number=SeqID_9117
  Gene Ontology: Mol. function=unspecific monooxygenase activity
  Homolog annotation: Hit_ID=O04892; Match level="QueryCoverage=57%, HitCoverage=17%, E-value=3e-28, Identity=79%"; Hit description =Cytochrome P450 like_TBP
MSRRARRSLQNPGREPGRSGRRCRSWCLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 125896 - protein, 134 aa, Glycine max
  Coding DNA Sequence Number=SeqID_9118
MEKSEKKNFSEKKMKKAYITWDDNDMESSEDSENEEINLCLMAKSYESDEEVTSSNNLSISFDELQDAFADLHKESIKLANCCGKYEKEIKDLKNSLAKFSFSKNNLDVILGKQRCVSNKAGIGYKPDKTTKIS

SEQ ID NO: 125897 - protein, 329 aa, Glycine max
  Coding DNA Sequence Number=SeqID_9119
  Gene Ontology: Mol. function=exodeoxyribonuclease V activity; Cellular component=exodeoxyribonuclease V complex
  Homolog annotation: Hit_ID=Q8PEL3; Match level="QueryCoverage=42%, HitCoverage=13%, E-value=1e-37, Identity=56%"; Hit description =Exodeoxyribonuclease V beta chain
MAAFQRMLAQHAGAEAVDGEDGRQIDLVCAHLQAALQCGGTFGAALQMALQDFAGQAYIRCFSLGRFQIDQACGQRQALAYALAQFLGGGVGEGHCQDLADAQALLHHQAGEQRGQGEGLTGAGAGFDEADAVQRQGQVGITAEGFDAVFGDGGAHALPSWRASAPRQVGITGIGGERVCAAQQQLPGVAAGFTPGAVAAVPLLPAFAALFFCRRVVQHPAGVRGKAQRLAQATLAQLQQRTQRSTCSGNAQCRQHVRTGTGIAAVMELHKRQRIARSVRQQPVQAVADHCIAIECAGTQAHQPFGMPIGHAAMQAHAIDVHFVATAFQ

SEQ ID NO: 125898 - protein, 120 aa, Glycine max
  Coding DNA Sequence Number=SeqID_9120
VVVSPAKPPPKPDPEVDDPLYLMTLIIPELFLRPYQVPLQRTLADGGHPTQGTPSCLCNRQKGSTECGYYVMHWMSTIILGTFRNNWEAYFNDPRPLELERSKALQIQWAQYYLRVRDQT

SEQ ID NO: 125899 - protein, 84 aa, Glycine max
  Coding DNA Sequence Number=SeqID_9121
MSMHAWEHVVDSTNRNILDERAWFLEISSSLISNIVAVGTTNDNVSSKRKTLDEVSLSSSESETQHDHRSTSTSYVPMDPGIGP

SEQ ID NO: 125900 - protein, 267 aa, Glycine max
  Coding DNA Sequence Number=SeqID_9122
MEFGYIVVHFNILDAMKHPSEDHTIFRAEIIDQILDDYMFDSVLHGRKHPFLSDLHACHSLCIEYESEFEFEPISDFYVESEFKFEFGSNFLGGVPLDADFLESECTNHVAGSTYTSDLLYEVQAEEPSSSPTMVPTTVQPPPTPEWKPLPATLKYAYLEDKEKFQVFISASLDAEQGEKLLLVLKKHKKGVERTCPLGPSKIFQQKAVPSGGTNPARLGELGSNHHPLFPINRGRRVKQKETFPWAILRRFSTVLHRSSSFFGLQP

SEQ ID NO: 125901 - protein, 316 aa, Glycine max
  Coding DNA Sequence Number=SeqID_9123
  Homolog annotation: Hit_ID=Q5GV95; Match level="QueryCoverage=32%, HitCoverage=73%, E-value=4e-40, Identity=81%"; Hit description =Dihydroneopterin aldolase
  Pfam annotation: Domain name=FolB; Domain location=117-223; Score =105.0; E_value=2.2e-28; Accession=PF02152.8; Description =Dihydroneopterin aldolase
MDRHHQCTAQPHVPEVEGFGCDVGAAGRCDSLQLPQSPLASSRTDGIPSPACAPGLAAGFQLPPGTLRVYRRAPLAGPFVLSGPTLAGGPLSVPGRVRAVPLPWPPVFGRVSAMDKVFIEGLTIDALIGIYDWERRIRQDLVFDLEMGFDNRRPAATDDIAHTLNYKAVSKRLEQFVRESEFGLVETLAERCAQIVLTEFDVKWLRLKLSKPGANKETTDGGRGGGGTVAGKAAEHTGTLSWRLPGVDDLGAADRRRPGQLGHQAHPGARAAAPAAAPTGCRVRAWQPPDAGDLAPVQRGAQPGDRLGHHSDRGIL

SEQ ID NO: 125902 - protein, 1309 aa, Glycine max
  Coding DNA Sequence Number=SeqID_9124
  Gene Ontology: Mol. function=ATPase activity, coupled to transmembrane movement of substances; Cellular component=integral to membrane; Biological process=auxin mediated signaling pathway
  Homolog annotation: Hit_ID=Q9ZR72; Match level="QueryCoverage=94%, HitCoverage=98%, E-value=0.0, Identity=79%"; Hit description =Multidrug resistance protein 1
  Pfam annotation: Domain name=ABC_membrane; Domain location=748-996; Score=84.1; E_value=4.3e-22; Accession=PF00664.13; Description=ABC transporter transmembrane region
  Pfam annotation: Domain name=ABC_membrane; Domain location=90-372; Score=131.9; E_value=1.7e-36; Accession=PF00664.13; Description=ABC transporter transmembrane region
  Pfam annotation: Domain name=ABC_tran; Domain location=1071-1255; Score=235.6; E_value=1.1e-67; Accession=PF00005.17; Description=ABC transporter
  Pfam annotation: Domain name=ABC_tran; Domain location=447-631; Score= 241.3; E_value=2.1e-69; Accession=PF00005.17; Description=ABC transporter
  Pfam annotation: Domain name=Dynamin_N; Domain location=450-616; Score=-42.3; E_value=0.045; Accession=PF00350.13; Description =Dynamin family
  Pfam annotation: Domain name=SMC_N; Domain location=436-635; Score= -128.5; E_value=0.033; Accession=PF02463.9; Description=RecFRecNSMC N terminal domain
  Pfam module annotation: Pfam domain module=ABC_membrane::ABC _membrane::ABC_tran::ABC_tran::Dynamin_N::SMC_N; Domain location=748 -996::90-372::1071-1255::447-631::450-616::436-635
SEEIKTIEQWKWSEMQGLELVPEEGGAAAPSQHQVPREMNTSEPPNKDVGASSAAVTSNGGGEKKEKESVPSVGFGELFRFADGLDYVLMGIGTVGAVVHGCSLPLFLRFFADLVNSFGSNANDVDKMTQEVVKYAFYFLVVGAAIWASSWAVVVVAEISCWMWSGERQSTKMRIKYLEAALNQDIQFFDTEVRTSDVVFAINTDAVMVQDAISEKLGNFIHYMATFVSGFVVGFTAVWQLALVTLAVVPMIAVIGGIHTTTLAKLSGKSQEALSQAGNIVEQTIAQIRVVLAFVGESRALQAYSSALRVAQKIGYKTGFAKGMGLGATYFVVFCCYALLLWYGGYLVRHHATNGGLAIATMFAVMIGGLGLGQSAPSMAAFTKARVAAAKIFRIIDHKPSIDQNSESGVELDTVTGLVELKNVDFSYPSRPEVQILNDFSLNVPAGKTIALVGSSGSGKSTVVSLIERFYDPTSGQVLLDGHDIKTLRLRWLRQQIGLVSQEPALFATTIRENILLGRPDADQVEIEEAARVANAHSFIIKLPDGYETQVGERGLQLSGGQKQRIAIARAMLKNPAILLLDEATSALDSESEKLVQEALDRFMIGRTTLIIAHRLSTIRKADLVAVLQQGSVSEIGTHDELFSKGENGVYAKLIKMQEMAHETAMNNARKSSARPSSARNSVSSPIIARNSSYGRSPYSRRLSDFSTSDFSLSLDASHPSYRLEKLAFKEQASSFWRLAKMNSPEWLYALIGSIGSVVCGSLSAFFAYVLSAVLSVYYNPDHRYMIREIEKYCYLLIGLSSTALLFNTLQHFFWDIVGENLTKRVREKMLTAVLKNEMAWFDQEENESARIAARLALDANNVRSAIGDRISVIVQNTALMLVACTAGFVLQWRLALVLVAVFPVVVAATVLQKMFMTGFSGDLEAAHAKATQLAGEAIANGQISGSGYGVAQFALYASYALGLWYASWLVKHGISDFSKTIRVFMVLMVSANGAAETLTLAPDFIKGGRAMRSVFDLLDRRTEIEPDDQDATPVPDRLRGEVELKHVDFSYPTRPDMPVFRDLSLRAKAGKTLALVGPSGCGKSSVIALIQRFYDPTSGRVMIDGKDIRKYNLKSLRRHISVVPQEPCLFATTIYENIAYGHESTTEAEIIEAATLANAHKFISGLPDGYKTFVGERGVQLSGGQKQRIAVARAFVRKAELMLLDEATSALDAESERSVQEALDRASSGKTTIIVAHRLSTIRNANLIAVIDDGKVAEQGSHSQLLKNHPDGIYARMIQLQRFTHSQVIGMASGSSSSTRPKDDEREG

SEQ ID NO: 125903 - protein, 69 aa, Glycine max
  Coding DNA Sequence Number=SeqID_9125
MVIFHHGDAAEDKGEEVASLRRFLEKTSLRSFFEKTSLRSYSLATHTPLITKLTSLRSFLKKIPKEARA

SEQ ID NO: 125904 - protein, 128 aa, Glycine max
  Coding DNA Sequence Number=SeqID_9126
MENGKALYVILFTLLLGSVQIKYTEAVTNAFLSTPTMSLFVAAITCHGLASMADTNLQGPVIIFHLSGIVGCEVLIWVLLTDILWYSMVNMLASLIAFVCFFNHIPNIFADHEMPIIEMQQPPEEEEV

SEQ ID NO: 125905 - protein, 118 aa, Glycine max
  Coding DNA Sequence Number=SeqID_9127
MAVRPKGISEIAKVLTSRAGVCKEKGFQYYKQLPEWVYVNHLSNTITHRPNPQSHAAEHDMSVVLRVEVTRMTVSFSVNKLKGNGKENNDNVKVPLSVEDTNDVIYELCVLAKTDSDN

SEQ ID NO: 125906 - protein, 330 aa, Glycine max
  Coding DNA Sequence Number=SeqID_9128
  Gene Ontology: Mol. function=DNA binding; Cellular component=nucleus; Biological process=regulation of transcription
  Homolog annotation: Hit_ID=Q09GS2; Match level="QueryCoverage=70%, HitCoverage=100%, E-value=1e-110, Identity=84%"; Hit description =Transcription factor MYBJ7
  Pfam annotation: Domain name=Myb_DNA-bind_2; Domain location=16-70; Score=-7.6; E_value=0.068; Accession=PF08914.1; Description=Rap1 Myb domain
  Pfam annotation: Domain name=Myb_DNA-binding; Domain location=14-62; Score=53.2; E_value=8.4e-13; Accession=PF00249.21; Description=Myb -like DNA-binding domain
  Pfam annotation: Domain name=Myb_DNA-binding; Domain location=68-113; Score=39.4; E_value=1.3e-08; Accession=PF00249.21; Description=Myb -like DNA-binding domain
  Pfam module annotation: Pfam domain module=Myb_DNA-bind_2::Myb_DNA -binding::Myb_DNA-binding; Domain location=16-70::14-62::68-113
MGRAPCCDKANVKKGPWSPEEDAKLKDYIEQHGTGGNWIALPQKVGLKRCGKSCRLRWLNYLRPNIKHGQFSEAEDKIICSLFASIGSRWSIIASQLPGRTDNDIKNYWNTKLKKKMMAMNPSLQRKPQQITLLSILQSSAYSSPSSFRDSNNISYYHPHGSFSYSSNLLSGNNTSASANSFFQAQESFIDPTQKCQFKDSSNNSMFLFGGEATATATSCSSSDGSCNNQISHVIEPEFGDASFVGGANNNIHPYSGVLEDNNTQKLMMFSNAGGSGSVSGWTDKQNGLLWEQNPLDYGLDEIKQLISTNNSCNNFLFDDKKTQERVTYF

SEQ ID NO: 125907 - protein, 530 aa, Glycine max
  Coding DNA Sequence Number=SeqID_9129
  Gene Ontology: Mol. function=phosphoinositide phospholipase C activity; Biological process=intracellular signaling cascade
  Homolog annotation: Hit_ID=Q2HRX8; Match level="QueryCoverage=68%, HitCoverage=55%, E-value=3e-40, Identity=31%"; Hit description=IMP dehydrogenase/GMP reductase
  Pfam annotation: Domain name=DUF1723; Domain location=155-204; Score =59.4; E_value=1.2e-14; Accession=PF08330.1; Description=Protein of unknown function (DUF1723)
MARTRGLGRVISRLVGIDRHDDHDAADVSEWRRPTVSARRQRVHQMTADARDMAEDVADMTDDVPDLVAEAPEMRADVQGADGAEGSDADDATEGFPGGSSDPSMLASFADHERPDLKLVPHGRKVTLIGRPVPEIEGLAAATGLSPLIDCSVITDDPGLISAFMERWHGETSTFHLSVGELTITLDDVSSLLHLPITGALHSFHALSADEARFLLTELLEVSAEEARVETTLTRGAYVRLGWVQDIYEMRCQARRATYVHVVNLYAFRDLAQSGGYAWGIAALVHMYDQLDEASRTTTRQLARYLTLLQCWIYEHFPSVHQCVTNDTYQETSPRASRWLTLKAHMKGITGAPYRARCDALTVTDVSWLPYTEHRGVRAFELISSFQGQLRWGPMVVTARPERVVRQFGYIQSIPLPPVSARLSHDDIDGRWMHFEEHLLPAGELCLVSGQAGDQPRDAPAADPKEYIQPPSPQIPVAFDPPPHVAIVQRLECVLNLRMVTAGTELYEIMQDCLTIARGGASADGSVRAH

SEQ ID NO: 125908 - protein, 111 aa, Glycine max
  Coding DNA Sequence Number=SeqID_9130
MGHARCTQQHCWCTQQLEQFVFYRKNLFPEEQIVILPKEGFSEKFPEEGSSGRTNCSSERTFFRKKVFPVEQIVHPEEPSSGEITGRTSGAPNMSQLEFNSISPKVFPHPH

SEQ ID NO: 125909 - protein, 146 aa, Glycine max
  Coding DNA Sequence Number=SeqID_9131
MSYLKVNVPLRKGGWILVQRLSGAESGIQEGQNSPSVVVVFFSASLLREPLDPFAFEVGGRNLPLVLLCTIVVAFRGRRRRKKWGKLGDGGAFRKIHLEFFRNFLKNVFRKISGRRVLPEVLKRLSEVLVFRKVSGTPLPKTFRKK

SEQ ID NO: 125910 - protein, 195 aa, Glycine max
  Coding DNA Sequence Number=SeqID_9132
  Gene Ontology: Mol. function=ceramidase activity; Cellular component =endoplasmic reticulum membrane; Biological process=sphingolipid metabolic process
  Homolog annotation: Hit_ID=Q304B9; Match level="QueryCoverage=98%, HitCoverage=30%, E-value=6e-60, Identity=54%"; Hit description =Neutral ceramidase precursor
  Pfam annotation: Domain name=Ceramidase_alk; Domain location=2-195; Score=-379.1; E_value=2.6e-05; Accession=PF04734.4; Description =Neutralalkaline non-lysosomal ceramidase
MAGRHLRDAVKTVLTSEEYFEFDDIHIVIAGLTNTYSQYITTYEEYQVQRYEVSWHTFWSLRNLRKQISIFPPVVVDATPLGVNFGDVCADVPRNSTFKSGDLVTASFWSACPRNDLMTEGTFALVEFLQEKDAWTPAYDDDDFKLSSRSKATLEWRIPQGVAHGVYRLRHFGAVKGLFGSIHCFTGSSTAFVVA

SEQ ID NO: 125911 - protein, 113 aa, Glycine max
  Coding DNA Sequence Number=SeqID_9133
  Subcellular localization annotation: CTP_CleavageSite=63; ConfidenceScore=5.43e-01
MTFPSRGRWFFHGIPGSAISSIFCWSPRKKRSSARPPTAPIHARKKRTFRGRRLVFYLAQRKPAQTKPDQTCLLPYGYQKRLKEKNELQMPAMEDDAREEEDLDAGRRRRTRC

SEQ ID NO: 125912 - protein, 66 aa, Glycine max
  Coding DNA Sequence Number=SeqID_9134
MPMEHFFRECQRKKFGKNAEEHFCHFENLLGAPAMLLGAPSKSQQYVNDTWVLIGLEQMLPPTRVY

SEQ ID NO: 125913 - protein, 534 aa, Glycine max
  Coding DNA Sequence Number=SeqID_9135
  Gene Ontology: Mol. function=transferase activity; Biological process= Mo-molybdopterin cofactor biosynthetic process
  Homolog annotation: Hit_ID=O74841; Match level="QueryCoverage=41%, HitCoverage=79%, E-value=2e-36, Identity=40%"; Hit description =Probable FAD synthetase
  Pfam annotation: Domain name=MoCF_biosynth; Domain location=269-402; Score=67.8; E_value=3.4e-17; Accession=PF00994.14; Description =Probable molybdopterin binding domain
  Pfam annotation: Domain name=PAPS_reduct; Domain location=37-207; Score=68.1; E_value=2.9e-17; Accession=PF01507.9; Description =Phosphoadenosine phosphosulfate reductase family
  Pfam module annotation: Pfam domain module=MoCF_biosynth::PAPS _reduct; Domain location=269-402::37-207
MEIDKAIRECDDRRLQTKYNNATYVVQRALALYSIEEVAFSFNGGKDSTVLLHILRAGYFLHKKGQNSANGDLKDFPIRTIYFESPCAFPEINSFTYDTAATLDIMESYGLQIDTISLDFKSGLEALLKEKPIRAIFLGVRIGDPTAVGQEQFSPSSPGWPPFMRVNPILDWSYRDVWAFLLTCKVNYCSLYDQGYTSIGSIYDTVPNSLLCISNSSNKFKPAYLLADGRLERAGRAKRPSTSTGGQHPAESNGLTSQDSLKNSMLTASIIAVGDEILFGIVEDQLGPYLCRKLHCIGWSVFQHSVVHNNIDSVAEEVERQKSKSDMVFIYGGVGPLHSDVSIAGIAKAFGVRLAPDEEFEEYLRHIIGDQCTGDRNEMAQLPEGITELWHHDKLSVPLIKCENVIILSATNVPELEKQWDCWIELAKSSDLLALLEPYVSKDVTTNLSDVEIAQPLSKLCLEFPDLYIGCYRKARYGSLIVSFKGKNENLSWLGSYHSHIIYKYKMHWDKDGEGRKQGAAVLLEERTMVQGGD

SEQ ID NO: 125914 - protein, 196 aa, Glycine max
  Coding DNA Sequence Number=SeqID_9136
  Gene Ontology: Mol. function=tetraacyldisaccharide 4'-kinase activity; Biological process=lipid A biosynthetic process
  Homolog annotation: Hit_ID=Q5PGH1; Match level="QueryCoverage=99%, HitCoverage=60%, E-value=4e-80, Identity=77%"; Hit description =Tetraacyldisaccharide 4'-kinase
  Pfam annotation: Domain name=LpxK; Domain location=11-196; Score =175.5; E_value=1.4e-49; Accession=PF02606.5; Description =Tetraacyldisaccharide-1-P 4'-kinase
MIARIWSGESPLWLLLLPLSWLYGLVSGAIRLLYRLGLKQAWRAPVPVVVVGNLTAGGNGKTPVVIWLVEQLQQRGIRPGVVSRGYGGKAAKYPLLLTAETTTAEAGDEPVLIYQRTGAPVAVSPVRSDAVRALLAEHAVQIIITDDGLQHYALARDKEIVVIDGVRRFGNGWWLPAGPMRERASRLKSVDAVIVN

SEQ ID NO: 125915 - protein, 92 aa, Glycine max
  Coding DNA Sequence Number=SeqID_9137
MSGFTRDSPRISASPHQLDFTLYASGSYNAQWNAPGLLHDKHTLRSSRILRKMEVEEPWLRLFAAKFLFVGVFWFVLKVVFVIGSAVDRLCG

SEQ ID NO: 125916 - protein, 259 aa, Glycine max
  Coding DNA Sequence Number=SeqID_9138
MAPRKLASKRSRKDKAAKGTSSAPEYDRVDRASAVDITGYPHGQWIPFDADAIGQLLGYPLVLEEGQECEYGQRRNQSDGFDEEAIAQLLCIPGQDFARTSAGRRVRIMRTNMTTLTQIWMTLLLSNILPTDHNSDLPMPKCQLVYAILTRMSIHVAQLIADAIYIFAGMAPTRHPFDPDKSNRALGFPSLITGLCQSFGVPVAPTKVIRPPITRAFIEKYCTQRQAQGDAPQAAGAPPPPHQAGQAGSFDMEQYLRHL

SEQ ID NO: 125917 - protein, 118 aa, Glycine max
  Coding DNA Sequence Number=SeqID_9139
MVEQEEREIKPHQEETMLVNLGTDKEKKEVKLSLAHQWAKRTSTAKRSFIALSTKENLAENQHQGRALSSAYFGKRALEAARGATYALKPRFCKFREISELESEREMLRRGGGIPLLV

SEQ ID NO: 125918 - protein, 291 aa, Glycine max
  Coding DNA Sequence Number=SeqID_9140
  Homolog annotation: Hit_ID=Q47522; Match level="QueryCoverage=19%, HitCoverage=77%, E-value=5e-19, Identity=74%"; Hit description=LacZ protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDDVFQTFAFWQPIDSTRIHEHNQGIRLSLSIQWPTFRTLLAIPIRLVSAGYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 125919 - protein, 218 aa, Glycine max
  Coding DNA Sequence Number=SeqID_9141
  Homolog annotation: Hit_ID=Q47522; Match level="QueryCoverage=28%, HitCoverage=83%, E-value=6e-22, Identity=75%"; Hit description=LacZ protein
VLQWLLFLSAVPPVQLLTGWCVTAKAPPDISAGKCSGHAARRVPFAIQAAQLLGRAIGAGLFAITPAGERGMCCKAIKLGNARVFPVTTLNSINSRQKHSQKRHWDVSIEVTVLNIPFHRAALRISLDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 125920 - protein, 174 aa, Glycine max
  Coding DNA Sequence Number=SeqID_9142
  Gene Ontology: Mol. function=DNA binding
  Homolog annotation: Hit_ID=Q1S0F5; Match level="QueryCoverage=97%, HitCoverage=42%, E-value=5e-16, Identity=31%"; Hit description=IMP dehydrogenase/GMP reductase
NGVVGVPRKFLEKGQRPWKIKANGLSFIDILALLIFGVVLFPNMEGLVDLAAIDAFLAFHHGKESPVVAILAMYDTFDRGCEKSSARIVCCALALYVWLEGRIRILSSCEGCPNVPLMGTRGCINYNPVLAIRPLGYPMRGVPSGESITPFIARGFSDHNARVLQGVRKAWDAA

SEQ ID NO: 125921 - protein, 58 aa, Glycine max
  Coding DNA Sequence Number=SeqID_9143
MAKTSSWARGEEEKQQRRREAREEKEKQQRECVMTRSPDKIKSIDGSKETLKTQCEDQ

SEQ ID NO: 125922 - protein, 209 aa, Glycine max
  Coding DNA Sequence Number=SeqID_9144
  Gene Ontology: Biological process=electron transport
  Homolog annotation: Hit_ID=P26701; Match level="QueryCoverage=79%, HitCoverage=93%, E-value=8e-67, Identity=72%"; Hit description=Tail protein I
RAVPVADGHRDDFQLRAARAGAGNLGRPGGGNNRFVFVHDFLLSGVNGNNIAINGGRAGVNPAGDVLQNVEADQVAAQGLGVGDKALHFLIHFLGDAGFQHANIQPEGAGRIGAVGMEPLDNVNQVAERLHHTAHCADGALMPVNVERSGHHTPLDVLRPRLIPAIDRERPRQIGQQMHRAGFRVPQITQGNRHALQLSTRGGGSNFQR

SEQ ID NO: 125923 - protein, 115 aa, Glycine max
  Coding DNA Sequence Number=SeqID_9145
  Homolog annotation: Hit_ID=Q66BM2; Match level="QueryCoverage=99%, HitCoverage=38%, E-value=1e-30, Identity=60%"; Hit description =Probable bacteriophage protein
VVRDALNDEDVRPVADRVIVQSAKIAPYVIEAVLYLYPGPEVAPILDTANKRLRAYVQNMRRLGRSIRRSSMNAALTVEGVEHVEIIKPAADIVLDKTQAGYCTGVNITPGRADD

SEQ ID NO: 125924 - protein, 204 aa, Glycine max
  Coding DNA Sequence Number=SeqID_9146
QCSNRSDASELNASILKRAGFEITQSTKKGMTGKNKIVASVKATVLGIGGSGGGETEDTHSQEVTTTPLEIDIDDVNDVIAALKSINFNKVIVLEDFHYMPFETQRDFSIALKAFHETSSITFIIVGVWLEDNRLIVYNGDLTGRIISVNADVWSDDELMQAIETGGQLLNINFTEEFKKQILANSLKSIYLVQEACRRACELS

SEQ ID NO: 125925 - protein, 157 aa, Glycine max
  Coding DNA Sequence Number=SeqID_9147
  Gene Ontology: Mol. function=chitin binding; Cellular component =extracellular region; Biological process=chitin metabolic process
  Homolog annotation: Hit_ID=UPI000066154C; Match level="QueryCoverage =80%, HitCoverage=100%, E-value=4e-15, Identity=36%"; Hit description= Homolog of Homo sapiens "Keratin-associated protein 10-1
GLHVLAFRGLHVLTLRGLHALAFRGLHVLAFRGLHALAIRGLHVLAFRGLHVLTFRGLHSLSFKGPHILAFRGLHVLPLTSEDYTGLRALTLRGLHFLVFRGLHALAFRGLHVLTFVVLHALAFIGLYICAFRELKANSLLLSVPRPPPDIGWRPTV

SEQ ID NO: 125926 - protein, 111 aa, Glycine max
  Coding DNA Sequence Number=SeqID_9148
  Gene Ontology: Mol. function=unspecific monooxygenase activity
  Homolog annotation: Hit_ID=O04892; Match level="QueryCoverage=98%, HitCoverage=26%, E-value=7e-29, Identity=58%"; Hit description =Cytochrome P450 like_TBP
  Subcellular localization annotation: CTP_CleavageSite=44; ConfidenceScore=5.23e-01
SGRWNNVGKESRQNGSVTSGKGLALRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 125927 - protein, 59 aa, Glycine max
  Coding DNA Sequence Number=SeqID_9149
MKNGGNLREIAHGNGKRGWWLSPSSPRRAGLLPPEGTAFCWNILEGPSGPDCYLHTLVY

SEQ ID NO: 125928 - protein, 95 aa, Glycine max
  Coding DNA Sequence Number=SeqID_9150
MSDSGIKYIKTLEIEQRKLSRNSNGHNFSLGWPNQAHNILRPSKFNNGSSREIPMAHNISRGLKLNNISSIEIEMVITFNTDVRFRRITYRDAQN

SEQ ID NO: 125929 - protein, 94 aa, Glycine max
  Coding DNA Sequence Number=SeqID_9151
MASKGGSWKSPVVNGGGGGAWGLVVTDKEGFELLVLPRIRARTVKIGVILVIVMKVVVVEGEGLVDIVVVAVKKVLLEAQLTSRKMEWASDEML

SEQ ID NO: 125930 - protein, 186 aa, Glycine max
  Coding DNA Sequence Number=SeqID_9152
  Subcellular localization annotation: CTP_CleavageSite=6; ConfidenceScore=5.34e-01
GSRRPRARPAKTPSTSAARHPASTSAAPPPARIAATPSTPPPGEFQHFKAMLRSIHQGQIILLQTWPGTQPPLHRDDEDPAAQVPHQPLDESSESSTPKPLIRKRRVVVTQEAAATPEKSPEATPEPPVPMANTTSPQQAADPSTPEVQTTPVLSPNTSLVATPVLHLTNEEEVQTQDTQDQSQDL

SEQ ID NO: 125931 - protein, 337 aa, Glycine max
  Coding DNA Sequence Number=SeqID_9153
  Gene Ontology: Mol. function=transcriptional repressor activity; Biological process=regulation of nitrogen utilization
  Homolog annotation: Hit_ID=Q2K726; Match level="QueryCoverage=52%, HitCoverage=63%, E-value=2e-54, Identity=58%"; Hit description =Hypothetical conserved protein
  Pfam annotation: Domain name=DUF24; Domain location=200-290; Score =110.8; E_value=3.9e-30; Accession=PF01638.8; Description =Transcriptional regulator
  Pfam annotation: Domain name=HTH_5; Domain location=203-250; Score =5.7; E_value=0.099; Accession=PF01022.11; Description=Bacterial regulatory protein, arsR family
  Pfam annotation: Domain name=PadR; Domain location=212-275; Score= -15.4; E_value=0.059; Accession=PF03551.5; Description=Transcriptional regulator PadR-like family
  Pfam module annotation: Pfam domain module=DUF24::HTH_5::PadR; Domain location=200-290::203-250::212-275
LAIEGVRGQRGGGAVGDIANIDKARLTLARRNGDLAMVDARLPVAVEIIGEPVGAQDDVRRARSDDLQLDLAIGNGIIGIDAEDAEEHDLHLAARGLLDNGRQRVDGIQTTASQDEEQTVNAVEGIRISRCVGIIETHAFRAARGVAATRGRLNAFALGKKRFHQRRADGAGGTDYEVKSMANIYDVYEDRCPTRMVLDRIADKWALLILDKLRRDAVRFNLLRREIKGISQKVLSQTLKKLERDGLISRQAFPTVPVTVEYSLTPLGRTLTDTVAALAHWAEGNMDAVMAAQRAYDERTTIASVIPDLIRYPASPSPWAEKTLFAAQTRIDWMPDQ

SEQ ID NO: 125932 - protein, 138 aa, Glycine max
  Coding DNA Sequence Number=SeqID_9154
MPISPCGRITPTKTTNEPAEVQQGPGVSSSGYGLLLVLQGARSPQQGIVPARHLVDPKKSNRVLELPALITGPYQFYGVPVAPSKVIRPPTNRAFIKKYCALKQAQGEIPQQSGDGRQRATDAPPPPLEFTSIHPQKG

SEQ ID NO: 125933 - protein, 130 aa, Glycine max
  Coding DNA Sequence Number=SeqID_9155
  Subcellular localization annotation: CTP_CleavageSite=25; ConfidenceScore=5.23e-01
QNRGGACHPTRPSELSLPRRAQLAQVSKVVSSRSNSLLEEGSGRPKWARLLFVPPFLLNAPLLFFAFEEVTETYGLRKNTSFRFSPHYGISRIAQACFLLISNTSRDFIHCATKDAKCLEAANQRLYIIK

SEQ ID NO: 125934 - protein, 65 aa, Glycine max
  Coding DNA Sequence Number=SeqID_9156
MRIPFLQAKVQKGVDFGPNFHIIPYGTQDNDDLKTTCKISHGYSQVGPQASCLWHCDTTVGNLYR

SEQ ID NO: 125935 - protein, 83 aa, Glycine max
  Coding DNA Sequence Number=SeqID_9157
MWAIIDKCKEKLNLAATHEQRLEDEYAKISAERKQGKRSQELPPLLAKAKAVADTYPAPEEIHGLLSYCQHMIDLMDHMIRNR

SEQ ID NO: 125936 - protein, 199 aa, Glycine max
  Coding DNA Sequence Number=SeqID_9158
MGETHEIPHHNLADFEPHLEYATMGQVVGGVPLPNTLEGPQFRPQPLPLHFAVGRVPPTMVEREKLDHIKERLRVIEGGGDHAFADIAELYLVPDIIIPLKFKVSDFDKFKGTTCPKNHLKLYCRKMGAYAKDEKLLMHFFQESLTRAAVTWIEVGLKRGKFDYPALINEKPGENREDEKEEGTHVVTAIPTWPNFPPA

SEQ ID NO: 125937 - protein, 193 aa, Glycine max
  Coding DNA Sequence Number=SeqID_9159
  Gene Ontology: Mol. function=signal peptidase II activity; Cellular component=membrane; Biological process=sporulation
  Homolog annotation: Hit_ID=Q1XMP3; Match level="QueryCoverage=84%, HitCoverage=39%, E-value=1e-55, Identity=62%"; Hit description=PSP1 C-terminal conserved region precursor
  Pfam annotation: Domain name=PSP1; Domain location=67-153; Score= -17.8; E_value=0.0072; Accession=PF04468.3; Description=PSP1 C -terminal conserved region
MSCGCKTSGDSAHSCGPKKSANGCENVNTCGSVVTVESSPGHDVGVVSLTGELVKIQMKKKKFSEENSLKIYRLANQKDIEVWQEARKKEDSVKIQARKIAHNLGLEMKVTDVEYQGDASKTVNKRIRLYIPNKNRHETDRFQTGSRKNRRNRVLWKRTLLFDMAYRLQICKYQRCEISAIKYQPAKTCRAMW

SEQ ID NO: 125938 - protein, 211 aa, Glycine max
  Coding DNA Sequence Number=SeqID_9160
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=5e-23, Identity=32%"; Hit description= UPI00006A17C9 related cluster
  Subcellular localization annotation: CTP_CleavageSite=10; ConfidenceScore=5.38e-01
MRTRSPLKVRACSPLKARRCSPLEMRACSPLLARTCSPFKVRACSPLTVRACNPLMVRACSPLKVRTCSPLKVRACSPLMVRACSPLKARTCSPLKVRACSPLMVRTCSPLKARTRSPLNGEGRVVLSRRGRVVLSTVRVTSTQVPKVRTYSPLKARTCSPLEVRACSPLMVRTCSPTLARTCSPLKVRACSPLLARTCSPLKVRACNPTK

SEQ ID NO: 125939 - protein, 417 aa, Glycine max
  Coding DNA Sequence Number=SeqID_9161
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=4e-53, Identity=32%"; Hit description= UPI00006A17C9 related cluster
LHALVFRGLQSSPSNGLHVLAIRRLHILAFRGLHALTFRGLHVLAIRGPHALTIRGLHVLAFRGLHVFTFRRLHVLAIRGLHVVTFRGLHVFAIRGLQALTFRGLHVLAIRGLHVLTFRGLHVLAIRGMHILTFRGLHVLAISGLHMLTLRGLHVLAFRGPHALPFRGLHVLAIRALHALPFRRLHILAIRGLHVLTFRGLHVLACRGLHPLAFRGLHVIAIKRLHVLAFRGLHVLAFRGLDVLAYRGLQVLAIGGLHALTFRGPHVLTIRGGLHAFTFRGLHVLAFRGLQAHIFEGQHAFSFRGLHVLTFRGLHVLAFRGLHILAIRGLYALAIRGLHVLAIRGPHVFTFRGMHVLAIRGLHALAIRGLYVLAFRGLHVLAFRGLDVLAYRVLHVLAIGGLHALTFRGPQRSRHQR

SEQ ID NO: 125940 - protein, 79 aa, Glycine max
  Coding DNA Sequence Number=SeqID_9162
  Homolog annotation: Hit_ID=Q5W7C9; Match level="QueryCoverage=68%, HitCoverage=20%, E-value=2e-19, Identity=80%"; Hit description =Unknow protein
MEENSESALSTNKEAISNATRNLMESSILAQDERWRHALHMQVGREVVFPVADGWKRLLIPRMLRSKRRNPPEEGLASD

SEQ ID NO: 125941 - protein, 312 aa, Glycine max
  Coding DNA Sequence Number=SeqID_9163
NKFPKQVRVRGHLIKFDIDSLNTFLETPVVVEQWESFPSYSRFARLRPDLQELAAQLCILGRGFVLNVEGLLWKLLRKDLTTLAQTWSALPYSNLAPTSHTSDLNLDRAKLVYRLIMKMNMNLGSLISGQISLIAQSNSSRLGFPTLITTLCKARGVTSDSLTFKARRSEAPSTSAAPTPSTSAPSTFALPLPPTAPVLPGPSAQSLESFPVYATESALGPAPEHAEFAGCGPTMTNYERGGVSSKAQEPQSDQEDNILEASEPTPPEPFIFETDPVAATPQVTPKPSTVVLDMSSSQPESTAPAPDLPLPQ

SEQ ID NO: 125942 - protein, 100 aa, Glycine max
  Coding DNA Sequence Number=SeqID_9164
MEANVVTIAATSIVAKVYPMPPSGLNLMNHPTLDMVGKDLGSRDDPHDVQNRNKHAFPPYGLPPNYTPPNVAYTPNEDVNNSTLIPIESQQPQTDHAHVS

SEQ ID NO: 125943 - protein, 170 aa, Glycine max
  Coding DNA Sequence Number=SeqID_9165
VDCNKGDREEHTYTGIQGAPRLTPDSRCLLDPIWGASTDLGLPFDFMLFRSPALEARCCVLPTREGGCTTRIIWFQQVRCALCQVSVSATTWTGQASDPLPDGNAPQPRVVPQAPQTDIPHVPDLGAPSTSVRPAVEEPRHVVEVFHGIVERSERHLSLGMVTPGSSTHE

SEQ ID NO: 125944 - protein, 66 aa, Glycine max
  Coding DNA Sequence Number=SeqID_9166
MVTRTFHQPGANEPIDVQRLTSSSATFAIQGQRVRWQAVIPYGHPHLSSTEGNEFDVIRMMLVIRF

SEQ ID NO: 125945 - protein, 120 aa, Glycine max
  Coding DNA Sequence Number=SeqID_9167
MEIQRLNQNEETDKKKRSIALKASSSMQEENEEEESDDEEDFSLFVKNFQNFVKKRRIERPNCPSNEEWPKKSDKKKYEERRTKKTYIAWDDNDSSNGSEKEINLLTKDYESDENISQED

SEQ ID NO: 125946 - protein, 134 aa, Glycine max
  Coding DNA Sequence Number=SeqID_9168
MDRSWMKASRISDEYENGVQQFLQFTECNATSLGRKFFCPCIKCGNGRRQSINDIRSHLICDVIIPSYTKWIWHGEFPNMPTVPQTESVHEDIGYRIEDMIRDLGQDSFQQAHALLYEKIQNDSNQNSHLDNLV

SEQ ID NO: 125947 - protein, 69 aa, Glycine max
  Coding DNA Sequence Number=SeqID_9169
ALKGLDDAPQPKSKAPARWIVVKMSTIILETFRNNWEAYFNNPRPLEPERLKALRIQWAQFYLRVRDQT

SEQ ID NO: 125948 - protein, 122 aa, Glycine max
  Coding DNA Sequence Number=SeqID_9170
MFFSIYHHYGPYGQIDVVRIIVCPFEKDECPTHVISAKGFVSEVNSLLVFTFGHQESRTDSLALLCKGLTSDVWKYVVEVNSSEMQPEGNLSFDPVCIWLWFRYRLKTFFRALISVEVEYCS

SEQ ID NO: 125949 - protein, 66 aa, Glycine max
  Coding DNA Sequence Number=SeqID_9171
MKEPALQGEPVTSRVSISSPGRAAIDPGAHFPINRCAREVEERFQGSEVKGIERTKKEEETKPRHC

SEQ ID NO: 125950 - protein, 65 aa, Glycine max
  Coding DNA Sequence Number=SeqID_9172
MSVKNLVRRLRVHDKTNHALNVPTMWDRHKLKGALKPGVFTLKAYTPKSLLGPLPPDSSSTQKTF

SEQ ID NO: 125951 - protein, 141 aa, Glycine max
  Coding DNA Sequence Number=SeqID_9173
MPRTHDAILYYNGKWNMPPQNKFVGCMFTGKNPKKFQIPSTCTIDELKNLIKQVAPKGIPPLGIHESQTVRRLFFRQPARFEYSDTVIKYEINELMTNEELLKVLVQSNYWKKYGPVEILAVFTKYVVKIEDEVTGTSLNN

SEQ ID NO: 125952 - protein, 54 aa, Glycine max
  Coding DNA Sequence Number=SeqID_9174
MGFPLPAVPYLAENLSGQGSKRSKVVFQWGLLSWEPNLDIWGETNLGVKVSISG

SEQ ID NO: 125953 - protein, 320 aa, Glycine max
  Coding DNA Sequence Number=SeqID_9175
  Gene Ontology: Mol. function=transporter activity; Cellular component= integral to membrane; Biological process=transport
  Homolog annotation: Hit_ID=Q1H2E0; Match level="QueryCoverage=74%, HitCoverage=50%, E-value=8e-64, Identity=53%"; Hit description=Outer membrane efflux protein
  Pfam annotation: Domain name=OEP; Domain location=134-307; Score =26.2; E_value=0.00012; Accession=PF02321.8; Description=Outer membrane efflux protein
MKRWDMVCLMAIRRLHTTQGLKCPSWIIRQSCMVEQVNPQSHPKAVIQLISISHPKELHMSTNTGALRARSAILVAVSLLLGGCATFSKDGGMDEVQKQTQPYLKQEYQWAKTEESTQSLQEKTQALLAQPLDVEGAVQVALYNNKGLQASFYELGISEADLVQAGRLPNPRFSMLYARHGGEYKIEQAFTFNVFSLITMPKAVEIEKRRFAQAQASTAIEVLKLAYQTRTAYFNAVAATELARYSAQVKESAEASAELAKRLHETGNWNRLEQSREQSFYADAALEYANAKNSEVRAYETLARQLGVKASQINIRSRNY

SEQ ID NO: 125954 - protein, 388 aa, Glycine max
  Coding DNA Sequence Number=SeqID_9176
  Homolog annotation: Hit_ID=UPI00005FA3D4; Match level="QueryCoverage =29%, HitCoverage=34%, E-value=2e-19, Identity=41%"; Hit description =COG3064: Membrane protein involved in colicin uptake
HHLLTIFRVPVRDVIGGLALILYKYSSGIFSNTTLIRLIIIHKDRDMKITHSGYKTGAATLLPVMLALALTGCAKSTVPSQTVPANKGVDDLFANLGEPKTPVPGKEKEQYFAQLLAVIQSHLKDAEAYSGRSCTLRIKLAPDGLLISVRAEQGEPQLCQAAIKAIVNARLPKPPTAAVYEAVNNGTLHGICCQYLPIHHCAHALASIFKTVAAHRDHVIAVVVFLRVLAHQLFGKQAAEGDGGDEGQPFHFVGADLLRSADIRRREHGFVELAARQQQGKQQGGGDLRGSAVIHTNEGLNMLVRLAAETDAAALIALDSVAQNAPQRAAQIRAWCAQGICFLAEEQGMVMGYGVLHYHFFGCGFIEMLMVGERYRRRGVGQALIAAL

SEQ ID NO: 125955 - protein, 361 aa, Glycine max
  Coding DNA Sequence Number=SeqID_9177
  Gene Ontology: Mol. function=lyase activity; Cellular component =membrane; Biological process=DNA replication
  Homolog annotation: Hit_ID=Q3Y2U5; Match level="QueryCoverage=99%, HitCoverage=73%, E-value=7e-96, Identity=49%"; Hit description =Carboxylyase-related protein
  Pfam annotation: Domain name=UbiD; Domain location=12-361; Score=3.7; E_value=1.3e-15; Accession=PF01977.7; Description=3-octaprenyl-4 -hydroxybenzoate carboxy-lyase
MKNKINDLRSAIALLQRHEGQYIETDRPVDPNAELAGVYRHIGAGGTVKRPTRTGPAMMFNSVKGYPGSRILVGMHASRERAALLLGCEPSELAKHVGQAVKKPVAPVVVPASQAPCQEQVFYADDPDFDLRKLLPAPTNTPIDAGPFFCLGLVLASDPEDSSLTDVTIHRLCVQERDELSMFLAAGRHIEVFRKKAEEAGKPLPVTINMGLDPAIYIGACFEAPTTPFGYNELGVAGALRQQPVELVQGVAVKEKAIARAEIIIEGELLPGVRVREDQHTNTGHAMPEFPGYCGEANPSLPVIKVKAVTMRHQAILQTLVGPGEEHTTLAGLPTEASIRNAVEEAIPGFLQNVYAHTAGG

SEQ ID NO: 125956 - protein, 182 aa, Glycine max
  Coding DNA Sequence Number=SeqID_9178
ADTVVSDGKQRPSLVILHPRYAEIPYGYPHPFARQTQLCPMASRDQRPSLVILHPRYAEIPYGYLHPFARQTQLCPMASRDQVWSFCTQDTRRYLTVIRTLLSSRGGGPDDKQRPNRTLDSMQRLTQSSAPFVPPGTTKSFTCGNFMVTRDSRQPRGAKLVSYTDFWGPLLDDMRPFFGPCG

SEQ ID NO: 125957 - protein, 107 aa, Glycine max
  Coding DNA Sequence Number=SeqID_9179
  Subcellular localization annotation: CTP_CleavageSite=64; ConfidenceScore=5.49e-01
MGHLLPSLVTDVWGANTFPARKCNSRAFHLKVRRSRLFRFFRRFPQINVGGDSARIPFMEHASRESRFASRRRKKKEGVETRVVITERAGRTKSVSYLCFPLISDER

SEQ ID NO: 125958 - protein, 86 aa, Glycine max
  Coding DNA Sequence Number=SeqID_9180
MNDLAINFRGSRKSLQVVGPPGSILSVEQFIEKVSWPGTLLSTVGEGEGPQCSGAGVEMRPEGATFCEPIVPAIHETIEAGDSQLR

SEQ ID NO: 125959 - protein, 452 aa, Glycine max
  Coding DNA Sequence Number=SeqID_9181
  Gene Ontology: Mol. function=dihydroxy-acid dehydratase activity; Biological process=branched chain family amino acid biosynthetic process
  Homolog annotation: Hit_ID=Q3SFC9; Match level="QueryCoverage=99%, HitCoverage=49%, E-value=1e-153, Identity=58%"; Hit description =Dihydroxy-acid dehydratase
  Pfam annotation: Domain name=Aldose_epim; Domain location=266-450; Score=-52.9; E_value=0.00026; Accession=PF01263.10; Description =Aldose 1-epimerase
  Pfam annotation: Domain name=ILVD_EDD; Domain location=2-240; Score =11.3; E_value=2.5e-19; Accession=PF00920.11; Description=Dehydratase family
  Pfam module annotation: Pfam domain module=Aldose_epim::ILVD_EDD; Domain location=266-450::2-240
DEEVKKVYRAAPGGISTTIAFSQSMLWPSLDDDRENGCIRDKAHAYSQDGGLAVLYGNIALDGCIVKTAGVDDSILKFTGRARVYESQDAAVASILADEVVAGDVVVIRYEGPRGGPGMQEMLYPTSYLKSKGLGKACALLTDGRFSGGTSGLSIGHASPEAAEGGAIGLVQEGDTIEIDIPNRTIHLAISDEEMAHRRSNMEAKGKDAWKPLNRERMVSPALRAYAAMSTSAAKGAVRDHGQPEMTKRMQLHAHVSQLQDENGLQYLEIDNPLATGKIALQGAHVMQWQPKFLSDPVLWLSSNARYIKGRSIRGGTPICWPWFGAHPTDSTLCPHGFARVIPWRVMDIDATQTGATRIILEMQQTPEAQRQLSYPYELTLTITIGRRLRIDMATTNLAEHPFVIGEAFHTYFNVSDISNIHITGMQDCVYMDKLLRYERNVEHNALALTAK

SEQ ID NO: 125960 - protein, 119 aa, Glycine max
  Coding DNA Sequence Number=SeqID_9182
MGLSNFRKKCFWKLLRRIPEEVLPEVLLQEWALVTSGRCASGRYLPEEASSGNILDDVLLERVSEYFRNHEFFFRKKVLSEKESSGMIPEEGSFGNGFRGRAFSPLHCLLGAPAIMLSA

SEQ ID NO: 125961 - protein, 91 aa, Glycine max
  Coding DNA Sequence Number=SeqID_9183
IAPARHPVDPKKSTGSWSCQALITGLCQFYGVLVTSGKGIRPPTNRAFIKKYYVSRQAQGETPQQPGDGWQRATDAPPSPLEFTSAHPQKG

SEQ ID NO: 125962 - protein, 308 aa, Glycine max
  Coding DNA Sequence Number=SeqID_9184
  Gene Ontology: Mol. function=aspartate-tRNA ligase activity; Cellular component=cytoplasm; Biological process=tRNA aminoacylation for protein translation
  Homolog annotation: Hit_ID=Q9X1F4; Match level="QueryCoverage=99%, HitCoverage=53%, E-value=1e-112, Identity=63%"; Hit description =Aspartyl-tRNA synthetase
  Pfam annotation: Domain name=tRNA-synt_2; Domain location=116-308; Score=223.8; E_value=3.9e-64; Accession=PF00152.11; Description=tRNA synthetases class II (D, K and N)
  Pfam annotation: Domain name=tRNA-synt_2b; Domain location=139-278; Score=-45.4; E_value=0.025; Accession=PF00587.15; Description=tRNA synthetase class II core domain (G, H, P, S and T)
  Pfam annotation: Domain name=tRNA_anti; Domain location=19-101; Score= 76.7; E_value=7.4e-20; Accession=PF01336.15; Description=OB-fold nucleic acid binding domain
  Pfam module annotation: Pfam domain module=tRNA-synt_2::tRNA-synt _2b::tRNA_anti; Domain location=116-308::139-278::19-101
MYRTHTCGELRGTDEGKNVILSGWIERIRDLGGVKFIVLRDRYGKTQVVVNPDSPVYPIVNNISREYVIQVEGIVRKRPAEAITPEPTGEIEIVASELKILSKSELPPFYPGDDVSEEMRLKYRYLDIRNPKMMNNLILRHKLAFATREYLSNNNFLEVETPYLTKSTPEGARDFLVPSRLKKGNFYALPQSPQLFKQILMISGIDRYFQIVRCFRDEDLRADRQPEFTQIDIEMSFVHMEDVINLAENLIRYIYKAIGIELPEKFDRITYEEAMEKYGSDKPDRRYGMEMVDLTEFFKNSDFKIIKE

SEQ ID NO: 125963 - protein, 200 aa, Glycine max
  Coding DNA Sequence Number=SeqID_9185
  Gene Ontology: Mol. function=transferase activity, transferring nitrogenous groups; Cellular component=organelle inner membrane; Biological process=regulation of transcription, DNA-dependent
  Homolog annotation: Hit_ID=P23256; Match level="QueryCoverage=57%, HitCoverage=29%, E-value=2e-43, Identity=64%"; Hit description =Protein malY [Includes: Cystathionine beta-lyase (EC 4.4.1.8) (CBL) (Beta-cystathionase) ...
  Homolog annotation: Hit description=(Cysteine lyase); Maltose regulon modulator]
MNQHFILRLRPVAQQLRHHINHRRAIHQRLCRDLAGKAAAHPVLQGGEKILVLPAAVAQHAVIQPLLQRVNDAGSGGEIHVRDGEGQQIGHAKAVGDKVPLRAPAAVAIYHPIKIKRLHVYTVALIRWAISSLTDCTCGPMTTCRLVWFRCTTPMAPLAFSAASSTLLMSATDRRRRVRQLSSEVMLSTPPSAARIAGVL

SEQ ID NO: 125964 - protein, 51 aa, Glycine max
  Coding DNA Sequence Number=SeqID_9186
  Subcellular localization annotation: CTP_CleavageSite=9; ConfidenceScore=5.09e-01
MPRGFRNVSVSNYAKILDRSSTFIVRSSFSSVFNGETKAKINSPSQARPQK

SEQ ID NO: 125965 - protein, 101 aa, Glycine max
  Coding DNA Sequence Number=SeqID_9187
MTPTYDALLYYNGRWNMSHQNEFVGYLFTGKNPKKFDIPSGCIIDELKDLIKHVAPHGISPYGIHESQTLKTNDDVLKVLVQSNYWKHFEPIEILAIFSKQ

SEQ ID NO: 125966 - protein, 97 aa, Glycine max
  Coding DNA Sequence Number=SeqID_9188
MRDEPEAGFTVPQLRANLDPTKGVGRLRQQDGGHGSRNPLRSVLPTLETAQPEVGSSGWKSTARRVVSGAPPAALENPEDRVPPTPGRTHNRIRSPR

SEQ ID NO: 125967 - protein, 118 aa, Glycine max
  Coding DNA Sequence Number=SeqID_9189
MAAELGRQMVELSTLITCAAHNKSSDTLALLMNWRSCHERHLWREWIAPPETSYLIESVTTYPSAGGRRGAHGCVFQERKMHGVATNVYSRKMSGKPEKCGLRNLSVKGSGVVFMHGE

SEQ ID NO: 125968 - protein, 90 aa, Glycine max
  Coding DNA Sequence Number=SeqID_9190
MGMKAKYLRKKGKYGEGMNEKVKVILWMNALLEPKLLNPRKTMNCWQPNPITSLESSSDSFLCVHFCMIGDEMQRLELVLVVYDGISLNT

SEQ ID NO: 125969 - protein, 82 aa, Glycine max
  Coding DNA Sequence Number=SeqID_9191
  Homolog annotation: Hit_ID=Q1S1J0; Match level="QueryCoverage=99%, HitCoverage=9%, E-value=4e-13, Identity=42%"; Hit description =Integrase, catalytic region; Zinc finger, CCHC-type
MATVDITGSNNNDLNKPFRFEGYHFKRWKQKMMFSMKKVAYVLNTDISVMPKDVEKEVKDKMTMESALWNENDYLCNNFILN

SEQ ID NO: 125970 - protein, 133 aa, Glycine max
  Coding DNA Sequence Number=SeqID_9192
MRIPNDYSFDTLKRRMHNTLQLTNDQLVDEIYYRQPFIDAGQQYFFQSLQLKNDDDVYTMGSPNGIHESQLGSRREVVAKPDFHATITVATCPSRASEGKAHGCAFQRRKDARSRHQRLFVENVGKTEGNRSK

SEQ ID NO: 125971 - protein, 754 aa, Glycine max
  Coding DNA Sequence Number=SeqID_9193
  Gene Ontology: Mol. function=binding; Cellular component =intracellular; Biological process=metabolic process
  Homolog annotation: Hit_ID=Q2QNV4; Match level="QueryCoverage=94%, HitCoverage=60%, E-value=1e-106, Identity=29%"; Hit description =Pentatricopeptide, putative, expressed
  Pfam annotation: Domain name=PPR; Domain location=143-177; Score =14.2; E_value=0.16; Accession=PF01535.11; Description=PPR repeat
  Pfam annotation: Domain name=PPR; Domain location=276-310; Score =40.5; E_value=5.6e-09; Accession=PF01535.11; Description=PPR repeat
  Pfam annotation: Domain name=PPR; Domain location=376-410; Score =18.4; E_value=0.026; Accession=PF01535.11; Description=PPR repeat
  Pfam annotation: Domain name=PPR; Domain location=477-511; Score =40.2; E_value=7.3e-09; Accession=PF01535.11; Description=PPR repeat
  Pfam annotation: Domain name=PPR; Domain location=512-546; Score=6.2; E_value=1.4; Accession=PF01535.11; Description=PPR repeat
  Pfam annotation: Domain name=PPR; Domain location=578-612; Score =44.1; E_value=4.6e-10; Accession=PF01535.11; Description=PPR repeat
  Pfam annotation: Domain name=PPR; Domain location=613-647; Score =29.2; E_value=1.4e-05; Accession=PF01535.11; Description=PPR repeat
  Pfam annotation: Domain name=PPR; Domain location=648-681; Score=1.1; E_value=5.5; Accession=PF01535.11; Description=PPR repeat
  Pfam annotation: Domain name=PPR; Domain location=714-748; Score=3.0; E_value=3.3; Accession=PF01535.11; Description=PPR repeat
  Pfam annotation: Domain name=PPR; Domain location=76-110; Score=20.6; E_value=0.0054; Accession=PF01535.11; Description=PPR repeat
  Pfam module annotation: Pfam domain module=PPR::PPR::PPR::PPR::PPR::PP R::PPR::PPR::PPR::PPR; Domain location=143-177::276-310::376-410::477- 511::512-546::578-612::613-647::648-681::714-748::76-110
MVIRMSKAYDAGELILVSKHIRTLDSLLRFHALTVTSGHSTNLFMASKLISLYDSLNNDPSSCSTLFHSLPSKDTFLYNSFLKSLFSRSLFPRVLSLFSHMRASNLSPNHFTLPIVVSAAAHLTLLPHGASLHALASKTGLFHSSASFVSLYSRCGRMELARKVFDEIPKRDVVAWTALIIGHVHNGEPEKGLRCLRHVHGVVEDDEKPNAKTWEGGFLACGNLGAVSEGSCLHGVVVKNGVASFIQSSVLDMYSKCGVPREAYRSFCEVIHKDLLCWTSVIGVYARIGMMGECLRLFREMQENEIRPDGVVVGCVLSGFGNSMDVFQGKAFHGVIIRRYYVDDEKVNDSLLFMYCKFGMLSLAERIFPLCQGSGDGWNFMVFGYGKVGENVKCVELFREMQWLGIHSETIGIASAIASCAQLGAVNLGRSIHCNVIKGFLDGKNISVTNSLVEMYGKCGKMTFAWRIFNTSETDVVSWNTLISSHVHIKQHEEAVNLFSKMVREDQKPNTATLVVVLSACSHLASLEKGERVHCYINESGFTLNLPLGTALIDMYAKCGQLQKSRMVFDSMMEKDVICWNAMISGYGMNGYAESALEIFQHMEESNVMPNGITFLSLLSACAHAGLVEEGKYMFARMKSYSVNPNLKHYTCMVDLLGRYGNVQEAEAMVLSMPISPDGGVWGALLGHCKTHNQIEMGIRIAKYAIDLEPENDGYYIIMANMYSFIGRWEEAENVRRTMKERCSMGKKAGWSLL

SEQ ID NO: 125972 - protein, 363 aa, Glycine max
  Coding DNA Sequence Number=SeqID_9194
  Gene Ontology: Mol. function=nucleoside-triphosphatase activity; Cellular component=mitochondrion; Biological process=protein metabolic process
  Homolog annotation: Hit_ID=Q9LLI0; Match level="QueryCoverage=96%, HitCoverage=34%, E-value=1e-144, Identity=77%"; Hit description=ClpB
  Pfam annotation: Domain name=Clp_N; Domain location=117-169; Score =60.7; E_value=4.9e-15; Accession=PF02861.11; Description=Clp amino terminal domain
  Pfam annotation: Domain name=Clp_N; Domain location=194-245; Score =57.3; E_value=5e-14; Accession=PF02861.11; Description=Clp amino terminal domain
  Pfam module annotation: Pfam domain module=Clp_N::Clp_N; Domain location=117-169::194-245
  Subcellular localization annotation: CTP_CleavageSite=39; ConfidenceScore=5.79e-01
MATRRTPTLTKSVFAAVTASRTSRSRSHSARRLFPAIPRASENSLSRSQIIDPTNVASAKFLSRSFTRTFHATNPSLRSAASSQVSIFVSHYFVNSDYAIVAQTDFTDMAWEGIVGAVDAARVSKQQIVESEHLMKALLEQKDGLARRIFTKAGLDNTSVLQATEDFIAKQPKVTGDTSGPVVGSHFSSLLDNSRKYKKEMGDEYVSVEHLLLAFHSDKRFGQQLFKNLQLSEKALKDAVQAVRGSQRVTDQNPEGKYEALDKYGNDLTELARRGKLDPVIGRDDEIRRCIQILSRRTKNNPVIIGEPGVGKTAIAEGLAQRIVRGDVPEPLMNRKWCQVSMQADYVKASEKGLIKLLNLVVS

SEQ ID NO: 125973 - protein, 35 aa, Glycine max
  Coding DNA Sequence Number=SeqID_9195
MPPKGSKSPKAIMACTSSFIHRFAATVLYKNGSYL

SEQ ID NO: 125974 - protein, 238 aa, Glycine max
  Coding DNA Sequence Number=SeqID_9196
MQSQGLALPPELEVGPLAACVSAKESCVDPLGKNPDSSDSDKCGLYIEENPPRLVALGRVLKVGVEEVRDADAPIPVPTEEVKLVGQTLNTFLAWPTHLVKCLSEQGAVGPAKPADRQDHEVDDPLYLMALTIPQLFLKPLQVMWDATMFGVFNEDFPLYIKHEDLSEIAHGGQCLSISIIQLWILHMTKTSMRAGNVDVYGFLEPQSIQRSGQSQFELESYMKNWMQNSKRDVYLGA

SEQ ID NO: 125975 - protein, 322 aa, Glycine max
  Coding DNA Sequence Number=SeqID_9197
  Homolog annotation: Hit_ID=Q1SXA5; Match level="QueryCoverage=46%, HitCoverage=71%, E-value=8e-71, Identity=83%"; Hit description=MIR
  Pfam annotation: Domain name=MIR; Domain location=196-322; Score= -8.7; E_value=0.00099; Accession=PF02815.9; Description=MIR domain
MSPYLSERVLKKFRCLQNIPSEPPDILHMRGAIRLLRSGSKRSIALQCKYLQSKAKQAFTECALSLSFDLGTNPNPLRTVASSGSQNLSRRKPSSSSSSSSQQTPGSTRIVYRESRIPSESDFPIWQQNWFIALLFVMALGFFALAIFLFLTLDSDIAPSSTASASASAASSEGVEVQVTYGTVLKLMHEKTKFRLHSHDVPYGSGSGQQSVTGFPNVDDSNSYWIVRPEPGTSAKQGDPIKSGTIIRLQHMRTRKWLHSHLHASPISGNLEENPNLTPGTIGRSGKTWKQDQRIRLQHIDTGGYLHSHDKKYSRIAGGQQE

SEQ ID NO: 125976 - protein, 35 aa, Glycine max
  Coding DNA Sequence Number=SeqID_9198
MAGADKELEEQLLEAGNKLVDPPSSVEELLALLEW

SEQ ID NO: 125977 - protein, 357 aa, Glycine max
  Coding DNA Sequence Number=SeqID_9199
  Gene Ontology: Cellular component=mitochondrion
  Homolog annotation: Hit_ID=Q1RSU0; Match level="QueryCoverage=98%, HitCoverage=32%, E-value=1e-100, Identity=57%"; Hit description=Tudor
MQVESCLSRVEQSPTDSMQNALSPSLKALIAEKLLRHSDDDVKIAVASCISEITRITAPEAPYDDDQMKEVFQLIVSSFENLHDKLSQTYPKRISILETVAKVRSCVVMLDLECDVLILEMFQHFLKAISCALVTCWSWVRIRKQPLCICKGKAAYNIPPPYLRIAKSLWAMGEHHPENVFSSMETIMTLVLEESEDISLDLLSPLLASIKKDNKEVFPIAQKLGERVLESCATKLKPYLVQSVKSLGISVDDYSAVLASICQDTSDDLEKNDTCVTSEHVEDKSESAKQSLEESTHVVKKDSREVTSSQQENPDDVNKSPKSVMSNGVACVGEDNALADSESIKKKEDADCSNHSD

SEQ ID NO: 125978 - protein, 506 aa, Glycine max
  Coding DNA Sequence Number=SeqID_9200
  Homolog annotation: Hit_ID=Q1RSU0; Match level="QueryCoverage=99%, HitCoverage=51%, E-value=5e-77, Identity=41%"; Hit description=Tudor
MLDCESNCKIVHSSPHEDHSVEAAGPSENDKEIDANIMSPKACNDDSEIVASPPSESLCDENHSKKLGQSKKKDDPVKEGTAEDVSKVSASDSEAKPTRRSVKKALGQKSDVKKTSVVDSVKKGSGAANDADAKKHSAKKSDENKKGSGGSSSRQMEYKKKGGRGKANSEADVAKSSDVDKEMVSSPTSGTKSTKDGKSEETPKTNVKRKRTPGKENDSDVKEYGENLVGLRVKVWWPKDHEFYIGVIDSFDSAKKKHKVLYDDGDEETLNLVKEKWKVIEADSDADEEERSDRADLDVSTDMSLKKKGKASAGESTKQGKMDASSKSGGAAASNGSKGASTKSSQKAKDGNKSKGSKANSKSEDKVSRKSKDGTPKSGSSKSIVAAKKMSNKLKNTDTSKTSESKDDDSSKPKPSAKSKHETLKSGKSKQETPKAAISKGKPVKSGGKTDVNGTGKVKSGLLKRKHFENENSDVSAGEIEDSKGKTASSSKAQGSELKSRKRRKT

SEQ ID NO: 125979 - protein, 907 aa, Glycine max
  Coding DNA Sequence Number=SeqID_9201
  Gene Ontology: Cellular component=mitochondrion
  Homolog annotation: Hit_ID=Q1RSU0; Match level="QueryCoverage=74%, HitCoverage=75%, E-value=0.0, Identity=52%"; Hit description=Tudor
  Pfam annotation: Domain name=SMN; Domain location=556-786; Score= -123.5; E_value=0.059; Accession=PF06003.3; Description=Survival motor neuron protein (SMN)
MGSTDKELEEQLLEAGMYEIDDQVESCLSRVEQSPIDSMQNALSPSLKALIADKLLRHSDDDVKVAVASCISEITRITAPEAPYDDDQMKEVFQLIVSSFENLHDKLSQSYAKRTSILETVAKVRSCVVMLDLECDALILEMFQHFFKAISEHHPENVFSSMETIMTLVLEESEDISLDLLSPLLASIKKDNEEVFPIAQKLGERVLDSCATKLKPYLVQAVKSLGISVDDYSTVLASICQEDTSNDLEKNDICVTSEHVEDKSGSAKQSPEESTHVVKKDSSEVTPSLPENTDVNISPKSVMRNGVACIGEDNVLGDSKSIKKQEDADCSNHSEGLNISGHEVHNDLDTEKFDTSKQKPEQAIKRRRKKSSSSTKSAKPSKSHVAANEKETKKLIDYESNRKKVPSSSHEDHSVEEAGPPENDKEVDAKISSPKACNDESEVVASPPSDSFYDENHSKKLGRTKKKDRDAEGVSKVSGAASDSEAKPVRWSVKKALGQKSDVKKTNVVDSVTKGSGATNGADAKKHSAKKLDENKKGSGGPSSRQMEEKKKVRQGKANSETDVAKSSALDVDKEMVSSLRSGTKSTKNENSEETPKTNVKRKHSSGKENESNAKEYGQNLVGLRVKVWWPDDREFYKGVIDSFDSAKKKHKVLYDDGDEETLNLVKEKWKVIEADDSDADEEERSDRASLDASTDMIQMDMSCLLLYFVILFDAVAYMVCFPAVSLFGLYLHWHRSLILFRPPKKKGKRSAGESTKQGKMDASSRSSGAATSNRSKGASTKSSQKSKDGNKSKDSKTISKPEGEVSRKSKGGSSKSTVAAKKFSNKSKITDTSIESKDDDTGTPKPPAKSKHETPKSGKSKQETLKTALSKVKHLKSGGKTDVNGKSKVKSGSSKRKYSENENSDV

SEQ ID NO: 125980 - protein, 50 aa, Glycine max
  Coding DNA Sequence Number=SeqID_9202
MSASRKLNTGEKTVLSWMIETGTILQHEKVLCSLLTRCTCKEDYEDGDEL

SEQ ID NO: 125981 - protein, 266 aa, Glycine max
  Coding DNA Sequence Number=SeqID_9203
MDEFMAELERRNFHKRLTSLADNSTDLALVMEFYANLYSPEGPSPKQVRIRGHLIRIDADNLNVFSETPVVLAEGESLPAYSRYCRMPTDIKEIEVALCILGRGFILNAEGHPGKILRKYLTTLAQVWSVLAYSNLALTSHTSDLTVDRARLIFGLVTEQITSMAQSNSSKLGFPALITTLCRSRGVASDSLVFERLSPIINLAYIRKNYWNPDDPTIIIRGARRPRARPAEAPSTLAAPHPASTSGAPPPARMTIAPSILPPADF

SEQ ID NO: 125982 - protein, 61 aa, Glycine max
  Coding DNA Sequence Number=SeqID_9204
QEPVIEEPPAPSPSRAAAKEKTTPAQTPQPSPPSAPTPEETQLSGDDWMIVLIKFSVIRRK

SEQ ID NO: 125983 - protein, 45 aa, Glycine max
  Coding DNA Sequence Number=SeqID_9205
MEALAETCEADTSVFNMPILLAVALIGATVGGKVVRDSLYSYSCL

SEQ ID NO: 125984 - protein, 171 aa, Glycine max
  Coding DNA Sequence Number=SeqID_9206
MDNIEVPTFYHQQWTPEYPEFVNFRYDGTIYQIKLRQHREKVYFAEGLKEFRKDLSIYESVIIKFLACNSKSMFDLYFVPSLECQTCGRPEVMSRQHIWTLEITQSILGAPGPLWNVVVVDGGVGRRYVVQPWYQFLADNDFSHGDEVSFYYRTIDKIWEIVIRRRKNWEY

SEQ ID NO: 125985 - protein, 170 aa, Glycine max
  Coding DNA Sequence Number=SeqID_9207
  Gene Ontology: Mol. function=electron carrier activity; Biological process=electron transport
  Homolog annotation: Hit_ID=Q8Z9Y0; Match level="QueryCoverage=100%, HitCoverage=64%, E-value=7e-68, Identity=67%"; Hit description =Protein fdhE homolog
  Pfam annotation: Domain name=FdhE; Domain location=6-170; Score=-6.5; E_value=8.7e-10; Accession=PF04216.3; Description=Protein involved in formate dehydrogenase formation
MSIRIVPKEQLGAQREKSSTAENIPPLLFANLKSLRSSMRMHDNPLQLDLSEALAQGAASGKPPLDLSVFPRSEHWRKLLASLITELRPQAPEHILAVLDNLEKASAHELELMADALLNREFGKVGSEKAPFLWAALSLYWAQMASLIPGKARAEYGEQRQFCPVCGSIP

SEQ ID NO: 125986 - protein, 197 aa, Glycine max
  Coding DNA Sequence Number=SeqID_9208
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=100%, E-value=7e-26, Identity=28%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
FRDIRGLHVLAIRGLHVHTFKGPHVLTFRGLHVLAFRGLHVLAFRGLCILTFRGLHALSFRGLHALAFAFVGLHALTFRGLHVLTYRGLHVLTFRRLHAFAFRELYVLTFRGLRVLTFKGLHALAFRGLHILAIRGLHFLANRGLHVLTFRGLYVIAFRGLHVLTFRGLHGLAFRGLHVLAIRGLHILANRGLHLTF

SEQ ID NO: 125987 - protein, 104 aa, Glycine max
  Coding DNA Sequence Number=SeqID_9209
MANKNISSNETYPPTLIPKTIPKLLNSLRVGKGNIGSKGLSKELIQGRLIWLEAYKNKMPKSSPNMHVKQKVSTRVKPRLLCKQPMGQNTPNKIDDDGSNSHQG

SEQ ID NO: 125988 - protein, 62 aa, Glycine max
  Coding DNA Sequence Number=SeqID_9210
  Subcellular localization annotation: CTP_CleavageSite=38; ConfidenceScore=5.04e-01
MSISPSGSITWSVSFRHRDRARNTPSGPEEVQQGPGVSSSGYGPLSVLQGARPPQQVHAIMT

SEQ ID NO: 125989 - protein, 86 aa, Glycine max
  Coding DNA Sequence Number=SeqID_9211
MHILLSYDRSRIVLGDGQRACRPRLTKGAEDDIAKKNVYTDNHSGISAHQRDSNVSMTDLVSAVDDVNLRVSTGLSTADRGRTRIK

SEQ ID NO: 125990 - protein, 55 aa, Glycine max
  Coding DNA Sequence Number=SeqID_9212
MAFKLKSISVRLFPYKNHALMPLRHFTEHLAGARLGINSKRTGTMWHVPLLQNAL

SEQ ID NO: 125991 - protein, 91 aa, Glycine max
  Coding DNA Sequence Number=SeqID_9213
MSYRMSRHHASEHADYIWEYEQIKQGTIKVAHKTLKSQNSQNNSSIPDLVQNSCSLHVFIAVCVSGLQQLVLDEIYHSSEKSALKDLKDTV

SEQ ID NO: 125992 - protein, 95 aa, Glycine max
  Coding DNA Sequence Number=SeqID_9214
MAYNEEDMWQVFQKYGKVWEVYIAKRRNSSGHQFGFVRFRGAQNEKELRSLMDNIHIRNIKLNVNIPKHNKQKRLVELGKQNFHGAYKNGANWRG

SEQ ID NO: 125993 - protein, 80 aa, Glycine max
  Coding DNA Sequence Number=SeqID_9215
MGAKANLNSKHKKGKPSEKGGGNGRVVEDEEGDPTSGQHGDVGPPLPGDILGDKDVVVSLGVLSPIRVEPNTKCGKGCRN

SEQ ID NO: 125994 - protein, 157 aa, Glycine max
  Coding DNA Sequence Number=SeqID_9216
  Gene Ontology: Mol. function=RNA-directed DNA polymerase activity; Biological process=RNA-dependent DNA replication
MLEGVGVSKMGGFCVEEKGGGTSLKGLSTNGAWEEDPQIVKEEVRSYFKRPYSKEHWDRPNFKQISHEHKSFFSSIFKEEELKEVAFLKSSSMSVLVNGSPTNEFVMERGLQQGDPLALFLFTIVVEGLVGLIRQAKDLNPFQGFEVGRNKVEVNLL

SEQ ID NO: 125995 - protein, 182 aa, Glycine max
  Coding DNA Sequence Number=SeqID_9217
  Homolog annotation: Hit_ID=O24408; Match level="QueryCoverage=19%, HitCoverage=13%, E-value=4e-09, Identity=77%"; Hit description=Auxin- responsive protein IAA18
MNTYTKSLFKFIIFIFSLQIPNPHEIHSSIPTQDSKGVLNFDFKGSLNVALSLSSTIAPSDPLIPHDSSMVAYTMSNRGLAAPALSVMDPVGSDNVPGVTRAGFCISTTRKGFRCVTSSGSMENIGNKMEVETQRGSPAGRVCNKQEEEKAIMRLLDGSREYTLVYEDNEGDRMLVGDVPWQ

SEQ ID NO: 125996 - protein, 127 aa, Glycine max
  Coding DNA Sequence Number=SeqID_9218
  Gene Ontology: Mol. function=nucleic acid binding; Cellular component= oxygen evolving complex; Biological process=DNA integration
  Homolog annotation: Hit_ID=Q1S1X7; Match level="QueryCoverage=99%, HitCoverage=10%, E-value=3e-29, Identity=52%"; Hit description =Integrase, catalytic region; Zinc finger, CCHC-type; Peptidase aspartic, catalytic
MSCVPYARVLGTCICTRPNLAQAVNVVGKYMGNPRKEHWKVVKHIFRYLKRTTNIGLIYHGDTSCALAGYSDSDYVADLDVRRFVTRYTFMSRDSLISWKATLNPIMALSTIEAEYMALEKATKEGI

SEQ ID NO: 125997 - protein, 227 aa, Glycine max
  Coding DNA Sequence Number=SeqID_9219
  Gene Ontology: Mol. function=transcription factor activity; Cellular component=nucleus; Biological process=regulation of transcription, DNA-dependent
  Homolog annotation: Hit_ID=Q1S689; Match level="QueryCoverage=72%, HitCoverage=21%, E-value=4e-24, Identity=56%"; Hit description =Pathogenesis-related transcriptional factor and ERF
MLWKLGRIDGDSALRETRIRATWEYVSSVEGGQQGMVGLYVICGCGELFCTIALSSPSTTCDGYSSTTAREQWHTQHLSHKFRLHPMLSMDSASIDNSSSSNIVVYDGYGGGGGYNVIPMGTTTTVVASDGDQNPRSNHGFGDNEIKALGYESVYGSTTDPYHAHAMNLYYLTQQQPSSVDAVKASAYDQGSACNTWVPTAIPTHAPRSSTSMALCHGATPFSLLHE

SEQ ID NO: 125998 - protein, 137 aa, Glycine max
  Coding DNA Sequence Number=SeqID_9220
  Gene Ontology: Mol. function=ferrochelatase activity; Biological process=heme biosynthetic process
  Homolog annotation: Hit_ID=Q1SPB9; Match level="QueryCoverage=97%, HitCoverage=23%, E-value=3e-15, Identity=36%"; Hit description =Transposase
MNITAEYEHVHYAGKNPSRCGYVMRITQGLPCACELSKYVLGSIPLDSIHMFWRRLSFSDQGLSKPQATITEEMETISKRFDELDVCGKVTLKSKLQEIAYPDQNSMCPPPEKVNTKGAQKKPMNINQRSTKRDSSY

SEQ ID NO: 125999 - protein, 424 aa, Glycine max
  Coding DNA Sequence Number=SeqID_9221
  Gene Ontology: Mol. function=GTP diphosphokinase activity; Cellular component=intracellular; Biological process=guanosine tetraphosphate metabolic process
  Homolog annotation: Hit_ID=Q7WD02; Match level="QueryCoverage=99%, HitCoverage=54%, E-value=0.0, Identity=82%"; Hit description =Putative GTP pyrophosphokinase
  Pfam annotation: Domain name=RelA_SpoT; Domain location=118-228; Score=178.7; E_value=1.4e-50; Accession=PF04607.7; Description =Region found in RelA  SpoT proteins
  Pfam annotation: Domain name=TGS; Domain location=297-356; Score =100.0; E_value=6.9e-27; Accession=PF02824.11; Description=TGS domain
  Pfam annotation: Domain name=ThiS; Domain location=297-361; Score= -1.7; E_value=0.057; Accession=PF02597.10; Description=ThiS family
  Pfam module annotation: Pfam domain module=RelA_SpoT::TGS::ThiS; Domain location=118-228::297-356::297-361
MQRKMLLAMAADLRIVLMRLASRLRTLRWHAESKTPCSTAFARQTLDLYAPLANRLGIWQIKWEMEDLAFRFLEPDRYKQIARLLEEKRVEREAFIAGAIERLQTALAKHGIESEVSGRPKHIYSIWNKMRVKRLDFSQMYDLRALRIIVDDVRACYTALGLVHEMWTPLSDEFDDYISRPKPNGYRSLHTVVADDDGRPFEVQIRTREMHQFAEYGMAAHWRYKEAGAKGGQVAASSEYDRQLAWMRQLLAWNTDVEAGDGAAADKSDAAKPAAAKSGPGKSRHAAVTPAPTDERIYVLTPQARVIELPAGATPVDFAYHLHTDLGHRCRGARVDGQMVPLQTRLATGQTVEIISAKSGGPSRDWLNPQLGFLASPRARAKVRMWFNAIELQQRITQGQALVEKELQRLGKTAVNLEQLAQNL

SEQ ID NO: 126000 - protein, 88 aa, Glycine max
  Coding DNA Sequence Number=SeqID_9222
TNDAQDDDFLNSNDRVDLKIAPASDTGVSIGSHLKGAGVNYCDRSLTLSLQYFIECSMEDMMLLMIDGYSLESEPLPSSDLIETSRRR

SEQ ID NO: 126001 - protein, 107 aa, Glycine max
  Coding DNA Sequence Number=SeqID_9223
MDKPKRLSPREKTRGVATNVYMRKTLEKPKRGMRILRKRVRELFMHGEGISTPRAHHKGRQPLIESKLHDESRLIQRSFDDNKSDDKKLKGQEHLMITKIMISRIIE

SEQ ID NO: 126002 - protein, 47 aa, Glycine max
  Coding DNA Sequence Number=SeqID_9224
MGLWDDERVLFFQKMKMFIEFSVEALEVDFEISGMIIRFWCLLGKDK

SEQ ID NO: 126003 - protein, 396 aa, Glycine max
  Coding DNA Sequence Number=SeqID_9225
  Gene Ontology: Mol. function=two-component response regulator activity; Cellular component=endoplasmic reticulum; Biological process=two-component signal transduction system (phosphorelay)
  Homolog annotation: Hit_ID=Q949H5; Match level="QueryCoverage=94%, HitCoverage=49%, E-value=1e-163, Identity=78%"; Hit description =Ethylene receptor
  Pfam annotation: Domain name=GAF; Domain location=186-332; Score =42.7; E_value=1.2e-09; Accession=PF01590.16; Description=GAF domain
MLKAVSFELLLICLLLLRTCVCATTDNGFPRCNCDDESSLWTIETILECQRIGDFLIAVAYFSIPIELLYFVSCSNFPFKWVLFQFIAFIVLCGMTHLLNGWTYGPHTFQLMVALTVFKILTALVSCATTITLLTLIPMLLKVKVRELMLKKKTWDLGREVGIIMKQKEAAMHVRMLTQEIRKSLDRHKILYTTLVELSKTLGLQNCAVWMPNVEKTEMNLTHELNGRNVNCSIPITNPDVVRIKGSDEVNIIDSDSILATASSGVYGGAGPVAAIRMPMLQVCNFKGGTPELRQTCYAILVLTLPSAEPRSWGAQELEIIKVVADQVAVALSHASILEESQLMREKLEEQNRALQMEKMNTMMASQARASFQKVTSNGMRRPMHSILGLLSMMYG

SEQ ID NO: 126004 - protein, 302 aa, Glycine max
  Coding DNA Sequence Number=SeqID_9226
  Gene Ontology: Mol. function=nucleic acid binding; Biological process= DNA integration
  Homolog annotation: Hit_ID=Q1SA33; Match level="QueryCoverage=49%, HitCoverage=19%, E-value=4e-36, Identity=44%"; Hit description =Integrase, catalytic region
MLCQDFSKLMQKEFEMSMMEEQKLFLGLQIKQTPKGIYIHQTKYVKELLKNFNMGDAKEMKTSMHPTTYLGLDKESTKVGKTWYRAMIDSLLYLIVYRPNIKFGVYLCARFQKEPREFHITTVKCGNLITWIYKKQGSTALSTVEAKYMLASKVPLQNLNTSKLLALLTTLKHFNFLSKIQTPLKLSAMATSISSTTKIIPTMEITTIHIDNEPSIHIKHFFDIQELEKVSLKLNETLLFCGAKHFFNEPQTIYLELIRTLWRHVKFVNRKMIASKVLGVKVVLSSDTIAKATGCLCEGNIY

SEQ ID NO: 126005 - protein, 195 aa, Glycine max
  Coding DNA Sequence Number=SeqID_9227
MKHDYENTPSKAFKALPTDAIVHLPPLQWTHLVHLWNPITKLLLVHPVDLNLSQEDRSSLGKLHEQMHLKDQAIAYPLGLHILRATDIKMVADKMSQRLPIWDAAKKKGFKLYYNKEMPSIKMKAEEEEEASVAAMKEDVASIQAKASTKVVDDTIVCGVIIDLTNTGVMDITLEASNVAIADEVEHDTLESASK

SEQ ID NO: 126006 - protein, 195 aa, Glycine max
  Coding DNA Sequence Number=SeqID_9228
  Gene Ontology: Mol. function=two-component response regulator activity; Cellular component=endoplasmic reticulum; Biological process=two-component signal transduction system (phosphorelay)
  Homolog annotation: Hit_ID=Q949H5; Match level="QueryCoverage=92%, HitCoverage=23%, E-value=5e-61, Identity=64%"; Hit description =Ethylene receptor
  Pfam annotation: Domain name=Response_reg; Domain location=70-185; Score=85.6; E_value=1.5e-22; Accession=PF00072.14; Description =Response regulator receiver domain
  Subcellular localization annotation: CTP_CleavageSite=50; ConfidenceScore=5.01e-01
MVILNWRVQFLQGSLRLMQGNIWLVPNAQGFPQVMALFLRFQLWRSIAVSNSEPGENSETSNSNSFFRGLQVLLADNDDVNRAVTQKLLQKLGCVVTSVSSGFECLNVIGPAGSSFQVILLDLHMPELDGFEVATRIPKFRSRNWPVIVALTASTDDLWERCMQIGMNGVIRKPVLLHGIASELRRIILQGNSVM

SEQ ID NO: 126007 - protein, 46 aa, Glycine max
  Coding DNA Sequence Number=SeqID_9229
MAPKYDLCGVHFQLDEIAYLQSNHVLPCRPSGITLDIKKSSYKKLS

SEQ ID NO: 126008 - protein, 127 aa, Glycine max
  Coding DNA Sequence Number=SeqID_9230
  Gene Ontology: Mol. function=RNA-directed DNA polymerase activity; Biological process=RNA-dependent DNA replication
  Homolog annotation: Hit_ID=Q1RVK7; Match level="QueryCoverage=82%, HitCoverage=15%, E-value=3e-23, Identity=50%"; Hit description=RNA -directed DNA polymerase
MAWNFREYSGVVEEPWKYHVVNLEKTLQHDNNQILFQEELLWCQKSIEQWVKLGHKNSAFFHAQTIMWRRRNKVHGLGLSNCTWSTNSTILQNKAFGFFKRLFSAGSSVAQEEFHVAHIPQLGEEAK

SEQ ID NO: 126009 - protein, 187 aa, Glycine max
  Coding DNA Sequence Number=SeqID_9231
MSTCEKLIRTSIIYSYCYSSKSKVDEMNGGGGGGEDGGGGGIRAKVGGGGCNNSSKHGHLSLLNVLKENDNKIEELSGDGILHGERELLILLTLSLVKGFHGHPYHILHLIPGNGDSKVSCSTSSAMATLDASRVMSMTPVLVRSMMTPHTMVSSTTLVDALAWIEATSSFIAATLASSSSSAFFFY

SEQ ID NO: 126010 - protein, 107 aa, Glycine max
  Coding DNA Sequence Number=SeqID_9232
MGGLASHCHERLCNCKGLMGREKDKEGWRWREGMTPKGEVSLNLRNLVLSATTVLSKKTIKHNSQAIGKAPLVALASAGNPHIDFLHRENERTAHPREDATDPEYSE

SEQ ID NO: 126011 - protein, 149 aa, Glycine max
  Coding DNA Sequence Number=SeqID_9233
  Gene Ontology: Mol. function=RNA-directed DNA polymerase activity; Biological process=RNA-dependent DNA replication
MISIRNFVELEARRGLVGEFWRVSRKNDSLLQQKSRCRWLKGGYGNSKYFHPLVNMRRLRSGVKGVMVDGQWVEDSGIVKICIMEFFKIRFKEEVCQRPTLDGVSLERLTEEGNSALCARFSKEKVWDCGGDKSPDQAISTSILSRNIG

SEQ ID NO: 126012 - protein, 124 aa, Glycine max
  Coding DNA Sequence Number=SeqID_9234
  Gene Ontology: Mol. function=oxidoreductase activity, acting on NADH or NADPH; Cellular component=mitochondrion; Biological process =mitochondrial electron transport, NADH to ubiquinone
  Homolog annotation: Hit_ID=Q42577; Match level="QueryCoverage=72%, HitCoverage=47%, E-value=3e-19, Identity=52%"; Hit description=NADH -ubiquinone oxidoreductase 20 kDa subunit, mitochondrial precursor
MQAILSIFQNVSASTESSDFESMVEKNKNKDSGSHLIGESVDNDQTDEAVKIVVGDAGVHHFNGTRWEAEGHGPNKVATSPIHQTVNLQHHELCQLRHVGRKGSTTRWKGKCERRELRRESEKA

SEQ ID NO: 126013 - protein, 76 aa, Glycine max
  Coding DNA Sequence Number=SeqID_9235
MRKVIFNGGSIQHRWKIGSWGLEVSVKASSVTFDKIKHGKADDRATVGVVGITNDSKGTLEVSSTKVDSKIVKDEK

SEQ ID NO: 126014 - protein, 146 aa, Glycine max
  Coding DNA Sequence Number=SeqID_9236
  Homolog annotation: Hit_ID=Q39008; Match level="QueryCoverage=30%, HitCoverage=7%, E-value=2e-11, Identity=68%"; Hit description =Mitogen-activated protein kinase kinase kinase 1
MACRSKSRKSEIREGGVNDSVASVGDVIFVKLRGSSWLLMKIVLIRMLNQENGPNDCQETSLLGSMEAMHILVKDSLLQEINETFNFNSSWDIKCANILVDVSGQVKLASFELEKAMKFNDVKSSKGSPYWMSPKVCPCSCIICLE

SEQ ID NO: 126015 - protein, 115 aa, Glycine max
  Coding DNA Sequence Number=SeqID_9237
MGRSLVEVKRISGYDLAWWKDPVVVCGVGRDSWFDKNVAWKQILEGTHEFGEKEMWVGEMGSWDNGVWSKELVWKRPWFTWELPMVESFMADLHRISRDHQEMDCLVWKTASIGP

SEQ ID NO: 126016 - protein, 130 aa, Glycine max
  Coding DNA Sequence Number=SeqID_9238
WRLQSSFFLLHSASIDIKEAKDSIDEEDPRPTSSTWSYIKSSLEFCLQANITLAKGNSNLKEHVLVLEVEMKALETRVLDVEASIKTNKEEVDSGEPTTPFGETQMTNLRKEDGDKDDEVHREEEGNRGL

SEQ ID NO: 126017 - protein, 67 aa, Glycine max
  Coding DNA Sequence Number=SeqID_9239
MWYIKNLSTGIHVVKSHMHVNNGDDNSDINVGGGDSGGSDSNNYGGDSNNNDYDNDGVAMIATVLTP

SEQ ID NO: 126018 - protein, 113 aa, Glycine max
  Coding DNA Sequence Number=SeqID_9240
MGGWGLMERWISLLHYGGETRDKCVVRSAWIGGSKDWGWMGSEVDEILRRVWDLEIPLKTQFMMLRLLLDRLPTKVNLIKEQLKDQSKNNSSESRPIQDLKNQDQDSRLKIQE

SEQ ID NO: 126019 - protein, 336 aa, Glycine max
  Coding DNA Sequence Number=SeqID_9241
  Gene Ontology: Mol. function=DNA binding
  Homolog annotation: Hit_ID=Q6K709; Match level="QueryCoverage=72%, HitCoverage=83%, E-value=2e-46, Identity=47%"; Hit description=DNA -binding protein-like
  Pfam annotation: Domain name=DUF296; Domain location=134-251; Score =201.4; E_value=2.1e-57; Accession=PF03479.5; Description=Domain of unknown function (DUF296)
MCSYYVRSWIQELPLFVNFFLRPICERVRKYRPSSTQSKAGKTSELTQIFSWVDPATNSPSSTLNKRQMDLSINERSLVRERQEEDEEDERDNGDEPKEGAVEVGTRRPRGRPPGSKNKPKPPIFVTRDSPNSLRSHVMEVAGGADVAESVAQFARRRQRGVCVLSGSGAVANVTLRQPSAPGAVVALHGRFEILSLTGTFLPGPAPPGATGLTVYLGGGQGQVVGGSVVGSLVAAGPVMVIAATFANATYERLPLEEEEDDGGASAHGGSTLGGSPPGMGNSGGNGDNSGGGHLSSGGIPDPSSLALYNLPPNLIPNGGHHEAFAWAHGHGRPPY

SEQ ID NO: 126020 - protein, 127 aa, Glycine max
  Coding DNA Sequence Number=SeqID_9242
MGVLLILNVAPSQLHPNGWTAFQALQALCLYTYVKATPARFFIILLSVTQEGVVGIMAQGGGKMATFRLTHENRVPSYADNTIPVPLVNQTLDLRNPLEDIIPFGSKEPKGKDKHKNKKWSQDHKSG

SEQ ID NO: 126021 - protein, 118 aa, Glycine max
  Coding DNA Sequence Number=SeqID_9243
MVSTKVSLREIEGLGFEVQGFNEEVLEKRIHLLMIMGSLSTFSAFLNQLLKSVAVNIGEIPDIGITAAYEISRPLSQEAKEANVGSHDPSVQVVLQKCQHVLMEKKMCPLLPFWATNG

SEQ ID NO: 126022 - protein, 97 aa, Glycine max
  Coding DNA Sequence Number=SeqID_9244
MEGWRSLRNAMDFHRFRSLPRGSNPSFITLIPKRLKSVLHAVIDGRQGVFLWRSMLDGVIIANEVVEEAKKKKKNEEDAIAAQKNEAAEKGLRKTEE

SEQ ID NO: 126023 - protein, 38 aa, Glycine max
  Coding DNA Sequence Number=SeqID_9245
MASIKFDVVAGEQCPKCFAMDLTTTFVERENRVVVKIP

SEQ ID NO: 126024 - protein, 74 aa, Glycine max
  Coding DNA Sequence Number=SeqID_9246
MDEDQWMHEGIMPKEVDMDENEEECGVNEPHVDCSDAFNTSQVFDNRDDVLRLARSVTYENGFVTVILRSDTKT

SEQ ID NO: 126025 - protein, 191 aa, Glycine max
  Coding DNA Sequence Number=SeqID_9247
  Gene Ontology: Mol. function=chitin binding; Cellular component =extracellular region; Biological process=chitin metabolic process
  Homolog annotation: Hit_ID=UPI00006A17C9; Match level="QueryCoverage =70%, HitCoverage=98%, E-value=9e-10, Identity=30%"; Hit description =UPI00006A17C9 related cluster
  Subcellular localization annotation: CTP_CleavageSite=27; ConfidenceScore=5.07e-01
MLLSSNVIYICVRVVMLVRMIRTRLFAAARVKSCPGMHSSCVTASLSGCARTIGPPPISGGGLGTMWSTLKMRTRSPLKVRACSPLMVRMCSPLKARACSPLNGEDKQSFGGRACSPLKARTCNPLMVRACSPLKARTCSPLEVRACSPLMVRTCSPLKARTCSPLNGEGRVVLSRRGRVVLSTVRVTSTQ

SEQ ID NO: 126026 - protein, 148 aa, Glycine max
  Coding DNA Sequence Number=SeqID_9248
MDFFSDESFKCIQVFQNSNLISFMSLKLPVYSELVKAFYSNLEIQESTLIFEVYGIKMVIDQSLFYDLTQLPSEGVPFEGTLDDDWKFDFSVHDARRLVCTNQADMTGRLLADSLALESHILHYLIVRILLSRSSNLAQVSEEDLIVM

SEQ ID NO: 126027 - protein, 74 aa, Glycine max
  Coding DNA Sequence Number=SeqID_9249
MTVATFCKGLHVGPFDESLVQQKSETMANIRSCASCHVEVVKATVNKTIMEKKEENLAPSSKSHQKDYLKPRIN

SEQ ID NO: 126028 - protein, 157 aa, Glycine max
  Coding DNA Sequence Number=SeqID_9250
MGTRGCISYNLVLAIRQHGYPMRRAPLEEELAPAISRGFMVQKKDKELRGSNNGPIGGYREWLKAHVQGLDWLPSLRTAKREEVEAPEEDEEVQALRTELEQAQTVKERFKSAALKIRKENAELRDINMATARALEQETKRALKEDHGRDKFCGALW

SEQ ID NO: 126029 - protein, 289 aa, Glycine max
  Coding DNA Sequence Number=SeqID_9251
  Gene Ontology: Mol. function=DNA binding
  Homolog annotation: Hit_ID=Q1SWX1; Match level="QueryCoverage=53%, HitCoverage=34%, E-value=7e-13, Identity=29%"; Hit description=IMP dehydrogenase/GMP reductase
MGQLQRQAFCKAYGKIWDLARVEVSTESIASLAQYYDHPLRCFTFGDFQLSPMVEEFEEILGCPLGGRKPYLFSGFYPSLARISKKGPNLGAGIRPPKASRKWGGRNTEKIFGVLFPNVDGLVDLAAIDVFLTYHNHKESPVVAMLADLYDTFDRRCEESNARIVCCTPRRKGELGPTGKADNPHKKKLRTYLGIVARDKVDVTYENWKQVPVAQKYLIWKDIQAEFDIPKASDSDLTLKWALAADKDSVDDTVYEKYGINKEKWAQFCQSLRDPSWEDVRKKAQAIQK

SEQ ID NO: 126030 - protein, 251 aa, Glycine max
  Coding DNA Sequence Number=SeqID_9252
  Gene Ontology: Mol. function=protein binding; Cellular component =integral to membrane; Biological process=protein amino acid phosphorylation
  Homolog annotation: Hit_ID=Q4G2V8; Match level="QueryCoverage=82%, HitCoverage=82%, E-value=7e-45, Identity=40%"; Hit description=Hcr2 -p3
MKSKLTKLPMEAGIGPVSSFKNIYNSLSFDKFPMVKGMDPESLFLKRCMESKLTKLPMEAGIGLVSSFKDIYNPLSFDKFPMVKGMDPESLFSSRNKESKWTKLPMEAGIGPMSSLKDIDNTLSFDKFPMVKGMDPESLFRSRSIKSKLTKLPMEAGIGPSKLTKLLMETGIGPVSSLKDIDNTLSFDKFPMVKGMIPERSLLDFHFNKAFASEAISEEAANAQKYITRSSKSGWSFMDRSVGIMNTMRKF

SEQ ID NO: 126031 - protein, 179 aa, Glycine max
  Coding DNA Sequence Number=SeqID_9253
GTLVDDWKLDYSSHDARRIVCNDQADMTDKLLAGSFTFNCCIMHYIIVRILLPRSSNFAQAYEEDLILLCALQTGRQIDWAHLVQYRMHKALRANAPLPYPHLVTLFLHHFNVPLDDEPYVKVKRSFSIGAGADLPPPIPDERTPPPPPQRDDSTSLLNEVLTELCNLRAFVGERFDAM

SEQ ID NO: 126032 - protein, 152 aa, Glycine max
  Coding DNA Sequence Number=SeqID_9254
  Homolog annotation: Hit_ID=P00722; Match level="QueryCoverage=25%, HitCoverage=3%, E-value=2e-11, Identity=95%"; Hit description=Beta -galactosidase
MRRYRARPIRHSGCATVGRAIGAGLFAITPAGERGMCCKAIKLGNARGELELHRGGGRSRTSGSPGLQEFDLSSSRNSSARPRAPHLFLDLLISSRSSSASPRAHRLFYNMNYEWLNPFKRYVGSLVYKAQLPGQSELLISLPSSLAHSHAP

SEQ ID NO: 126033 - protein, 179 aa, Glycine max
  Coding DNA Sequence Number=SeqID_9255
  Homolog annotation: Hit_ID=Q1SP02; Match level="QueryCoverage=71%, HitCoverage=28%, E-value=4e-10, Identity=33%"; Hit description=IMP dehydrogenase/GMP reductase
MPMDCYEGNCEVHIYSEVQAASGSTQDSCWMPFREHRVIREFDMISCFSGQLCWGPVAVRHRLERVMRQFGYVQSIPARPVDSWVSFEEIDDGRMHYSDHLAPAGEICLVPSQCAPEYMDWFFVISHPLTITAQPSDLPQDPPATHDASFIEPYIPQVPELVATSIHARSNVDEPRHAV

SEQ ID NO: 126034 - protein, 129 aa, Glycine max
  Coding DNA Sequence Number=SeqID_9256
YGKTGNYKQYPPLQRHAFVKWWSQFDTSKAAPDQVKNWFQSNPEFLKPADPETSLFLNQKSQLAAFLASSKSKESLAQNLKEVLQLLQQEVEEEPSKKEAESSETNDDQEDDPFYQNEDDCFGISLDDD

SEQ ID NO: 126035 - protein, 93 aa, Glycine max
  Coding DNA Sequence Number=SeqID_9257
  Subcellular localization annotation: CTP_CleavageSite=48; ConfidenceScore=5.02e-01
MDGARLVYGLVIGMDMNIGSLISGQITIMAQSNSSRLGFPALITALCRSRGVGSDALTSYRSLRPGQGKLGPKQLVFPLLQHQQPHLPKAPRL

SEQ ID NO: 126036 - protein, 46 aa, Glycine max
  Coding DNA Sequence Number=SeqID_9258
MVHNMPLLHGQVKDVVEEIIHANALVPVPNDQHPVPPAKPPYTTDP

SEQ ID NO: 126037 - protein, 93 aa, Glycine max
  Coding DNA Sequence Number=SeqID_9259
WATGDGGFMRALWMWKNLLCTIARPPPSTTCDGVVPGDMSRGSGDLGDVRRAPGSQQIKGKQDHKARRLVVAGRLLENEVRKLRKPLVIDYQG

SEQ ID NO: 126038 - protein, 89 aa, Glycine max
  Coding DNA Sequence Number=SeqID_9260
  Homolog annotation: Hit_ID=Q1S1X7; Match level="QueryCoverage=63%, HitCoverage=4%, E-value=7e-07, Identity=49%"; Hit description =Integrase, catalytic region; Zinc finger, CCHC-type; Peptidase aspartic, catalytic
MEHMDVKTTFLHDDLEEQTYMEQSDRFIKGGLGRLVFSKEKVLDKFNMSNVNLVSTLLEKNFKLSVDQCLKTDAELKYMSKVPHANAVG

SEQ ID NO: 126039 - protein, 63 aa, Glycine max
  Coding DNA Sequence Number=SeqID_9261
FGLGGVAREGCGNHTLMFGSKVLYHVMELASPWEVWKKLESKYMSKSLTDKLYLKHKLYGLKM

SEQ ID NO: 126040 - protein, 325 aa, Glycine max
  Coding DNA Sequence Number=SeqID_9262
  Gene Ontology: Mol. function=nucleic acid binding; Cellular component= intracellular; Biological process=DNA integration
  Homolog annotation: Hit_ID=Q1S9T9; Match level="QueryCoverage=80%, HitCoverage=25%, E-value=1e-30, Identity=30%"; Hit description =Peptidase S8 and S53, subtilisin, kexin, sedolisin; Integrase, catalytic region; Zinc finger, CCHC-type
  Pfam annotation: Domain name=zf-CCHC; Domain location=72-89; Score =33.1; E_value=1e-06; Accession=PF00098.13; Description=Zinc knuckle
MALINAFNQIINDLAHLDVKATLMSHSQWRQNAAGGEDLYVKEKKEHGRTQGKSFGGRMRKNSKSREHKKTMECYKCNQKGHLKRDCPKLKKFGEGTSRSANVAEIDNSNYYTEGDVYYSKGYVLTGSCSNFGSVYMGNNKTCAIVGMGQVQIAMDDDGANGFIYKTDGDRNTLRVCNGTLIVMKAQQTIRNIYRLLGCRDISRVAFDEFDDDATRLWHLRMGHLSEHGMTKLHKRGLLKGVQSCKLDLCEYCGPTRDLSLGGSHDFVTFIDDLSRKVEVKNKTGRKIWYLRSDNGVKGFKFWDPISKNIVMSRDAMFDEKSMLP

SEQ ID NO: 126041 - protein, 568 aa, Glycine max
  Coding DNA Sequence Number=SeqID_9263
  Gene Ontology: Mol. function=RNA-directed DNA polymerase activity; Cellular component=chromatin; Biological process=chromatin assembly or disassembly
  Pfam annotation: Domain name=Chromo; Domain location=440-484; Score =16.5; E_value=0.011; Accession=PF00385.14; Description='chromo' (CHRromatin Organisation MOdifier
  Pfam annotation: Domain name=rve; Domain location=162-318; Score =108.0; E_value=2.7e-29; Accession=PF00665.16; Description=Integrase core domain
  Pfam annotation: Domain name=zf-H2C2; Domain location=103-144; Score =15.0; E_value=0.0037; Accession=PF09337.1; Description=His(2)-Cys(2) zinc finger
  Pfam module annotation: Pfam domain module=Chromo::rve::zf-H2C2; Domain location=440-484::162-318::103-144
MGYDFPIQYRSSLLNRIADALSRVPEVDKGMVFWLSVPDFTIMDDLKRELAANQEFLNLRKELQEQPSQHLDFVYSYGLILQSGQIWLPNDLNFIPLLLHEFHSIPTGGHMGITKTLAQIQANFTWRSICEDVFHFVGRCPDCQATKYETQKSAGLLAPLSLPHRPLEDLPLDFIVGLPPYRGHTMILVVVDHFSKGIHSGLLPAQFSAYQVASVFLDIVAKHHGMPKSLVSDRDPLFICKFWQELFKISGTKLRFSSAYHPQFDGQTEVMNRIINQYLRAFVHNKPATWGKFLPWVEWSYNTSRNTSTGNSPFEVTFGKEPLTVLQYIQGSLLVDAVDTLLTSRETLFASLRKKLLKAQECMKHFADKHRRERYYGSFKIIKRIGPVAYRLLLPAGSRIHLVFHCSLLKPFLQDVDNQLAPLPLPPTTLDNQPVISSLAILSSRQEGPDEDMYLQVLVQWKGLHVDDTSWEDWATLKGTYHLKDKVIFDEVGNDRPSGSQAVHTERPKRRITTPRRFQDFGSLGLHFDDLGTVTSESREVEGAVTSPGDGEVMKRRAKAVVKGNVRI

SEQ ID NO: 126042 - protein, 284 aa, Glycine max
  Coding DNA Sequence Number=SeqID_9264
  Gene Ontology: Mol. function=RNA-directed DNA polymerase activity; Cellular component=chromatin; Biological process=chromatin assembly or disassembly
MPLTTISYKRLSSEELSMRHEKGLCFNCDERFTRGHHCASKLFIFIADDDELDPEIPLLEDSPSLPHDQDELPHPQISLHAISGHLAPETAYGGIYLNQEGSRAPVLGRVSCLTSWGCGLGSGSAMAQLRRVVQSNGVSALFHIRLTETKLPSNQITRTSTQFPDIDILLQQYAGLFQNPSALPPTRQINHTINLLLNSALLWVRPYRALNAITVKDRFPIPAIDELLDELGKACWFTKLDLLQGYRQILMQEEDVYKIAFHTYEGHYEFHVMPYGLCNAPSSF

SEQ ID NO: 126043 - protein, 604 aa, Glycine max
  Coding DNA Sequence Number=SeqID_9265
  Gene Ontology: Mol. function=asparagine synthase (glutamine -hydrolyzing) activity; Cellular component=cytoplasm; Biological process=asparagine biosynthetic process
  Homolog annotation: Hit_ID=P93168; Match level="QueryCoverage=96%, HitCoverage=95%, E-value=0.0, Identity=87%"; Hit description =Asparagine synthetase 1
  Pfam annotation: Domain name=Asn_synthase; Domain location=206-475; Score=316.3; E_value=5.5e-92; Accession=PF00733.11; Description =Asparagine synthase
  Pfam annotation: Domain name=GATase_2; Domain location=7-158; Score =72.3; E_value=1.6e-18; Accession=PF00310.11; Description=Glutamine amidotransferases class-II
  Pfam module annotation: Pfam domain module=Asn_synthase::GATase_2; Domain location=206-475::7-158
MWGPPCCEIIGNFVVENYNKRTNKLKHRGPDWSGLHQYGDNYLAHQRLAIVDPASGDQPLFNEDKTVVVTVNGEIYNHEELRKQLPNHTFRTGSDCDVIAHLYEEHGENFVDMLDGIFSFVLLDTRDNSFIVARDAIGVTSLYIGWGLDGSVWISSELKGLNDDCEHFESFPPGHLYSSKERAFRRWYNPPWFSEAIPSAPYDPLALRHAFEKAVVKRLMTDVPFGVLLSGGLDSSLVAAVTARYLAGTNAAKQWGTKLHSFCVGLEGAPDLKAAKEVADYIGTVHHEFHYTVQDGIDAIEDVIYHIETYDVTTIRASIPMFLMSRKIKSLGVKWVISGEGSDEIFGGYLYFHKAPNKEEFHQETCRKVFRVIMLLVKTKYKYGWIIQIKALHKYDCLRANKSTFAWGLEARVPFLDKDFIRVAMNIDPEYKMWFTTSSVQIKKEEGRIEKWVLRRAFDDEEHPYLPKHILYRQKEQFSDGVGYGWIDGLKAHAEKHVTDRMMLNAANIFPFNTPTTKEAYYYRMIFERFFPQNSARLSVPGGPSVACSTAKAVEWDAAWSNNLDPSGRAALGVHASAYGNQVKAVEPEKIIPKMEVSPLGVAI

SEQ ID NO: 126044 - protein, 48 aa, Glycine max
  Coding DNA Sequence Number=SeqID_9266
MVVILPEDNVVIWLCSLHNWPNNYLKGIINRDSVTVKEVNPWMLLDGS

SEQ ID NO: 126045 - protein, 90 aa, Glycine max
  Coding DNA Sequence Number=SeqID_9267
  Gene Ontology: Mol. function=protein serine/threonine kinase activity; Cellular component=integral to membrane; Biological process=protein amino acid phosphorylation
  Homolog annotation: Hit_ID=Q9MB88; Match level="QueryCoverage=96%, HitCoverage=10%, E-value=1e-26, Identity=64%"; Hit description=S18 S- locus receptor kinase
  Pfam annotation: Domain name=Pkinase_Tyr; Domain location=2-90; Score= -159.0; E_value=0.01; Accession=PF07714.7; Description=Protein tyrosine kinase
MGEGGFGSVYRGKLAHGQEIAVKRLSKTSKQGISELMNEVGLVAKLQHRNLVSVLGGCTQGEERMLVYEYMANSSLDHFIFGNTTNAKTL

SEQ ID NO: 126046 - protein, 169 aa, Glycine max
  Coding DNA Sequence Number=SeqID_9268
  Gene Ontology: Cellular component=integral to membrane; Biological process=phosphoenolpyruvate-dependent sugar phosphotransferase system
  Homolog annotation: Hit_ID=UPI0000196D5C; Match level="QueryCoverage =86%, HitCoverage=23%, E-value=2e-25, Identity=44%"; Hit description =nucleotide binding
MLGLVLRDNGFMDDSEDSFQELSNSSHQRFNILCSADKDGNISLGIFGIFPIRKVNMHNLTFPTSHDGSEMSNRISKASIHKVSLSKDLCRLIVRCSRELVNVGDDLSEIQMDGHNEHGLHCLALKTTIFWNRKNELHQGVKHISKVLSGAGKNLNVLSWTTSRCSNIY

SEQ ID NO: 126047 - protein, 99 aa, Glycine max
  Coding DNA Sequence Number=SeqID_9269
MTVPQEPSYERELPLHDRHLGGPLPHHPGPASLENRSFCDVGIDVVKKLLVFEVVLLSFFLFSSLVAEGLKLALNLLNNKDADEAFQAHINLRALLLDM

SEQ ID NO: 126048 - protein, 95 aa, Glycine max
  Coding DNA Sequence Number=SeqID_9270
MMDNQVTQVMIVTTLKNLSLFPTVMMKGDVSSIGASEWKRKRKRKCHFKEKMSLEEAHHHRRPWIRAWRKNEMNEGRGREEHEILCSRRALKSEI

SEQ ID NO: 126049 - protein, 140 aa, Glycine max
  Coding DNA Sequence Number=SeqID_9271
MVFDRCFIEGSIFFLLQTKCCTLVSPQDPMPKIVDFHHTENNNNNSSRYSPNTCAGKNNQVIGAIDPVTIVLFSSPNLFLLVWFLASVEQPSPGAQQCHNGTISLECSIDKQVETNNGLYKCVYTRRKVRKSCEGFSMPS

SEQ ID NO: 126050 - protein, 104 aa, Glycine max
  Coding DNA Sequence Number=SeqID_9272
MPISPYKSIDWSVPSRHRDRTHKAPSGPGEVQQGSGVSSSGYGPLSFLQGSAHKTPSGPGEVQQGPGVSSSSYGPLSFLQGSRPPNKGSRPQDTQWTRRSPTGS

SEQ ID NO: 126051 - protein, 53 aa, Glycine max
  Coding DNA Sequence Number=SeqID_9273
MKAYLDKYLQGTTTKGHQSKVTVVRNSGTRHDGALGFLCGGHGGAPSVPLRGS

SEQ ID NO: 126052 - protein, 98 aa, Glycine max
  Coding DNA Sequence Number=SeqID_9274
MKNIPDSRVIFTFEEVDKSGALAPTYPPSKWKSDLRSSLKRGESSDSLLLGRWSFKALDLKMIHFTWLEKLRRWTSNHLMRSTKAGLLLLRILQRRGN

SEQ ID NO: 126053 - protein, 133 aa, Glycine max
  Coding DNA Sequence Number=SeqID_9275
MLADQPNSGNNELKDMVTTFTSTMDDGVALHENLLNAPRNLFTTIMVTEEEEEPLPDNLLLMATMVTNENVDESKNTKMAEKLWWLMYIRGTKMMIRDFFIENIKVRDPVNLVQMATKLTQFATARALLLRPI

SEQ ID NO: 126054 - protein, 130 aa, Glycine max
  Coding DNA Sequence Number=SeqID_9276
  Gene Ontology: Mol. function=prephenate dehydrogenase (NADP+) activity; Biological process=tyrosine biosynthetic process
  Homolog annotation: Hit_ID=Q1RX89; Match level="QueryCoverage=99%, HitCoverage=65%, E-value=2e-49, Identity=67%"; Hit description =Prephenate dehydrogenase; NADP oxidoreductase, coenzyme F420- dependent
  Subcellular localization annotation: CTP_CleavageSite=63; ConfidenceScore=5.39e-01
MGWVQRTSKSEGSAWRRRFLGNSLTGSRSTKGVLRFKRWRGRVRSTRWVQMMEEHKRITSGCSSQRSWGLGKKVTPSCWAVREWSEREWARTVWPWRTRVWARNCPRLPKPTMAIYSFWASWNCWAILDS

SEQ ID NO: 126055 - protein, 86 aa, Glycine max
  Coding DNA Sequence Number=SeqID_9277
MGLFLKAHANRSSYWCVPSRRDTWQWCRQLQWRFAGLGLASLTSELRVGDCFAQTTCSRKRCRRAAFLQLKAPVLLAICAAVGSSQ

SEQ ID NO: 126056 - protein, 551 aa, Glycine max
  Coding DNA Sequence Number=SeqID_9278
  Gene Ontology: Mol. function=N-acetyltransferase activity; Biological process=metabolic process
  Homolog annotation: Hit_ID=UPI00001628AD; Match level="QueryCoverage =93%, HitCoverage=65%, E-value=3e-58, Identity=46%"; Hit description =DNA binding / N-acetyltransferase/ RNA binding / protein binding / zinc ion binding
  Pfam annotation: Domain name=Agenet; Domain location=23-103; Score =31.4; E_value=3.1e-06; Accession=PF05641.3; Description=Agenet domain
  Pfam annotation: Domain name=PHD; Domain location=521-551; Score =16.9; E_value=0.0012; Accession=PF00628.19; Description=PHD-finger
  Pfam module annotation: Pfam domain module=Agenet::PHD; Domain location=23-103::521-551
MEIVHNNYSPRNRKRKRGFSRKLGVNEKVEVRSVDLGFLGSWHPATVIQCEKLKRHVRYNNVLDDGGVNYLEEAVSVLEALDGDKECYSYSRGSIRPMPPLVEFERGDLKFGLCVDVNYEKAWWEGVIFDDHSDGMEKRSVFFPDLGDEMQVGIHQLRITQDWHEVTEEWEQRGNWVFLDLVEEQKRKSFVAVSAKQIWYDVRIKNGFEKIQEWTCNMKYLWRNLVMEVINDYLSLTINEVISVLNLQLFPPTISSSLVEDEVEDVPMFCPEAVEQYYRSYISNMSRADKKQWILKAKNHLLAEGWIFDYPPPTNKKRGIIYISPLKRRFSTLHAACRFCMGKSIFKLARSDMKHLNVSGMNEENVDQVWSRDLVYRSAGNRKRKRLENSKANIQKVSASSSLTNHKPLNVLSYLIDNSIILPRCKVYYKVKGRHRKVCTLADGKITRDGIKCNCCMGIYSFVGFENHASGNSTCRPSASIFLEDGRSLLDCLIKMMHDHKTMETSGKSFSGLSLVENDYICSVCHYGGELILCDKCPSSFHKTCLGLEVD

SEQ ID NO: 126057 - protein, 425 aa, Glycine max
  Coding DNA Sequence Number=SeqID_9279
  Gene Ontology: Mol. function=N-acetyltransferase activity; Biological process=metabolic process
  Homolog annotation: Hit_ID=UPI00001628AD; Match level="QueryCoverage =75%, HitCoverage=21%, E-value=3e-35, Identity=48%"; Hit description =DNA binding / N-acetyltransferase/ RNA binding / protein binding / zinc ion binding
MGMEEECGVGGGDGAGKKIYEGLHKLLGEPVSVGVDNLTWTLVKFIHPDRFEHDSSKSDLLAESYSKLHLAISVMHECFEPLKESLSNRDLVEDVIFSRWSELNRLNFQGFYTVLLERNEELISVATVRVYGKKVAEIPLVGTRLQYRRLGMCHILIEELEKVSLCGDSWSTGVPLKSLQQLVLEPMIRLGDWLKRVKWQRWISALEIPCIKSLPSGESKQRVPHMERQCKYCRSPYVVTRGSQKLKQLGVERLVLPAVPSVLETWTRSFGFAKMTNLERSQFLDYTFLDFQGAIMCQKLLTNNNPSPNPVLLTESQAKCDVSSGSCCANLSESSPVCELYQVEEIDLGGMMNHQMDTCAGKNNQVIGAIDPVEQPSPGDQQCQNGTTSLECSIDKQVETNNGLYKCVYTRRKVRKSCEGFSMPS

SEQ ID NO: 126058 - protein, 563 aa, Glycine max
  Coding DNA Sequence Number=SeqID_9280
MLSFNTDCERFVMHDDAPVHEEEISSDLGQASSDLMTSGQVLCSNLGSTSPVILPAATQSDETPSAPAELNLRLDDDNADRTGLVESITCKPVSLSLTDDAHPVGSSAKTSLDNLDDDDPYIHSDDLLQVLNDLELAHGDECSDHSEIKMSEAEPPNENPSKSLVNRDIGSPVEDPVSPSMEELNLNSGATLAHDKQSLFGLPTSEKETLYQNPFFPVIALESDKLQHSSGFAVGVSGHPVAIPFQFPIMVNESKGQYNYLLLDSNQIQNPLLTLPVASMGMPPQGFIVAPEGEVIQNSNPCAPIPSAAYAVLGHNSIPPQEKSTQPPYQLMMETTPDDKSLKQSMSNVVSMDRPPHGHAVASEGEMELNSNPGPTIPPAECAVSGHDSLSPQEKLTQPPSQLLMEHSSDDKTLLQFVTNVVSMNSSNSHIVSSEGEMEQSSNPDPPTPPVECAVPGPGHDFISSHENPTKPPSQLMSETSSEFKTLLQSISNVEGEQGLLPISFMSPPNMESMEPNQSFLPFEGGMEMSLDTSDNEPHQFNHSSQAFYPRIQIITSLFLFVH

SEQ ID NO: 126059 - protein, 65 aa, Glycine max
  Coding DNA Sequence Number=SeqID_9281
MQIAARIGAFRLDATPGSGVASFNGVLQELGLASQTGELRARRCRQLQWRFGWPKAPAPAVICVA

SEQ ID NO: 126060 - protein, 85 aa, Glycine max
  Coding DNA Sequence Number=SeqID_9282
MEKSHVIVANGGGSLTDNGFASEQRWWLEGRLWSRNRATLVAQRVAAKGGYETKKKKKEEEEEANEKNEGSWNGGKGKEDFGVGW

SEQ ID NO: 126061 - protein, 354 aa, Glycine max
  Coding DNA Sequence Number=SeqID_9283
  Gene Ontology: Mol. function=aspartic-type endopeptidase activity; Cellular component=lysosome; Biological process=lipid metabolic process
  Homolog annotation: Hit_ID=Q1SD40; Match level="QueryCoverage=96%, HitCoverage=63%, E-value=1e-101, Identity=55%"; Hit description =Peptidase A1, pepsin
  Pfam annotation: Domain name=Asp; Domain location=80-336; Score =165.9; E_value=1e-46; Accession=PF00026.14; Description=Eukaryotic aspartyl protease
  Pfam annotation: Domain name=SapB_2; Domain location=300-334; Score =45.1; E_value=2.4e-10; Accession=PF03489.7; Description=Saposin-like type B, region 2
  Pfam module annotation: Pfam domain module=Asp::SapB_2; Domain location=80-336::300-334
MGFKYLLVVMCVLVWFGSLSFATSNNGGLMRIGLKRRILDLQSLKAARIKETVHHKDLGGVNENCCDEDIVYLKNYLDAQYFGEISIGSPPQYFNVVFDTGSSNLWVPSSKCIFSEYLAKSLMAKDQFLDSSAKIMYKLGISSSKINLLLPILKEFAEITREGSLALAALPFDGILGLGFQDTSVGKVTPVWYNMLERGLISHKIFSLWLNQDPSEEMGGEIVFGGIDYRHFRGDHTYVPLSKKGYWQIDLGDILLANNSTGLCEGGCAAVVDSGTSLIAGPTSVVTQINHAIGAEGYVSFECKSIVHNYGDSIWESLITGLNPDIICSDIGLCSNIGFNIMEYTFLIFLILIL

SEQ ID NO: 126062 - protein, 116 aa, Glycine max
  Coding DNA Sequence Number=SeqID_9284
MAENNAALREGSLVIASLTTSTRARFLFSGANMVGSGTLYHKSSVTVGHVALWEKVATAVLGEIVDGDEEKRGEFERVVVQCELVIEPERNMFSAADVELAKGLAAGGSGWLWFPS

SEQ ID NO: 126063 - protein, 106 aa, Glycine max
  Coding DNA Sequence Number=SeqID_9285
MISILGTLGRLNEMRDVIEQMKEDSCECKDSVFVSVIKTYANVGLVDEADKVVRILWQYEAVIWLEDMISQGKLPEISVWNSLASLFCNSEKIKVSSETFSRLRSL

SEQ ID NO: 126064 - protein, 39 aa, Glycine max
  Coding DNA Sequence Number=SeqID_9286
  Homolog annotation: Hit_ID=O82667; Match level="QueryCoverage=87%, HitCoverage=5%, E-value=9e-07, Identity=71%"; Hit description=MAP3K alpha 1 protein kinase
MTNHQKSASNNLIRGANILVDPNGEIKLTDFGMAKHVTF

SEQ ID NO: 126065 - protein, 51 aa, Glycine max
  Coding DNA Sequence Number=SeqID_9287
MEDNALVLLFSKCRTGMRESITLLLFWPKNPKGKKREWSASKVKEVTTNPE

SEQ ID NO: 126066 - protein, 44 aa, Glycine max
  Coding DNA Sequence Number=SeqID_9288
MQSNPVLEAFGNAKTVRNDNSRVLGLGLCGWWQECIGLHLHKKL

SEQ ID NO: 126067 - protein, 47 aa, Glycine max
  Coding DNA Sequence Number=SeqID_9289
MVSNNWRPNQTSNPIMDISDWRGQIPTDSRQRIVNKMLIDYTYGKHL

SEQ ID NO: 126068 - protein, 112 aa, Glycine max
  Coding DNA Sequence Number=SeqID_9290
  Gene Ontology: Mol. function=unfolded protein binding; Cellular component=phagocytic vesicle; Biological process=protein folding
  Homolog annotation: Hit_ID=P27323; Match level="QueryCoverage=61%, HitCoverage=9%, E-value=3e-15, Identity=59%"; Hit description=Heat shock protein 81-1
MSSSLCWGHHKFICRILGSSIFVRAGSSYFLVYCAMHNVNNFNIKEMKRCPLRNKEDRLTSISVPHLRSASQANALPVIGETLVESIILLLCDLLRLCHPNGLMLVHQRAFM

SEQ ID NO: 126069 - protein, 95 aa, Glycine max
  Coding DNA Sequence Number=SeqID_9291
  Subcellular localization annotation: CTP_CleavageSite=39; ConfidenceScore=5.42e-01
MVVSNFFSLFLLLPHGSSQTLVSLAIFFFYVLCCGFRVMCCLVVGYGGRCSSVLTLPLLYFNLLSDLDSAIDEDTKVSLSLLTIHGIALDNFISF

SEQ ID NO: 126070 - protein, 208 aa, Glycine max
  Coding DNA Sequence Number=SeqID_9292
MVLKWVSFSIETVRQVERFHSNRRVPLVVEFQWRTMAVSGGYWWLWKERRRNGIFPKLLGLQGSKRTSEQCSRKRKHSSHSRHLLKDPNGQIMGKCLVKLQTKFLEELTIYIRVLQQTLTKFTIYSKQAILIVKNVCTFHEGTRLKEKVKRGTHTSTAHWGARGTGTTFEIVRLTSTRWHNHDLTNGTQQYQRNNLKVMSFVFEFKNA

SEQ ID NO: 126071 - protein, 68 aa, Glycine max
  Coding DNA Sequence Number=SeqID_9293
  Homolog annotation: Hit_ID=Q9ZUW3; Match level="QueryCoverage=98%, HitCoverage=7%, E-value=6e-13, Identity=48%"; Hit description =Putative selenium-binding protein
MITKYAQHGRAKKALMVFEGMQKQNLEVNAITFTGVISASTHVGLVDKVQYYFNVMINDHQIKPTMKH

SEQ ID NO: 126072 - protein, 66 aa, Glycine max
  Coding DNA Sequence Number=SeqID_9294
MTVADSIKIALPKTDNAKEFIGLVGERSQTADKSLAGTLMSTLITMKFDGSRTMHERVIEMTNIAT

SEQ ID NO: 126073 - protein, 153 aa, Glycine max
  Coding DNA Sequence Number=SeqID_9295
  Homolog annotation: Hit_ID=Q5CEG7; Match level="QueryCoverage=68%, HitCoverage=99%, E-value=8e-45, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFLR

SEQ ID NO: 126074 - protein, 38 aa, Glycine max
  Coding DNA Sequence Number=SeqID_9296
MEPAPMSKGFATDMLQRRILPYSSFCSIRGSSSPKRKY

SEQ ID NO: 126075 - protein, 47 aa, Glycine max
  Coding DNA Sequence Number=SeqID_9297
MANFLGLNKVNLGIKWMNEMNKVEDEMVEGKNHSFRRGQHTKDVKDL

SEQ ID NO: 126076 - protein, 99 aa, Glycine max
  Coding DNA Sequence Number=SeqID_9298
MKLNQKVGKKETNTQEFYTGSATTRAYIQSLNDLRSLRFIFNLVNSFTSKDPQGMYPSLFSLNNLVDVPSTRTDPQEMYPLLVPQRMYLQCVKTKISGG

SEQ ID NO: 126077 - protein, 86 aa, Glycine max
  Coding DNA Sequence Number=SeqID_9299
MHSIGVRNPLKQPPSTIYRRKRGEGCRPARPGKQGYRNFTEALRKPWMPFFNKMGEVAAAQLAQASSARPGELGCFHLKQKKSRIL

SEQ ID NO: 126078 - protein, 79 aa, Glycine max
  Coding DNA Sequence Number=SeqID_9300
MDPIHPASFNQVNCPVSDVVQSKHSFPPYGLSPNYTPPTVIYAYGENINNSAPVLIQNQQPQSNHAHVSQPMGETHEVP

SEQ ID NO: 126079 - protein, 131 aa, Glycine max
  Coding DNA Sequence Number=SeqID_9301
MDCPLCKLCSMECSICGVNEKSESPADKGTRSGICVDARGIAGVGMGGTGVVEEEGAVVFGVAEVVGTYVLLPLAFLDPLNVTVGSSRFQQFFLIYVKLMVGLKFSRDLESDWTSLALHRTVIKAGNPSLD

SEQ ID NO: 126080 - protein, 83 aa, Glycine max
  Coding DNA Sequence Number=SeqID_9302
MDKVDIFVPHPLTNACLLIQLSPECGCKPLVCLLKQPALLSVDFQDRSIRDYSSCTLVGSCELSRIGCRTYGLSYLEKKRGLN

SEQ ID NO: 126081 - protein, 264 aa, Glycine max
  Coding DNA Sequence Number=SeqID_9303
  Gene Ontology: Mol. function=transporter activity; Cellular component= integral to membrane; Biological process=transport
  Homolog annotation: Hit_ID=Q8U937; Match level="QueryCoverage=79%, HitCoverage=69%, E-value=1e-115, Identity=98%"; Hit description=ABC transporter, membrane spanning protein
  Subcellular localization annotation: CTP_CleavageSite=15; ConfidenceScore=5.21e-01
MKALPSSEMNSLSPRVVSKRNRPKRGLPPGERRSQNHMPTSKTAMVPKKAAVCHVHAIQRKAFGDVIAHEPDHQSAGYQRQHAGSGKQAPVHARGRNGARHRRGDRFCVRGGQRAGDQKLNPREHEAEEAGDADAGSNERHEDLHEEFRKGVAVNIGGLVDFLRHAGHETFENPNRQRHVEQAMRERHRNMRVDQPESGIKLKERQRKDRRWRHAVGQKPEEQVLVAEKTVTRKGIGRWQRDSHRDHHVHDDIDDRIDIAGIPG

SEQ ID NO: 126082 - protein, 100 aa, Glycine max
  Coding DNA Sequence Number=SeqID_9304
  Subcellular localization annotation: CTP_CleavageSite=34; ConfidenceScore=5.12e-01
MGTTTGEELATQLAQASSARPSELSSPKRAQLAQASQVASSRSNRLLEEESGRHTQRDCPYPKKEQSGGCLNDQTGHPKATGRVFTLNGAEALKSKDLIQ

SEQ ID NO: 126083 - protein, 187 aa, Glycine max
  Coding DNA Sequence Number=SeqID_9305
  Homolog annotation: Hit_ID=Q6CQF2; Match level="QueryCoverage=38%, HitCoverage=90%, E-value=2e-17, Identity=63%"; Hit description =Kluyveromyces lactis strain NRRL Y-1140 chromosome D of strain NRRL Y- 1140 of Kluyveromyces lactis
MPLIIGLLPDRTRPRAPAIPEGNFGGNQLLDGSISLFAPIPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISSTL

SEQ ID NO: 126084 - protein, 103 aa, Glycine max
  Coding DNA Sequence Number=SeqID_9306
  Gene Ontology: Mol. function=hydrolase activity
  Homolog annotation: Hit_ID=Q9LXI7; Match level="QueryCoverage=94%, HitCoverage=23%, E-value=1e-25, Identity=57%"; Hit description =Purple acid phosphatase
  Subcellular localization annotation: CTP_CleavageSite=37; ConfidenceScore=5.01e-01
MDGPKVHISQVGQNKMRISWITDSPTPAKVMYAPSPSGNTVSATGTTSSYRYLVYESGEIHNVVIGPLNPNTVYYYRLGDPPSSQTYNFKTPPSQLPIKFAIV

SEQ ID NO: 126085 - protein, 66 aa, Glycine max
  Coding DNA Sequence Number=SeqID_9307
VPLAGRFTSRMVFRSNEISVLSLLLFYLQYKTSKEGQLSYPNFVQGPSVVGMRPSFDHFEVFGTHR

SEQ ID NO: 126086 - protein, 190 aa, Glycine max
  Coding DNA Sequence Number=SeqID_9308
MSHHSSSVNGEGTSHKDPLSRILDELSSLKLWKEKIERKEKGKETVEINQDEREKIREEERRKILKELRKEKHATYSSHESCKSLSKELRDYYEGRHRLHLRPHSHRRKKERKPQEANINLPYFYGKDNVEAYLNWEIRVEQQFKRKSTLKSYGSYSYPKKDQGLGILGATPSKPKDDKGKTIEKQPPKA

SEQ ID NO: 126087 - protein, 121 aa, Glycine max
  Coding DNA Sequence Number=SeqID_9309
MAQSNSSRLGFPTFITALCMTIEVASDNLVFEHLSPIINLAYIRKNCWNHDDPTIIIRGARRPRERPAEAPSTSAAPHLASTSAAPPPARIATALSTLPPANFQRFEAMLRSIHQGKIILL

SEQ ID NO: 126088 - protein, 241 aa, Glycine max
  Coding DNA Sequence Number=SeqID_9310
  Gene Ontology: Mol. function=signal transducer activity; Cellular component=membrane; Biological process=regulation of transcription, DNA-dependent
  Homolog annotation: Hit_ID=UPI00005F7513; Match level="QueryCoverage =100%, HitCoverage=36%, E-value=3e-74, Identity=60%"; Hit description= COG2200: FOG: EAL domain
MLQLFREHWPRKQKALFFVHADLVEEVVFALGLHPFGDYPEGQRLRRRDDRAHQRLRYRVEIHPAHEAFIQLDGVQRNARQLRQRRIAGAEVVEMHLRAQFAQPGDQRARAVLVFNQATFGQLEVQQTGGHAVIAQHPEQVVDDAVIGQLTGREVDRHPQIQALFLPLRRLPGGGLQHPLAERADQAGLLGVGNELQRRDQAALRRIPAHQRFHAVHFTAARVDFRLVIQHQLILLQPFAQ

SEQ ID NO: 126089 - protein, 90 aa, Glycine max
  Coding DNA Sequence Number=SeqID_9311
MEEGYATALLLHWGRNVWSTWTSNILEGRSRLLLLLLRARPFEIRVIPPSGIVSVAGEVIIVLLWLILLLRLRRLLHRRAKVCMVVDRGA

SEQ ID NO: 126090 - protein, 159 aa, Glycine max
  Coding DNA Sequence Number=SeqID_9312
  Gene Ontology: Mol. function=pectinesterase activity; Cellular component=cell wall; Biological process=cell wall modification
  Homolog annotation: Hit_ID=Q8RVX1; Match level="QueryCoverage=62%, HitCoverage=17%, E-value=3e-32, Identity=83%"; Hit description =Pectin methylesterase precursor
MDKMLWSIAWGWGIHWFDKPPQFYSHLLCQDFPRVCHSRRCQRFCSIYETMDVINMLSCCGRWIYSSRHMIPKHSRPIEAPSSDSSCRRRPIHHKPIAVLMPSKTLSTPTLTGSSTKIPLSLARTVHFIFGNAVVVFQKCNLVARKTLSNQNNMATTQG

SEQ ID NO: 126091 - protein, 187 aa, Glycine max
  Coding DNA Sequence Number=SeqID_9313
  Gene Ontology: Mol. function=calcium ion binding; Cellular component =flagellin-based flagellum; Biological process=ciliary or flagellar motility
  Homolog annotation: Hit_ID=Q45W79; Match level="QueryCoverage=81%, HitCoverage=85%, E-value=8e-24, Identity=42%"; Hit description =Calcium-binding pollen allergen
  Pfam annotation: Domain name=Dockerin_1; Domain location=43-63; Score= 8.2; E_value=0.83; Accession=PF00404.9; Description=Dockerin type I repeat
  Pfam annotation: Domain name=Dockerin_1; Domain location=81-101; Score=6.7; E_value=1.4; Accession=PF00404.9; Description=Dockerin type I repeat
  Pfam annotation: Domain name=efhand; Domain location=119-147; Score =28.4; E_value=2.6e-05; Accession=PF00036.22; Description=EF hand
  Pfam annotation: Domain name=efhand; Domain location=156-184; Score =41.2; E_value=3.5e-09; Accession=PF00036.22; Description=EF hand
  Pfam annotation: Domain name=efhand; Domain location=34-62; Score =32.6; E_value=1.4e-06; Accession=PF00036.22; Description=EF hand
  Pfam annotation: Domain name=efhand; Domain location=72-100; Score =25.2; E_value=0.00023; Accession=PF00036.22; Description=EF hand
  Pfam module annotation: Pfam domain module=Dockerin_1::Dockerin _1::efhand::efhand::efhand::efhand; Domain location=43-63::81 -101::119-147::156-184::34-62::72-100
MMSACRKRRQSNRKFTSSSDLSTSSFLHMELSTQFHQVFKLIDTNGDGKISATELSEVLSCLGYNKCTADKEAEGMVRVLDFNGDGFVDLDELMIVMNGMEEEEEEEKFGSGMEHGGGYLMDAFLIFDTDKNGLISAKELQRVLINLGCDNCSLRECKRMIKGVDKNGDGFVDFEEFRSMMQSGLAN

SEQ ID NO: 126092 - protein, 139 aa, Glycine max
  Coding DNA Sequence Number=SeqID_9314
  Gene Ontology: Mol. function=GPI anchor binding; Cellular component =anchored to membrane
  Homolog annotation: Hit_ID=Q1T3K3; Match level="QueryCoverage=60%, HitCoverage=13%, E-value=1e-22, Identity=67%"; Hit description =Phytochelatin synthetase-like conserved region; Carbohydrate- binding
MELSKSGTEDPTKVMPFPIKAGKSVPSIRFPPLAEIRISSMNNLHVFACVENCCGGIEGPRLCRGLLHAREFFRSGEKVIGNENPDDERKWLSLSFINCWSKEIKFEERKQGCVVGKCRRSRVMEKEVRCMENRKMGEE

SEQ ID NO: 126093 - protein, 236 aa, Glycine max
  Coding DNA Sequence Number=SeqID_9315
  Gene Ontology: Mol. function=GPI anchor binding; Cellular component =anchored to membrane; Biological process=root hair cell differentiation
  Homolog annotation: Hit_ID=Q1T3K3; Match level="QueryCoverage=99%, HitCoverage=33%, E-value=1e-104, Identity=71%"; Hit description =Phytochelatin synthetase-like conserved region; Carbohydrate- binding
  Pfam annotation: Domain name=Phytochel_synth; Domain location=82-236; Score=274.2; E_value=2.6e-79; Accession=PF04833.5; Description =Phytochelatin synthetase-like conserv
MIQLIGTQFRVNPPTIPMPKTIKLVTDGYNCPQPTTRKDSMHACCKKDPKFKATLRKTKFFPRQKGDLTISYDVNQVYENNYMVEVTMENNHLLGRLDHWNLTWEWTRGEFIYSMKGAFTCVIEYSDCIYGAAGQYYKDMDFSKVVNCQKNPIVSDLPPEKANDTEIGKIPHCCKNGTILPIHMDPSKSKSVFQMQVFKVPPDLNKTAIYPPEKWKIMGILNPDYKSGAPIRVDPA

SEQ ID NO: 126094 - protein, 227 aa, Glycine max
  Coding DNA Sequence Number=SeqID_9316
  Gene Ontology: Mol. function=ARF guanyl-nucleotide exchange factor activity; Cellular component=intracellular; Biological process =regulation of ARF protein signal transduction
  Homolog annotation: Hit_ID=Q9LZX8; Match level="QueryCoverage=99%, HitCoverage=12%, E-value=2e-89, Identity=73%"; Hit description =Guanine nucleotide exchange factor-like protein
MAMKVLCLSKLSCSIFISLVSRFRAGLKAEIGVFFPMIVLRVLENVSQPNFQQKMTVLRFLDKLCVDSQILVDIFINYDCDVNSSNIFERMVNGLLKTAQGVPPGVMTTLLPPQEATLKLEAMKSLVAVLKSMGDWMNKQLRIPDPHSAKKVEATDNSPESGGFTMVNGNGEDPVDGSDSQSEVSNDASDVSTIEQRRAYKLELQEGISLFNRKPKKGIEFLINAKK

SEQ ID NO: 126095 - protein, 287 aa, Glycine max
  Coding DNA Sequence Number=SeqID_9317
  Gene Ontology: Mol. function=sequence-specific DNA binding; Cellular component=nucleus; Biological process=regulation of transcription, DNA-dependent
  Homolog annotation: Hit_ID=Q93V99; Match level="QueryCoverage=99%, HitCoverage=38%, E-value=1e-102, Identity=65%"; Hit description =Protodermal factor2
  Pfam annotation: Domain name=Homeobox; Domain location=58-114; Score =80.6; E_value=4.9e-21; Accession=PF00046.19; Description=Homeobox domain
MFDSHPHLLDMSPPHKTTCSESDLAKPCRDDEYETKSITDTMDAPSGDDQDPNPRPKKKGYRRHTQRQIEEMEAFFKQCPHPDDKQRKELSRELGLEPLQVKFWFQNKRTQMKTQHERNENAILKAENEKLRAENSRYKEALTNATCPNCGGPAALGEMSFDEQHLRIENARLREEIDRISGIAAKYVGKPVTSSYSNLSSLNNNHVPVGNYGSQSGTVGEMYGGSDLFRPLPAPADADKPMIVELAVAAMEELTRLAQAGEPLWVPSNHHSEILNEDEYLRTFPTR

SEQ ID NO: 126096 - protein, 414 aa, Glycine max
  Coding DNA Sequence Number=SeqID_9318
  Gene Ontology: Mol. function=sequence-specific DNA binding; Cellular component=nucleus; Biological process=regulation of transcription, DNA-dependent
  Homolog annotation: Hit_ID=Q38887; Match level="QueryCoverage=96%, HitCoverage=58%, E-value=0.0, Identity=78%"; Hit description =Meristem L1 layer homeobox protein
  Pfam annotation: Domain name=START; Domain location=1-153; Score =122.7; E_value=1e-33; Accession=PF01852.10; Description=START domain
MTLMGTGFQNQWSTVFCGIVSRALTLEVLSTGIAGNYNGALQVMSSEFQVASPLVPTRENYFVRYCKQQPDGIWAVVDVSLDNLRPSTISRSRRRPSGCLIQELPNGYSKVTWIEHVEVDDRAVHSIYRTLVNSGLAFGAKRWVATLERQCERLASSMANNIPAGDLCVITSAEGRKSMMKLAERMVMSYCTGVGASTAHAWTTLSATGCDDVRVMTRKSTDEPGRPPGIVLSAATSFWLPVPPKRVFHFLRDQNSRNEWDILSNGGLVQELAHIANGRDPGNCVSLLRVNSANSSQSNMLILQESCTDSTGSYVVYAPVDIVAMNVVLSGGDPDYVALLPSGFAILPDGPPALNGGPIHDVGSGGSLLTVAFQILVDSAPTAKLSLGSVATVNSLIKCTVERIKVAVIRDNTT

SEQ ID NO: 126097 - protein, 116 aa, Glycine max
  Coding DNA Sequence Number=SeqID_9319
MHFFYKAEAKSLFEINMLEDGDVDLNASPEALDKLLGYSLAFKVKASCKIHIPLPDFNDPSYYETVTAKSDVPVFSSYLLNAPINPYLQQQIMIRFSEPPLHQRSDRHFRDVTMKH

SEQ ID NO: 126098 - protein, 215 aa, Glycine max
  Coding DNA Sequence Number=SeqID_9320
  Gene Ontology: Mol. function=helicase activity
  Homolog annotation: Hit_ID=Q1SRJ5; Match level="QueryCoverage=92%, HitCoverage=23%, E-value=8e-56, Identity=51%"; Hit description =Probable helicase [imported]-Arabidopsis thaliana-related
MVHGPCEILRKESSCMKEGKYSRFYPKMFQPHTFLDVDGYPIYHKRDNGQTISKNGVIIDNIYIVPYNPKLLRKYQAYIDIEWCNQNTSIKYLFQYVNKGYDRVTVVIVDDENDASLHVASHHDEIKEYLDCIYISPCEATWRIFGFPIHGRKLAVERLHFHLPGQHAVFYQDHDDIDDVLSKPSIFDSKFISWMNTNKKKDIGNSGKNDTLLGG

SEQ ID NO: 126099 - protein, 138 aa, Glycine max
  Coding DNA Sequence Number=SeqID_9321
MTTLITMVVEMSVPMMSIVKVEDDSGDNATMTMMMIVKAIVLASDGGDGDNNGGDNNKMVVVVTTREKTTVKCRENFKCLEGKFMQKCEEKTFKKKLKIEIARLTCKTSSTVKCPCNVISEELGKDISTIHYQDRGIE

SEQ ID NO: 126100 - protein, 111 aa, Glycine max
  Coding DNA Sequence Number=SeqID_9322
  Gene Ontology: Mol. function=structural constituent of ribosome; Cellular component=ribonucleoprotein complex; Biological process =translation
  Homolog annotation: Hit_ID=Q9LX88; Match level="QueryCoverage=87%, HitCoverage=75%, E-value=4e-48, Identity=94%"; Hit description=40S ribosomal protein S15a-4
  Pfam annotation: Domain name=Ribosomal_S8; Domain location=5-111; Score=97.8; E_value=3.2e-26; Accession=PF00410.9; Description =Ribosomal protein S8
MVRVSVLNDALKSMYNAEKRGKRQVMIRPSSKVIIKFLLVMQKHGYIGEFEYVDDHRAGKIVVELNGRLNKCGVISPRFDVGVKEIEGWTARLLPSRQWTVVEGSGIGFLI

SEQ ID NO: 126101 - protein, 129 aa, Glycine max
  Coding DNA Sequence Number=SeqID_9323
MISRWVNKFKIRIIASFMRRNQEIQDSREIGFQDSREDEFKIQEKKSRRLHKGKGTSTWVVVIENKRGYISCGSVQVEGTSTWLFKETKGGYIPCGSLLVKVFIRLKRNPKDRWSLGDWMLARVVAEPV

SEQ ID NO: 126102 - protein, 129 aa, Glycine max
  Coding DNA Sequence Number=SeqID_9324
  Subcellular localization annotation: CTP_CleavageSite=40; ConfidenceScore=5.43e-01
MATDPTSPPQSDGQSEATSKRSRTTTRLRTLTLRTVDQPRPAVYVDPATGRASGPMREKFHSYLGVVAREKVPIIHNNWKDVPETLKEIVWNDILVSLPAIETYNIFMYTTLVSYLSSSPHHIMELLAD

SEQ ID NO: 126103 - protein, 208 aa, Glycine max
  Coding DNA Sequence Number=SeqID_9325
  Gene Ontology: Mol. function=nucleoside-triphosphatase activity; Cellular component=chloroplast
  Homolog annotation: Hit_ID=Q2PMM5; Match level="QueryCoverage=99%, HitCoverage=9%, E-value=1e-109, Identity=93%"; Hit description =Protein ycf2
MEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPFWGLFHLFHDRNSGRYTLHHDFESEEIFQEMADLFTLSITEPDLVYHKGFAFSIDSSGLGQKHFLNELFNSRDESKNHSLLVLPPLFL

SEQ ID NO: 126104 - protein, 37 aa, Glycine max
  Coding DNA Sequence Number=SeqID_9326
MDNFSNLLAKLHVEAKYCSMITTICELKWLKGILSII

SEQ ID NO: 126105 - protein, 474 aa, Glycine max
  Coding DNA Sequence Number=SeqID_9327
  Gene Ontology: Mol. function=oxidoreductase activity; Cellular component=integral to membrane; Biological process=electron transport
  Homolog annotation: Hit_ID=Q69F95; Match level="QueryCoverage=99%, HitCoverage=99%, E-value=0.0, Identity=90%"; Hit description =Cytochrome P450 85A
  Pfam annotation: Domain name=p450; Domain location=35-470; Score =108.1; E_value=2.6e-29; Accession=PF00067.12; Description=Cytochrome P450
MALFMAVLGVVALVLCFCSALLKWNELRYRRKGLPQGTMGWPVFGETTEFLKQGPSFMKNKRARYGSFFKSHILGCPTIVSMDPELNRYILMNEAKGLVPGYPQSMLDILGTRNIAAVHGSTHKYMRGALLSIISPTLIRDQLLPKIDEFMRTHLSDWDNKVINIQEKTKEMAFLSSLKQISGMESSSISQPFMTEFFKLVLGTLSLPINLPGTNYRRGLQARKSIVSILSQLLEERKTSQKGHVDMLGCLMNKDENRYKLTDEEIIDLIITIMYSGYETVSTTSMMAVKYLHDHPKVLEEIRVSAKVLMFLKKEHFAIRERKNPEDPIDCNDLKSMRFTRAVIFETSRLATIVNGVLRKTTHDMELNGYLIPKGWRIYVYTREINYDPFLYHDPLTFNPWRWLGNSLESQSHFLIFGGGTRQCPGKELGIAEISTFLHYFVTRYRWEEIGGDKLMKFPRVVAPNGLHIRVSSN

SEQ ID NO: 126106 - protein, 603 aa, Glycine max
  Coding DNA Sequence Number=SeqID_9328
  Gene Ontology: Mol. function=protein serine/threonine phosphatase activity; Cellular component=protein serine/threonine phosphatase complex; Biological process=protein amino acid dephosphorylation
  Homolog annotation: Hit_ID=P46014; Match level="QueryCoverage=84%, HitCoverage=88%, E-value=1e-165, Identity=57%"; Hit description =Kinase-associated protein phosphatase
  Pfam annotation: Domain name=FHA; Domain location=216-292; Score =59.7; E_value=9.3e-15; Accession=PF00498.16; Description=FHA domain
  Pfam annotation: Domain name=PP2C; Domain location=317-584; Score =168.8; E_value=1.4e-47; Accession=PF00481.12; Description=Protein phosphatase 2C
  Pfam module annotation: Pfam domain module=FHA::PP2C; Domain location= 216-292::317-584
MQVCRNLEGDDLKGEVVANPDPISLAKEDDGSDATNHSHCASSPYASSHRHFSFLSLQTMALLFLFAFPLLHQGDASSFNRSNELPRDHDLEGACYPSEAHFRSPRTHGQVLVHKQRLQTLNMPQPQAADTLVVDVISDHSSSEDLDVGQTLKLPSSHLAQIQKHALPNFQIDRLQDFVQRDISDQRSCLTLEVISGPSQGLRYSVQSTSPSRLPLTLGRVSPSDLLIKDSEVSGKHAMIKWNLDKMKWELVDMGSLNGTLLNSTPINHPDTGSRNWGDPMNLTNGDIITLGTTSKVMVHITSQTQHHIPFGVGMASDPMALHRGGKRFPMEDVYYYQWPLPGLDQFGIFGICDGHCGDGAAKSASKLFPEIIASILSDSLKRERVLSHRDASDILREAFSQTEAHMNNYYEGCTATVLLVWTDGGENFFAQCANVGDSTCIMSVNGKQIKMSEDHKFTNYSERLRIEETGEPLKDGETRLYGINLARMLGDKFLKQQDSRFSSEPYISQVVHIDQASKAFAILASDGLWNVISVKKAIQLVLQFAFSNAQMRERCYSERQNTAEKIASLLLNEAKTLRTKDNTSVIFLDFDTFNRFSCKVES

SEQ ID NO: 126107 - protein, 208 aa, Glycine max
  Coding DNA Sequence Number=SeqID_9329
  Homolog annotation: Hit_ID=Q10NR6; Match level="QueryCoverage=48%, HitCoverage=27%, E-value=6e-08, Identity=38%"; Hit description =Expressed protein
MAAIVCQSSRIHRLMLASPKPPPQQPFKSCLWENNYSYKPDTTTAWTSIEALSSTVSNYEYEVSLLRLSPKSLELCTENLGNETGCDDIITETGIELLSSSSSSSTREQKSRKAREAARSFPPPLTTIRGSESIRVRPHREGGRLVLQLTKVPSCFQAQRSPGRLRLCFWTDIQTQEHEDEEDDDGRGWEHTKGCNSWVENNYERQIS

SEQ ID NO: 126108 - protein, 87 aa, Glycine max
  Coding DNA Sequence Number=SeqID_9330
  Gene Ontology: Mol. function=tRNA (guanine-N2-)-methyltransferase activity; Biological process=tRNA processing
  Homolog annotation: Hit_ID=Q9SRU7; Match level="QueryCoverage=75%, HitCoverage=12%, E-value=3e-17, Identity=62%"; Hit description =Probable N(2),N(2)-dimethylguanosine tRNA methyltransferase (EC 2.1.1.32) ...
  Homolog annotation: Hit description=(tRNA(guanine-26,N(2)-N(2)) methyltransferase) (tRNA 2,2-dimethylguanosine-26 methyltransferase) (tRNA(m(2,2)G26)dimethyltransferase)
MARNWDMASKQSLWPGLSFDLRLILLELYRLLARHKLRRLHAFFQILKGTGVLNLGQDVKLIASVSLYWVKQQLMEFSIRKRMKNLN

SEQ ID NO: 126109 - protein, 59 aa, Glycine max
  Coding DNA Sequence Number=SeqID_9331
MILDLNAVDDSGSDDDSDEWQWWFLVLIAKQLLPASFKASGTPNPVPDCKITFRIRYWN

SEQ ID NO: 126110 - protein, 134 aa, Glycine max
  Coding DNA Sequence Number=SeqID_9332
  Gene Ontology: Mol. function=tRNA (guanine-N2-)-methyltransferase activity; Cellular component=mitochondrion; Biological process=tRNA processing
  Homolog annotation: Hit_ID=Q9SRU7; Match level="QueryCoverage=94%, HitCoverage=22%, E-value=1e-47, Identity=67%"; Hit description =Probable N(2),N(2)-dimethylguanosine tRNA methyltransferase (EC 2.1.1.32) ...
  Homolog annotation: Hit description=(tRNA(guanine-26,N(2)-N(2)) methyltransferase) (tRNA 2,2-dimethylguanosine-26 methyltransferase) (tRNA(m(2,2)G26)dimethyltransferase)
MGSLIFIFQNNSVKYLPGHGPVVPQECNYCGKKFNMGGPIWSAPIQDQEWVTSILADVKSMKESCSDIFFSGIATLFLSLHNLCATLKCTSPSAIIFRSAVINAGYHISGTHVNPQGLKSDAPMDVIWDIMRCW

SEQ ID NO: 126111 - protein, 141 aa, Glycine max
  Coding DNA Sequence Number=SeqID_9333
  Gene Ontology: Mol. function=DNA binding; Cellular component =chromatin; Biological process=DNA integration
  Homolog annotation: Hit_ID=Q1T010; Match level="QueryCoverage=94%, HitCoverage=9%, E-value=8e-48, Identity=67%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
TSGYLFKFGGAVVSWSSKKQPVTALSSCEAEYISGSFAACQAIWLKSLLDELKCEVQMPLSLLIDNKSAISLAKNPVSHGRSKHIETRFHFIREQVNNGVLKLIYCPTEDQLADLLTKAVKPDSFIKLREEIGVICFEDLN

SEQ ID NO: 126112 - protein, 211 aa, Glycine max
  Coding DNA Sequence Number=SeqID_9334
  Gene Ontology: Mol. function=acyltransferase activity
  Homolog annotation: Hit_ID=Q69FA1; Match level="QueryCoverage=84%, HitCoverage=37%, E-value=7e-45, Identity=51%"; Hit description =Anthocyanin acyltransferase
MVEDSNGLRSTCPIYDAPSNSDMVKSKDPDTEVTDPKDDDSYCLTFLADCRNRSKLSVPSTYFGNCLTICHVELQKEKLVGENGILEAVSAIGGEVRGLRGDPLKGFEWIVSGRRRRELGRQSQHVMIIAGSPKLNVYETDFGWGRPKMSEILHADDAGAMCLSDCRNQERGGIEVGLALSAIQMKKFNAILDEQLGDIDIVVPHRILNTI

SEQ ID NO: 126113 - protein, 314 aa, Glycine max
  Coding DNA Sequence Number=SeqID_9335
  Gene Ontology: Mol. function=GPI anchor binding; Cellular component =anchored to membrane
  Homolog annotation: Hit_ID=Q69F99; Match level="QueryCoverage=95%, HitCoverage=72%, E-value=1e-142, Identity=76%"; Hit description =Phytochelatin synthetase-like protein
  Pfam annotation: Domain name=Phytochel_synth; Domain location=4-166; Score=299.7; E_value=5.6e-87; Accession=PF04833.5; Description =Phytochelatin synthetase-like conserv
MVQAVVTMNNFLAFRHIPSPGWSMRWTWAKKEVIWNMVGGQATEQGDCSKFKGNIPHSCKKNPTVVDLLPGTPYNQQVANCCKGGVLTTLVQDPTKAAASFQVSVGRAGTTNRTVKLPKNFTLKAPGPGYTCGPAKIVRPTKFITPDKRRVTVALSTPHLASNVTSSGTNNLSPLVQCTKHMCPTQVHWHVMRNSKKYWRVKVTVTNFSYRMNYSDWNLLVQHHNFNNRTQVFGFNYKLLALDAYTNDIAMLWGIKSRHNDILNQAGPKGNVQAELLFRKDKATFTFDKGWAFPRRIYFNGDICVMPPPDAYPF

SEQ ID NO: 126114 - protein, 336 aa, Glycine max
  Coding DNA Sequence Number=SeqID_9336
  Gene Ontology: Mol. function=transporter activity; Cellular component= mitochondrial inner membrane; Biological process=transport
  Homolog annotation: Hit_ID=Q69FA0; Match level="QueryCoverage=94%, HitCoverage=96%, E-value=1e-131, Identity=74%"; Hit description =Mitochondrial carrier protein
  Pfam annotation: Domain name=Mito_carr; Domain location=111-203; Score=82.2; E_value=1.6e-21; Accession=PF00153.17; Description =Mitochondrial carrier protein
  Pfam annotation: Domain name=Mito_carr; Domain location=13-100; Score= 54.2; E_value=4.3e-13; Accession=PF00153.17; Description =Mitochondrial carrier protein
  Pfam annotation: Domain name=Mito_carr; Domain location=219-308; Score=82.3; E_value=1.5e-21; Accession=PF00153.17; Description =Mitochondrial carrier protein
  Pfam module annotation: Pfam domain module=Mito_carr::Mito_carr::Mito_ carr; Domain location=111-203::13-100::219-308
MKFTQFCRLDKTRFYVVGAGLFTGVSVALYPVSVVKTRLQVATKDAVERNVFSVAKGLLKTDGIPGLYRGFGTVITGAIPARIIFLSTLETTKVAAFRMLEPFRLSETSQAAIANGVAGMTSSLFAQSVFVPIDVVSQKLMVQGYSGHAQYSGGLDVVRQVLRTDGIRGLYRGFGLSAITYAPASAVWWASYGSSQRFIWRFLDHGAKYDEVAPSLQKIMLVQATGGIIAGATSSCITTPLDTIKTRLQVMGHENRSSIKQVAKDLINEDGWRGFYRGFGPRFFSMSAWGTSMILTYEYLSKNSSSLITFSLSNAYAQKMNRCNWSESFCRSINQD

SEQ ID NO: 126115 - protein, 424 aa, Glycine max
  Coding DNA Sequence Number=SeqID_9337
  Gene Ontology: Mol. function=GPI anchor binding; Cellular component =anchored to membrane; Biological process=root hair cell differentiation
  Homolog annotation: Hit_ID=Q69F98; Match level="QueryCoverage=99%, HitCoverage=93%, E-value=0.0, Identity=93%"; Hit description =Phytochelatin synthetase-like protein
  Pfam annotation: Domain name=Phytochel_synth; Domain location=29-193; Score=375.5; E_value=8.3e-110; Accession=PF04833.5; Description =Phytochelatin synthetase-like conserv
MEGDAYDPLDPNGNITIKWDIISWTPDGYVAVVTMNNFQQYRHIASPGWSMGWTWAKKEVIWSMMGGQTTEQGDCSKFKGGIPHCCKKDPTVVDLLPGTPYNQQIANCCKGGVLSSWAQDPTNAVSSFQVSVGRAGTTNKTVKVPKNFTLKAPGPGYTCGPAKIVAPTKFITSDKRRVTQALMTWNVTCTYSQFLAQKTPSCCVSLSSFYNDTLVPCPTCACGCQSNSSRSGTCVDPDTPHLASVVAGSGKNNFSPLVQCTRHMCPVRIHWHVKLNYKEYWRVKVTITNFNYRMNYSEWNMVVQHPNFDNLTQLFSFNYKSLTPYGSINDTAMLWGVKFYNDFLNQAGPNGNVQSELLFRKDKATFTFDKGWAFPRRVYFNGDNCVMPPPDSYPWLPNAGARQEVSLFSLVIASLVALVFYAHA

SEQ ID NO: 126116 - protein, 371 aa, Glycine max
  Coding DNA Sequence Number=SeqID_9338
  Homolog annotation: Hit_ID=Q1T010; Match level="QueryCoverage=31%, HitCoverage=8%, E-value=1e-31, Identity=57%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MAMRGIRKVPSFKLRGGVRDKCGEICSGFCYGEGDRIRICLCEEDVRGVWLWKEDKVGREREEVLESEGKRVFESWKKSLEEVLGGIREVVEGTVSGGGLTSHCSITFTVTVSAMNYGVELGKLRACFEAPKPPEEEEEQRGEMFRIQQFGYSYLLKASIESSILHTMFLHDLEVTKISRSHHSSLFVAVCTPLLVFDLFVLELLLMAPSALCFLLLYGTLLAPSMTVQVTVFDNNGETRENCEVHLSEEQSEKMNGNGGFNTHLPVFDGKNWSRWSIQMRVLFGAQDVLEFVNDGVPDLEENATEAQRNLHREKKKKDQKALFYIHQCVDAKIFEKIGESTTAKAAWDTLVRCYGGDATVKKVKLQSLRK

SEQ ID NO: 126117 - protein, 333 aa, Glycine max
  Coding DNA Sequence Number=SeqID_9339
  Gene Ontology: Mol. function=hydrolase activity; Cellular component =nucleus; Biological process=metabolic process
  Homolog annotation: Hit_ID=Q5NUF4; Match level="QueryCoverage=98%, HitCoverage=99%, E-value=1e-106, Identity=57%"; Hit description=2 -Hydroxyisoflavanone dehydratase
  Pfam annotation: Domain name=Abhydrolase_3; Domain location=85-312; Score=166.1; E_value=9.1e-47; Accession=PF07859.3; Description =alphabeta hydrolase fold
MAWSGTNTNTNTKHIVSQIPPYIYVYNDGSIERPIDIPRTPPSLEDPATGVASKDILFSKNPFLFARLFLPKLTTPPPNQKIPILVYSHGGAFCFESAFAAHHTKYCNLIASQANVIIVSVEHRKAPEHFLPAAYNDSWAALKWVASHSHATNSNSDTWLINHGDFSKIFIGGDSSGANIVHNLAMRAGVEALPGGVKVYGAYLNHPYFWGSKPIGSEAVIGFEETPQSLIWNFAYPDAPGGLDNPMINPLAPGAPSLAQLGCSKMLLTVAGKDHLLFRDRTLLYYKAVKESGWKGQVELFEEEQEDHVYHMFNMETHQAKRLITIVANFLRQ

SEQ ID NO: 126118 - protein, 138 aa, Glycine max
  Coding DNA Sequence Number=SeqID_9340
MWLMNAGFSIKGSKYLNSPKIDVYSLKLERIERTSGKISALDNCKEISRILSRINNALLKIQLGLIFFKQHCPFVCNYFRIYWIISTMDSMMTVNYLIIQNLRLSLYLAMTTWIQSRTFGDDTATSKSPLNTGWELSV

SEQ ID NO: 126119 - protein, 72 aa, Glycine max
  Coding DNA Sequence Number=SeqID_9341
MREEREEEEEEEEEEEEEEEEAESLDATQPKTVHKWNSGFEHEMEGLVWVKKAGPVIKFGGPAWLQILHVRL

SEQ ID NO: 126120 - protein, 457 aa, Glycine max
  Coding DNA Sequence Number=SeqID_9342
  Gene Ontology: Mol. function=protein serine/threonine kinase activity; Cellular component=membrane; Biological process=protein amino acid phosphorylation
  Homolog annotation: Hit_ID=Q10LW0; Match level="QueryCoverage=82%, HitCoverage=43%, E-value=1e-101, Identity=52%"; Hit description =Protein kinase family protein, putative, expressed
  Pfam annotation: Domain name=Pkinase; Domain location=116-391; Score =142.6; E_value=1.1e-39; Accession=PF00069.15; Description=Protein kinase domain
  Pfam annotation: Domain name=Pkinase_Tyr; Domain location=116-391; Score=166.0; E_value=9.9e-47; Accession=PF07714.7; Description =Protein tyrosine kinase
  Pfam module annotation: Pfam domain module=Pkinase::Pkinase_Tyr; Domain location=116-391::116-391
SKKQGIVTLSTCEAEYVAATSCTCHAIWLRRLLEELQLLQKESTKIYVNNRSAQELAKNPVFHERSKHIDTRKNVAVNESSNKKEGTSRDNGSLSVPTGLCRHFSIKEMRTATNNFDEVFVVGVGGFGNVYKGHIDNGSTTVAIKRLKQGSRQGIREFKNEIEMLSQLRHPNIVSLIGYCYESNEMILVYEFMDCGNLRDHLYDTDNPSLSWKHRLQTCIGVARGLDYLHTGVKQVIIHRDVKSANILLDEKWEAKVSDFGLARIGGPMGISMMTTSVNTEVKGSIGYLDPEYYKRNILTEKSDVYSFGVMLLEVLSGRHPLLHWEEKQRMSLANWAKHCYEKGTLSEIVDSELKGQIKPQCLHKFSEVALSCLLEDGTQRPSMKDIVGVLEFVLQIQDSAVNYEDSSSHSTVPLSDCSENTGLSTTSDGDGSYGRMESFVLIPDDVFSETKNPKRR

SEQ ID NO: 126121 - protein, 340 aa, Glycine max
  Coding DNA Sequence Number=SeqID_9343
  Gene Ontology: Mol. function=voltage-gated chloride channel activity; Cellular component=integral to membrane; Biological process=chloride transport
  Homolog annotation: Hit_ID=P92943; Match level="QueryCoverage=63%, HitCoverage=26%, E-value=9e-74, Identity=69%"; Hit description =Chloride channel protein CLC-d
MDLSECGNRTVMDVTATVKDYLSTPLVCSISAVKSSRFRAERRHRKSPPAGGNDQKVDLNYLSKAELRDKRAISGYQNPHPLIPFDKKERTKARTHAGTIERENDGTTLKEETAVLSFGSDRPTMLSNHFQNGIETARLVWSRIPNSEESQLLDDAVGILKKNDGGGVESLDYEVIENFAYREEQGEAVCELFAGGEMVLCLAHWHLYVLQFDRSFESTGLAAVFINIAVENFAGWKFSVTFNIIQKSYIAGFVVYVLINLALVFSSVYIITQFAPAAAGSGIPEIKGYLNGVDIHGILLFRTLIGKIFGSIGSVGGGLALGKEGPLVHTGACIASLLGQ

SEQ ID NO: 126122 - protein, 72 aa, Glycine max
  Coding DNA Sequence Number=SeqID_9344
MTKLGMKTMSQTAAAWHFAFIVRHFFFSPMPCAQWWELKFGFKSIKNFLPIAQRLFSLTLAYVKRLFPDLNP

SEQ ID NO: 126123 - protein, 875 aa, Glycine max
  Coding DNA Sequence Number=SeqID_9345
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=88%, HitCoverage=88%, E-value=0.0, Identity=46%"; Hit description =Receptor-protein kinase-like protein
  Pfam annotation: Domain name=Pkinase; Domain location=541-813; Score =109.1; E_value=1.3e-29; Accession=PF00069.15; Description=Protein kinase domain
  Pfam annotation: Domain name=Pkinase_Tyr; Domain location=541-813; Score=144.9; E_value=2.1e-40; Accession=PF07714.7; Description =Protein tyrosine kinase
  Pfam module annotation: Pfam domain module=Pkinase::Pkinase_Tyr; Domain location=541-813::541-813
MAPAHCFATVCCFAYSLSMDTTGTHIASGAILFLLLLCLSYLSIADVIYSPVELFSINCGSNSSLSTRDGRNWTADIKFLSENKDSVAAPALTPSTLEGPYTDARFSHSQFTYSFSVSTGPKFLRLFFYSTSYQNFHRSKAYFSVKAGQYTLFQDFNASLNADADDDPAQTDILFREYCINLKDGDRLNITFIPSKTSQHPDSYAFINGIEIVSMPPFLYYTNPDDVDISGLPLLVGLNTNPFPIENNFTLETKYRLRVGGAEIPASQDTGMLRSWDVDNKYVTSQSVLSLYIATGIKLRFTNKIPNYTAPDTVYRSVRNMGSNGTFNMGFNLTWQLPVDSGFTYLLRLHFCQLDPNISRPGDQSFFIYVQDQLVEDWADILGWSHKQKGVPVVKQYVVFIPGNQQETLNLSLKMHPNPNSLAKDAQINAIELFKISNFNSSLAGPNPDPNRLPVTPIVPLQRPNNKSSGTTRNLATAVAGAVSAAVLLSFIVAFFLIQCKKKMGSKKKDETPLGGGLSSLPTSLCRHFTIVEIRGATNYFDEHFIVGMGGFGNVYKGYIDDGSTRVAIKRLRPDSRQGAQEFMNEIEMLSQLRHLHLVSLVGYCYESNEMILVYDFMDRGTLCEHLYDTDNPSLSWKQRLQICIGAARGLHYLHTGAKHMIIHRDVKSTNILLDEKWVAKVSDFGLSRIGPISSSMTHVSTQVKGSVGYIDPEYYKRQRLTEKSDVYSFGVVLLEVLSGRQPLLRWEEKQRISLVNWAKHCYEKGTLSDIVDAKLKGQIAPQCLQRYGEVALSCLLEDGTQRPSMNDVVRMLEFVLHLQEGAVNEVTESEDTKDVFSSSHSSLHFSDYSKSTALSMATNVGDCSYGSKDSEERG

SEQ ID NO: 126124 - protein, 116 aa, Glycine max
  Coding DNA Sequence Number=SeqID_9346
  Gene Ontology: Mol. function=sugar porter activity; Cellular component=integral to membrane; Biological process=carbohydrate transport
  Homolog annotation: Hit_ID=Q1SDF6; Match level="QueryCoverage=70%, HitCoverage=15%, E-value=2e-35, Identity=93%"; Hit description=Sugar transporter superfamily; Major facilitator superfamily MFS_1
MLIAGVFFICGVVLNAAAQDLAMLIVGRILLGCGVGFANQAVPVFLSEIAPSRIRGALNILFQLNVTIGILFANLVNYGTNKTRKCSTCWLLCSVLSASGTSVNLVFSQQASVLGH

SEQ ID NO: 126125 - protein, 93 aa, Glycine max
  Coding DNA Sequence Number=SeqID_9347
MPRNVLKKVTLSATQPGSLAENHGIQFSAKEIEFEEHGGVERVKTKLRSMESGIHGSLGCGEVGHGGLEAVQAGERFDICHGRATEKGAGRTN

SEQ ID NO: 126126 - protein, 124 aa, Glycine max
  Coding DNA Sequence Number=SeqID_9348
MSSIVCRDCARKTPSGPEEGQQGLGVASSKYGSLSVLGSACRPQQGHQVPPTNRAFIKKFCVSRQAQGETPQQPGEGWQRATDAPPSPLEFTSAHPQKGLSISYTTWPTNRRPSPKPKDAPSCS

SEQ ID NO: 126127 - protein, 279 aa, Glycine max
  Coding DNA Sequence Number=SeqID_9349
  Gene Ontology: Mol. function=phosphoribosylanthranilate isomerase activity; Cellular component=cytoplasm; Biological process=aromatic amino acid family biosynthetic process
  Homolog annotation: Hit_ID=UPI00005FA5CE; Match level="QueryCoverage =94%, HitCoverage=57%, E-value=1e-105, Identity=73%"; Hit description= COG0134: Indole-3-glycerol phosphate synthase
SRHQNLRHVLATKFAEGLEDRGQARGIFDARFAFHAGVEIQPGAAELGRLDAVVGAQAARQHHVSQIFALQHRPVEALAGAAGAVVEQIAIDMLQIARRHPIFHAQRFPDAAIGRQAGAQGVDIGLVFRAVQLHRVQTEALNGQRHGIDLGVAEHADVLQRRAGDHFASAGDVHIARRAADENQPAVDGAGLIGGGGVLRTGQAAHFVVAQDHAAHGGAQIGFRHQRAADQEAVGVMAQLADLPVVVDARFADHRHAVRHARRQLTGAVQIDAQIAQIA

SEQ ID NO: 126128 - protein, 276 aa, Glycine max
  Coding DNA Sequence Number=SeqID_9350
  Gene Ontology: Mol. function=helicase activity; Biological process =viral genome replication
  Homolog annotation: Hit_ID=Q1SRJ5; Match level="QueryCoverage=98%, HitCoverage=32%, E-value=1e-73, Identity=49%"; Hit description =Probable helicase [imported]-Arabidopsis thaliana-related
MFHPQTVLDSNGYPIYRRRNDDHTISKNGVIIDNIYIVPYNAKLLRKYQAHINVEWCNQNTSIKYLFKYINKGYDRVTAVVIHDDNGTLENAISQNDEIKEYVDCRYISPCESTWRIFCFPIHARKPDVERLHFHIPGQHNVFYEDDDDIDDILSKPSILESKFLAWMNSNKCFSEGRNLTYSQFVSKFVYNQKARSWNLRKKGNTIGRLIWVPPTTGELFYLRMMLTACKGATSFEDIRTVENVLYPTYRETCFAMGFLQDDREFVEAIKEAKDQ

SEQ ID NO: 126129 - protein, 175 aa, Glycine max
  Coding DNA Sequence Number=SeqID_9351
  Homolog annotation: Hit_ID=Q1T493; Match level="QueryCoverage=97%, HitCoverage=31%, E-value=6e-14, Identity=27%"; Hit description =Nucleic acid-binding, OB-fold, subgroup
VLSCTLWENYCLQFLSYLNDIEDERPIIILLTHARIKEAQRSYLASVSNSFKASKLMINDLVLEIQEFRESLLDLGIEVRAILVPIGQGSSQVSGSSQLSSKDAFLSKTEVKNISEINVSLEEFVCVTVAKITTIVMDNYSWCYPACGQCYKKADMQTVSFTCPCGKENDQPVLR

SEQ ID NO: 126130 - protein, 91 aa, Glycine max
  Coding DNA Sequence Number=SeqID_9352
MNVLSGATLFCKITYAPMICVHRDSLGRNNQHENIEKGVPTDPKRIKVIPEWSTPPSVEGRNIEYQETLDLKSNPFQGGGDDAILPLKGIG

SEQ ID NO: 126131 - protein, 100 aa, Glycine max
  Coding DNA Sequence Number=SeqID_9353
MVIDQSLFYDLTQLSSDGVPFEGALDDDWKFDFLCMMPVGHLPAGEDSSLLQSILDRFDGLQTNVVDTRFKEMDSRIKKVEGDVTFIRDCFDLPPLPPSV

SEQ ID NO: 126132 - protein, 180 aa, Glycine max
  Coding DNA Sequence Number=SeqID_9354
MAEASGNRLPACVIDYTEEWVTGNRLPGMCNRLHSIVMAAQLIRDRVEMEFLEGAWETLEGNTRCRFRGTIRFTATSLVHPDEPARTLQRTVEWILPTPTPYRLVEPVQVIEVTSSEEDPEEDLEELPPEPAVDALDFLEGDEDPLLEVDSPEEVMSASEADSTEDSDPREMAISGGSSS

SEQ ID NO: 126133 - protein, 198 aa, Glycine max
  Coding DNA Sequence Number=SeqID_9355
MGISYFAYQDQLKKQPQGEPTTAQSENIQEAPQDAAKKNRHLWTPGLWVFSSLIWCSTFPLFAWCGTSPHTCNPTISPSSLLEPTCSSYLHHRSICGTRCLDPPPGRLLIQGIPKAKIHHRHLTRLSRSPILLIPVVGEFEGSKHRIDLHRLRRVRWRRWILAWGSLVSKVFLAMLQAACPADRAAVQVPQVARACGL

SEQ ID NO: 126134 - protein, 175 aa, Glycine max
  Coding DNA Sequence Number=SeqID_9356
MTHFTARYGIREISGEMESGVRSGGSGVVVKSRNSSGCLIVRKKGDGLSATASTSRNLYESKKRPNINVSVSSSDSGSSDELLMPPGRRLGPETIRVCNGLAASERGGSEISRKRDRVERISGSGEDIAAEKGLEQWERKRSKLDVYDFNEYDGMDVENIRRRHLDGHGGGRFMG

SEQ ID NO: 126135 - protein, 326 aa, Glycine max
  Coding DNA Sequence Number=SeqID_9357
  Gene Ontology: Mol. function=acid phosphatase activity
  Homolog annotation: Hit_ID=Q1SDD1; Match level="QueryCoverage=96%, HitCoverage=96%, E-value=1e-121, Identity=70%"; Hit description =Survival protein SurE
  Pfam annotation: Domain name=SurE; Domain location=7-228; Score =138.7; E_value=1.5e-38; Accession=PF01975.8; Description=Survival protein SurE
MEGGKRGTILVTNDDGIDAPGLRALVHSLVNANLFNVLVCAPDSEKSAVSHSITWLHPVAVKQVQIEGTTAFAVSGTPADCASLGISKALFPTVPDLVVSGINKGSNCGYHICFSSYYFMKKLLPIALLSRSLCSVYSGTVAGAREAFFNDILSISISYDWVKGKSKLQDFTLAAQVCLPIISALLVETKNQSYPRKCFLNIDVPNNVPNHKGYKLTKQGKSIIKTGWRQVTSETEGPKMSSDMTNTDTETSKNFDSSSASPEHLLFAREVIGSVLDEDDTDYKCLREGYITVTPLAALTHVEVDCQAYFKNWLQSVPELPSSSSL

SEQ ID NO: 126136 - protein, 612 aa, Glycine max
  Coding DNA Sequence Number=SeqID_9358
  Gene Ontology: Mol. function=nucleotide binding; Cellular component =chloroplast; Biological process=response to heat
  Homolog annotation: Hit_ID=Q8L8N8; Match level="QueryCoverage=87%, HitCoverage=94%, E-value=0.0, Identity=71%"; Hit description=70kD heat shock protein
  Pfam annotation: Domain name=HSP70; Domain location=27-608; Score =181.5; E_value=2.1e-51; Accession=PF00012.10; Description=Hsp70 protein
MVEPAYTVTSDSETTGEEKSSTFPEIAIGIDIGTSQCSVAVWNGSQVELLKNTRNQKIMKSYVTFKDNIPSGGVSSQLSHEDEMLSGATIFNMKRLIGRVDTDPVVHACKNLPFLVQTLDIGVRPFIAALVNNMWRSTTPEEVLAIFLVELRAMAEAQLKRRIRNVVLTVPVSFSRFQLTRIERACAMAGLHVLRLMPEPTAVALLYGQQQQQTSHENMGSGTEKIALIFSMGAGYCDVAVTATAGGVSQIKALAGSTIGGEDLLQNMMHHLLPNSENLFKNHGVKEIKQMGLLRVATQDAIRQLSSQTIVQVDVDLGDGLKICKAVNREEFEEVNRKVFEKCESLIIQCLQDAKVEVEEVNDVIIVGGCSYIPRVKNLVTNVCKGKELYKGMNPLEAAVCGAAVEGAIASGVNDPFGNLDLLTIQATPLAIGIRADGNKFVPVIPRDTTMPARKELVFTTTHDNQTEALILVYEGEGEKAEENHLLGYFKIMGIPAAPKGVPEINVCMDIDAANVLRVLAGVVMPGSRQPAIPVMEVCGVQETRAREVRHDSEVLNDFKRFEEMALVGLWCVHPSPSPRHSMKQVMQMLDGTVEVGVPPLVYDQMMADQCL

SEQ ID NO: 126137 - protein, 368 aa, Glycine max
  Coding DNA Sequence Number=SeqID_9359
  Gene Ontology: Mol. function=lipoxygenase activity; Cellular component=cytoplasm; Biological process=electron transport
  Homolog annotation: Hit_ID=Q1S0A0; Match level="QueryCoverage=97%, HitCoverage=41%, E-value=1e-149, Identity=72%"; Hit description =Lipoxygenase
  Pfam annotation: Domain name=Lipoxygenase; Domain location=183-368; Score=-272.4; E_value=6e-05; Accession=PF00305.9; Description =Lipoxygenase
  Pfam annotation: Domain name=PLAT; Domain location=68-171; Score =141.3; E_value=2.7e-39; Accession=PF01477.13; Description=PLATLH2 domain
  Pfam module annotation: Pfam domain module=Lipoxygenase::PLAT; Domain location=183-368::68-171
MFPVVSGIFNRGQKLKGTVVLMRKNVLDINALTSAQSATGIIGGAIGAVGDIIGTGVDTLTSFLGRSVALKLISATSADSTGKGKVGKQTFLEGLVASLPTLRAGESALDIHFEWDSDMGIPGAFYIENFMQVEFFLVSLTLEDVPNHGTIHFVCNSWVYNAKMYKNTRIFFTNKTYLPSETPGPLVKYREEELKTLRGDGTGQRKEHERIYDYDVYNDLGTPEKDNLARPVLGGSTLPYPRRGRTGRNKSKKDPKSEIRSDSVYIPRDESFGHLKSSDFLAYILKSASQNVIPQLQSALRLQFNQPEFTSFDDVRGLYDGGIKLPTDALSKLSPIPLFTELFRTDGEQVLKFPTPKVIQGSTLKAYS

SEQ ID NO: 126138 - protein, 94 aa, Glycine max
  Coding DNA Sequence Number=SeqID_9360
MEKERFLLLDTLKLKMYSLESSESSGCGYCGDHALSTTAHRLNEYDDDHTANVKCTLSVPLGFFKSLLRAKLELATKLGNALDLSCALSELSQS

SEQ ID NO: 126139 - protein, 261 aa, Glycine max
  Coding DNA Sequence Number=SeqID_9361
  Gene Ontology: Mol. function=lipoxygenase activity; Cellular component=cytoplasm; Biological process=electron transport
  Homolog annotation: Hit_ID=Q1S0A0; Match level="QueryCoverage=92%, HitCoverage=27%, E-value=3e-96, Identity=70%"; Hit description =Lipoxygenase
  Pfam annotation: Domain name=PLAT; Domain location=68-171; Score =149.8; E_value=7e-42; Accession=PF01477.13; Description=PLATLH2 domain
MFSGVTGLINRGHKVKGTVVLMQKNVLDVNALTSAKSVGGIAGGALGVVGGVIGTAVDTLTSFLGRSVALRLISATSSDGSGKGKVGKQTFLEGIVTSLPTLGAGQSAFNVHFEWDTDMGIPGAFYIENFMQVEFFLVSLTLEDIPNHGSIHFLCNSWVYNSKKYKSDRIFFANKTYLPSETPGPLVKYREEELKTLRGDGTGERQEHERIYDYDVYNDLGDPDSNARLARPVLGGSTTLPYPRRGRTGRKKSKKGIRLLF

SEQ ID NO: 126140 - protein, 614 aa, Glycine max
  Coding DNA Sequence Number=SeqID_9362
  Gene Ontology: Mol. function=zinc ion binding; Biological process =metabolic process
  Homolog annotation: Hit_ID=Q6ZA58; Match level="QueryCoverage=75%, HitCoverage=27%, E-value=2e-67, Identity=35%"; Hit description=PHD finger transcription factor-like
  Pfam annotation: Domain name=PHD; Domain location=515-558; Score =61.2; E_value=3.4e-15; Accession=PF00628.19; Description=PHD-finger
MNKDGAQVPPLSQREKFNSDESIRVQGKNGVLKVMVNKKKVAGPSEQYYDHHKPLESRLRLKTEEMAKRLKTEEAAKRLKTEGTSKRNIPIRPSSYIDKKPVDKPALHKRPEKKRIASRKSLSSKDSKGDEGDSDNSDTSLNPRIRNTEARKSVKKIISEDEQTPVHQKTPTTRTKEGKLKRGSGTEKQKLREQIREMLLNSGWTIDYRPRRNRDYLDAVYINPAGTAYWSIIKAYDALQKQLNDDADEVKPKGDSSSFAPIADEVLSQLTRKTRKKMEKELQKKKKRHDSESDSEKEPQRKRSASNKHNMNSMDSDSYEEKLSSFIKQGNKSMKNKMFENTSISARSKIQNATHHSSDGIEKSLFGCDPHIHGRKSKKHGRCTLLVRSSNKGSNSESDGFVPYTGKRTVLAWLIDSGTVELSQKVQYRRRKKVMLEGWITRDGIHCGCCSKILTVSKFELHAGSKLPQPHHNIYLESGVSLLQCQIDAWNRQEHAEKIGFHAVDIDGNDPNDDTCGICGDGGDLICCDGCPSTFHQSCLDIQMLPPGEWHCPNCTCKFCGIASGTSDKDDASVNILQTCILYHNSCTKEMNTLPNKINSSSLSFCGKECKERA

SEQ ID NO: 126141 - protein, 523 aa, Glycine max
  Coding DNA Sequence Number=SeqID_9363
  Gene Ontology: Mol. function=lipoxygenase activity; Cellular component=cytoplasm; Biological process=electron transport
  Homolog annotation: Hit_ID=Q1S0A5; Match level="QueryCoverage=99%, HitCoverage=79%, E-value=1e-150, Identity=49%"; Hit description =Lipoxygenase
  Pfam annotation: Domain name=Lipoxygenase; Domain location=1-507; Score=608.0; E_value=8.3e-180; Accession=PF00305.9; Description =Lipoxygenase
MEQKSAKNITGYMIMMFTMIWAILTPMTDWAVRFSEDPTRCHTLGGVELAENHLRKVGIKLPTDALSKLSPITLFKELFQTEGEQALKFPKPKVNQAEQSAWMTDEEFVREMLAGVNPTVIMASENYNIIHLLNLQLASYKLFEFPPESKLDRQLYGDNTSTITREHLEPNLGGLSVEKAMENRKLFHLDHHDTIFPYLRRINETDTKAYAARTILFLQDNGTLKPLAIELSRPHPEGDKFGPVSNLNLPFGYLPRLMWLHTHAVVEPFIIATNRHLSVVHPIHKLLLPHYRDTMNINAVARNVLVNAEGIIESTFLGGKHALEMSAVAYKDWDFLWSSLPNDLVKRGRADADPSSLHGVVRLLIEDYPYAADGLEIWSAIHSWVEEYVSFYYKSDVAIAQDTELQAFWKEVREVGHADQKINARWPKMQTWKSDALKNLTIIEVLSRHASDELYLGQRDSEFWTCDAQPLEAFKRFGKKLAEIEQKLIQRNNDETLKMSYTLLYPSSEEGLTCRGIPNSISI

SEQ ID NO: 126142 - protein, 788 aa, Glycine max
  Coding DNA Sequence Number=SeqID_9364
  Gene Ontology: Mol. function=lipoxygenase activity; Cellular component=cytoplasm; Biological process=electron transport
  Homolog annotation: Hit_ID=Q1S0A0; Match level="QueryCoverage=99%, HitCoverage=63%, E-value=0.0, Identity=74%"; Hit description =Lipoxygenase
  Pfam annotation: Domain name=Lipoxygenase; Domain location=1-548; Score=1193.1; E_value=0; Accession=PF00305.9; Description =Lipoxygenase
FNQPEFNSFDDVRGLYDGGIKLPTDTLSQLSPIPLFKELFRTDGEQALKFPTPKVVQAVEQSAWMTDEEFTREMIAGVNPHIIKRLQEFPPKSKLDSQLYGDNTSTIAKQHLEPNLGGLTVEQAIQHNRLFILDHHDTIFPYLRKINATDTKAYATRTIIFLQDNGTLKPLAIELSKPHPRGDNYGPVSNVYLPANQGVEASIWLLAKAYAVVNDSCFHQLVSHWLNTHAVVEPFIIATNRHLSVVHPIHKLLLPHYRDTMNINSLARNVLVNAEGIIESTFLWGGYSLEMSAVVYKDWVFTEQALPADLVKRGVAVKDSSSPHGLRLLIEDYPYAADGLEIWATIKSWVQEYVSFYYKSDAAIAQDAELQAFWKELVEVGHGDKKNEPWWGKMKTRQELIDSCTILIWTASALHAAVNFGQYPYGGYILNRPTLSRRFMPEKGSPEYDELAKNPQKAYLKTITGKNETLTDLTIIEVLSRHASDELYLGQRDGGNGWTSDAQIIQAFKRFGNKLAEIEQKLIQRNNDETLRNRYGPVKMPYTLLYPSSEEGKIDAKIGRKKALKKNWKNWTACLTRNPGLARTLAKRKSSRLSTKKANEEAQRLDTHADVEPFVIATNRHISVVHPIHKLLPQYRDTMNINSLARLVLDNEESRGVAVEDSASSHGIRLLIEDYHYASDSELQAFWKELVEVGHANKKNEPWWPKMQTREELIELCTTLIRQYPYGGYVLNRSTLSRGFIPEKGSPEGKESDPYTHRGVVIYQCMLLIIYTLDKEMAVVIVGLLMHR

SEQ ID NO: 126143 - protein, 178 aa, Glycine max
  Coding DNA Sequence Number=SeqID_9365
  Gene Ontology: Mol. function=2 iron, 2 sulfur cluster binding; Cellular component=chloroplast; Biological process=electron transport
  Homolog annotation: Hit_ID=Q1SVD7; Match level="QueryCoverage=82%, HitCoverage=100%, E-value=8e-52, Identity=68%"; Hit description=2Fe -2S ferredoxin, iron-sulfur binding site
  Pfam annotation: Domain name=Fer2; Domain location=50-125; Score =77.7; E_value=3.6e-20; Accession=PF00111.17; Description=2Fe-2S iron- sulfur cluster binding domain
  Subcellular localization annotation: CTP_CleavageSite=40; ConfidenceScore=5.55e-01
MASLQLTTTPFTLLRQQRQHPTKKKSTASQLNPPRPRPLRVSVRSYKVVIEHDGESTEVEVEPDETILSKALDSGLSVPHDCKLGVCMTCPARLISGSVDQSDGMLSDDVVERGYALLCAAYPQSDCHIKIIPEDELLSLQLATANDYILLMLEIQHLTQIRIDTNCPTLLINGYLAQ

SEQ ID NO: 126144 - protein, 177 aa, Glycine max
  Coding DNA Sequence Number=SeqID_9366
  Gene Ontology: Mol. function=structural constituent of ribosome; Cellular component=intracellular; Biological process=translation
  Homolog annotation: Hit_ID=Q1SDC7; Match level="QueryCoverage=99%, HitCoverage=52%, E-value=1e-64, Identity=68%"; Hit description =Ribosomal protein L18P/L5E
  Pfam annotation: Domain name=Ribosomal_L18p; Domain location=75-177; Score=-46.1; E_value=0.1; Accession=PF00861.12; Description =Ribosomal L18pL5e family
MRVCGDLFYKFERSSKEFEEYNLDLHRKKSFKKKEELNKAKTTPNVVSKDHKLPRVNELTRSKSVVPRVEEINDGSTVNKRQRTPTFNQLTGPYHEPLCLDIFVSKAWVRACIVHRVTSKVVAVAHSISKGIKFDLASTKNKTTCAAVGAILAQRALADDIHDVIYTPRKERVEGKL

SEQ ID NO: 126145 - protein, 971 aa, Glycine max
  Coding DNA Sequence Number=SeqID_9367
  Gene Ontology: Mol. function=zinc ion binding; Biological process =metabolic process
  Homolog annotation: Hit_ID=Q6ZA58; Match level="QueryCoverage=58%, HitCoverage=35%, E-value=1e-108, Identity=40%"; Hit description=PHD finger transcription factor-like
  Pfam annotation: Domain name=PHD; Domain location=727-770; Score =60.5; E_value=5.3e-15; Accession=PF00628.19; Description=PHD-finger
  Subcellular localization annotation: CTP_CleavageSite=84; ConfidenceScore=5.03e-01
MESGLRSGGSGVVVKSRNSSGCLIVRKKGDGLGATASTSRKLYESKKRPNINVSLSDSGSSEGSLIPPGRRLGPETIRVCNGLAASERGGTEISRKRDRVQRIKGNGEGIAAEKGLEQWERKRSKLGVYDFDDYDGMDLENMRRRHLDGHGGGSFMGSVHAARSGIDREFITGSSVRILDKRKNSYGDRPSGLYLGDNVDHSRYKINRDGVWVPLRLQREKFNSDESIRVQGKNGVLKVMVNKKKVGGPSEQDYDHHKPVEGRQRLKTEETAKRLMTEETAKRLMTEETAKRLKTEEAAKRNVPIRPLSYLETKPVEKPGLLKRPENKRIASRKSLSSKDSKGDEGDSDNSDTSLNLGIRNTEARKPAKNVMSEDEQTPVHEKLPTTRTKEGKIKRGSGTEKQKLRERIREMLLNSGWTIDYRPRRNRDYLDAVYINPAGTAYWSIIKAYEALQKQLNEDANEAKPKGDSSSFAPIADEVLNQLTRKTRKKMEKELKKKKKYDSESDNEKEPQIRSASNKRDLNSTDGDNNEEKLSSFIKQGSKSMKNKMFEDTIMSASSKIQNATNHSGDGIEKSLFECDPQIHGRKSKKHGRCTLLVRSSKKGSNSESDGFVPYMGKRTVLSWLIDSGTVELSQKVQYRRRKKVMLEGWITRDGIHCGCCSKILTVSKFELHAGSKLPQPYQNIYLESGVSLLQCQIEAWNRQEHSEKICFHSVDIDGDDPNDDTCGICGDGGDLICCDGCPSTFHQSCLDIQMLPLGEWHCPNCTCKFCGIASGNSEKDDASVYVLQICNLYHDSCTKEMDNLPNNINTSSLSFCGKECKELSEHLKKYLGTKHELEAGFSWSLIHRIDEDSEAACRGISQRVECNSKLAIALTVMDECFLPVIDRRSGINLIRNVLYNSGSNFSRLNYSGFYTATLERGDEIIASASIRANCRNNRSWESERFFSCNWIESPPTFQIYLREVRELRK

SEQ ID NO: 126146 - protein, 511 aa, Glycine max
  Coding DNA Sequence Number=SeqID_9368
  Gene Ontology: Mol. function=glycylpeptide N-tetradecanoyltransferase activity; Cellular component=cytoplasm; Biological process=N-terminal protein myristoylation
  Homolog annotation: Hit_ID=Q9LTR9; Match level="QueryCoverage=76%, HitCoverage=98%, E-value=1e-178, Identity=71%"; Hit description =Glycylpeptide N-tetradecanoyltransferase 1
  Pfam annotation: Domain name=NMT; Domain location=69-230; Score =381.9; E_value=1e-111; Accession=PF01233.10; Description=Myristoyl -CoA:protein N-myristoyltransferase, N-terminal domain
  Pfam annotation: Domain name=NMT_C; Domain location=244-393; Score =166.3; E_value=8e-47; Accession=PF02799.6; Description=Myristoyl -CoA:protein N-myristoyltransferase, C-terminal domain
  Pfam module annotation: Pfam domain module=NMT::NMT_C; Domain location=69-230::244-393
MVDSNPSSGSPEETQNPNPDGNAPVESDLALENLAQKVQESLSLEKRHKFWETQPVGQFKDVGDSSLPEGPIELPTPLSEVKQEPYNLPDHYEWVTCDINSEETCDEVYNLLAHNYVEDDENMFRFNYSKEFLRWALQPPGYFKSWHIGVRVKSSKKMVAFITGIPARIRVRDEVVHMAEINFLCVHKKLRTKRLAPVMIKEVTRRVHLENMWQAAYTAGVVLPTPITTCQYWHRSLNPKKLIDVGFSRLGARMTMSRTIKLYKLPESTITPGFRKMEIHDVPAVTRLIRNYLSHFVVAPDFDENDVEHWLLPRDGVIDSYLVESPETHELINDALIVAKHKDYDVFNALDVMQNETFLRELKFGPGDGKLHYYLYNYRIRHALKPSELGLVLLGNDNDDDINVDGDDVNNNDNDKDISSGCNDRTVAIVAVTLTVVIMVVGMSVVLVVTTYGDNVVVAVMEVVLFVVVVTMTMTLTFGDTGGGSNAGGGDGGDKSVGGRGCGNGGDGDNI

SEQ ID NO: 126147 - protein, 277 aa, Glycine max
  Coding DNA Sequence Number=SeqID_9369
  Gene Ontology: Mol. function=ribonuclease H activity; Biological process=RNA-dependent DNA replication
  Homolog annotation: Hit_ID=Q1RYI2; Match level="QueryCoverage=83%, HitCoverage=53%, E-value=3e-14, Identity=39%"; Hit description =Ribonuclease H
MEAGIFSNSNKCYPIMNVDEVIDLLFKGDDIPAWKYTANGEFTVKSASCAISSIDEVIDLLFKGIWKWQGPERIKILLWKMANKGILTNQARLRRGMTDTALFPICNKNDESISHCLRDLKYAPTSRMLDQVRKMFGVLFSVFPSRSGGGIGMMCLGVCLFTQAKLHAIRIGLKIVAMRGFSDLDIESDSLTTINLIKSGCLPEHPCNCLVDQIKDMATCLAISSWKHVFRKTNQVADALAKYGLSIDNGCIFDVNPSFITLKVIADVASTTFFRGF

SEQ ID NO: 126148 - protein, 1242 aa, Glycine max
  Coding DNA Sequence Number=SeqID_9370
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1SSN5; Match level="QueryCoverage=99%, HitCoverage=99%, E-value=0.0, Identity=82%"; Hit description=ATPase, E1-E2 type
  Pfam annotation: Domain name=Hydrolase; Domain location=418-904; Score=10.0; E_value=0.0072; Accession=PF00702.16; Description =haloacid dehalogenase-like hydrolase
MTRGRIRARLRRSHLYTFGCLKPSTTEEAPHPLNGPGFSRTVYCNQPLLHDKKPVLYCKNDISTTKYNVITFFPKALFEQFRRVANIYFLLAACLSASPISPFSPLSMIAPLAFVVGLSMAKEALEDSRRFLQDVKVNRRKVNRHKGDGFFSPRSWQNIMVGDVVKVNKDQFFPADLLLLSSSYEDGICYVETMNLDGETNLKVKRSSETTMTLDNDEVFKDFTGTIRCEDPNPNLYTFVGNLEYERQIYPLDPSQILLRDSKLRNTDYIYGVAIFTGHDSKVMQNSTKSPSKRSTIEKKMDYIIYTLFTVLILISVISSIGFIFKTKYQAPKWWYLRPDNIEYQYDPNKVGLAGMSHLITALILYGYLIPISLYVSIEVVKVLQATFINQDIQMYDEETGTPADARTSNLNEELGQVDTILSDKTGTLTCNQMDFLKCSIAGTAYGVRSSEVEVAAAKQMASDHEDQDSDLSNFPMPKSKARVSWDDVRKAEEIELETVVTSKGDEDQKHAIKGFGFEDDRLMNCNWLKEPNADDLLMFFRILAVCHTAIPELNEETGVYTYEAESPDEGAFLVAAREFGFAFCRRTQSSIFIHERFSASGQVVEREYKLLNLLDFTSKRKRMSVIVRDEEGSFLLLCKGADSIIFDRLSKNGKNYLEATTRHLNEYGEAGLRTLALAYRKLDEQEYTAWNNEFQKAKAAVGADRDSMLERVSDMMEKELILVGATAVEDKLQKGVPQCIDNLAQAGLKIWVLTGDKMETAINIGFACSLLRQGMKQICITTPVTDSVATDVKQAIKDNILNQITNGSQMIKLEKDPHAAFALIIDGKTLTYALEDDMKLLFLGLAVDCASVICCRVSPKQKALVTRLVKQGSGKTTLAIGDGANDVGMIQEADIGVGISGVEGMQNSVRNYNWPILKPATPFQAVMASDFAIAQFRFLERLLVVHGHWCYKRIAQMICYFFYKNITFGLTIFYFEAFTGFSGQSVYDDWYMILFNVVLTSLPVISLGVFEQDVPSEVCLQFPALYQQGPKNLFFDWYRILGWMGNGLYASLIIFFLIVTIFYDQAFRADGQVADMAAVGTTMFTCIIWTVNCQIALTMSHFTWIQHLFVWGSIATWYIFLSLYGMLSPEYSKSAYQILVESLGPAPIYWVTTLLVTVTCNLPYFAHISFQRCFNPMDHHIIQEIKYYKKDIEDQHMWTRERSKARQETKIGFTARVEAKIRQLKGRLQKKQSTLAISAPS

SEQ ID NO: 126149 - protein, 476 aa, Glycine max
  Coding DNA Sequence Number=SeqID_9371
  Gene Ontology: Mol. function=protein serine/threonine kinase activity; Cellular component=cytoplasm; Biological process=protein amino acid phosphorylation
  Homolog annotation: Hit_ID=Q1SRR9; Match level="QueryCoverage=99%, HitCoverage=100%, E-value=0.0, Identity=76%"; Hit description =Protein kinase
  Pfam annotation: Domain name=Pkinase; Domain location=9-278; Score =156.5; E_value=7.1e-44; Accession=PF00069.15; Description=Protein kinase domain
  Pfam annotation: Domain name=Pkinase_Tyr; Domain location=9-273; Score=-107.7; E_value=7.3e-06; Accession=PF07714.7; Description =Protein tyrosine kinase
  Pfam module annotation: Pfam domain module=Pkinase::Pkinase_Tyr; Domain location=9-278::9-273
MEPRVGNKFRLGRKIGSGSFGEIYLGTNIQTNEEVAVKLESVKTKHPQLLYESKLYKILQGGNGIPNVKWYGVEGEYNVLVMDLLGPSLEDLFNFCSRKLSLKTVLMLADQMLNRVEFVHSKSFLHRDIKPDNFLMGLGRRANQVYIIDFGLAKKYRDTTTHQHIPYRENKNLTGTARYASMNTHLGIEQSRRDDLESLGYVLMYFLRGSLPWQGLKAGTKKQKYEKISEKKVSTSIESLCRGYPSEFASYFHYCRSLRFDDKPDYAYLKRLLRDLFIREGFQFDYVFDWTILKYQQSSSVTAPARAIGPAAGPSSGMPPLASNGDGQLGGEDGNGRPTNWSSSDPTRRRNSGTIANDGILSRQKGPVTYDSTGSKDAMLSSSNFFWSSGTAKRGAVSGNRDVVGSETEASRSLILDSSQGALRKIPAPGAQRSSAIMSSEHNRTSSGRNTSNIKNLETTLRGIESLHFNDERVHY

SEQ ID NO: 126150 - protein, 258 aa, Glycine max
  Coding DNA Sequence Number=SeqID_9372
  Gene Ontology: Mol. function=transmembrane receptor activity; Cellular component=membrane; Biological process=defense response
  Homolog annotation: Hit_ID=Q9FNJ2; Match level="QueryCoverage=51%, HitCoverage=13%, E-value=1e-20, Identity=40%"; Hit description =Disease resistance protein-like
  Pfam annotation: Domain name=LRR_3; Domain location=148-167; Score =33.2; E_value=8.9e-07; Accession=PF07725.3; Description=Leucine Rich Repeat
MNSSLDSLESLCSEFGDQYRYSRLIITTRNRKLLDGKVERRYKYVKHVEKILEKDNEAHEVIKSNKGTDAIQGIALNLSLIKDLLLHADTFTKMKTLRFLKFHNTLGQSSSNTYLDLPATLEPFSDQLRYIEWIGYPFQSPSPFFAKFLVEIPMPHSKLKQLWQGIQELDYLQEIELGECKQFEEVPDLSKAPVTINDSAQSNTEQSIIKHGEQGIESNTEAIQGAESKPETGTSMEKASKPKRGIIKPRCLKDFVEK

SEQ ID NO: 126151 - protein, 204 aa, Glycine max
  Coding DNA Sequence Number=SeqID_9373
  Gene Ontology: Mol. function=RNA-directed DNA polymerase activity; Cellular component=chromatin; Biological process=chromatin assembly or disassembly
  Subcellular localization annotation: CTP_CleavageSite=51; ConfidenceScore=5.01e-01
MAIKFIAIPDKDAQRSRQGVKFPGRSDPLRHKSLFGSWAVRVGAGLRVPVKAESLLAVACHFGGGGGFGGVGNKGSGEGAREGGERGLGGVTTEWPASVYQLLLLESCEPDGVDNGEGRREANNAVSQGLELRQVLSDCPFLRELEEDPGRVLVWRMRKTGLNGFQKAWPGGELVVTGEPLKPCQCWALHVGGDGKLFRFGGGM

SEQ ID NO: 126152 - protein, 374 aa, Glycine max
  Coding DNA Sequence Number=SeqID_9374
  Gene Ontology: Mol. function=DNA-directed RNA polymerase activity; Cellular component=mitochondrion; Biological process=transcription
  Homolog annotation: Hit_ID=O47884; Match level="QueryCoverage=88%, HitCoverage=36%, E-value=6e-71, Identity=48%"; Hit description=RNA polymerase
MAAKDLYYYPKQTTNKTMLTTRQFKCMLEKHKLFLLPVRFQSTSNWISHFANTLDMPENKSENRAKIESFWEGALKDIYEETLMYDNNDVVHSPDECVDPETRKIKVPKSEFVKTYKNSVFSLLDRYRYENNDAQTLESLQREIEDLTLNFSEDKYPGRMTIYAESRSGDSLETSGSELSDEENKNLRCVLSESDKSLLVELGEHSIECLLVHTLGHLFNLENIVSLASLVDRIERNVRDYASSSTLYYNSRVCNLSMDAVDKGTKASKTRAYPFGTALVEFLVSRGLLRLVTYNVDLLNFSDDSGPKTVVKNVVKKGHNYYRSSLVYAECLFNPALLPIKLNLPMVFPPKDWEPHKPEQKPTLRAKSTALNGV

SEQ ID NO: 126153 - protein, 312 aa, Glycine max
  Coding DNA Sequence Number=SeqID_9375
MAKTERDSRRSVRDMTVLDCGMKARGDRPWQPVRPVSMRAPGRGMQQTARPRFVAEGIAMCVPILPSAAARRISRVPALVALLMIAAMALQAQQANASCVRLNPGDQDLTVSLTMPNIDRPDTRYRVFNAGQIPGGFECTAGQTAFNIDAPLTGLTYVRDVQMDSYLYKVYSTGPRSPLIGFSFSVKKSSQGSYGGPPIELGVRNRHPGESVTQTEPMNVDVYMVIFFRGGAMESIPMTDLGTITSSVEGDPSQSMQHHVRLEIIVPPVTCTLANASHTLDDVLANELAASGSNAKESSFDVAMNCPMDNID

SEQ ID NO: 126154 - protein, 450 aa, Glycine max
  Coding DNA Sequence Number=SeqID_9376
  Gene Ontology: Mol. function=protein serine/threonine kinase activity; Cellular component=cell surface; Biological process =protein amino acid phosphorylation
  Homolog annotation: Hit_ID=O49445; Match level="QueryCoverage=75%, HitCoverage=52%, E-value=2e-94, Identity=49%"; Hit description =Receptor protein kinase like protein
  Pfam annotation: Domain name=Pkinase; Domain location=120-375; Score =136.5; E_value=7.1e-38; Accession=PF00069.15; Description=Protein kinase domain
  Pfam annotation: Domain name=Pkinase_Tyr; Domain location=126-375; Score=64.0; E_value=2.1e-16; Accession=PF07714.7; Description =Protein tyrosine kinase
  Pfam module annotation: Pfam domain module=Pkinase::Pkinase_Tyr; Domain location=120-375::126-375
MQVASFTGESQATAQYNQSLTKAYRTAVQDGVVAGRIIDSAKILAWSFSDSKFSIGDALVTENLPSFVHHKKWFPGAQAFAVAFFVLRRRKTQEEVEDWELEYWPHRIGFHEIDAATRGFSEENVVVVGGTVKVYKGVLHGVEVAVKRIPQEREEGMREFLAEVSSLGRMKHKNLVGLRGWCKKEKGNLILVYDFMSNVSLDKWIFECEEGMMLTWEERIQVLKNVATGILYLHEGWEVKVLHRDIKESNVLLDKDMNARLGDFGLARMHDHQGQVVSTTRVIGTLGYIAPEVIQRGTASTLSDVFGFGILVLEVICGRRPIEEHKPGLIEWLMSLMVQGQLHSAVDERLKAKGGYTIEEDPSIRPTMRQVVKILEVEIDSIESDEDNMEMSLLGKIRSATTWSRAECALPYSGYPSFDEVKMFSFNSRTSRSGSSTFPGSGSEITSINM

SEQ ID NO: 126155 - protein, 144 aa, Glycine max
  Coding DNA Sequence Number=SeqID_9377
  Subcellular localization annotation: CTP_CleavageSite=53; ConfidenceScore=5.69e-01
MAIARGTSNIAGAPSNFLKTQKCPCTFSLYKNYFFSFFLFAFSLLRFLHSGVRFLHSGACAVRFLSMLDVLVLFFGVIFVKEHITTTEEKNLFRGITRKTPFMDEDQWAYYSAMSEEVDMDFQNEEDCGVNEAHVDCSDAFNTS

SEQ ID NO: 126156 - protein, 314 aa, Glycine max
  Coding DNA Sequence Number=SeqID_9378
  Gene Ontology: Mol. function=nucleotidyltransferase activity; Cellular component=membrane; Biological process=lipopolysaccharide biosynthetic process
  Homolog annotation: Hit_ID=Q5W5Y8; Match level="QueryCoverage=60%, HitCoverage=83%, E-value=1e-42, Identity=48%"; Hit description =Putative acylneuraminate cytidylyltransferase
  Pfam annotation: Domain name=CBS; Domain location=163-270; Score= -2.4; E_value=0.098; Accession=PF00571.18; Description=CBS domain
  Pfam annotation: Domain name=CTP_transf_3; Domain location=1-194; Score=-37.5; E_value=0.0085; Accession=PF02348.9; Description =Cytidylyltransferase
  Pfam module annotation: Pfam domain module=CBS::CTP_transf_3; Domain location=163-270::1-194
ALNSSSIDRVIVSTDCEDIAAVAREYGAEVPFMRPAHLANDTAATEPALLHTLEWLAEHESYHPEYTVLLQATSPVRKDDAIDSAIRKILEKKADSLLSVCEFWHFLWENEDNPKAYYDYLNRPRRQDIKPENIKLKENGSIYVTKSEILLSTGNRLGGKVVAHKMSEEESFEIDTMLDWAVVEVILKNWNGKLCGSFSDGDFRRWITNGDFDLSREMSEVMNQNVRYKKVDAPRNEIESLFSNGVDVLPLVDDYRRLVAVALQSEKGLTIGKHTITETSPTYIIAEIGNNHNGDIKLAKHLVDLAVDAGADCV

SEQ ID NO: 126157 - protein, 141 aa, Glycine max
  Coding DNA Sequence Number=SeqID_9379
MVMGDFISRLSFPACLHFSGENTETFSSLTSYPELRRSEFLIGGYVGARASLLSTTPPFVAMTQELVARGDTLRLSAPRHSVIPSVIDEQRPIWSSAPFPEMSAFSDGDFSSLTSYQELRRSEFLIGGYVGARALLLSAAP

SEQ ID NO: 126158 - protein, 132 aa, Glycine max
  Coding DNA Sequence Number=SeqID_9380
MDEWALTIQEIDDQIQSKRIEKSSTLETVQKRKAELTSRLANTANSIPTLVHEIQLLLSQISKWEQEKASNAKRVAEIEEKNIASCGSDLRVIYISNQWVYIYIMWLLDLVTIPVVVALDLVTILVVVLSSL

SEQ ID NO: 126159 - protein, 454 aa, Glycine max
  Coding DNA Sequence Number=SeqID_9381
  Gene Ontology: Mol. function=potassium ion transporter activity; Cellular component=membrane; Biological process=potassium ion transport
  Homolog annotation: Hit_ID=Q94IL7; Match level="QueryCoverage=99%, HitCoverage=58%, E-value=1e-153, Identity=60%"; Hit description =Putative high-affinity potassium uptake transporter
  Pfam annotation: Domain name=K_trans; Domain location=1-454; Score =166.9; E_value=5.3e-47; Accession=PF02705.7; Description=K+ potassium transporter
MDILFWPVFVVAALAVIVASQAVIASTFSIVQQCHAFECFPRVKAVHSRRWIPGQTYIPEINWILMIISLVVTVGLGDMSNIGYAYGMAYLIVVFVTTCLTSLVINLVWNQSLIVALAFALFFGAIEILFLSSYCMKILKGSWIPLVLSAVFMVVMYVWHYGSRKKYLFDMLNKVSMRSIITLGPSLGIVRVPGLGLIYTELATGVPASFTHFLTNLPAFYQVVVFVCVKTVPVPCVPHEERYLIGRIGPKSYRLYRCIVRNGYKDVYSHQNDFENDLVMSIAEYIQLEAEGCSGNAEGSVDGRMAVVRTSGKFGTRLRMSESAGFEEGCSISLPGALTVTSSKSPALKKLQAMYEQESPDELNTRRRIQFELLNVIYKDPRVKEELMELVEAKRAGAAYVIGHSHVKAKWNSSFLKRFAINLYSFLRKNCRSPAVGLNIPQISLIKVGMNYHV

SEQ ID NO: 126160 - protein, 346 aa, Glycine max
  Coding DNA Sequence Number=SeqID_9382
  Homolog annotation: Hit_ID=Q94F64; Match level="QueryCoverage=84%, HitCoverage=56%, E-value=1e-64, Identity=44%"; Hit description=CDPK adapter protein 1
MQLQLRYGHGNALPIAAVPLQQIAQEAYDSDSGDVVKCKARNKKCTSLVLEEIEKYSPAMHCDICCSEPGFCRDCCCILCCKTVSSAYGGYNYIKCQVNSGGGICGHVAHMECALRCLLAGKVGGNIGLDAQYHCRRCDGRTDMISHVNNLLQTCRAADLDDEIRKKILNLGACLLRGSQKPGNRNKNHLACFLLHIVKAYDQFDSLYQLKCGTNLEDIWKEDDSFIAHSADNGNDVMEVMVYDDPFEVRTGLESYDFLPRSIKLESEVDQVLRALRKSQELEYKVAEETLQDQKTYLKNLYQQLDCEKYELACQNSSTSDVSSSAVRERKKQIRREVAKFEIMKK

SEQ ID NO: 126161 - protein, 73 aa, Glycine max
  Coding DNA Sequence Number=SeqID_9383
MEKKGKRTTVDAPRSLLASELIAKPEENRASSFGLERERALSLRSFLERKKNGKSTPTGVYWDREIASNVEHV

SEQ ID NO: 126162 - protein, 58 aa, Glycine max
  Coding DNA Sequence Number=SeqID_9384
MGLTVFAPPSHLWLHFAFIFGTPTHSNMPKVHPEAMGHATLPPFSCYSCQNMRPPSSR

SEQ ID NO: 126163 - protein, 164 aa, Glycine max
  Coding DNA Sequence Number=SeqID_9385
MKSYYCLVEEYLGTVTKYQNDPLLMRLISKHLYLERIFDDSTSNNPTLRWRYRNFFSDNAVNGHRTHDRESNDKSQGRSENVTDSKRTNLKTKRTFKNASPDIMSEGDPLDCLFGYAPPVEEIHHSNFPNKPSGIHNRARRKSHRRRRMHNHEDLSNSESAAAV

SEQ ID NO: 126164 - protein, 120 aa, Glycine max
  Coding DNA Sequence Number=SeqID_9386
MMDLSTFTKRLRGTIMHICAELEATRIYGLSKLDLSALFEQQYPMIFCKGSNYLPVTYLSYCLPWGHQRFQYLDPVNLSSQKWGRRKKEWKVNATVTNDKSAAAVTAFRNTKLSLYEVKG

SEQ ID NO: 126165 - protein, 487 aa, Glycine max
  Coding DNA Sequence Number=SeqID_9387
  Gene Ontology: Mol. function=metal ion binding; Cellular component =intracellular; Biological process=protein kinase C activation
  Homolog annotation: Hit_ID=Q1SVE9; Match level="QueryCoverage=99%, HitCoverage=96%, E-value=0.0, Identity=47%"; Hit description =Tetratricopeptide-like helical
  Pfam annotation: Domain name=PPR; Domain location=11-45; Score=4.5; E_ value=2.2; Accession=PF01535.11; Description=PPR repeat
  Pfam annotation: Domain name=PPR; Domain location=182-216; Score =45.4; E_value=2e-10; Accession=PF01535.11; Description=PPR repeat
  Pfam annotation: Domain name=PPR; Domain location=217-251; Score=7.9; E_value=0.86; Accession=PF01535.11; Description=PPR repeat
  Pfam annotation: Domain name=PPR; Domain location=253-287; Score =10.6; E_value=0.42; Accession=PF01535.11; Description=PPR repeat
  Pfam annotation: Domain name=PPR; Domain location=319-353; Score=0.3; E_value=6.8; Accession=PF01535.11; Description=PPR repeat
  Pfam annotation: Domain name=PPR; Domain location=46-80; Score=1.7; E_ value=4.7; Accession=PF01535.11; Description=PPR repeat
  Pfam annotation: Domain name=PPR; Domain location=81-115; Score=19.5; E_value=0.012; Accession=PF01535.11; Description=PPR repeat
  Pfam module annotation: Pfam domain module=PPR::PPR::PPR::PPR::PPR::PP R::PPR; Domain location=11-45::182-216::217-251::253-287::319-353::46- 80::81-115
MKTSGTEPDAIILCTVLSACGHAGNLSYGKLIHQFTMDNGFRVDSHLQTALVNMYANCGAMDLAREVYDQLPQRCFRGMRNLEWAMISGYAESDEPLEALQLFNEMQRRIIVPDQITMLSVISACTNVGALVQAKWIHTYADKNGFGRALPINNALIDMYAKCGNLVKAREVFENMPRKNVISWSSMINAFAMHGDADSAIALFHRMKEQNIEPNGVTFIGVLYACSHAGLVEEGQKFFSSMINEHGISPQREHYGCMVDLYCRANHLRKAMELIETMPFPPNVIIWGSLMSACQNHGEVELGEFAAKQLLELEPDHDGALVVLSNIYAKEKRWEDVGLIRKLMKHKGISKEKACSKIEVNKEVHVFMMADGYHKQSDEIYKMLDAVVSQLKLVGYTPSTLGILVDLEEEEKKEVVLWHSEKLALCYGLIGERKESCIRIVKNLRICEDCHSFMKLVSKLYRIEIVMRDRTWFHHFNGGICSCRDYW

SEQ ID NO: 126166 - protein, 119 aa, Glycine max
  Coding DNA Sequence Number=SeqID_9388
  Gene Ontology: Mol. function=protein serine/threonine kinase activity; Cellular component=integral to membrane; Biological process=protein amino acid phosphorylation
  Homolog annotation: Hit_ID=Q1SK93; Match level="QueryCoverage=55%, HitCoverage=12%, E-value=4e-29, Identity=92%"; Hit description=EPS15 homology (EH); Protein kinase
MDDGDDLAAGVGGGALGVVALGDDAVEELAAGAELHDEVDGVAVLVGALELDDVAVAGEVVHDLHLAPDVVDVVAVRVRREDGDAVAAGMVVGVGGAADSAAAAAVAHGLRTKMDFAAA

SEQ ID NO: 126167 - protein, 723 aa, Glycine max
  Coding DNA Sequence Number=SeqID_9389
  Gene Ontology: Mol. function=protein serine/threonine kinase activity; Cellular component=membrane; Biological process=regulation of transcription, DNA-dependent
  Homolog annotation: Hit_ID=Q9AXB2; Match level="QueryCoverage=75%, HitCoverage=81%, E-value=1e-177, Identity=57%"; Hit description =Disease resistance protein-like
  Subcellular localization annotation: CTP_CleavageSite=85; ConfidenceScore=5.39e-01
MFILADVSVPTMWFNANSMSASMMDRRDTSGFVSGGGFITFMDARFKNFLGFAANHSANAFKILGNSMQVEGRGANYHGTDTILRLDSPGSSIPTSVPSYKGTKRKWDLIDGCMGQRVDSSLSLGLGRSSSSSDSKGSSAAACTAMSSAKDIDEESSLDIELDFSLHLGCEKVHSQKKPVNPSLKTMELQPKFDLELSLSTGPCESDITSVHLNPSPLQLNMEMPLAFSGTQNTDEGSTSCSWKPGIALPSSKTSSNTGTNFLLNQSSKQFDHSPIVVELSSTRPKSLVTCISELTQQQQALHRPSNSKTCQVEGCGKGARGASGRCISHGGGRRCQKPGCHKGAEGRTVYCKAHGGGRRCEFLGCTKSAEGRTDFCIAHGGGRRCNHEGCTRAARGKSGLCIRHGGGKRCQRENCTKSAEGLSGLCISHGGGRRCQAPGCTKGAQGSTMFCKAHGGGKRCTAPGCTKGAEGSTPYCKGHGGGKRCTYQGGGVCTKSVHGGTNFCVAHGGGKRCAVPGCTKSARGRTDHCVRHGGGKRCKFEGCGKSAQGSTDFCKAHGGGKRCSWGHPGSEYGIQQDGPCNSFARGKTGLCALHSGLVHDKRVHGGISLGSVVQDPHSSKTDELKQVLVDKNMGIDMMKIGSSLGTATCSDFEQFEAATAHVSAKEGSHLPVSVAVPEGRVHGGSLMAMLTGSSSRGSSSGRGLVGDPSEPIKGYAMPQSWI

SEQ ID NO: 126168 - protein, 181 aa, Glycine max
  Coding DNA Sequence Number=SeqID_9390
  Gene Ontology: Mol. function=protein serine/threonine kinase activity; Cellular component=cytoplasm; Biological process=protein amino acid phosphorylation
  Homolog annotation: Hit_ID=Q2PMC9; Match level="QueryCoverage=76%, HitCoverage=27%, E-value=8e-68, Identity=87%"; Hit description=CDPK
  Pfam annotation: Domain name=Pkinase; Domain location=1-108; Score= -61.6; E_value=6.9e-05; Accession=PF00069.15; Description=Protein kinase domain
MHSCGDVFRDLVGSAYYVAPEVLRRSYGPETDIWSAGVILYILLSGVPPFWAENEQGIFDAILRGHIDFASDPWPSISSSAKDLVKKMLRADPKERLSAVEVLNHPWMRVDGDASDKPLDIAVLTRMKHFRAMNKLKKVALKVGQAQGADVFAPLHFAPLYSSICPLITYEPCTTSCNGII

SEQ ID NO: 126169 - protein, 247 aa, Glycine max
  Coding DNA Sequence Number=SeqID_9391
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=3e-43, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLASKGLHALALKGRHVLAFRGLHALAFRGLHILAFRGLHVLAFRGLHVLAFRGLHALAFIGLHVLAFKGLHVHAFRAQNALACRGLHILAFRGLHVLAFRGLHALAFRGLHSLAFRGLHVLAFRGLHVLPFRGLHVLTFIGLHALTFRGLHVLPFRGLHILTIRGLHILPFIGLHALTFRGLHILPFRELYALAFVGLHALTFRGLHVLAFRGLHALSFIGLHALAFMGLHICAFRELKVLHP

SEQ ID NO: 126170 - protein, 431 aa, Glycine max
  Coding DNA Sequence Number=SeqID_9392
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S7U6; Match level="QueryCoverage=98%, HitCoverage=23%, E-value=1e-114, Identity=55%"; Hit description =Prefoldin
MSVAEDENSVILHEVLALSNLNLVYESFLTQKVIEQKALSEHLSSNLSRLNSDLNQELGVLRKKFELKEEESVYLNEATKRMDKELREIKNANCRLSHQVENSENLLKKKDIELLEMETRLKAAEKLNGEFCRYIEELKMDQEESRLIRENLDRQILELSENCMNQKREIEHFNEENRSFQSMMRSLLHEVEQHKVREQALNTELQDKTNECQLCEAEAASFYLELQISSISEELLKGKVTELTGVFKRLDDESAGKGLLIEQMRERISLLEKEIRGLKGQLSAYTPMITSLKEDFASLEHTYFLLTNKTFAVGNGEQKDVAIETCLHEELSYQSLKGSESSLTPDGVADLLSMQTRIRVVEKFMMEELERRVKKESLTANVKAEAVTEMNEHSNLEVGTYPEIDDRKVVMKIKKDNSKRGHNAWRTKSQK

SEQ ID NO: 126171 - protein, 521 aa, Glycine max
  Coding DNA Sequence Number=SeqID_9393
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S7U6; Match level="QueryCoverage=99%, HitCoverage=31%, E-value=0.0, Identity=68%"; Hit description =Prefoldin
MELKYGLQLLKDLQFPKQGFKEEMQENVEENRILNELTFSSTRSLLRRQQTEISKLKEIKEKLERELVVNSEENNALQQEAHQIKNNIQLLNNKYHAMLEQLQTLGLDPKCFAASVKDLQNENSNLKEVCKMERNEKEALHEKSKDMDELLIENAFMEFSLSRLNDELDGLRVTVRKSQESCHVLQEEKSTVVDEKLALLSQLQIVTESMQKLLEKNALLEKSLSDSKIELEGLKAKSTDLEEFCKLLNDEKYNLLNERSILVSQLESVEAKLRNLEKLFTKLEEKYADSEKDKESTGNQVEELRASFLVQKEKHANHKHLSEVRLTNLENLFHALQEELWLGKIEFEKEVDKAVNAQMEMFILQSCIEDLEQKNLALLTECEKHVEASKFSNKVISELETENFMQLMEEEFLLHEIRKLKMAIHQVCGALQIDPYGVHDKGIKQEEMPILHILDNIEGLKSSYVKSQEEKQKLLVENSVLLTSLEQNRSDREKMESEKKIMEQEFESMRQKNAMLQKREG

SEQ ID NO: 126172 - protein, 91 aa, Glycine max
  Coding DNA Sequence Number=SeqID_9394
MLMLDQFHPCIHDSIENMIDVKADGNRGYRAIVALLGMGEDSWSLVRNHLLKELVEWFDEYINLLGRTDRFKELKRSLLVDGLSMFLWISG

SEQ ID NO: 126173 - protein, 86 aa, Glycine max
  Coding DNA Sequence Number=SeqID_9395
MGKAKEVQEQMEADMEAMKEQMAAMMEAMMSMKKIMEANAVAVATTSAVAKVNPTSPSGINPMNHPTSDMIGKDFGSMGGPHYAQI

SEQ ID NO: 126174 - protein, 63 aa, Glycine max
  Coding DNA Sequence Number=SeqID_9396
MVDTRDSKSRAKEGGGDLSIEKIHRPETKRKKGRSVWEVRSSLDISSSVKNCRCETQRQKADL

SEQ ID NO: 126175 - protein, 103 aa, Glycine max
  Coding DNA Sequence Number=SeqID_9397
MVNMNEQHVDCSDAFNTFQWTRSVAHENRFVTVIMRSDTNTDNKGRTSFVLIGCERSVQDRSRNKDSVRRDARSRKCECPFKLHRKLVLRGQGLDGEVVVWES

SEQ ID NO: 126176 - protein, 95 aa, Glycine max
  Coding DNA Sequence Number=SeqID_9398
  Gene Ontology: Mol. function=transferase activity; Biological process= DNA integration
  Homolog annotation: Hit_ID=Q1SER7; Match level="QueryCoverage=85%, HitCoverage=45%, E-value=1e-13, Identity=36%"; Hit description=Tpv2 -1c-related
MKIRLPHFATLSIERKQYAKIQSSFDIPQNSFGYQDGRFPPLLYNFSYQANTVGQLECGWIAISHVESLQDNSRILLLMCENSLPSGRKLYSKKV

SEQ ID NO: 126177 - protein, 56 aa, Glycine max
  Coding DNA Sequence Number=SeqID_9399
SSRFIFSLKWRLQSSFYFFIPLPSNFKKQRTPLMKKIQGLQAPHGATSCGIKSIFI

SEQ ID NO: 126178 - protein, 98 aa, Glycine max
  Coding DNA Sequence Number=SeqID_9400
MYYNGKWNIPRQGEFLGYSFTGTNPIRFGIPSGCGMEKLKDLIKQVAPIGVPPNGIHGSQLVRRLFFRQPGHSKYSENLIEYDITELKNDEDVLKVLA

SEQ ID NO: 126179 - protein, 132 aa, Glycine max
  Coding DNA Sequence Number=SeqID_9401
MGEEVAAQLAQAICRLSPEATCSPRRAGCFLLKLPDGPSALNVTGKNPHVNKQLSSDEIRQGNLRLWDRSCAPLKDGNGLSHFGMGRNLPFGGRATRDSRVRVPRKEYARSHHQHLFEENVGKTGKDVVYEL

SEQ ID NO: 126180 - protein, 482 aa, Glycine max
  Coding DNA Sequence Number=SeqID_9402
  Gene Ontology: Mol. function=transcription factor activity; Cellular component=nucleus; Biological process=regulation of transcription
  Homolog annotation: Hit_ID=Q1SRF6; Match level="QueryCoverage=99%, HitCoverage=100%, E-value=1e-180, Identity=69%"; Hit description =GRAS transcription factor
  Pfam annotation: Domain name=GRAS; Domain location=32-391; Score =245.4; E_value=1.2e-70; Accession=PF03514.5; Description=GRAS family transcription factor
  Subcellular localization annotation: CTP_CleavageSite=63; ConfidenceScore=5.49e-01
MTQFTPPLPPLHHQITSLLPNPNMMNKNQIPRPRPWPASGFPTTSKALSNLGNANCMEQLLVHCANAIETNDVTLAQQILWVLNNIAPHDGDSNQRLASGFLRALTARAAKTGTCKMLVSAGTNLSIDTHRFNIIELANFVDLTPWHRFGFTAANAAVLEATEGFSVVHIVDLSLTHCMQIPTLVDAIASRQHHDAPPPIIKLTVADACCRDHIPPMLDLSYEELGAKLVSFARSRNVIMEFRVVSSSYQDGFASLIEHLRVQQEQQQQQQQQHFVYAAEPSTPSEALVINCHMMLHYIPDETLSDTTDLTSYVYDSSSSAAVSVTPTSSLRSLFLKSLRGLDPTVVILVDEDADLTSNNLVCRLRSAFNFLWIPYDTVDTFLPRGSKQRQWYEADICWKIENVIAHEGLQRVERVEPKNKWEERMKNASFQGVGFSEDSVAEVKAMLDEHAAGWGLKKEDEHIVLTWKGHNVVFASAWLPA

SEQ ID NO: 126181 - protein, 201 aa, Glycine max
  Coding DNA Sequence Number=SeqID_9403
  Homolog annotation: Hit_ID=Q8H6Q8; Match level="QueryCoverage=29%, HitCoverage=1%, E-value=9e-11, Identity=52%"; Hit description=CTV.20
  Subcellular localization annotation: CTP_CleavageSite=25; ConfidenceScore=5.38e-01
MKAKILENVLIMSRLLRSFSRISFRSNSSSSSSSRNTNLLNDQDNQTQEVAPKHNPFDEEVRFEDINQNMDDWNIPEIPQDQLYVPETIKDKHNFDYIIKTVENNIPLGQDIGEEFHLLSKNSIYEHSRKYKYLHIGCVQVAIKPLIDMGIDAAVLMCLRDIRHNQFEDSLIGTVETSLGQGPIYFNCYPNKTVSLMDRNI

SEQ ID NO: 126182 - protein, 89 aa, Glycine max
  Coding DNA Sequence Number=SeqID_9404
  Gene Ontology: Mol. function=nucleic acid binding; Biological process= DNA integration
  Homolog annotation: Hit_ID=Q1RWP6; Match level="QueryCoverage=77%, HitCoverage=5%, E-value=5e-18, Identity=60%"; Hit description=Zinc finger, CCHC-type; Polynucleotidyl transferase, Ribonuclease H fold
MSRLPSRHGTLSTKGLVIHTLNGLGVEYKEVSTALRTCEKLIDFEDIYDLLSDIESYLKRDDNNNDTSFVATTHAAHKGKQPYHKSPTI

SEQ ID NO: 126183 - protein, 326 aa, Glycine max
  Coding DNA Sequence Number=SeqID_9405
  Gene Ontology: Cellular component=nucleus
  Homolog annotation: Hit_ID=Q9FN12; Match level="QueryCoverage=94%, HitCoverage=94%, E-value=2e-47, Identity=40%"; Hit description =Arabidopsis thaliana genomic DNA, chromosome 5, TAC clone:K8K14
MPAARYFSPADTIEQKLQIERRLGSVKTRKYFNLLERFLSFKISKHEFDRVCIATIGRENVPLHNHFLKSILRKACLSKTAGSRESKVESSLNVKTPNGCSNLQILCKDFPQSPRKGRTPNLRDRRSRDRPSPLGPNGKNNSIGCSRLPLSVEDGEEVDQDYEILNLFKKSPIQAPLAIPTYNRRPQPKYLSQGLSSGTVSDTCQSIAQLPDTCSLTKRLEQKLEIEGLKISTDAASLLNNALDVYLKRLIKPCLDLAASKSVNKFSGPIQPGLNELPLRRCVQKPIRSASVSISDFRTAVELNPTILGEDWPLNLEKVCLCALEE

SEQ ID NO: 126184 - protein, 244 aa, Glycine max
  Coding DNA Sequence Number=SeqID_9406
  Gene Ontology: Mol. function=oxidoreductase activity; Cellular component=vacuole; Biological process=response to oxidative stress
  Homolog annotation: Hit_ID=Q9ZP15; Match level="QueryCoverage=73%, HitCoverage=51%, E-value=6e-73, Identity=78%"; Hit description =Peroxidase precursor
  Pfam annotation: Domain name=peroxidase; Domain location=44-237; Score=192.1; E_value=1.4e-54; Accession=PF00141.13; Description =Peroxidase
MGRLNLLLVWSLSLTLSLYYLHPISAQLSPNHYAKTCPNLESIVRQAVTKKFQQTFVTVPATLRLFFHDCFVQYCSHDWWQKGCDASVLIASTGNNQAEKDHPDNLSLAGDGFDTVIKAKAAVDAIPQCRNKVSCADILALATRDVIALSGGPSYTVELGRFDGLVSRTSDVNGRLPQPTNNLNQLNSLFAANGLTQTDMIALSGNLRATVCKWVPFAFVHVLGSLLEWLIFDNVSSHLCYCKV

SEQ ID NO: 126185 - protein, 74 aa, Glycine max
  Coding DNA Sequence Number=SeqID_9407
MGMYIKSTQYRIWLIIINGDIPITKPEAEWRNDDLTIVELNTKAKYTLTCFWTDVLQGLDKLKGAGQLSQGVGT

SEQ ID NO: 126186 - protein, 169 aa, Glycine max
  Coding DNA Sequence Number=SeqID_9408
MEEGFSINTPPLFREIKYDYWKECMIAHFEFIHIDLWDVIPKGQRMKEKKLKFLLNSKVRNVMMYALFIEEYTKADDSFDDEYEEDSDKDELTFISQKIRKMWQNKGSSKWKTPQEEYPKKRKIKTRAPYSTMNAKKPRHLKSECLELEKGQEKKKYFKTKEKQGLMSN

SEQ ID NO: 126187 - protein, 250 aa, Glycine max
  Coding DNA Sequence Number=SeqID_9409
  Gene Ontology: Mol. function=nucleic acid binding; Cellular component= chromatin; Biological process=DNA integration
  Homolog annotation: Hit_ID=Q1SDG1; Match level="QueryCoverage=88%, HitCoverage=19%, E-value=6e-81, Identity=62%"; Hit description =Integrase, catalytic region; Zinc finger, CCHC-type
  Pfam annotation: Domain name=rve; Domain location=1-154; Score=106.3; E_value=9.1e-29; Accession=PF00665.16; Description=Integrase core domain
MDLFGLTRTLSLGGKKYGFVIIDDYSRYTWVYFLAHKNESFKVFEIFYKIVQNEKGFYISSIRSNHGTKFKNAEFRSFYKKNGIFHNFSTSRIPQQNGVVKRKNRTLQEMARTMLCENSLPKYFWAEAVNTTCYVQNKILIKPLIKNTPYELWRRKRPNISYFHSFGCKCFILNTKDQLAKFDSKVDKGIFLGISNTSKEYRVFNTRTLVVEESIHVEFNDGLTSDKRLLDLKDDFTDMQMRSSIHPKER

SEQ ID NO: 126188 - protein, 81 aa, Glycine max
  Coding DNA Sequence Number=SeqID_9410
  Gene Ontology: Mol. function=RNA-directed DNA polymerase activity
MEDAKPMKTPMHDSKPLSNMKHKQDFSLVGYYDAEDRVERKNASRGCHYIGPSLISWASKKKNFIALSTTEVATSCCSQLL

SEQ ID NO: 126189 - protein, 70 aa, Glycine max
  Coding DNA Sequence Number=SeqID_9411
MAPPRKNESFNNPIINNVEDASQAFPKEWFIPGKEQQGKMESTSRGLLLRLKWRSLLPLLLLCLDVLWMV

SEQ ID NO: 126190 - protein, 156 aa, Glycine max
  Coding DNA Sequence Number=SeqID_9412
MKKKAHEEEANKILEKIIIESLKILTREEELRQTTISDQVPDEVVLEVVKVASEEEMQKEKFDARVQSTLETMPLQGSKVVASSNLIETDPRVAPLHSRLVIVDDEAVVDALLAQPMLEADISRLKGIYGATEYVSFNEMKIRLEIKKRVETDAAP

SEQ ID NO: 126191 - protein, 67 aa, Glycine max
  Coding DNA Sequence Number=SeqID_9413
TQGPGKSSLLTAHLGAQCPMCAVKKTLWIFRLPTTKDEIHIQRMCDGMMQMRKSATRGCTEYDNIHK

SEQ ID NO: 126192 - protein, 116 aa, Glycine max
  Coding DNA Sequence Number=SeqID_9414
MDEFDTQVAWPGAQSSPFGGGGASAAQEPEPEEPAATAKGEDELTPPEPFYFDANVHMAQEEETSIDQIPEPSLVPIPDDSMPFAPAFELEQPIPQDSPAAQVLDLNEHAQEQSQE

SEQ ID NO: 126193 - protein, 243 aa, Glycine max
  Coding DNA Sequence Number=SeqID_9415
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=38%, E-value=1e-130, Identity=82%"; Hit description =Photosystem I P700 chlorophyll a apoprotein A1
  Pfam annotation: Domain name=PsaA_PsaB; Domain location=1-239; Score=- 94.2; E_value=6.7e-05; Accession=PF00223.9; Description=Photosystem I psaApsaB protein
MSALGRPQDMFSDTAIQLQPVFAQWIQNTHALAPGTTAPVGGKVALLPIPLGTADFLVHHIHAFTIHVTVLILLKGVLFARSSRLIPDKANLGFRFPCDGPGRGGTCQSDVWGSISDQGIVNHITGGNFAQSSITINGWLRDFLWAQASQVIQSYGSSLSAYGLFFLGAHFVWAFSLMFLFSGRGYWQELIESIVWAHNKLKVAPATQPRALSIVQGRAVGVTHYLLGGIATTWAFFLARIIA

SEQ ID NO: 126194 - protein, 104 aa, Glycine max
  Coding DNA Sequence Number=SeqID_9416
MSMPSVECFSTMFKLYVACVFFTNGACTMANNNVPAQIPICWKVINGTVATYPFAGERGEAHGCVFQRRKMRGVATNVYLWKTSEKLKETGHEEYSRFGSCIYV

SEQ ID NO: 126195 - protein, 175 aa, Glycine max
  Coding DNA Sequence Number=SeqID_9417
MVVGDTEGPPKCLVGVCHQTPAPQWHIRGKARSRLECGLGVLHVSPPWVEGPVPDQIGVVIDILSKYRSGVIDILIESMCNIGWCIVGRQAIWWEGMLALDLHKMGVARTSQRFAFLTYHIQVMTVVVLTSIIFLILIMASIIVVIFSFMTSMSAFICSCTSFISLITQALACVW

SEQ ID NO: 126196 - protein, 583 aa, Glycine max
  Coding DNA Sequence Number=SeqID_9418
  Gene Ontology: Mol. function=signal transducer activity; Cellular component=membrane; Biological process=response to light stimulus
  Homolog annotation: Hit_ID=Q1SC08; Match level="QueryCoverage=99%, HitCoverage=95%, E-value=0.0, Identity=72%"; Hit description =BTB/POZ; NPH3
  Pfam annotation: Domain name=BTB; Domain location=9-104; Score=2.4; E_ value=0.0025; Accession=PF00651.21; Description=BTBPOZ domain
  Pfam annotation: Domain name=NPH3; Domain location=184-439; Score =414.1; E_value=1.9e-121; Accession=PF03000.5; Description=NPH3 family
  Pfam module annotation: Pfam domain module=BTB::NPH3; Domain location= 9-104::184-439
MKRASEWAYSHEIPSDVTIQVGEVSFSLHKFPLVSKSGYIGKLVSESSDAFIELYDVPGGAEAFELATKFCYGINFEISIENIAMLRCVAEYLDMTEDYSVGNLVGRADSYLNEVALKTISGAASILHVSERLLPIAEKAKLVSRCIDAIAFIASKETQFCSSMRGDIIGTDGIGMASHQRPVVHWWAEDLTVLRIDIFQRVLIAMMARGFKQFALGPVIMLYAQKSLRGLEIFGKDRKKIEVEAQEEHEKRVVLETLVSLLPREKNAMSVSFLSMLLRAAIYLETTVACRLDLEKRMSLQLGHAVLDDLLIPSYSFTGDTLFDVDTVQRIMMNYLQSEKEDHSPYNADDEYFSPPQSDVYWVGKLMENYLAEIATDRNLAVSKFITVAELIPDQSRETEDGMYRAIDIYLKAHPILSDMEKKKVCSVMDCQKLSREACAHAAQNDRLPVQMVVQVLYYEQQRLRDSMDSSAGWDSPNFLDKVNSSPNELSILRRENQDLKLEIVKLKMRLKEFERTSIRSASSSPVIYASRSADKPPLPRKSFINSVSKKLGRLSPFSRGDAATIPPKGRVKPDKNRRHSIS

SEQ ID NO: 126197 - protein, 232 aa, Glycine max
  Coding DNA Sequence Number=SeqID_9419
  Homolog annotation: Hit_ID=Q10IX1; Match level="QueryCoverage=93%, HitCoverage=94%, E-value=4e-08, Identity=27%"; Hit description =Expressed protein
MEKLVRSSCNKEYMRMAMLKHEETFKEQKVDLKCGINFTNVIAHGLLLKISPVYELHRLYRIQKILMQNMEARRGIEASEEEWHFKNGIGLTHKGAQEKPQIKFDLESPAEEHIAESEDGVLEVIDETEIELTLGPSSYNRRKKVETPLTSDSGHSLSSSSSGSSHVNKTRCHGSHTREESSGSIIRLVQVPGSTPGYQSGIRNSFDIEEQLRQERLKQSPWLFQVLNLNMT

SEQ ID NO: 126198 - protein, 57 aa, Glycine max
  Coding DNA Sequence Number=SeqID_9420
MWEQKNIQMDNEHLLQQGEWLGGNFEGISTRRVREDEKEKKVWESVKEEESYMGEGF

SEQ ID NO: 126199 - protein, 62 aa, Glycine max
  Coding DNA Sequence Number=SeqID_9421
MDSAHVIVENKGSGTNMSFNLGKDLNYLVLPYSDEENLKGAASVKLYFDLKHFDGNWDEAEM

SEQ ID NO: 126200 - protein, 54 aa, Glycine max
  Coding DNA Sequence Number=SeqID_9422
MVLSMTYVEVDYDVGCHEFLLDAPKRESQGVLLMLWNGMEEVEYKLIVVIYRIQ

SEQ ID NO: 126201 - protein, 192 aa, Glycine max
  Coding DNA Sequence Number=SeqID_9423
  Gene Ontology: Mol. function=ribonuclease III activity; Biological process=RNA processing
  Homolog annotation: Hit_ID=Q1SEC6; Match level="QueryCoverage=74%, HitCoverage=29%, E-value=7e-32, Identity=49%"; Hit description =Ribonuclease III
  Subcellular localization annotation: CTP_CleavageSite=80; ConfidenceScore=5.73e-01
MFVPHQWNLPSSPSRPPSLQTQSKSPPKNSIPHFRSNHRPTAGASQEQPPAPPKGAHRAQAPFTPNSTRAPRRFILTRPLDDKRVADRFLSSPQLALNTFPFLSSCLPFAPLGHVDNIWMEKHALGYPLEPSVTLRDDSKPARELDTLLYLAFQHEVCEKSRARHVRFGHSRLFFLGQYVLELAFTDYFLQR

SEQ ID NO: 126202 - protein, 85 aa, Glycine max
  Coding DNA Sequence Number=SeqID_9424
MELLVGEEAGGGGGGRGCGCVQKWEIGCECVKDERAVPRERLGEHAKIEGIESVNEKGTKPALHGNNYKTHAIHFQNFHCKKERF

SEQ ID NO: 126203 - protein, 180 aa, Glycine max
  Coding DNA Sequence Number=SeqID_9425
  Gene Ontology: Mol. function=ribonuclease III activity; Biological process=RNA processing
  Homolog annotation: Hit_ID=Q1SEC6; Match level="QueryCoverage=96%, HitCoverage=37%, E-value=2e-77, Identity=70%"; Hit description =Ribonuclease III
MDAYALFAHPRLFRACVPPSMHQFRGNLWDYDCRPQIMQVLGYPLKMKDRIPEITKARNIELDLGLQLCFLHPSKYKFDHPQFFYERLEYLGQKIQDSVMAERLLMKHLDAPGLWLQNRHRRFLMNKYCGRYLKAKNCHHFTIYDEKALHGLSYVVYGKRDVRRLMFEVFDFKQTQLEAK

SEQ ID NO: 126204 - protein, 204 aa, Glycine max
  Coding DNA Sequence Number=SeqID_9426
  Gene Ontology: Mol. function=protein serine/threonine kinase activity; Cellular component=plasma membrane; Biological process =protein amino acid phosphorylation
  Homolog annotation: Hit_ID=P28523; Match level="QueryCoverage=99%, HitCoverage=56%, E-value=2e-83, Identity=75%"; Hit description =Casein kinase II subunit alpha
  Pfam annotation: Domain name=Pkinase; Domain location=34-204; Score= -16.2; E_value=1.3e-07; Accession=PF00069.15; Description=Protein kinase domain
MSKARVYTDVNVLRPKEYWDYESLTVQWGDQDDYEVVRKVGRGKYSEVFEGINVNSNERCVIKILKPVKKKKDSVVLGALQQPVSANSSLEIVIVIGSQTLILIGDLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVAS

SEQ ID NO: 126205 - protein, 171 aa, Glycine max
  Coding DNA Sequence Number=SeqID_9427
  Gene Ontology: Mol. function=protein kinase activity; Cellular component=protein kinase CK2 complex; Biological process=protein amino acid phosphorylation
  Homolog annotation: Hit_ID=Q94F17; Match level="QueryCoverage=83%, HitCoverage=77%, E-value=3e-76, Identity=94%"; Hit description =Casein kinase II alpha subunit
  Pfam annotation: Domain name=Pkinase; Domain location=3-157; Score= -90.7; E_value=0.0037; Accession=PF00069.15; Description=Protein kinase domain
MCEDCFRQKGQGRTNGVPRTVLGLHELRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEAIDFLDKLLRYDHQDRLTAREAMAHPYFSQVRAAESSRMRTQ

SEQ ID NO: 126206 - protein, 89 aa, Glycine max
  Coding DNA Sequence Number=SeqID_9428
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q1SEC9; Match level="QueryCoverage=73%, HitCoverage=16%, E-value=2e-27, Identity=86%"; Hit description=2OG -Fe(II) oxygenase
MQMASFLLYLTDVEEGGETMFPFENGLNMDGNYGYEDCIGLKVKPRQGDGLLFYSLLTNGTIDPNILCVEAIKQQVSQFYLRSSNSHHG

SEQ ID NO: 126207 - protein, 167 aa, Glycine max
  Coding DNA Sequence Number=SeqID_9429
MSIFPCESIGWSMPSRHRDCARKTPSGPGEAQQGPGVSSSGYGPLLVLQGARSPQQGIVLARLPVDPEKSNRVLGFPALITGLYQFYRVLIAPNKVIRPLTNRAFIKKYYAPQSGARRNTTAAWGWPATGNKCTAATSRAPQLIHKKVRVLPTTHGRPIGDLVQSQR

SEQ ID NO: 126208 - protein, 78 aa, Glycine max
  Coding DNA Sequence Number=SeqID_9430
MSWGSGDLGDVRWGAIAQNQAWLILTQSGHSQSVRTCDVPKQASSWQSTNKRTKSTKQGDLCGGWPAMYLGWYMKISL

SEQ ID NO: 126209 - protein, 287 aa, Glycine max
  Coding DNA Sequence Number=SeqID_9431
  Gene Ontology: Mol. function=sequence-specific DNA binding; Cellular component=nucleus; Biological process=regulation of transcription, DNA-dependent
  Homolog annotation: Hit_ID=O04136; Match level="QueryCoverage=88%, HitCoverage=63%, E-value=5e-85, Identity=64%"; Hit description =Homeobox protein knotted-1-like 3
  Pfam annotation: Domain name=KNOX1; Domain location=148-192; Score =74.4; E_value=3.5e-19; Accession=PF03790.4; Description=KNOX1 domain
  Pfam annotation: Domain name=KNOX2; Domain location=201-256; Score =105.9; E_value=1.2e-28; Accession=PF03791.4; Description=KNOX2 domain
  Pfam module annotation: Pfam domain module=KNOX1::KNOX2; Domain location=148-192::201-256
MAYHHNPQELPLHHFTDQQQHHNQPLVDNSLLSDPASKPASDPHQPAPNWLNNALLRTHYTDNNNNNNVNAANNNTNNGTNFLNLHTSTSDSGQWLARPILNRNHSEVIDDVTGAGDSNMAAAESGDLKGDAAAVEGGSDGLMNWQNARLKAEILAHPLYEQLLSAHVACLRIATPVDQLPRIDAQLTQSQNVVAKYSAFGQAIVGDDKELDQFLSHYVLLLCSFKEQLQQHVRVHAMEAVMACWEIEQSLQSLTGQLSVNIARFRLTINDMQVLNCCWTKKHGYRD

SEQ ID NO: 126210 - protein, 149 aa, Glycine max
  Coding DNA Sequence Number=SeqID_9432
MEDRQRALLQLQLKVMSDKPKEDQEVNSKQTLSHSLCQGINTLNSRKSDTAFKGGYYIITVFESRGDVTFKGGYYIITVFESRGDVTFKGGYYVITVFECRPDVTFKGGYYVITVFENFSLSKTVVIITVIKSNCVSTTLYTTTVYNRR

SEQ ID NO: 126211 - protein, 214 aa, Glycine max
  Coding DNA Sequence Number=SeqID_9433
  Gene Ontology: Cellular component=nucleus
  Homolog annotation: Hit_ID=Q1RYJ5; Match level="QueryCoverage=56%, HitCoverage=22%, E-value=2e-55, Identity=86%"; Hit description=WD40 -like
MHWMWNIVGGGLKNDWSMWFLDGTALDNETITTIRQKWAAYFLKVQSIQCTKFRVNDGEDNYTTLPRIDPSVSQRIPTQHVVPLDKKLLIGTSDGCIKAWNVDAKRVVCDLNTTEAFPSVLDIKCSPVEPIFVSAAASGGAGSNYIDNLGFASLTVWNMKTWKAMTVLPLGEDPPAITSLCFNHNGKILAASAVDGMIHMFGILNFVHLIVSLV

SEQ ID NO: 126212 - protein, 130 aa, Glycine max
  Coding DNA Sequence Number=SeqID_9434
  Homolog annotation: Hit_ID=Q8X6P0; Match level="QueryCoverage=85%, HitCoverage=86%, E-value=7e-25, Identity=47%"; Hit description=No significant matches
MMNKKATLALLVAAVLITGCASRTAPIQNVSQTVAQSYSDQQMQRAIVEAGAANHWVISPAGSGVMNGLLAERGHTANIRITYTANSYRIDYVSSTNLKAGSGQIHRNYNRWIQNLNQGIQTRLAVQAVK

SEQ ID NO: 126213 - protein, 289 aa, Glycine max
  Coding DNA Sequence Number=SeqID_9435
  Gene Ontology: Mol. function=transporter activity; Cellular component= membrane; Biological process=transport
  Homolog annotation: Hit_ID=Q2LRD6; Match level="QueryCoverage=92%, HitCoverage=55%, E-value=2e-39, Identity=39%"; Hit description=Type I secretion outer membrane protein
  Pfam annotation: Domain name=OEP; Domain location=98-284; Score =105.5; E_value=1.6e-28; Accession=PF02321.8; Description=Outer membrane efflux protein
ACGGLGSRADGGQFGRVRLPQPVRARRAAARHRGHAGNAAELAEPGAASVRNRLYLAAGMDAGGVGVSDGESANSAAAASDRPAGKRAQHSGRHESAPDRAQQPLLNRRPDIVQAQRLLLASDASLAAAQAQLLPSLNLTASGTLQSSQLHDLLDNPFRLWSIGGSVLAPLLNREALTAQVDVAMASRNQALYGYERVVRNAFAEVDNALDAITRSQQQLTELQAQERYVAEAWRIARNRYQNGYASYLDELDAQRTLFSTQLNIVAVKNTLLLAQIDLYRALGGGWQG

SEQ ID NO: 126214 - protein, 146 aa, Glycine max
  Coding DNA Sequence Number=SeqID_9436
SKTEKTNQYPSPQRHAFVKWWTQFDSSKADPEQVKLWFQSHPEFLKTADPETSVFLNQKSHLAAFLAGSTSKEVLAKNLKEVLQMLQQEEEASSSKKEETSSTEDEEDPFYQNEDDCFAIKVPVKTTCLVTNSQIVPVKTTGNYRS

SEQ ID NO: 126215 - protein, 327 aa, Glycine max
  Coding DNA Sequence Number=SeqID_9437
  Gene Ontology: Mol. function=RNA-directed DNA polymerase activity; Cellular component=chromatin; Biological process=RNA-dependent DNA replication
  Homolog annotation: Hit_ID=Q94I07; Match level="QueryCoverage=90%, HitCoverage=46%, E-value=6e-95, Identity=48%"; Hit description =Putative retroelement
MGSSSPILLEPLAHGSSDWSLPREDCIMMNKGWVQESMSSCVVLLILVPKKDGTWRICTICRAINNIKVKYRHPIPRLDDLLDELHGACIFSKIDLKNGYHQIKMKEEDEWKTAFKTKYGLYEWLVMPFGLTNAPNTFMRLMNNVLREFLAKFVVVYFDDVLIYNTDLDLHIEYLSVVMNVLREENLFTNIKKCTFCTNHVVFLEFLVSAEGVQVDDEKVKAIQEWPSPKTMSEVRSFHRLAIFYRRVVLMQEGHPIAYFSEKLNGASLNYPTYDKELYALVRALKTWQHYLLPKEFVIHIDHESLKYLKGQGKLKKGMPNGLNFLE

SEQ ID NO: 126216 - protein, 62 aa, Glycine max
  Coding DNA Sequence Number=SeqID_9438
MTFQAIDTIQNPKNVSVITLRSGNQIQVPPSVAALAPKPVKLPSTPEKEDEIVTDRGRTQIK

SEQ ID NO: 126217 - protein, 74 aa, Glycine max
  Coding DNA Sequence Number=SeqID_9439
MVIPKFKVPDFDKYKETTFPKNHLKMYCRKMGAYAKDEKLIRPKVKRPGSSSGSLNHGERNDNNDSRHITGVLL

SEQ ID NO: 126218 - protein, 284 aa, Glycine max
  Coding DNA Sequence Number=SeqID_9440
LERIDGDPALRGTRIRATWEYVSSIGGGQQGMVGLYVICGCGELSCTIARPPPSTTCDGVVPGDMSRGSGDLGDVRRAPGSQQITRTKTTKQGGLCGGWPAVNLVLKKGTGRLWRPLVIDYQSVYSITQRNGSLVIEYQIVMAAQLIHDRVEMECLEGAWETLEGNTRCRFRGTIRFTATSLVHTDEPARTLQRTVEWILPTPTPYRLVEPVQVIEVTSSEEDPEEDLEELPPEPIVDALDFLEGDEDPLPEVDSPKDVMSASEAYSTEDSGPGEMAINGGSSS

SEQ ID NO: 126219 - protein, 368 aa, Glycine max
  Coding DNA Sequence Number=SeqID_9441
  Gene Ontology: Mol. function=cystathionine gamma-synthase activity; Cellular component=chloroplast; Biological process=amino acid metabolic process
  Homolog annotation: Hit_ID=Q2JZS3; Match level="QueryCoverage=95%, HitCoverage=82%, E-value=1e-145, Identity=71%"; Hit description =Cystathionine gamma-synthase protein
  Pfam annotation: Domain name=Aminotran_1_2; Domain location=55-358; Score=-101.2; E_value=0.026; Accession=PF00155.11; Description =Aminotransferase class I and II
  Pfam annotation: Domain name=Beta_elim_lyase; Domain location=59-340; Score=-111.1; E_value=0.0031; Accession=PF01212.11; Description=Beta -eliminating lyase
  Pfam annotation: Domain name=Cys_Met_Meta_PP; Domain location=19-366; Score=193.4; E_value=5.4e-55; Accession=PF01053.10; Description =CysMet metabolism PLP-dependent enzyme
  Pfam module annotation: Pfam domain module=Aminotran_1_2::Beta_elim _lyase::Cys_Met_Meta_PP; Domain location=55-358::59-340::19-366
MAASSGKKTQIGTRELHPETQMLNYGYDPRLSEGAVKPPVFLTSTFVFNSAEEGKEFFDFVAGRQQPPAGKSGGLVYSRFNHPNSEIVEDRLAIYEGAESAALFSSGMSAIATTLLTFARPGEVILHSQPLYGGTETLLSKTLHDLEIKAVGFSDGTDEDKVYEAAKLAWQRGRVAMILIETPANPTNSLVDIQLMRQVAEVITQQQGSRPILACDNTLLGPLFQRPLQHGADISLYSLTKYVGGHSDLIAGAALGSRALINKVRSLRSAIGTQLDPHSSWMIGRSLETLSLRMEKAASNAEQVAAFLRDHAQVAKLHWLPYLDASSPAGETWQRQCSGAGSTFSFDIEGGQAAAFRFLNALALFKLA

SEQ ID NO: 126220 - protein, 343 aa, Glycine max
  Coding DNA Sequence Number=SeqID_9442
  Homolog annotation: Hit_ID=Q1RUD8; Match level="QueryCoverage=49%, HitCoverage=32%, E-value=3e-23, Identity=36%"; Hit description=IMP dehydrogenase/GMP reductase
MANQEEWVPFADVLALLIFGVVLFPNVDGLVDLAAIDAFLAYHHSKESPVVAILADLFDTFDRRCEKNSAWIVCCLPALCVWLVSHLFQQDIRHPCPLQSYRSCVKKRRVDWDQYLAGIRGRTINWFPRWKEGREGVLFSCGDYPNISLIGTRGCINYNPALSIRQLGYPMRGAPTEESLSPFLESPLRKDKELRGIRNGIIGDYHELLKVHTRGLDWLSKLKIINEENFEAPEEDEEVRALKIELGKARLAKEKFKLVATDVRKECVELREENAATARALEQETKRARKEEHGRDKFRGALWGSNNELKLRRKERDQSRVHGMVLKEELAVCSRSRGVWPNT

SEQ ID NO: 126221 - protein, 78 aa, Glycine max
  Coding DNA Sequence Number=SeqID_9443
GLFGGAGITGFVYPQWMSGSPNCCHWATRTLMQSYPARALDRKLQVDWARDAREGPRVLMSLRVDFGPMGYVRAYLSL

SEQ ID NO: 126222 - protein, 620 aa, Glycine max
  Coding DNA Sequence Number=SeqID_9444
  Gene Ontology: Mol. function=protein kinase activity; Cellular component=extracellular region; Biological process=protein amino acid phosphorylation
  Homolog annotation: Hit_ID=Q69TY8; Match level="QueryCoverage=95%, HitCoverage=89%, E-value=3e-47, Identity=26%"; Hit description =Receptor protein kinase-like
  Pfam annotation: Domain name=LysM; Domain location=173-216; Score =16.9; E_value=0.0093; Accession=PF01476.10; Description=LysM domain
  Pfam annotation: Domain name=Pkinase; Domain location=346-616; Score=- 5.8; E_value=3.2e-08; Accession=PF00069.15; Description=Protein kinase domain
  Pfam annotation: Domain name=Pkinase_Tyr; Domain location=363-616; Score=-19.7; E_value=2.9e-11; Accession=PF07714.7; Description =Protein tyrosine kinase
  Pfam module annotation: Pfam domain module=LysM::Pkinase::Pkinase _Tyr; Domain location=173-216::346-616::363-616
MTGACSAQLSYDQNNCTLNEIGQGARYSCKSTQDSCRTFLVYRANKHFNTISQVSKLFNMNSDEVLQKNNLTSSSLFDVLKQGKEVLIPVNCSCSGGYFQASLSYKVLDNTTYSEIACGVFEGLLKHLTLAEENLSQGNKPEADSELHVPLVCACSESYNFTRSMKVKYLVTYPLVLGDDPDKLSKKFGISIEEFYAVNSLNPLSTVYPDTVVLVPLTDGPIRILDIPDSPSPPPGFLLTNPVVTTEESTQSSNMYIAGSVIGFFLFIALLASGLYMKRMRKSDVVHSFSQTNSLTLLSPTRSSHISTQTGKSSTTWCLSPDLLVGIKYYLLNYSMEELQKATKYFSEENKICCNQGHDSDFVYKGSVDDHEVMIKKMRLADTQQVIDLHSKINHTNIVNLLGVCYIGDESNDDSWSYLVFELPKNGCLRDCLSDPCNPLNWYKRTQIAFDIATCLYYLHCCSFPSYAHMNVSSRNIFITANWRGKLADVGRALAASVTPTKRNGVEIPKGLVAPEYLLHNGLVSEKVDIFAFGVVLLELISGRDNFDGKAIKDSLGFWLGEASEGGCFEGLRSFMDPNLKDFSLPEALCLSFLAKDCVADDPLHRPSMDDIMKVLSKMV

SEQ ID NO: 126223 - protein, 335 aa, Glycine max
  Coding DNA Sequence Number=SeqID_9445
  Gene Ontology: Mol. function=tetracycline:hydrogen antiporter activity; Cellular component=integral to membrane; Biological process=tetracycline transport
  Homolog annotation: Hit_ID=Q5PFU9; Match level="QueryCoverage=99%, HitCoverage=96%, E-value=1e-150, Identity=60%"; Hit description =Possible efflux pump
  Pfam annotation: Domain name=DUF368; Domain location=13-297; Score= -133.4; E_value=0.09; Accession=PF04018.4; Description=Domain of unknown function (DUF368)
  Pfam annotation: Domain name=MFS_1; Domain location=1-301; Score =90.7; E_value=4.6e-24; Accession=PF07690.6; Description=Major Facilitator Superfamily
  Pfam module annotation: Pfam domain module=DUF368::MFS_1; Domain location=13-297::1-301
MWGSLADRKGRKLMLLRASLGMAIAILLQAFATNVWQLFILRAVMGLTSGYIPNAMALVASQVPRERSGWALSTLSTAQISGVIGGPLLGGFLADHVGLRAVFFITAILLTVSFLVTLFLIKEGARPQMSKAERLSGKAVFASLTHPGLVISLFFTTLVIQLCNGSIGPILALFIKSMAPDSNNIAFLAGMIAAVPGISALISAPRLGKLGDRIGTSRILLATLCCAVVMFFAMSFVTSPLQLGVLRFLLGFADGAMLPAVQTLLLKYCSDNVTGRIFGYNQSFMYLGNVAGPLIGASVSAMAGFRWVFIATALIVLINIWQLAIMLRRSRRAAV

SEQ ID NO: 126224 - protein, 95 aa, Glycine max
  Coding DNA Sequence Number=SeqID_9446
MVRSASSSDASFLKIDRSSFLADVGKHFFRSVLDMTKSKGGDPLEGLGGPMTRARARKAKEALQQVLSILFEYKPKFQGEKSKVVSCIMAQMEED

SEQ ID NO: 126225 - protein, 167 aa, Glycine max
  Coding DNA Sequence Number=SeqID_9447
  Homolog annotation: Hit_ID=Q2HSY3; Match level="QueryCoverage=62%, HitCoverage=48%, E-value=4e-10, Identity=32%"; Hit description =Nucleic acid-binding, OB-fold
MHELCLILIYIATVYAFLFVLMPTTVSILFFLNRFLFSSNFFCRIAPVCHCLQNQKVMSRKENMISELHTRKGTWKIAVRITDLWQARKQNSKQTIEMVLMDQTGSKIGATLYQELFTELRDKLQCGSSYLIQNLRIVDNQSEYRVSPTPYLVYFLKTTFVKEIHRP

SEQ ID NO: 126226 - protein, 45 aa, Glycine max
  Coding DNA Sequence Number=SeqID_9448
MATHRNEERRSIKHGNEQKMSKRRPTIGQAHMISNKWKSRVTKMV

SEQ ID NO: 126227 - protein, 242 aa, Glycine max
  Coding DNA Sequence Number=SeqID_9449
  Pfam annotation: Domain name=zf-CCHC; Domain location=122-139; Score =13.0; E_value=0.007; Accession=PF00098.13; Description=Zinc knuckle
MAIMNDSNPFLIHPSDNPSLMLVSHPLSGDNYNSWKKAMKMAFLGKKKFGFVDGSILEPPPGHINYLKPAHSCPCDGIQPWCDYDRMEKTEIGTSASHETSHVFAVKNGFDSKNKGGQKDHPICAHCGIQGHTKAQCYKQNGYPPNYKKNKPSSNSANQVSSRSVNQVSLSSMSQDSPSQFQLTAQQYNQLMSLLQGQTSNVTVPHQNHGDSNGMIMSASSFNLLRDCWLVDSGASTHVACQ

SEQ ID NO: 126228 - protein, 111 aa, Glycine max
  Coding DNA Sequence Number=SeqID_9450
  Subcellular localization annotation: CTP_CleavageSite=67; ConfidenceScore=5.03e-01
MAVLKMAQHNNANINNIVSQQQQLVKPMFHDFLGIKNKNPIDSNVLYAPNLHVTSSSSSLSSTTVSRGGATSDLASERQVGNHLEGVPFYGARSNFSGIEIGNRTSGKQEK

SEQ ID NO: 126229 - protein, 544 aa, Glycine max
  Coding DNA Sequence Number=SeqID_9451
  Gene Ontology: Mol. function=RNA-directed DNA polymerase activity; Cellular component=chromatin; Biological process=chromatin assembly or disassembly
AGNLVGGVFRRQCPKMGTLRVAVNNHQDGDAPMGWRQSRDEVENATLRYHATNIAAHSVLEEGFFEPSQGLSFSHMASKWRGVKFIQQHGDIRIIELEPKLAAISNPSQQSRVGIERMKHCPGGTMRERASIAMLPTLVVCDDNEMVVEEIVLPFANDRGDRMEFSNDGSHCHTGGVGLQAKWNSEIRRSQQRCRGHDLFKFIESTLSFIIPMKIVPAKEIGQKGCQRCISMYETPVEPGKAKESVKAGFGENALRGTQEEEALGDRGKNSFQMPEMISCRSIAQPKRHDAVLIMAVVGCHAQLVEELVNGRHREAVFNGNNIEGVIINASAPTTILFLGEEHRGGYGGKLDGLEGAGLVRGEYVGTYPGGRTGLWVADGHLKLRWGRWLGMKVRVWCGGGIGPRPPGPMWVKNMENEVCDKPVPLNLNGDLRVAAGTLHDSAVTNHNRERVYRGRGKSKKLSDMGLHKIVRTTAIDKYGSIGAESRLRLVAGRGRCVVGAIRVVRWAQSLIAFDGDRLRGQAAERQFGGGCGGYRPCGWWWVG

SEQ ID NO: 126230 - protein, 160 aa, Glycine max
  Coding DNA Sequence Number=SeqID_9452
MAQRWDKVTLSSLGTAPIAIIGIPDCFIECHQTDIFQGEEISAMARMANISVLRRVSLQFFQEGNWTHDDLFEDTELEGDTEEDLYQRLLYCSNCIQFIHTRRGYMIATGHKLMEGPRDLPRGQPITKTTSEAHQGFLLNIQSSFCFHSVMRIILLLFPF

SEQ ID NO: 126231 - protein, 622 aa, Glycine max
  Coding DNA Sequence Number=SeqID_9453
  Gene Ontology: Mol. function=GTP binding; Cellular component =intracellular; Biological process=RNA-dependent DNA replication
  Homolog annotation: Hit_ID=Q5QN90; Match level="QueryCoverage=81%, HitCoverage=90%, E-value=1e-108, Identity=43%"; Hit description=Leaf protein-like
  Pfam annotation: Domain name=PPR; Domain location=202-236; Score=9.4; E_value=0.58; Accession=PF01535.11; Description=PPR repeat
  Pfam annotation: Domain name=PPR; Domain location=278-311; Score =21.2; E_value=0.0037; Accession=PF01535.11; Description=PPR repeat
  Pfam annotation: Domain name=PPR; Domain location=312-346; Score =44.2; E_value=4.4e-10; Accession=PF01535.11; Description=PPR repeat
  Pfam annotation: Domain name=PPR; Domain location=347-381; Score =25.0; E_value=0.00026; Accession=PF01535.11; Description=PPR repeat
  Pfam annotation: Domain name=PPR; Domain location=382-416; Score =42.2; E_value=1.8e-09; Accession=PF01535.11; Description=PPR repeat
  Pfam annotation: Domain name=PPR; Domain location=417-451; Score =20.9; E_value=0.0045; Accession=PF01535.11; Description=PPR repeat
  Pfam annotation: Domain name=PPR; Domain location=452-486; Score =18.3; E_value=0.027; Accession=PF01535.11; Description=PPR repeat
  Pfam annotation: Domain name=PPR; Domain location=487-521; Score =20.3; E_value=0.007; Accession=PF01535.11; Description=PPR repeat
  Pfam module annotation: Pfam domain module=PPR::PPR::PPR::PPR::PPR::PP R::PPR::PPR; Domain location=202-236::278-311::312-346::347-381::382 -416::417-451::452-486::487-521
  Subcellular localization annotation: CTP_CleavageSite=39; ConfidenceScore=5.58e-01
MLSRSLRPRHILSSLRSLPFTLNPNPNPNPNPNRTPPIRASTHRPFSSSWLSEPGNPIIQWPSLPPPKPTPNPNPNPNLNPTPDPPSPNPNALSVISNLFADPSLSPGPALHAELDRAGIEPDPALLLAVFDRFGSSPKLLHSLFLWAQTRPAFRPGPKLFDAVVNALAKAREFDAAWKLVLHHAEKDGEEEGEKERLVSVGTFAIMIRRYARAGMSKLAIRTYEFATNNKSIVDSGSEMSLLEILMDSLCKEGSVREASEYFLWKKELDLSWVPSIRVYNIMLNGWFRLRKLKQGERLWAEMKENMRPTVVTYGTLVEGYCRMRRVEKALEMVGDMTKEGIAPNAIVYNPIIDALAEAGRFKEALGMLERFHVLEIGPTDSTYNSLVKGFCKAGDLVGASKILKMMISRGFLPSATTYNYFFRYFSRCRKIEEGMNLYTKLIQSGYTPDRLTYHLLVKMLCEEEKLDLAVQVSKEMRHNGYDMDLATSTMLVHLLCKVRRLEEAFVEFEDMIRRGIVPQYLTFQRMKADLKKQGMTEMAQKLCKLMSSVPYSPNLPNTYGEVREDAYARRKSIIRKAKAFSDMLKDCKDPSELRKHRSSSENTVSSTNSLIEDIERKRNTG

SEQ ID NO: 126232 - protein, 315 aa, Glycine max
  Coding DNA Sequence Number=SeqID_9454
  Gene Ontology: Mol. function=RNA-directed DNA polymerase activity; Cellular component=chromatin; Biological process=chromatin assembly or disassembly
MPEHNTRQTSIERLEEAIHKLTQHQSTLSQNQQSLTQANANLNLKLDSVLDRLAALTESPPSPKPPPSPPPNTISRPHMKLEVPHFDGQDPLGRIFKITQLFDYQGIPDAERITVASFYMEGLALCWFQWMSRNGFLTSWPTMLQALESRFAPSYYDDPHGALFKLQQRGTVNDYLAEFEHLANHVIGLSPPLLMSCFIYELSLELRRRQVLQPPSQQPSHLPHPPPATRPITTTPSSKLPFRRLSPEAIAIKRDKGLCYYCDAKWLTGHRCQPRIHLLIAEDDVDLLTPPDHPNRPNHTATPPRHQSQTTLSPN

SEQ ID NO: 126233 - protein, 168 aa, Glycine max
  Coding DNA Sequence Number=SeqID_9455
  Gene Ontology: Mol. function=iron-sulfur cluster binding; Biological process=electron transport
  Homolog annotation: Hit_ID=Q7XHS1; Match level="QueryCoverage=62%, HitCoverage=48%, E-value=2e-18, Identity=51%"; Hit description=2Fe -2S iron-sulfur cluster protein-like
  Subcellular localization annotation: CTP_CleavageSite=34; ConfidenceScore=5.16e-01
MASMSIFTTISLAADARNPAIYFPRRRQPNTVIFAAASSPESPPEIELEFIGPKPGSDGSYPVERVKAISGEKLLRNIMLDNKIELYATYGKLMNCAGGGSCGTCIVEIIEGKDLLNERTNTELRYLTFAILNRNPNLGGWLVKLLLETKKTLASKSGVTSVRAQHIP

SEQ ID NO: 126234 - protein, 269 aa, Glycine max
  Coding DNA Sequence Number=SeqID_9456
  Gene Ontology: Mol. function=protein binding; Cellular component =nucleus; Biological process=regulation of progression through cell cycle
  Homolog annotation: Hit_ID=Q39878; Match level="QueryCoverage=90%, HitCoverage=54%, E-value=2e-48, Identity=47%"; Hit description =Mitotic cyclin a2-type
MVRENAVMGGASEERGVRVTRAMARAVLGGVSASSRPSFKKQHKNNKGFGRVALADVTNISKKGCATSKSQARGGYKKTNTKGASNVSIQVLSTQEDVRAKLAKDLPSISMVQSHDANVAERQEGTEVVQPSMSVMAGPLLSMQDSMKSDEILRSPNKDVDMMITEKLKLSDGLDIVDIDSVELKDPQVWSSYAPDIYNSIFVREFERRPSSDYMDMLQQDITPSMRGILIDWLVELMSNFDELRVSLGTMIRLLLPHESLPRDQEFNS

SEQ ID NO: 126235 - protein, 126 aa, Glycine max
  Coding DNA Sequence Number=SeqID_9457
  Gene Ontology: Mol. function=chromatin binding; Cellular component =chromatin; Biological process=chromatin assembly or disassembly
  Homolog annotation: Hit_ID=Q1SAV4; Match level="QueryCoverage=97%, HitCoverage=35%, E-value=1e-24, Identity=51%"; Hit description =Integrase, catalytic region
MTALLSDTHSFHWRNGATIHQLITAQASFPQYLPGSSTIKAADSIVLTRQELHNKLQRRLAKAQAAMKIHADCHRRDVQFHVSDLVYVRLWPYLQLSIRPHYSKLAKRFYGPYWVTEKIGLVAYRL

SEQ ID NO: 126236 - protein, 190 aa, Glycine max
  Coding DNA Sequence Number=SeqID_9458
  Homolog annotation: Hit_ID=Q1T4Z8; Match level="QueryCoverage=42%, HitCoverage=23%, E-value=4e-15, Identity=49%"; Hit description =Ribonuclease H
MWIKLIHAKRARMLPNADQLKPTRIIYPKLHKKPTMETQTTSREKSTYLDNVNALKKKKNEPTSQVVEEKTTLQNRARWKKKKVAEEEEEGRRPKLVAVIQRLKPFFNDRVLDILIWNENLNGSYTTKSGYQWLLRRRLGDDLCNGWNWVWKVKAPEKLKFIFYRMKPSNIVLETTPYPDSYGKNWVYKG

SEQ ID NO: 126237 - protein, 164 aa, Glycine max
  Coding DNA Sequence Number=SeqID_9459
  Gene Ontology: Mol. function=kinase activity; Cellular component =nucleus; Biological process=regulation of progression through cell cycle
  Homolog annotation: Hit_ID=Q39878; Match level="QueryCoverage=89%, HitCoverage=31%, E-value=2e-60, Identity=79%"; Hit description =Mitotic cyclin a2-type
  Pfam annotation: Domain name=Cyclin_C; Domain location=16-143; Score =176.7; E_value=5.7e-50; Accession=PF02984.9; Description=Cyclin, C -terminal domain
MESEVLNLLHFQLSVPTTKTFLRRFILASQSSYKVSYVELEFLANYLAELTLVEYSFLQFLPSLIAASAVLLARWTLNQSEHPWNSTMEHYTNYKVSELKTTVLALADLQHDMKGCSLNSIREKYKQQKFRSVANLSPKPVQSLFKAQDLKIVAKRASCNLQID

SEQ ID NO: 126238 - protein, 662 aa, Glycine max
  Coding DNA Sequence Number=SeqID_9460
  Gene Ontology: Mol. function=protein phosphatase type 2A regulator activity; Cellular component=protein phosphatase type 2A complex; Biological process=signal transduction
  Homolog annotation: Hit_ID=Q93YV6; Match level="QueryCoverage=65%, HitCoverage=95%, E-value=1e-180, Identity=64%"; Hit description =Serine/threonine protein phosphatase 2A 57 kDa regulatory subunit B' iota isoform
  Pfam annotation: Domain name=B56; Domain location=289-659; Score =815.9; E_value=2.2e-242; Accession=PF01603.10; Description=Protein phosphatase 2A regulatory B subunit (B56 family)
MQKIEVQKLNWVKLWKKGVPRIDPFSYSSFETLQEAEAASYEMPFFTPLNLQQLLTLMATFNLVLPWNRAKLEESFYIEDIYLEDPEMSPTFSEWDNYTASKDGTHKQGLATFAKVLQIFVYGQNLSFTVQLPKSTFTFIHQVQLIIKDVNSNDEAPTVAANMAMEVYNCPSPSQEEAKRWKIFGEYLFNKCVDTFLNNSSDNKSGDKFFRKLEEEEEVVKQKGENNKLPRKSLKPDSDESPRVDSARSADSPRAAGRSNKPHGGSSSAAKRASSSAVFPASMVSGIEPLVPFKDVPNAEKMNLFVSKLSLCCVTFDFTDPSKSSADKDVKRKTLVELVDFVACGTMRFSEPAILAICRMCAINLFRVFPPNYRASGGGENDDDEPLFDPAWPHLQLVYELLLKFISSSCIDAKVAKKYIDHSFIARLLELFDSEDPRERDCLKTILHRIYGKFMVHRPYIRKSINNIFYRFVFETDKPNGIGELLEIFGSVITGFALPLKEEHKIFLWRVLVPLHKPKSIGAYFQQLSYCVMQFIEKEPKLASIVIRGLLKYWPATNSQKEVAERALFLWNNDHIVNLIAHNRQVILPIIFSALDRNVQSHWNPAVVNLTNNIRKMFLEMDEKFFISCHNHFKEEEAILISTGEKRKEAWKQLEHAASLRP

SEQ ID NO: 126239 - protein, 142 aa, Glycine max
  Coding DNA Sequence Number=SeqID_9461
  Gene Ontology: Mol. function=actin binding; Biological process =cytoskeleton organization and biogenesis
  Pfam annotation: Domain name=Transposase_21; Domain location=28-142; Score=19.2; E_value=3e-16; Accession=PF02992.5; Description =Transposase family tnp2
MHKCPRCGVSWYKVKNHDKCSSDESTKKGHTTKGVMVSSYHSKARNLRLGLAIDGMNPFGSLSNQHSSWFVLLVIYNLPPWLCMKRKYMILSMMISDPRQSGNDIDVYLSSLIEDLTNLWDEGVAVYDGYQNEIFKLCAMLF

SEQ ID NO: 126240 - protein, 107 aa, Glycine max
  Coding DNA Sequence Number=SeqID_9462
MPSRAMMLRGESDTLVLRSEIERAMLKGETERATLRGVSETESDAESSFSGIGLLPIIGPKPYMQDYKQYAWLGRVQSKKSKPNPIVLNHFKLTTRPDLTCNLFKPT

SEQ ID NO: 126241 - protein, 171 aa, Glycine max
  Coding DNA Sequence Number=SeqID_9463
  Gene Ontology: Mol. function=ribonuclease H activity
  Homolog annotation: Hit_ID=Q1T4Z8; Match level="QueryCoverage=40%, HitCoverage=15%, E-value=1e-09, Identity=49%"; Hit description =Ribonuclease H
MPNPDVEPLYMMALTIPQLFLKLLQMLWDATMFEGFNDSQGSKSKVAARWILVKQKGSIEYEYYVMHWMSTIVLGEFKDNWEMAYCMLAFMDKGRNILVASQSCGIPTEMEVMFSMSMEENWVSLEERGLVVSSEPVMGNGLLVLVAIWVREISFLQSLMQFIEGFYKLVI

SEQ ID NO: 126242 - protein, 1594 aa, Glycine max
  Coding DNA Sequence Number=SeqID_9464
  Gene Ontology: Mol. function=nucleic acid binding
  Homolog annotation: Hit_ID=Q1RSU0; Match level="QueryCoverage=13%, HitCoverage=22%, E-value=2e-07, Identity=23%"; Hit description=Tudor
MEGRAENTNDTAILKKSRSLDLKSLYKSKLTENTAKKNLKRIGNSSGGGDEKRKKKKARKKVFLSSLENGDGSSELKLGVSQRLSSSSSTLNRISFSVGDDDVQIPKRKRSFVGRKKSELVQASKVVEQSGLKIGYGDQVPKLGSDDLGSGVESFKIKHTKEFDEFKENRNSDSNSVQHVKEDGDCASHSVVNSGDSSLSKSRRKNRKRKASALDRTKVSKEAEPLVSSCKIPGDLQDEEENLEENAARMLSSRFDPSCTGFSMKGLNGLPFFGSSSQSIVNRGLKSQSGSESASADTAGRILRPRKQYKNKGDSRKRRHFYKILLGDVNAYWVLNRRIKIFWPLDQSWYYGFVDNYDEGSKLYHIKYDDRDVEWVNLHTERFKLLLLRSEVPGNAKGERALTKRRSSDHQKGSKSSKERQRTTEDDRSGESSMDSEPIISWLARSSHRLRSSFQGIKKQKTSGTIPSTMSSFLYDEPVTAKGHLAKISLRGVKNNFSSDSVSQDKLSDDFRDKSSLLSATATKDGKQPIVYFRRRIRKPAPISPHISEENYAITGASGSVAFNHMFCGVEKMKNPSNGRAEVGGPLCFTLKAGVSKIFWDMESASFKFGLNFPMRLVLNDFFQSENLWLLYSVLLLRFGTVMTKWPRVCLEMLFVDNVVGLRFLLFEGCLNMAAAFFFFVLRVFHQPAYRGKYVDLQFPCTSIGFKFSSVHVIKKPLVFEFYNFSEVKNSKWMCLDSKLKRHCLLSKQLHLSECTYDNIQALQNGSCRFSITSVSGSSSVKVRQKRSRPGINIMGISKVSAQADTHQYSDAGKWKLPPFALSFSAAPTFFLHLHLMLLMEQSTNRISFCDQTPIFDQEDPGLVTNGCTNTSGCSHRNSEIILRKDMETLSNGVAGDGGSCADSDHPSTCSDKILIQNYLNIGLNSTGTAISHDSERLSTTQVPEWKCHHHLEQELGSLPSSSLIRQDKADDGSHSSIGDLSIQIPAVDQFEKPGDDGDLCDAEHSPGFSWNINGGGIPSSNPTARRSSWYWNRNSSLSLGFQSHVWSDGKADSLCNGPKKPRTQVSYSVPSAGYEFSSKQRNHHQKGLPHKRIRKASEKKSSDVARGLEKNVECLSCGANVLITLGNKGWRESGAHVVLELFDHNEWRLSVKLLGITRYSYKAHQFLQPGSTNRYTHAMMWKGGKDWILEFPDRSQWALFKEMHEECYNRNIRAASVKNIPIPGVHLIEENNDNGCEATFVQSCMYYQQVETDVEMALNPSLVLYDMDSEDEQWISNAQNSVKDNNDLSWISEEMFEKTIDMFEKVAYAKKCDHFTPNEVEELMVNVGPLSVVKIIYDHWQERRQKKGMALIRHFQPPLWERYQKQVREWELAMTKNNAHSNGCLDKFTTLEKPAMFAFCLKPRGLESLNKGLKHRSQKKISVSGHANSNLDQDGFHTFRRRQNALPFGDEKFLYQGHNYDSFDDSSLALTSPRVFLPRDAGSLKYYPTSNGAGYRNHIPKFHKSRYDTPGSRHHLLAGPMRQGTEQLDTSVLEELRLRDAVAEARFKRHVAKLKRDRAKRLLYKADVVIHKAMSALMTAEAMKASEGTPLVK

SEQ ID NO: 126243 - protein, 115 aa, Glycine max
  Coding DNA Sequence Number=SeqID_9465
MKGSVLEIFSSKASSKIPPRLQELTNLLEPLIFSLFWNTERIREVVKAKKARPMRARPKKATWQLRNGGKRIKSFEELVQQAKSTDMKKFQFKLEILKNSPSEFNSPNEQGQLRK

SEQ ID NO: 126244 - protein, 241 aa, Glycine max
  Coding DNA Sequence Number=SeqID_9466
  Gene Ontology: Mol. function=protein binding; Cellular component =integral to membrane; Biological process=protein amino acid phosphorylation
  Homolog annotation: Hit_ID=Q1SPZ8; Match level="QueryCoverage=97%, HitCoverage=59%, E-value=5e-29, Identity=32%"; Hit description =Leucine-rich repeat; Leucine-rich repeat, cysteine-containing type
  Pfam annotation: Domain name=LRR_1; Domain location=109-131; Score =7.6; E_value=11; Accession=PF00560.23; Description=Leucine Rich Repeat
  Pfam annotation: Domain name=LRR_1; Domain location=133-155; Score =3.6; E_value=59; Accession=PF00560.23; Description=Leucine Rich Repeat
  Pfam annotation: Domain name=LRR_1; Domain location=166-189; Score =4.9; E_value=34; Accession=PF00560.23; Description=Leucine Rich Repeat
  Pfam annotation: Domain name=LRR_1; Domain location=190-212; Score =6.6; E_value=17; Accession=PF00560.23; Description=Leucine Rich Repeat
  Pfam annotation: Domain name=LRR_1; Domain location=214-236; Score =11.1; E_value=2.4; Accession=PF00560.23; Description=Leucine Rich Repeat
  Pfam annotation: Domain name=LRR_1; Domain location=26-49; Score=9.7; E_value=4.3; Accession=PF00560.23; Description=Leucine Rich Repeat
  Pfam annotation: Domain name=LRR_1; Domain location=60-82; Score =10.3; E_value=3.4; Accession=PF00560.23; Description=Leucine Rich Repeat
  Pfam annotation: Domain name=LRR_1; Domain location=84-107; Score =11.9; E_value=1.7; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=109-131::133-155::166- 189::190-212::214-236::26-49::60-82::84-107
MVGSILIDLDSSQLYGTIEANCSLFHLKHLDVVDNNFNPSQIPSRIGELSQLSYVTISSSLQRLSLDHCELHGEFPSGIFQLQNLRYLNMGNRQNLTGSMPSSFGNLTQLMVLDIEHNKFRGHLSSFLENLSKLRTLIVGWNEFITGTFSWIFGMVLSCFGSSSQSLKVLVLKGNKFIGLIPQTYMITSDMRMMDLSNNYLQGQLPRESVNCRMLEVIDVRNNQINDSFPCWLGTLPEVVV

SEQ ID NO: 126245 - protein, 102 aa, Glycine max
  Coding DNA Sequence Number=SeqID_9467
  Subcellular localization annotation: CTP_CleavageSite=47; ConfidenceScore=5.41e-01
MLLLRRTRPLPLKNYVDTKKNTIPIPSRKKKLLIRSLLSSTSFASTTATSGSSGSGASHASSSDEWGEVGNALRMHPSPPWGAAGAGCDRSQPERPPTSPNQ

SEQ ID NO: 126246 - protein, 100 aa, Glycine max
  Coding DNA Sequence Number=SeqID_9468
MSHEPSGRMLELMSHGPLPDRKIFSLTSSHHKCRETKRIVKEVKSYFYPLPRNQSAPEKRLTMEKGKSLISSLGSQQQSMPFDEDQRLPHSGLYLFFIGL

SEQ ID NO: 126247 - protein, 484 aa, Glycine max
  Coding DNA Sequence Number=SeqID_9469
  Gene Ontology: Mol. function=RNA-directed DNA polymerase activity; Cellular component=intracellular; Biological process=RNA-dependent DNA replication
  Pfam annotation: Domain name=rve; Domain location=248-404; Score =83.1; E_value=8.5e-22; Accession=PF00665.16; Description=Integrase core domain
MALFDNEDSSKERGWIMWFDGASNIIGHKIGVILLSPEKQYIPTTTRSFNGDFPPWRCNGRQRRRGERRRQPLGNKPWKKELHHQECALDKKLGEDASMEEKKYKEKEKGGSTKLKGIASPSMFALSKDEDMTFIKIQHHDQSMYCHLVEEESDGKPWYFDVKEYIKSRKYPPNTSENDKRTLRRLAVSFFLNGDVLYKKNHNMVLLKCADVIEAKKIIKEVHERKRHKCQTYVDNINAPPMSLNVLSSPWPFSMWGMDVIGPIEPKASNGHHFILVAIGYFTKWVKVASYAIVTQNVIVKFIKTELIGRYGIQSKLITDNATNLNNKMMTKLCANFKIQHHNSTPYCPKMNGAVEAANKNIKKIIQKMVVTYKDWHDMLPFALHGYRTSACTSIDATPFSLVYGMEVVLPIEVEIPSLRVLMEVELKEAEWAQMRFDQLNLLEEKRPYGVKKAFSGRAFILTNMDGKELPYLVNSNAVMKYYA

SEQ ID NO: 126248 - protein, 247 aa, Glycine max
  Coding DNA Sequence Number=SeqID_9470
  Gene Ontology: Mol. function=RNA-directed DNA polymerase activity; Biological process=RNA-dependent DNA replication
MVVVPIQTDQPVHSTPPINHNMIQVTKGVPVACSNEHLQMLEESLKVIEGSNYGMVEAANLCLVPDAIIPPKFKAPEFDNYKGTSCPKSQLTMYCRKMAAHTRDDKQLIHCFKDSLIGATLKWYMQLEQGHIRSWKDLGEAFILQYKYNIHLTPERFERLRKFKLRLNPAKCTFGVKSGKLLGFIVSQRGIKVDPDKVCANVAPSHGKGDLRFPGKVELYSPIYIPTNGDMRTYLQIVAQKSSFRVG

SEQ ID NO: 126249 - protein, 102 aa, Glycine max
  Coding DNA Sequence Number=SeqID_9471
MERVEHKYRLFGVVEQMSGLSSGVEYICQEDSGLVARVRLILGLNVGAGLFSRLNDGVESASTSPVGVRLDCWVWVGSGLDYWCQVGSGISRWNVDVKLLGH

SEQ ID NO: 126250 - protein, 71 aa, Glycine max
  Coding DNA Sequence Number=SeqID_9472
MRGCLGALIGPWSWALTFGRDHSSYDTGNRVTVAKEHLWAPRLITYGRGAVTCTTGWSQQTQHSSLSESVE

SEQ ID NO: 126251 - protein, 196 aa, Glycine max
  Coding DNA Sequence Number=SeqID_9473
  Gene Ontology: Mol. function=RNA-directed DNA polymerase activity; Biological process=RNA-dependent DNA replication
MEVDIPLGWKSLNLERVQYATSRSHCMTLAALASLRQADDESLRKFIGKFGRTVVQIRNLNPEIKLHSMLLALHPSKFVDSLCKKLPGSMDEPHERAKGYIQIEEMSKFWNEVYQVKQKCERCKANTKTDLHKSDKRPQARQAPTSLQKARYERYIPLTANRTTILEEAFDLEAQTQPSTAGFTAVLNTTTKIVGP

SEQ ID NO: 126252 - protein, 217 aa, Glycine max
  Coding DNA Sequence Number=SeqID_9474
  Subcellular localization annotation: CTP_CleavageSite=53; ConfidenceScore=5.66e-01
MATPPSSSPSPLPPPTEVASQSSSTLKQTRKATRLRSLATRLAGANRPMVHIDLATGKADGPHKKKLRTYLAIVACDKVNVTYENWKQVPAAQKDLIWEDIQGAVGPAKHADRLDHEVDDPLYLMTLTIPQLFLKPLQVMWDAIVFQLFNSYFPLYIKHEDLSEITHGGQCISISIIQLWILHLSEIGMRAGNFDVYGFLEPQSIQRSGQSQFESKS

SEQ ID NO: 126253 - protein, 171 aa, Glycine max
  Coding DNA Sequence Number=SeqID_9475
MKVVGTSMALESWNFNLLCQPLALNFVASMADSSAVELRQKECTESVMVIKVIWCPPLSLPPLKLLDLSLLAGAVGRSQLSYKGKGVDKHKHKPHITKVYTHKQRAREAITMDHQQQGAQHPRGANHPTVTTHPKGARGHDPWEQSQPTVMIHPRVARSRDANQGGMTLGN

SEQ ID NO: 126254 - protein, 140 aa, Glycine max
  Coding DNA Sequence Number=SeqID_9476
  Pfam annotation: Domain name=Transposase_23; Domain location=1-51; Score=-14.7; E_value=0.046; Accession=PF03017.5; Description =TNP1ENSPM transposase
MGRVYEGSTLVHNTPLLPGQVKVSVEEVKDADAPVPVPTVEVSLVGQALHTFLAWPTHQIKSLSNQVRWDATVFGVVNPDFPLYIKNEDLSEIAHDGQCLSISVLQLWILHLTATCMRAGILISMIPRASVHSEVWAIAV

SEQ ID NO: 126255 - protein, 192 aa, Glycine max
  Coding DNA Sequence Number=SeqID_9477
MVKFDPEIVMEFYANAWPIKEGVRDMCSWVRGQWIPFDEHAINQFLGHPLVSSTRGGVWPPTFMRRISVSCYAFWGWRCCFATFSPVTITRTFPCRSFEGFMPLRQLVDPEKSNRALGFLALITSLCQFYGVAVVEAMPSKVILMMQKNQELSKVSSKDSRIKFQDSRIKLQRSRFKTQDSRIKRSLNQDKY

SEQ ID NO: 126256 - protein, 156 aa, Glycine max
  Coding DNA Sequence Number=SeqID_9478
  Gene Ontology: Mol. function=transition metal ion binding; Cellular component=chromatin; Biological process=electron transport
MSKSRVLKEHNKTFLNWFKDIIFGDDNASEMLRKLADGPKRNVITWQGYDINMYSFYTKAQDDKNKIQNSRVSLRVKSQHFASVHDGNPRLAFNPYSGVIEEIRGLNYVKFIVCVFKCKLVDNNIGVRIDDLGFMLVDLKKLAYKNDPFIMAEQAK

SEQ ID NO: 126257 - protein, 157 aa, Glycine max
  Coding DNA Sequence Number=SeqID_9479
  Gene Ontology: Mol. function=transferase activity, transferring glycosyl groups; Biological process=sucrose metabolic process
  Homolog annotation: Hit_ID=Q43876; Match level="QueryCoverage=99%, HitCoverage=12%, E-value=4e-56, Identity=72%"; Hit description =Sucrose-phosphate synthase
MAGNDWLNSYLEAILDVGPGLDDAKSSLLLRERGRFSPTRYFVQEVIGFDETDLYRSWVRVPSHTTLSFLLSSFIPSLPLISFLQASSTRSPQERNTRLENMCWRIWNLARQKKQLESETALRVNKRRLERERGRREATADMSEDLSEGEKGDPLSD

SEQ ID NO: 126258 - protein, 771 aa, Glycine max
  Coding DNA Sequence Number=SeqID_9480
  Gene Ontology: Mol. function=voltage-gated chloride channel activity; Cellular component=membrane; Biological process=chloride transport
  Homolog annotation: Hit_ID=Q1SF64; Match level="QueryCoverage=98%, HitCoverage=96%, E-value=0.0, Identity=68%"; Hit description=Cl -channel, voltage gated; IMP dehydrogenase related 1
  Pfam annotation: Domain name=CBS; Domain location=583-751; Score =50.0; E_value=8.2e-12; Accession=PF00571.18; Description=CBS domain
  Pfam annotation: Domain name=Voltage_CLC; Domain location=110-552; Score=455.7; E_value=6.1e-134; Accession=PF00654.10; Description =Voltage gated chloride channel
  Pfam module annotation: Pfam domain module=CBS::Voltage_CLC; Domain location=583-751::110-552
METPKLSFVVLCCPPKDPLSTPRPRLLLSAPMIFENEFFKHDWRSRGKAQIFQFMIMKWLLCLLIGMIVCLVGFCNNLAVENLAGIKFVVTSNMMLERRFLMAFLVFFVSNLVLTVFACTITALIAPTATGSGIPEVKAYLNGVDAPGIFTVRTLLVKIIGSITAVSSSLLIGKAGPMVHTGACVAALLGQGGSKRYGLTWKWLKFFKNDRDRRDLIICGSAAGIAAAFRAPVGGVLFALEGMSSWLAYIKLMRPSTTYMASVAHTAGLSFYMSLLSSKPTGNMWRSALLWRAFFTAAIVAILLRALIDLCLSGKCGLFGKGGLIMFDAYSARGILGSLFNLILSKVLRIYNFINEKGTIFKILLACLISIFTSCLLFGLPWLTSCRPCPPDPSEPCPTIGRSGIYKKFQCPPNHYNDLASLIFNTNDDAIRNLFSKNTDDEFEFKSVFIFFITCFSLSIFSYGVVAPAGLFVPVIVTGASYGRIVGMLLGKKDSLSHGLYAVLGAASFLGGSMRTTVSLCVIILELTNNLLLLPLIMMVLFISKTVADAFNANIYDIIMKAKGLPYLETHAEPYMRQLSVGDVVTGPLQTFNGVEKVCNIVFILRTTGHNGFPVIDEPPISQAPVLFGIILRDHLLTLLKKKAFMSSPMATSGDVINEFSADDFAKKGSSKGRLKIEDIQLSEEEMDMFIDLHPFTNASPYTVVETMSLGKALTLFRELGLRHLLVVPKFSGRSPVVGILTRHDFMSEHILGLHPFLVEGASLLVCRNRE

SEQ ID NO: 126259 - protein, 77 aa, Glycine max
  Coding DNA Sequence Number=SeqID_9481
  Gene Ontology: Mol. function=DNA binding; Biological process=DNA integration
  Homolog annotation: Hit_ID=Q1SIT1; Match level="QueryCoverage=84%, HitCoverage=26%, E-value=1e-13, Identity=43%"; Hit description =Integrase, catalytic region
MYALLKKYGAGDALWAHRTANKAPIGMSPYRAGKERKLQLSELDEIRLEAYENSKFYKEKTKKFHDNLIAKKDFVVG

SEQ ID NO: 126260 - protein, 81 aa, Glycine max
  Coding DNA Sequence Number=SeqID_9482
MWSGIARQSLKKVVDGGGQGVDGSNEPQGGPRWWTKIQGGVVGGSGGWSCSCGGQPWRLRTTGSVDGGRQPWELRMVSGMG

SEQ ID NO: 126261 - protein, 472 aa, Glycine max
  Coding DNA Sequence Number=SeqID_9483
  Gene Ontology: Mol. function=hydrolase activity; Cellular component =extracellular space; Biological process=biological_process
  Homolog annotation: Hit_ID=Q6YGT9; Match level="QueryCoverage=95%, HitCoverage=89%, E-value=0.0, Identity=79%"; Hit description=Purple acid phosphatase-like protein
  Pfam annotation: Domain name=Metallophos; Domain location=158-356; Score=74.0; E_value=4.7e-19; Accession=PF00149.18; Description =Calcineurin-like phosphoesterase
MMQAMLLNLVLVSFVLLSSIRDGSAGITSSFVRPQWPGVDIPVDHEVFAVPKGYNAPQQVHITQGDYDGKAVIVSWVTPDEPGTRHVQYGTSKDKFKTSAEGTVANYTFYNYKSGYIHHCLIEGLEYKTKYYYRIGSGDSARDFWFETPPKVGPDTPYKFGIIGDLGQTFNSLSTLEHYLESGGEAVLYVGDLSYSDEHDYKDMGLRWDTWGRFAERSAAYQPWMWNVGNHEVEFLPEVGEVEPFKNYLYRYTTPYSASKSTSPLWYAVRRASAHIIVLSSYSPFVKYTPQYIWLKEELARVDRKKTPWLIVLVHKPLYSSNVAHYMEGEAMRSVFETWFVQYKVDVIFAGHVHAYERSYRYSNIDYNITGGRRYPIPDKSAPIYITIGDGGNLEGLASSYLDPQPEYSAFREASYGHATLEIKNRTHAIYHWYRNDDGKKVPADSLVLHNQYWGSNGRKQNEVIDEVVNVK

SEQ ID NO: 126262 - protein, 98 aa, Glycine max
  Coding DNA Sequence Number=SeqID_9484
  Gene Ontology: Mol. function=binding
  Homolog annotation: Hit_ID=Q402G4; Match level="QueryCoverage=95%, HitCoverage=25%, E-value=2e-31, Identity=82%"; Hit description =Hypothetical protein GmTDF-5
MLGFRSEAERRWRVSRSIQAWISDSISAATRERECVERGAREEGSEALRVVEGVDEGFEAVEVVGESGEVGVGGGEDGVELEECLYGWGIRGVVSLFF

SEQ ID NO: 126263 - protein, 341 aa, Glycine max
  Coding DNA Sequence Number=SeqID_9485
  Gene Ontology: Mol. function=ubiquitin thiolesterase activity; Cellular component=intracellular; Biological process=ubiquitin -dependent protein catabolic process
  Homolog annotation: Hit_ID=Q1RTH1; Match level="QueryCoverage=98%, HitCoverage=94%, E-value=1e-129, Identity=67%"; Hit description =Peptidase C19, ubiquitin carboxyl-terminal hydrolase 2; Zinc finger, FYVE/PHD-type
  Pfam annotation: Domain name=UCH; Domain location=198-341; Score= -22.1; E_value=4e-05; Accession=PF00443.19; Description=Ubiquitin carboxyl-terminal hydrolase
  Pfam annotation: Domain name=zf-UBP; Domain location=56-133; Score =22.1; E_value=0.00042; Accession=PF02148.9; Description=Zn-finger in ubiquitin-hydrolases and other protein
  Pfam module annotation: Pfam domain module=UCH::zf-UBP; Domain location=198-341::56-133
MSSKINGQISPLPCPHLAEFHRTSAKPFLALHNCLRIKPPGGRASLRRNPDEVPRCCACGLSAPSRLYACVTCAAVSCHSSAAGVLSHAAAHAASMPPGHQIAVDVDRAELFCCACRDQVYDRDFDAAVVIAQTAASTLGGDPPPPIPSPQPENLRKKRRVDYWPWAPDLRERALIGSFSGPIAGAETVVDHSPGLPRGLRGLNNLGNTCFMNSVLQALLHTPPLRNYFLSDRHNRFFCQKKNNGDVDVDAAVKRSGGNNGNKNARICLACDMDATFSAVFSGDRAPYSPAKFLYSWWQHAANLATYEQQDAHEFFISMLDGIHEKVEKGRRKPHTEGNMF

SEQ ID NO: 126264 - protein, 120 aa, Glycine max
  Coding DNA Sequence Number=SeqID_9486
  Homolog annotation: Hit_ID=Q1RTE9; Match level="QueryCoverage=63%, HitCoverage=9%, E-value=2e-27, Identity=81%"; Hit description=AIG1
MPEGYGWDSNPRFELGSDHSANSVSSPIPSNSSNSSYGDQSNQHSSSLQLVSDTEIYQYQHNTNGRRKDTLAKVEELQVKFFRLLQRLGQSQENLLVAKVLYRMHLATLIRAKELDLKKS

SEQ ID NO: 126265 - protein, 153 aa, Glycine max
  Coding DNA Sequence Number=SeqID_9487
MGYEVLKEQQSTLFLGKGRGEWIGYLLTNDTNSVSPNLTAANGRFPLEDLFGRKHAYLENKNSETEDDDEDGDEDDEDGHDQDDDGEDEEFSGEEGDEEGDPEDDPEANGGGSDDDDDDDNDNEEDDDDGEDEEEEEEEDDEETSQPPTKKRK

SEQ ID NO: 126266 - protein, 145 aa, Glycine max
  Coding DNA Sequence Number=SeqID_9488
  Gene Ontology: Mol. function=structural constituent of cytoskeleton; Cellular component=cytoskeleton; Biological process=regulation of actin filament polymerization
  Homolog annotation: Hit_ID=Q1RTH3; Match level="QueryCoverage=86%, HitCoverage=60%, E-value=2e-56, Identity=85%"; Hit description =ARP2/3 complex, 21 kDa p21-Arc subunit
  Pfam annotation: Domain name=P21-Arc; Domain location=1-141; Score =206.4; E_value=6.6e-59; Accession=PF04062.5; Description=P21-ARC (ARP23 complex 21 kDa subunit)
MVYHSSFVNEDGVSRACGCSLLPLKSHIKGPAPVSDQDRTDIVDEAITFFRANVFFRNFDIKSPADKLLIYLTFYINVALKRLEGCRTLAEGTKAIINLGLEKVPVPGESGFPFPGLFPLPQSHKEAGESCHHYSFILIFLSADA

SEQ ID NO: 126267 - protein, 218 aa, Glycine max
  Coding DNA Sequence Number=SeqID_9489
  Gene Ontology: Mol. function=transferase activity
  Homolog annotation: Hit_ID=UPI00005DC2B3; Match level="QueryCoverage =89%, HitCoverage=29%, E-value=9e-37, Identity=41%"; Hit description =ATMAK10; acetyltransferase
ILKPLQNNPDLEEGYCKALLCRLRFRKHFYHLLMSMKRPQGRGLELARKHIASCISEIDYIRKCSEFLRANAHGISEQNLYNTTASGLSAPTPPRSIKIHSWEKKSRPDLVARAHLQGNSLFAYARARQHTMTFPHTLHGKEPPPDTRLLLVQDGKLYGRDPMFSMITGAAGLPGVTENYDFQKNEFMVQLGQTCILSMTMMIIFLPEIIKAQLLPFI

SEQ ID NO: 126268 - protein, 108 aa, Glycine max
  Coding DNA Sequence Number=SeqID_9490
  Homolog annotation: Hit_ID=Q1T344; Match level="QueryCoverage=87%, HitCoverage=33%, E-value=1e-15, Identity=41%"; Hit description=RNA polymerase, RBP11-like
MGSDTHIGSRGRTSFVLIGCERSGQYKYRKKEFVRRDTGSRKCGCPFKLRGKPVHGGKCWMVKLICGIHNRELAKSLVGHPYIGRLTKDEKNIIADMTKSMVKPRTSC

SEQ ID NO: 126269 - protein, 298 aa, Glycine max
  Coding DNA Sequence Number=SeqID_9491
  Gene Ontology: Mol. function=nucleoside-triphosphatase activity; Cellular component=chloroplast
  Homolog annotation: Hit_ID=Q2PMM5; Match level="QueryCoverage=99%, HitCoverage=13%, E-value=1e-167, Identity=99%"; Hit description =Protein ycf2
MPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFLKSFLDILNVPTIHGT

SEQ ID NO: 126270 - protein, 271 aa, Glycine max
  Coding DNA Sequence Number=SeqID_9492
  Gene Ontology: Mol. function=transferase activity; Cellular component= membrane; Biological process=metabolic process
  Homolog annotation: Hit_ID=Q1SG26; Match level="QueryCoverage=98%, HitCoverage=66%, E-value=1e-108, Identity=72%"; Hit description =Exostosin-like
  Pfam annotation: Domain name=Exostosin; Domain location=2-234; Score =115.7; E_value=1.3e-31; Accession=PF03016.6; Description=Exostosin family
MWITIDYTNIIAHRYPYWNRTRGADHFLASCHDWAPPDISRAESGKELFKNIISVSYSPLDFIFFYFLVLYNANKSEGFKPEKDVPMPEVNLQGFKLSSPILGLDPNNRSILAFFAGGVHGRIREILLQHWKDKDEEVQVHEYLPKGVDYHGLMGQSKFCLCPSGYEVASPRIVESINIGCVPVIVSDYYQLPFSDVLDRSKFSLHIPSRRIAEIKTMLKNVPHAKYLKLQKRVMKVQRHFVLNRPAKSFNVFHMILHSIWLRQLNIRLYH

SEQ ID NO: 126271 - protein, 392 aa, Glycine max
  Coding DNA Sequence Number=SeqID_9493
  Gene Ontology: Mol. function=protein serine/threonine kinase activity; Cellular component=membrane; Biological process=protein amino acid phosphorylation
  Homolog annotation: Hit_ID=Q1T6P5; Match level="QueryCoverage=99%, HitCoverage=51%, E-value=1e-136, Identity=56%"; Hit description=EGF -like, subtype 2; S-locus glycoprotein; Curculin-like (Mannose- binding) lectin; ...
  Homolog annotation: Hit description=Apple-like; Serine/threonine protein kinase, active site
  Pfam annotation: Domain name=PAN_2; Domain location=152-220; Score =98.4; E_value=2.2e-26; Accession=PF08276.2; Description=PAN-like domain
  Pfam annotation: Domain name=S_locus_glycop; Domain location=12-135; Score=24.9; E_value=5.5e-07; Accession=PF00954.11; Description=S -locus glycoprotein family
  Pfam module annotation: Pfam domain module=PAN_2::S_locus_glycop; Domain location=152-220::12-135
MKLGWNLETGLERYGLSWKSVENPAEGDYTVKIDLGGYPQMVIFREFVINEKEVYYEYELLDRSVFSLYTLAPSGTGQGLFWTTEISTRKVVSIGEQDQCENYAFCGTNSICSYEGNYSTCECVKGCVPKFPQYWNLSIWSNGCVPRIKSNCKNGYTYGFLKYTQMKLPDTSSSWFNKTMKLEDCHKLCLENCSCLAYASLDVRGGGSGCLLWFNNLADLRKFSQWGQDLYIKVPASDLLVTYHALHLLDHVATGHENIKKKIVGITVGAARKIYNKHYKSKQIIEDIDLPTFALSALANATENFSTKNKLREGGFGPVYKGTLMDGKVLAVKRLSKKSIQGLDEFKKEVALIAKPQHRNLVKLLGCCIEGEEKMLIYEYMPNQSLDYFVFG

SEQ ID NO: 126272 - protein, 251 aa, Glycine max
  Coding DNA Sequence Number=SeqID_9494
  Gene Ontology: Mol. function=transferase activity; Cellular component= proton-transporting two-sector ATPase complex; Biological process =positive regulation of cell proliferation
  Homolog annotation: Hit_ID=Q1SG27; Match level="QueryCoverage=93%, HitCoverage=86%, E-value=4e-96, Identity=75%"; Hit description=Mak10 subunit, NatC N(Alpha)-terminal acetyltransferase
  Pfam annotation: Domain name=Mak10; Domain location=21-235; Score =279.5; E_value=6.7e-81; Accession=PF04112.4; Description=Mak10 subunit, NatC N(alpha)-terminal acetyltransferase
MAEDGSLPPRASIPSGDNSVWADVSPLLQAACQDLQEGELIHGDNFNLFAAMSALEIMDPKMDSGIACTYYSLDEAIENGVAPIPISADKTTDVRCMIDIMDHLLACEVSLSKGAEKFLSFSKTYSNISIVRLTNATWHKGHSLAQTVYSCLYLLRPERTSSHALLHSYCKVIRATCKAILSVVSQARTHEEEDLFTMAYGLPLSGDGDEKCLSMLNAVEETISRQLRACKVSSSKRRVPEGLIKVVVRFK

SEQ ID NO: 126273 - protein, 368 aa, Glycine max
  Coding DNA Sequence Number=SeqID_9495
  Gene Ontology: Mol. function=transferase activity; Cellular component= membrane; Biological process=metabolic process
  Homolog annotation: Hit_ID=Q1SG18; Match level="QueryCoverage=93%, HitCoverage=82%, E-value=1e-143, Identity=69%"; Hit description =Exostosin-like
  Pfam annotation: Domain name=Exostosin; Domain location=35-329; Score= 238.5; E_value=1.5e-68; Accession=PF03016.6; Description=Exostosin family
MSPCASTLALTQNACIGVCDKKKSSQKEMLKRFKVWVYEEGEQPLVHYGPVNNIYSIEGQFIDEMDNYHKWSHFRARNPNQAHVFLIPFSIVNIVQYVYNRNLRQPGSQSIQLLVEDYIRVIAHKYPYWNRTEGADHFLLSCHDWGPTISYANPKLFKNFIRVLCNANTSEGFRPNKDVSIPEVNLLPRGTLGSPNRGQHPNDRTILAFFAGREHGAIRTILLNHWKDKDNDVQIYESLPKGKVYTKLMGQSKFCLCPSGYEVASPRVVEAIYAGCVPVLISSSYSPPFTDVLNWSQFSVEIPVEKIPEIKTILQSVSPKKYLKLQMNVLRVQRHFTINRPAKPFDLMHMILHSIWLRRLNLKLVDSR

SEQ ID NO: 126274 - protein, 157 aa, Glycine max
  Coding DNA Sequence Number=SeqID_9496
  Gene Ontology: Mol. function=transferase activity; Cellular component= membrane
  Homolog annotation: Hit_ID=Q1SF57; Match level="QueryCoverage=89%, HitCoverage=36%, E-value=3e-44, Identity=68%"; Hit description =Exostosin-like
MVSRVRLQCVVSGNLRCHILSFGYSFNCNEFTPFNHITERQRVIVTNYYWDTPHIDCFHHPRTCHLHWDTSRTFFGPSTLYTLDPLEAKKTNNIVRLLGCWAVFGGPSFLEGKYTSVMDTSLLGWNPSEVLALQSALMKYLKTSGLASDIHGPRIIK

SEQ ID NO: 126275 - protein, 359 aa, Glycine max
  Coding DNA Sequence Number=SeqID_9497
  Gene Ontology: Mol. function=transferase activity; Cellular component= membrane; Biological process=metabolic process
  Homolog annotation: Hit_ID=Q1SG18; Match level="QueryCoverage=95%, HitCoverage=82%, E-value=1e-157, Identity=73%"; Hit description =Exostosin-like
  Pfam annotation: Domain name=Exostosin; Domain location=26-321; Score= 227.3; E_value=3.4e-65; Accession=PF03016.6; Description=Exostosin family
MAGLTKFYCKMLGSRSHIEMVKRFKVWVYQEGEQPLVHDGPVNNIYAIEGQFMDEMDNNGKWSQFRARHPEEAHVFFLPISIANVVHYVYKPILKQSDYEPVRLQHLVEDYIGVIQDKYPYWNRSIGADHFLLSCHDWGPKVSYGNPELFQTFIRALCNANTSEGFHPNRDVSIPEVYLPVGKLGPASLGQHPNSRTTLAFFAGGVHGEIRKILLKHWKDKDNEVLVHEYLPKGQDYTKLMGQSKFCLCPSGHEVASPRVVEAIHAGCVPVIICDNYSLPFSDVLNWSQFSVEIPVEKIPEIKSILQSISRNKYLRLHMNVLRVRRHFMINRPTKPFDMMHMILHSIWLRRLNIKLIAS

SEQ ID NO: 126276 - protein, 150 aa, Glycine max
  Coding DNA Sequence Number=SeqID_9498
  Homolog annotation: Hit_ID=Q1SG18; Match level="QueryCoverage=43%, HitCoverage=16%, E-value=8e-10, Identity=52%"; Hit description =Exostosin-like
MLSSRCSTASMLLPLLFPIFLFLFIIHLEGNHLSFEFPNFSLSSIKGITTQLQPHGQYLANSAYRSLEHRIKKRTSFDVVEEGLAKARASIREAILSRNHSNSGKQEDFIPKGSIYRNPHAFHQLSSKDFDIFIFITYNQGFKLWSWSGC

SEQ ID NO: 126277 - protein, 53 aa, Glycine max
  Coding DNA Sequence Number=SeqID_9499
  Homolog annotation: Hit_ID=Q1SF60; Match level="QueryCoverage=59%, HitCoverage=8%, E-value=6e-08, Identity=84%"; Hit description=Hly -III related proteins
MLLERRQNIEPPRKTKNGHLAITSAVDSSSIVKDLLGLNIRKLINITGLILEV

SEQ ID NO: 126278 - protein, 249 aa, Glycine max
  Coding DNA Sequence Number=SeqID_9500
  Gene Ontology: Mol. function=DNA-directed DNA polymerase activity; Biological process=DNA replication
  Homolog annotation: Hit_ID=UPI00005F98F4; Match level="QueryCoverage =85%, HitCoverage=66%, E-value=3e-78, Identity=70%"; Hit description =COG0613: Predicted metal-dependent phosphoesterases (PHP family)
  Pfam annotation: Domain name=PHP; Domain location=49-249; Score=33.7; E_value=6.5e-07; Accession=PF02811.9; Description=PHP domain
IFIIPPGVRGRGRIDFRPAADRGYDRKPSHCRIAVLTDSNPPSTAFTLYDLHSHTTASDGYLTPTQLVQRAVEMRVGVLAITDHDTTAGLAEAAAAIAEQALPLWLVNGVEISTLWENHEIHIVGLGMDVAHPALVALLAEQTERRNRRAQEIGVRLGKARIPDAYAGAQRLAGDGAVTRGHFARYLVEIGVAGNMAQVFKKYLAKGKTGYVPPQWCTIEQAIDAIHQSGGQAVMAHPGRYDLTAKVVE

SEQ ID NO: 126279 - protein, 138 aa, Glycine max
  Coding DNA Sequence Number=SeqID_9501
MEADMEAMKEQMATMMEAMMSMKKIMEANAVAVVATRAVAKVNPMPPSDLNQMNHPTSDMMGKDLGSTDDPMMCKFKTSMPSRHMACLPTIHHPMWRTLPVRMSITPLLYPLRANNPKLVMHMSLKPWGRHMKLPTII

SEQ ID NO: 126280 - protein, 86 aa, Glycine max
  Coding DNA Sequence Number=SeqID_9502
MSATDPSLKSTWNRVIEIPKGYCVCFWNKATRVISRESPTLSFFPGIGRRTMFGFGYDPSSEKYKVVAIALTMLSLDVSEKTEMKV

SEQ ID NO: 126281 - protein, 74 aa, Glycine max
  Coding DNA Sequence Number=SeqID_9503
MTLSSVDMAEAHALTLRKDSSQVLKAFHSQKSSTDRSLRPIVSDVQQLRMSHHSWSSPPPAILAILREDHHCLT

SEQ ID NO: 126282 - protein, 91 aa, Glycine max
  Coding DNA Sequence Number=SeqID_9504
  Subcellular localization annotation: CTP_CleavageSite=7; ConfidenceScore=5.30e-01
MSAFICSCTSSTSPITLALAQDMGLNQFRFFNMVHDILVKVKLEVTRTSTVLNVFGSEQSSDRKMQGLRMSKHENQRYVVCRTKSMLNAYA

SEQ ID NO: 126283 - protein, 242 aa, Glycine max
  Coding DNA Sequence Number=SeqID_9505
  Gene Ontology: Mol. function=protein serine/threonine kinase activity; Cellular component=membrane; Biological process=protein amino acid phosphorylation
  Homolog annotation: Hit_ID=Q9FG33; Match level="QueryCoverage=74%, HitCoverage=32%, E-value=8e-32, Identity=45%"; Hit description =Lectin-like protein kinase
  Pfam annotation: Domain name=Lectin_legB; Domain location=29-242; Score=53.0; E_value=5.3e-14; Accession=PF00139.10; Description =Legume lectin domain
PSRTERDRKERPKEVKSYFSPLSRKSKCTGEKFLWRKVQVFLWRKSRKLLKNFYNLLLNINSKIYLDAIQVTPDSRGPISNYSGRAFYKEQLKLWDSQRGIKASVNSTFVFNVNPQTSPGCEGFTFMLPDDTSLPSNSAGQWLGIVNSTSIGVSNIVAVKFDTRKSYSEDIDDNHVGVDVKSIYSIQQESLGPHGVNISSGTNSIATIYFDAKGGKLIIYVSTSGDLKGIYPAQLNKIMEFL

SEQ ID NO: 126284 - protein, 181 aa, Glycine max
  Coding DNA Sequence Number=SeqID_9506
  Gene Ontology: Mol. function=protein transporter activity; Cellular component=membrane; Biological process=intracellular protein transport
  Homolog annotation: Hit_ID=Q9LGF8; Match level="QueryCoverage=83%, HitCoverage=46%, E-value=5e-34, Identity=53%"; Hit description =Putative syntaxin of plants 31
  Pfam annotation: Domain name=Syntaxin; Domain location=44-150; Score =96.2; E_value=9.9e-26; Accession=PF00804.15; Description=Syntaxin
  Subcellular localization annotation: CTP_CleavageSite=30; ConfidenceScore=5.10e-01
SFVFGNRTHEFQSIAERLKKTGSAPNGQSSSSSRSEEQRSAIANQSEFNRRASKIGLGIHQTSQKLAKLAKLAKRTSVFDDPTMEIQELTGVIKQDITALNSAVVDLQLLCNSRNESGNASTDTTSHSTTVVDDLKTRLMSTTKEFKDVLTMRTEVPYLSYWCASVYLLIADDTDVMLLFL

SEQ ID NO: 126285 - protein, 118 aa, Glycine max
  Coding DNA Sequence Number=SeqID_9507
MVILRPLSFRSSESSDKRAETNYGHSAPFVIQKQSSNSSDKRAETNYGHSAPFVIQGQPDHARWRAETNYGHFAPCVNQKEQIWQYQDDVGHSVLIIFKIFASFAGGEIDRPNGVSLK

SEQ ID NO: 126286 - protein, 101 aa, Glycine max
  Coding DNA Sequence Number=SeqID_9508
MEVLRRSLFVLHHSSIFNRSKSPAFVDPMRSLKIQRLNISLLSKNKISLKNYVGLILMEACLCGFYGDWIFELQLGPLMVIFHHGDAAEDKGEEVRGGVIH

SEQ ID NO: 126287 - protein, 115 aa, Glycine max
  Coding DNA Sequence Number=SeqID_9509
MASFCDFGAEMVCKGWSFDGASMVRKKKGIATLRVISLVPIPRVSLHPSGPVFESRQYIYQNTQNETPSVVQRPKNDEERTTNDEERLKIFAKSPTETLRKRLGLDFLHGNNFPH

SEQ ID NO: 126288 - protein, 123 aa, Glycine max
  Coding DNA Sequence Number=SeqID_9510
LGRIDGDSALRGTRIRATWEYVSLVGGGQQGMSGTWRYVAGVRRPWGRQASSWQSTDKRNKDHKPMRLVWWLASCEYCVIYGLWLLVIDYQGLENKVVEASGNRLPVCVIDYTEEWVTGNRLP

SEQ ID NO: 126289 - protein, 176 aa, Glycine max
  Coding DNA Sequence Number=SeqID_9511
  Gene Ontology: Mol. function=two-component response regulator activity; Cellular component=membrane; Biological process=two -component signal transduction system (phosphorelay)
  Homolog annotation: Hit_ID=Q89KU8; Match level="QueryCoverage=97%, HitCoverage=77%, E-value=7e-53, Identity=60%"; Hit description=Two -component response regulator
  Pfam annotation: Domain name=Response_reg; Domain location=1-66; Score=-0.4; E_value=0.0038; Accession=PF00072.14; Description =Response regulator receiver domain
  Pfam annotation: Domain name=Trans_reg_C; Domain location=98-173; Score=72.8; E_value=1.1e-18; Accession=PF00486.18; Description =Transcriptional regulatory protein, C
  Pfam module annotation: Pfam domain module=Response_reg::Trans_reg_C; Domain location=1-66::98-173
MLLDRQLPDGDGVAFVATARALRPNLAVIMMTAKGTLSDKVEGLDVGADDYLVKPVAIEELMARIRAVSRRPSAMVTPSLHLGRLDFDFESLQAQVEGQLLALPRRQVLVLQALAMRQGRTVTRSALEAAVYGFDDEIQSNALDAHISKLRKALQQAGAGVEIHVIRGVGYLLAEA

SEQ ID NO: 126290 - protein, 185 aa, Glycine max
  Coding DNA Sequence Number=SeqID_9512
  Gene Ontology: Mol. function=protein histidine kinase activity; Cellular component=integral to membrane; Biological process=two -component signal transduction system (phosphorelay)
  Homolog annotation: Hit_ID=Q8ZN78; Match level="QueryCoverage=86%, HitCoverage=28%, E-value=3e-25, Identity=42%"; Hit description =Sensory histidine kinase in two-component regulatory system with NarP
  Pfam annotation: Domain name=HAMP; Domain location=104-174; Score =30.3; E_value=6.9e-06; Accession=PF00672.15; Description=HAMP domain
MQIYRLAWDSTRDPQQLAHHMQQYQQTLESPALQHLERPWVPIEVSSRYRYLRDSWPVLQETLQPARAQVYQQRVAGYVSEIDRFVLAVQHYAELKMHLVAASSLFGFLAIVALALWSIGFIRRNVVRPLDSLVTASQYVEQANFSFPPLSVHQPNELGVLAQAFTHHGGAAAFALSPAGVRGAQ

SEQ ID NO: 126291 - protein, 183 aa, Glycine max
  Coding DNA Sequence Number=SeqID_9513
  Gene Ontology: Mol. function=protein histidine kinase activity; Cellular component=integral to membrane; Biological process=two -component signal transduction system (phosphorelay)
  Homolog annotation: Hit_ID=Q6D5Y8; Match level="QueryCoverage=100%, HitCoverage=32%, E-value=1e-41, Identity=49%"; Hit description =Nitrate/nitrite sensor protein
AEGGEQLAQLLIGLGQRAIKIGDDRLCLRLAAIDITPQQRQLDTQKRERLRQRIVQLARNGGALFNQQHLLILLLRLPDPQCTRQHVGQAVHQLIGRRRAAGLPAQFAEVLLLLLQRQPLPAEIVGGHAGLEGDILAGDLQHLQRFPSLHQPKQALKQLGIERAAGENLRAFIQQRQRAVGLG

SEQ ID NO: 126292 - protein, 72 aa, Glycine max
  Coding DNA Sequence Number=SeqID_9514
MGVWPFLEASACLDSSRERKVLIVGGALGREKDRYWLSSGTDMGDVALCGACRPWIFFINGVLCFLKIMAVE

SEQ ID NO: 126293 - protein, 60 aa, Glycine max
  Coding DNA Sequence Number=SeqID_9515
MAFRRQGSMAPAHCRGKTERDKILMAWWWLIYECATFKLFGGRKSTKQKGHFGKNDSSSQ

SEQ ID NO: 126294 - protein, 167 aa, Glycine max
  Coding DNA Sequence Number=SeqID_9516
  Gene Ontology: Mol. function=nucleic acid binding; Cellular component= nuclear pore; Biological process=DNA integration
  Homolog annotation: Hit_ID=Q1SRN1; Match level="QueryCoverage=95%, HitCoverage=16%, E-value=4e-36, Identity=38%"; Hit description =Integrase, catalytic region
MAEAKPISSPMVINLKLSKAGNGFLQDPTLYRSVVRTLQYATITRPEISFSAADPDDHRSTSGAAIFLGPNLVSWGSRKQQMPLIFCDNQSAVVAQAHNPILHSRTKHMEIDLFFVREKVLSNKLYVVHIPAQDQWADLLTKPLSPTRFQFIRDKLKVLELSQAHPP

SEQ ID NO: 126295 - protein, 489 aa, Glycine max
  Coding DNA Sequence Number=SeqID_9517
  Gene Ontology: Mol. function=nucleic acid binding; Biological process= DNA integration
  Homolog annotation: Hit_ID=Q1S7C5; Match level="QueryCoverage=88%, HitCoverage=63%, E-value=8e-35, Identity=42%"; Hit description =Integrase, catalytic region
MTQDNELEDPAMAESNPPSSVPPSFSSSFAFVHSITKKLTDSNFLLWRQHVEPEIKAHQLHRYLVYPNIPLRYANEADQDSSPMNPASILSCVLGSIHAFQVWEKIHDHFQKLTRAKAHQLCTKLRSTTLDNKSVSEFLLHIKALADALASIRDPIIPEQHVDVILKGLPSDYNLVISVIESKFELMQIEEVRTGALAALGSQTPEHLIMSLQIRITSANSALLKVQTKFSLVMDKETTEILLQGTVDSDGLYQFPSLHLQPQSKLCFPANCLVFNSDSQTKYVSTVVSPSYRFMWHVRLGHPNDHTLKLVLNHYLATLKLEFRSHESLFLGYSSNHKDYRCLSPNGKVFISKDVVFNETKFPYPVLFSKPSSSLSPSSSSSFSANIPLADPATFIHTSTTIQCPSTSAQNNVSNPSSPPQDFAPNPPPSQSIYIVSEPVTQPVDPVTQSVDHVTQPLATDSVSELPSTTASVSSSDSSSESTFHFPVP

SEQ ID NO: 126296 - protein, 383 aa, Glycine max
  Coding DNA Sequence Number=SeqID_9518
  Gene Ontology: Mol. function=phosphoprotein binding
  Homolog annotation: Hit_ID=Q9M9F9; Match level="QueryCoverage=99%, HitCoverage=99%, E-value=2e-68, Identity=46%"; Hit description =Uncharacterized protein At1g78430
MKPSFPTRGSELPQRQSPRGPHQHRTSSSDSDPLHHRLIADRSPKLGDRRSPRGTQSEGLNQKKLGTRIADLESQLGQAQVELKVLKDQLASAEAAKKEAQDELVKKAVQSVLPVVEKLQEKSTSKNAPESNKTEIKPQDVIPDDDQLETDVFEVPIEKLTIEFSKPADQSEKETQPFEDTNAAAISKPEKLSVDEHELTLKNDEIALLKTSLEEKGKELESMSNEKENLKNQLNEAVSKVSAAQTKEEGMTLQLNQLREELETSKANADKLDEKLKSVEAEKEGLESEMKKLRVQTEQWRKAADAAAAVLAGGVDMSARIPERCGSMDKHFGGTFETPAGRYNGYVGSPGMADDLDDSFGGGKRKGSGIRMFGDLWKKKSQK

SEQ ID NO: 126297 - protein, 224 aa, Glycine max
  Coding DNA Sequence Number=SeqID_9519
  Gene Ontology: Mol. function=transporter activity; Cellular component= integral to membrane; Biological process=transport
  Homolog annotation: Hit_ID=Q010B9; Match level="QueryCoverage=80%, HitCoverage=21%, E-value=5e-57, Identity=58%"; Hit description=[R] KOG0255 Synaptic vesicle transporter SVOP and related transporters
  Pfam annotation: Domain name=DUF572; Domain location=1-224; Score =326.5; E_value=4.7e-95; Accession=PF04502.3; Description=Family of unknown function (DUF572)
MGERKVLNKYYPPDFDPSKLPRARRPKNQQIKVRMMLPMSIRCNTCGNYIYKGTKFNSRKEDVIGETYLGIQIFRFYFKCTKCSAEVTMKTDPQNSDYIVESGATRNFEPWRAEDEEADKTKEKRDAEEMGDAMKSLENRTLDSKREMDILAALDEMKSMKSRHATVTVDEMLEALQRTAADKCYLSSAFGTKILEKRLEQEDEALIKSVVFHAKFRRFCQKNS

SEQ ID NO: 126298 - protein, 237 aa, Glycine max
  Coding DNA Sequence Number=SeqID_9520
  Homolog annotation: Hit_ID=Q6T367; Match level="QueryCoverage=36%, HitCoverage=38%, E-value=2e-09, Identity=46%"; Hit description =Centromeric histone 3
MEANRFILKIHKPIVKRDREGKRRRKEKENCKKRNRKPNPKSEGSLNPMARVKHTPASRKSAKKQAPRASTSTQPPPQSQSPATRERRRAQQVEPQQEPEAQGRKKRRNRSGTVALREIRHFQRSCELLIPAAPFIRCGCLENCLIGVEWKFYILEFQSIKVKQITNQFSTEVSRWTPEAVVALQEYIEGKVMGVSKREGEWKRLQSVLQGFNMFPCTFLACLRALPTKLSPRVIIN

SEQ ID NO: 126299 - protein, 141 aa, Glycine max
  Coding DNA Sequence Number=SeqID_9521
MSREEDLEVHGEGFLKTWSLKDTMKEDFFGLTPKKTLQGLEDCKEEILKMFHSEKYLYVIDEVYVKSSIENSSKEDGILLVTPTKTTSSLIPKIKNQQNGSPSRKNSSSTTTSKMPIFTDMDEGLMDQHDMNSDENFKTSS

SEQ ID NO: 126300 - protein, 126 aa, Glycine max
  Coding DNA Sequence Number=SeqID_9522
MGSFPNYLQHGAVFYVKCMGTCSQTAIANGEFGLSEGLATASGDMSMQDTNRQYEWRYTQRKGTASQTGEFHGLMVQAYVAGNCTFQWLDCRSFFRERGVATAIGELPASCNSHWRFRQKNSHHEW

SEQ ID NO: 126301 - protein, 198 aa, Glycine max
  Coding DNA Sequence Number=SeqID_9523
  Gene Ontology: Biological process=response to biotic stimulus
  Homolog annotation: Hit_ID=Q5MJ53; Match level="QueryCoverage=86%, HitCoverage=97%, E-value=2e-86, Identity=87%"; Hit description=AT -rich element binding factor 3
PKLKLIPPHLLPLPYVIAKRIEEKMNGGESYGAIETQYIRRHHKHEPRENQCTSALVKHIRAPVHLVWSLVRRFDQPQKYKPFVSRCIMQGDLGIGSVREVNVKSGLPATTSTERLEQLDDEEHILGIRIVGGDHRLRVIDGRPGTMVIESFVVDVPDGNTRDETCYFVEALIRCNLSSLADVSERMAVQGRTNPINH

SEQ ID NO: 126302 - protein, 402 aa, Glycine max
  Coding DNA Sequence Number=SeqID_9524
  Gene Ontology: Mol. function=binding; Cellular component =intracellular; Biological process=metabolic process
  Homolog annotation: Hit_ID=Q9LHZ4; Match level="QueryCoverage=99%, HitCoverage=94%, E-value=4e-98, Identity=32%"; Hit description =Pentatricopeptide (PPR) repeat-containing protein-like
  Pfam annotation: Domain name=PPR; Domain location=132-165; Score =13.1; E_value=0.21; Accession=PF01535.11; Description=PPR repeat
  Pfam annotation: Domain name=PPR; Domain location=168-201; Score =13.4; E_value=0.19; Accession=PF01535.11; Description=PPR repeat
  Pfam annotation: Domain name=PPR; Domain location=234-268; Score=8.0; E_value=0.84; Accession=PF01535.11; Description=PPR repeat
  Pfam annotation: Domain name=PPR; Domain location=97-131; Score=33.1; E_value=9.8e-07; Accession=PF01535.11; Description=PPR repeat
  Pfam module annotation: Pfam domain module=PPR::PPR::PPR::PPR; Domain location=132-165::168-201::234-268::97-131
MISGCCQNENYTDALQFFSQMQEENVKPNSTTISTLLRACAGPSLLKKGEEIHCFSMKHGFVDDIYIATALIDMYSKGGKLKVAHEVFRNIKEKTLPCWNCMMMGYAIYGHGEEVFTLFDNMCKTGIRPDAITFTALLSGCKNSGLVMDGWKYFDSMKTDYSINPTIEHYSCMVDLLGKAGFLDEALDFIHAMPQKADASIWGAVLAACRLHKDIKIAEIAARNLFRLEPYNSANYVLMMNIYSTFERWGDVERLKESMTAMGVKIPNVWSWIQVRQTIHVFSTEGKSHPEEGEIYFDLYQLISEIKKLGYVPDTNCVHQNIDDSEKEKVLLSHTEKLAMTYGLMKIKGGTPIRVVKNTRICQDCHTAAKYISLARNREIFLRDGGRFHHFMNGECSCNDRW

SEQ ID NO: 126303 - protein, 227 aa, Glycine max
  Coding DNA Sequence Number=SeqID_9525
  Gene Ontology: Mol. function=nucleic acid binding
MALPHLLKRRIYFIGVQRKLRRLENTMEGDVLAEARNGIIQIINLHDGYYQVVFTTHDDYNFALFEGPWMVVDHYLIVQRWLPFFLTNVEKMKNVAVWLKVQCLPIELYNDVFLKRIGMSLRKSLKADKLTSIQSRGKYARICMELDLYKPLESHIYDPSMDRVAVPTESPVENSSEARIELVVNTVVVQHTIRADIISTSANPNVSINASQGNNEDESLFGAWMIV

SEQ ID NO: 126304 - protein, 116 aa, Glycine max
  Coding DNA Sequence Number=SeqID_9526
  Homolog annotation: Hit_ID=Q1SXT4; Match level="QueryCoverage=34%, HitCoverage=3%, E-value=2e-12, Identity=80%"; Hit description =Protein kinase-like
MDLRVEAYLKFVEVQDKEMENFVAEKEKMLHAHGTGYAAMKWRHWEEEVQYEHKFVEELTNLMEITMFRGGVVTNSRASLGWFAFEPEWYDTNYTNFAQFEAQSFSLLVQYLSNMK

SEQ ID NO: 126305 - protein, 144 aa, Glycine max
  Coding DNA Sequence Number=SeqID_9527
  Gene Ontology: Mol. function=RNA-directed DNA polymerase activity; Biological process=RNA-dependent DNA replication
MKMLDITFTSLDIKGLDPNQDDLMVITVEIANCLVRKTLVDQGNSIDILFWKTFKQLEIPKSTLTSYNILLDQLSVNALGAIVSTPHVAMKFLSYQGSIIAIHENLKVARDCYMASLKLAPMSEFDEFKAINMVSLVDMEDVEV

SEQ ID NO: 126306 - protein, 656 aa, Glycine max
  Coding DNA Sequence Number=SeqID_9528
  Gene Ontology: Mol. function=triacylglycerol lipase activity; Biological process=lipid metabolic process
  Homolog annotation: Hit_ID=Q5ZBH3; Match level="QueryCoverage=69%, HitCoverage=66%, E-value=1e-112, Identity=46%"; Hit description =Lipase class 3 family protein-like
  Pfam annotation: Domain name=Lipase_3; Domain location=378-517; Score= 105.9; E_value=1.2e-28; Accession=PF01764.16; Description=Lipase (class 3)
  Subcellular localization annotation: CTP_CleavageSite=45; ConfidenceScore=5.38e-01
MAYSAVSVPISITSSATMDITKENKFLLHSLSNKGLLCKHSTSVRSYSTSNNCIQATSMQPKHKSRNSIIVFPLQLSVSILPNPLRSFLFDTETRREMNMGQKGINNIKENMVESSEEVMINRARWVQRLTGIKRYWRRKVPKESMETDIICKHNTNSYEEGDEKEENGQEVACDRDSFSKFLVPVPWPDTKLFSKLAFLCSMAYVIPQIKAKDLGRNYGLEFVTSSLEKKGDVTKIKAKLDQDSICVPMDASDSAASQDDSEKEKGDDNEQKHQIKLAYDITASAASYVQSRTKDLLSLASKSKKHSGNGDFSGREDSPYEEADETPPVYKSKYGVNAAALTMTVVAAAGTAVDLQSLRSSSCEWFVCDDPDTHTRCFAIQGSYSVASWKANLYFEPTTFEGTDVLVHRGIYEAAKGIYEQFMPEIMDHLKKYGDSAKLQFTGHSLGGSLSILVYLMLLTRKVVSPSTLLPVVTFGSPFVLCGGQKLLNELGLDESYIQCVIMHRDIVPRIFSCSFPNHVITVLKRLNGSFVSHPCLVKNKLLYSPLGKIFILQPDEKTSPPHPLLPLGSGFYAVDSSRCGYSPNVLRAFFNQPHPIETLSNPKAYGSDGTVLRDHDCNNYLKAVNGVFGQHSKIVVRTGRSKQPRKTFKKKMRK

SEQ ID NO: 126307 - protein, 96 aa, Glycine max
  Coding DNA Sequence Number=SeqID_9529
MAMLLSGMRGRAMAMKDIRAESARGSIPTLETLRAKMAVVKYMGDMRGRCSTMRLEQRAVVVAMLRRGEVGVAVHELLAKRILFYRLVCGWRRQGY

SEQ ID NO: 126308 - protein, 61 aa, Glycine max
  Coding DNA Sequence Number=SeqID_9530
MDYSIRNYMRVVWHGGSWVIVIHMVMVDGDIAVGLVCGHGGLRERQLSLLCRGRDLCGANS

SEQ ID NO: 126309 - protein, 1366 aa, Glycine max
  Coding DNA Sequence Number=SeqID_9531
  Gene Ontology: Mol. function=nucleotidyltransferase activity
  Homolog annotation: Hit_ID=Q10Q39; Match level="QueryCoverage=98%, HitCoverage=99%, E-value=0.0, Identity=42%"; Hit description =Nucleotidyltransferase domain containing protein, expressed
  Pfam annotation: Domain name=NTP_transf_2; Domain location=60-158; Score=8.9; E_value=0.021; Accession=PF01909.13; Description =Nucleotidyltransferase domain
MGEHEGWAQPPSGLLPNGLLPNEAASVIQVLDSERWLKAEQRTAELIACIQPNPPSEERRNAVADYVQRLIMKCFPCQVFTFGSVPLKTYLPDGDIDLTAFSKNQNLKDSWAHQVRDMLENEEKNENAEFHVKEVQYIQAEVETCGHRALDLVKIIKCLVENIVVDISFNQLGGLCTLCFLEEVDNLINQNHLFKRSIILIKAWCYYESRILGAHHGLISTYALETLVLYIFHVFNNSFAGPLEVLYRFLEFFSKFDWENFCVSLWGPVPISSLPDVTAEPPRKDGGDLLLSKLFLDACSSVYAVFPGGQENQGQPFVSKHFNVIDPLRVNNNLGRSVSKELNKKEPSACLSGHNQQWEYAIFYAFCGSNFFRIRSAFAFGAKKLARLLDCPEEELFSEVNQFFFNTWERHGSGERPDVPSIDLRHLSLSSHDQLQRSENLRNNNHKIDYASNHESNEEEHVSQSGLSQYSNFASEKTARSVVSTVSHSQNQNNSRTFDEVLRETNSNTGSHVNKGQRNVKANNLVSDVQGRFLFARTRSSPELTDSYGDVSTQGRSTKATESSKGQSSVAKLENSRRKNVEPDVAVRIDESSARHISSRQVLESAADSNCNHDESSSGVMGEEFASVVGAGGMQMMHQEEQDLLNMMASPTAQGFSGQTHVPMNIAPGHLPFHFPPSILASMGYAQRNMGNIPFIEAPWGTNMQFSQGFIPPLTPYFPGIGVTSNPQDLLETNNENFSSVEMNVAEADYEYWHEQERGSASEVEVDNGNFEMLPEDRQQSTSGSYNNSAPLSRVGSSNSNSSARVQQKFTKENRGSTREEHVDNFHYQDGRRNEVYFDDRTANSELSSAPPLSSFRSRTSSESSWDGSSAKSSKSTRERRGRKNTNSMASPVYAKGKNVSEISSNRLDDENREWTPLSTMASNIPERSNWPTSGTSMHVPRNQISGFETAQTSGSDSPLPIAPVLLGPGSRQRENSGVVPFTFYPTGPPVPFVTMLPLYNFPTESSDTSTSNFNLEEGADNSDSSQNFDSSEGYEHPEVSSPSNSMTRVAIESSEHRPDILNSDFVSHWQNLQYGRFCQNSRHPPSMTYPSPVMVPPVYLQGRYPWDGPGRPISGNMNIFSQLMSYGPRLVPVAPLQSVSNRPASIYQRYVDDMPRYRSGTGTYLPNPKVSARDRHSTNTRRGNYNYDRSDHHGDREGNWNTNSKLRGTGRGHNRNQTEKPNSKMERLATSESRAERPWGSHRHDTFIPHQNGPVRSNSSQSNPSNVAYGMYPMPAMNPSGVSSNGPTMPSVVMFYPYDHNTGYGSPAEQLEFGTLGSMGFSGVNELSQANEGSQSSGAHEDQRFRGGHGQRSSPDQPSSPHVSR

SEQ ID NO: 126310 - protein, 223 aa, Glycine max
  Coding DNA Sequence Number=SeqID_9532
  Homolog annotation: Hit_ID=Q3BRR9; Match level="QueryCoverage=62%, HitCoverage=80%, E-value=6e-13, Identity=33%"; Hit description =Putative type IV pilus assembly protein FimT
MAFQFSAGDRPARALAPDPPGDADDDAAVLLSIHAQHDGLVGAGIAAVGPEPDVGPMIAGAQVDMTPACPVHAEFPCGAGRAVGRFDLHPPALAPCLVTSHAIRRTADRHTAAFGDGGVACHRQAGDQFGAQRFRLEVPQRALPGAPGQSQQDRQHHDSDQQLDQMEAAVEPGRAKMKGHASSLVPCSRIHHRPMPRLPARKPLNLPSPLAPYTHPSRELATP

SEQ ID NO: 126311 - protein, 103 aa, Glycine max
  Coding DNA Sequence Number=SeqID_9533
MKKMKGRNQNGEPKLVPARRRLLRGRPLKNTNEEGARKKTLDQEEEGEEGEKNVGCTDEEGAWKKKGHFCNFNELLGAPAILLGAPSISLLLAVLLEEYSKTR

SEQ ID NO: 126312 - protein, 1124 aa, Glycine max
  Coding DNA Sequence Number=SeqID_9534
  Gene Ontology: Mol. function=zinc ion binding; Cellular component =endoplasmic reticulum; Biological process=ubiquitin cycle
  Homolog annotation: Hit_ID=Q1STD2; Match level="QueryCoverage=99%, HitCoverage=99%, E-value=0.0, Identity=80%"; Hit description=Zinc finger, RING-type; RINGv
  Subcellular localization annotation: CTP_CleavageSite=45; ConfidenceScore=5.63e-01
MEIAHEPPPSLDGSPSAAADTLANSPSSSSSSPSSSSSSSASSPRGAKKKEIESTASAPSPAPAPAPSKFDDEEEEEEDVCRICRNPGDAENPLRFCFAPTPNMSKVCKHAFSFSPVYAENAPARLPFQEFVVGMAMKACHVLQFFLRLSFVLSVWLLIIPFITFWIWRLAFVRSLGEAQRLFLSHLSTAIILTDCLHGFLLSASIVFIFLGATSLRDYFRHLREIGGQDADREDEVDRNGARIARRPPGQVNRNINNGEGNGEDAGGVQGIAGAGQVIRRNAENVAARWEMQAARLEAHVEQMFDGLDDADGAEDVPFDELVGMQGPVFHLVENAFTVLASNMIFLGVVIFVPFSLGRIILHYLSWFFSTASGPLLSAVAPLADTSLSLANITLKNALTAVKNMSSETQESGSIGHVAEMLKANASEMSNITSASAVILKGGSIGTSRLSDVTTLAIGYVFILTLIFCYFGIVALIRYTKGEPLTMGRLYGFASIAETIPSLFRQFLAAMRHLMTMVKVAFLLVIELGVFPLMCGWWLDVCTIQMFGKTMVHRVQFFSASPLASSLVHWVVGIVYMLLISIFVSLLRGVLRNGVLYFLRDPADPNYNPFRDLIDDPVHKHARRVLLSVAVYGSLIVMLVFMPVKLAMRMAPSIFPLDISVSDPFTEIPADMLLFQICIPFAIEHFKLRTTIKSLLRYWFTAVGWALGLTDFLLPRPDESGNQENGNGEPARQERLQVVQAGVQDQGMVPFAGDDLNRAINTVGEMNAGEDYDNDEQSDSDSYAFVLRIVLLLVIAWMTLLVFNSALIVVPISLGRALFNSIPRLPITHGIKCNDLYAFIIGSYVIWTAVAGVRYSIEQIRKRRSSVLFGQLWKWCGILVKSSALLSIWIFVIPVLIGLLFELLVIVPMRVPVDESPVFLLYQDWALGLIFLKIWTRLVGKNEYNWIMRVLLEGKHLVMLDHMMPLVDESWRVKFERVREDGFSRLQGLWVLREIVLPIIMKLLTALCVPYVLAKGVFPVLGYPLVINSAVYRFAWLGCLSFSFVCFCAKRFHVWFTNLHNSIRDDRYLIGRRLHNFGEHAEKANVAETSTGEQEAILLGTGLNQQDHEADVGLRLRHVNQQVG

SEQ ID NO: 126313 - protein, 186 aa, Glycine max
  Coding DNA Sequence Number=SeqID_9535
  Homolog annotation: Hit_ID=Q1SZM6; Match level="QueryCoverage=41%, HitCoverage=25%, E-value=4e-08, Identity=38%"; Hit description =Ribonuclease H
MSELKVSLSRLCAYASKGVARMRKDKLVSTTEFLSQIDWGSIWVRIPVWRFIKKVIPFLEDKFWLKLGMGIAVFGARFATLKMNLFGIVSYFALECPGFGVIKLGSLQNLGQAGFGGLVGNIEGQFLKGFYGNIGWSDNLHTEIYALRQGLEICLDLGIRELTCETDSLHTLQLVNNVIDPHPQQV

SEQ ID NO: 126314 - protein, 485 aa, Glycine max
  Coding DNA Sequence Number=SeqID_9536
  Gene Ontology: Mol. function=RNA-directed DNA polymerase activity; Cellular component=extracellular region; Biological process=RNA -dependent DNA replication
MKLWNKKQFGNTFKKEDLWTAAQSHESMLRQKARTKWIREGDCNSRYFHMLMNSNRRNNAVKGVLIEGSRVEDPTRVKEEIHNFFQSRFNEPDYGRPEINGTRFKELAVCDCRSEKSPRPDGLNFKFIKFFWELLKPDITRFLDEFHVNGIFPKGCNASFIALIPKVKDPQSLNEYKPLIGCVYKIVAEILANKLKKVLTDIIDERQTAFIKGRHLLHGVLIANEVVEEAKGCKKPCLVFKVDYEKAYDSVSKDINVVLVNGSPTNQFTPQRGLRFNCFLMGKNKEPVSILQYADDTIFFREATMENVKAIKTILRCFELTSGLKINFAKSRFGEIYKSDQWWKEVAEVLNCIRLSMSFSYLGIPIGANPRLSEIWDPIIRKVPNKIVEKLINIQRRFLWGGGTEQRKIAWVNWEKDLMLLNQQHETSALKNQIEWRVGQGDKIRFWENNWTDEDRPLMTKYPNLYQISKQQQQTISLMGSHNDA

SEQ ID NO: 126315 - protein, 127 aa, Glycine max
  Coding DNA Sequence Number=SeqID_9537
  Homolog annotation: Hit_ID=Q6Z0Z0; Match level="QueryCoverage=80%, HitCoverage=7%, E-value=7e-09, Identity=35%"; Hit description =Putative DNA polymerase V
MAKSLHLRYLSEPFQEPSQPEAGSPTSLGFKNTHLSRTTRGRARRSQKKESGEGGLKLEAEKDNGLDNCAPSVRYIVRRLIRDGCSRGTAMPKSYIVPLFAVQAPVDVVSWIKYVVLMFCFLVQFVC

SEQ ID NO: 126316 - protein, 519 aa, Glycine max
  Coding DNA Sequence Number=SeqID_9538
  Gene Ontology: Mol. function=RNA-directed DNA polymerase activity; Cellular component=intracellular; Biological process=RNA-dependent DNA replication
  Pfam annotation: Domain name=rve; Domain location=265-417; Score =68.8; E_value=1.8e-17; Accession=PF00665.16; Description=Integrase core domain
MDVKSQSIAQHMTDLEEVFGELCKYDMRLNPKKYTIEVGGGKFLGFMITHRGIEANPKKCITILEMCSPTNIYEVQKLNGRLASMSRFLPRLAEKAKPFYKLLKNPEPFLWDETCEQTFLAFKKSIATPLVEYEVLIASLKPSREVGAKRLRCYTNLQLVQGQVAKRYQTKETMLLKYYHIMKTFIENFECFKMYYIPRETLQAGQHQKENFMKGYVVSTTEDAPLRPKWCEPTTIGQHSGQTPSTLLGGIDLPCTPPNNLHNLSSPWPFATWGMNILGSLPKAPGVVKYLLVVIDYFTNWIKAKPLWEITANEVEKFTWKHLICRYDLSYATITDNNTQFKAQTYKDFLTRLGIKHLVTFVEHPQTNSQVEAIDRVILRVLRTRLNKSKGLWKKELSSILWAYHCSPQIATNENLYRLTYGTNAMILVEVRELSIRRLLFHQQQNEENMKVELETTDEVQDMARIREEAAKLRAARRYNAKSKVKPEKIPKRESLAPAGNEHSGSQPTLATEHIDYKT

SEQ ID NO: 126317 - protein, 586 aa, Glycine max
  Coding DNA Sequence Number=SeqID_9539
  Gene Ontology: Mol. function=RNA-directed DNA polymerase activity; Biological process=RNA-dependent DNA replication
MVSTWSSLRRKTPFEDFHPHSAADHDQLEARIRRPQGNEHFAHTLLEHIQGESHPRRTVNTVDDLSLSHMHCPVGRTTRQHPFVDCIMEADIPLGWKPLNLEWYDGTINPDEHLNAFLTRANLYTNDDMLHPDGKMSKFKNEVKQVIQKLDKYERYTPLTVNHTTILEEAFNLKVPIRLPPTKPPRSGLDVTKYCRQLPSWNKTQRSNKGFTMQIEEEIERKTEEDRDTNNNGVNDNLHKNRNPPNKLGRAFAKRDTQWLSTRKNLEEDDLSGSLRAPLQVIKRTTSAHPLSERSVGINLVNQDDPMVVSIIIANFMVSKVLIDQGSSTDILYLKTFQTLEVSPDTVHPHAGPLLSFTGERVETRGYTDLMTTFDQGKLSRRFTIRYLLVDADTLYFALIGKKTLNELRAIISMPHLKMKFHTLTREIITVMAEQKQAQQCYAKSLKVAPYPHPTIAEGTQVMSVNKGSPIRALTVYQASLEIRHRSVDLTSHEHRCIADVLHKNFDLFSWHPSEMPRIHPNIIFHKLSIYPQAKPISQKKRKMGEERCKAIKEEVDKLPNANFIREVRCSTWLANVVMVKKTNDK

SEQ ID NO: 126318 - protein, 569 aa, Glycine max
  Coding DNA Sequence Number=SeqID_9540
  Gene Ontology: Mol. function=protein transporter activity; Cellular component=cytoplasm; Biological process=intracellular protein transport
  Homolog annotation: Hit_ID=Q1STD0; Match level="QueryCoverage=99%, HitCoverage=56%, E-value=0.0, Identity=65%"; Hit description =Prefoldin
  Pfam annotation: Domain name=DUF869; Domain location=99-569; Score= -124.9; E_value=7.4e-10; Accession=PF05911.2; Description=Plant protein of unknown function (DUF869)
MNHKPWLWRKKSMEKRILAVDKVACPSKSIEEEAHKLPTNKETGLERSSKSLNEKLATVLLDSHSGDDSLEKDAQKSQQEIRGNGKTKQEVESVEDLHEKASAETVTPADATLEEPLQPPSGVQDEQEQKLSGAIAKISIEHEKIQKELEEKLRETSKMLDDLTAENTHLASALLTKEKSIGELVKCKQEADAEFSTLMARLDTTEKENSLLRYEFHVLEKELEIRKEEMDYSRQYADVSHKQYLECSQKASKLEAECQRLHLLLQKSSPGSAGSENMKNEVGMVRRRKSNPSRELIYKKNDVGKPTNVSEKSFSLMIKRLQDLDEENKALKRILTTKNSELESSRLKYAETASRLSQAEILLRKISENQKSMELARCYPMSNELPLISNYDIYSDDEAISSGSWANALMSELEHLRTSEAKIHKSCRDTEVSDMSFMDDFVEMEKRAIVSIDTPKRGYISDVSGRELVPVEQDHLGISERKQEIQFKHTTTENSFDWLQIVLNAILEEKRISRRSLPELFDDIKIALDCVDHPTACKSDTEAESKQHFNSNLRKSVHRIINLIEGIAP

SEQ ID NO: 126319 - protein, 255 aa, Glycine max
  Coding DNA Sequence Number=SeqID_9541
  Subcellular localization annotation: CTP_CleavageSite=44; ConfidenceScore=5.07e-01
MKKKKVEAASVSLSEAYALSEDHQCSCGVSSFLFGSNGHPSTALAATSPSSSSCPRVSLDHLYTFSDTDSLWGTSYKLEQKTPIGFVLAFDKNLIRRTDSGTKRLCIRWHPWRQRSPNEGLLLAQFGEWTTLRSNRQLPSKVGGVLAKLLRTKLDGDELFKCYKDLDELVKVNVDLKARLKESKSRLKEYELEASKKLKEELLVYKKEAMEQHEKGFNKADVKDDVLLDEEEIVVDKEAIDEEQSAEEQGDDTCV

SEQ ID NO: 126320 - protein, 133 aa, Glycine max
  Coding DNA Sequence Number=SeqID_9542
  Homolog annotation: Hit_ID=Q9M1I1; Match level="QueryCoverage=41%, HitCoverage=5%, E-value=8e-09, Identity=64%"; Hit description=RING finger-like protein
MSSDTSFADRKLCGFLCTVLTLTPRDDSDTTDIPFPEPCEIFGEGGEVGFRTPNGVVLGPVLDSLQCGGGGGGGSNKIKRRNKIGMVNGSVSVVHQLHAMVTRKCARIDARVVYGVAGSFRDRDPSLAPFFAI

SEQ ID NO: 126321 - protein, 68 aa, Glycine max
  Coding DNA Sequence Number=SeqID_9543
MREVNVTKENGRVGGGDNGNVEERSHQETWGKYDNDDTNSEGKSQTRSSRGRFPLAIESHPKNYSQVQ

SEQ ID NO: 126322 - protein, 246 aa, Glycine max
  Coding DNA Sequence Number=SeqID_9544
  Gene Ontology: Mol. function=structural constituent of ribosome; Cellular component=intracellular; Biological process=translation
  Homolog annotation: Hit_ID=Q1STC9; Match level="QueryCoverage=56%, HitCoverage=97%, E-value=5e-71, Identity=95%"; Hit description =Ribosomal protein S9
MNRTKNKKTQKHHHSPSTVRLLEPRTCATPTKLLGLAAPGIRDEQGTIVPHQNVLDLLLTLFINVLLVERDERLGDALANGVDLGGVAAALDADAHVDAGEAALSQQEDGLEGLKAEDLRLDELDGAAVDLDEAAPALAVGHGHRRLLATEALHLLQRRLPVLRLRLRLRLRHCWFVNQKVDIVDKENYVYQYIVDEGSVLLDTLEKVCYEYKLVASLDGGCIIMSIVKYYTKGDAQLTKEFLKDN

SEQ ID NO: 126323 - protein, 390 aa, Glycine max
  Coding DNA Sequence Number=SeqID_9545
  Gene Ontology: Mol. function=nucleotide binding; Cellular component =striated muscle thick filament; Biological process=striated muscle contraction
  Homolog annotation: Hit_ID=Q1STD0; Match level="QueryCoverage=92%, HitCoverage=35%, E-value=1e-140, Identity=72%"; Hit description =Prefoldin
  Pfam annotation: Domain name=Vac_Fusion; Domain location=76-155; Score=-15.4; E_value=0.08; Accession=PF02346.6; Description =Chordopoxvirus fusion protein
MEGRADFENFIKELAFALDWSINNCATSTNAAIARDKIKKHFSSHLSKNENKVDIEDKQSSRSPSFAYPDDQCELFNTKNDQGDLLEEIRKVKYDLRSTKTAKKDLEEKLLSVTDESQNLTKQCQEAQNNIRGLESEIETLKESKATLEDQIEKQKIINEDLDTQLTIAQAKLNDIFQKFSSLEVELEDKKNSCEDLEATCLELQLQLESIAKNESPTYGKYDVEKIYQTGWEITTASSKLAECQETILNLGKQLKALASSSEVALFDKFVSTTNTMANPTQKKNLIKRSSLRNQMQAEDEAKGGMHKSVQTEETKSDKDVQRPPLLQSETEKSLQSPKSLNSEQHDRSKTAGSLAIVPGKKQVGFGFLRKLLSRRKKGRGKGTKLLAKA

SEQ ID NO: 126324 - protein, 113 aa, Glycine max
  Coding DNA Sequence Number=SeqID_9546
  Subcellular localization annotation: CTP_CleavageSite=28; ConfidenceScore=5.63e-01
MKKCVAFLATTIWKRFHVSPPQTQCRFYCSPPSHASSNKLFVGGLSLSLFHFASPVVSFFLRLLTLRSFQGCHGQWTTSPSKRLSLPSGTSLKTSNILNLPESGANTLYECSL

SEQ ID NO: 126325 - protein, 465 aa, Glycine max
  Coding DNA Sequence Number=SeqID_9547
  Gene Ontology: Mol. function=nucleic acid binding; Cellular component= cytosol; Biological process=G1/S transition of mitotic cell cycle
  Homolog annotation: Hit_ID=Q5JL01; Match level="QueryCoverage=97%, HitCoverage=33%, E-value=1e-172, Identity=65%"; Hit description =Putative rad8
  Pfam annotation: Domain name=Helicase_C; Domain location=308-385; Score=40.6; E_value=5.2e-09; Accession=PF00271.21; Description =Helicase conserved C-terminal domain
MEEGRSRLLHLLQKCMISARKIDLQSIPPCTKKVVYLDFNEEHARSYNELVITVRRNILMADWNDPSHIESLLNPKQWKFRSATLKNVRLSCCVAGHIKVTHAGEDIQETMDMLVQSGLDPTSGEYTSVRYNLLYGGHCVRCKEWCRLPLITPCRHLLCLDCVSIDNTKCTYPGCSKLYEMQSREARPENPKPKWPVPKDLIELQPSYKQAWLMENSDNWDPDWQSTSSSKVSYLVQRLKALRGTNEETYFNTENSNDDLHIENSLHRSDDKSSIQTCSMSSTKTNLNPEKVLIFSQFLEHIHAIEQQLTIAGIKYTGMYSPMHSSNKKKSLAMFQHDSNCMALLMDGSAALGLDLSFVTHVFLMEPIWDRSMEEQVISRAHRMGASRPIYVETLAMRGTIEEQMLDFLQDADNFRRSPIKDATESVDDSGGRGYRSLHDFAESSYLLKLRSVYTNLESPKVKNI

SEQ ID NO: 126326 - protein, 101 aa, Glycine max
  Coding DNA Sequence Number=SeqID_9548
  Homolog annotation: Hit_ID=Q39887; Match level="QueryCoverage=72%, HitCoverage=56%, E-value=7e-09, Identity=53%"; Hit description =Proline-rich protein
  Pfam annotation: Domain name=Extensin_1; Domain location=32-41; Score= 10.5; E_value=0.12; Accession=PF02095.6; Description=Extensin-like protein repeat
  Pfam annotation: Domain name=Extensin_1; Domain location=42-51; Score= 10.5; E_value=0.12; Accession=PF02095.6; Description=Extensin-like protein repeat
  Pfam annotation: Domain name=Extensin_1; Domain location=61-70; Score= 8.5; E_value=0.51; Accession=PF02095.6; Description=Extensin-like protein repeat
  Pfam annotation: Domain name=Extensin_1; Domain location=71-80; Score= 1.4; E_value=88; Accession=PF02095.6; Description=Extensin-like protein repeat
  Pfam module annotation: Pfam domain module=Extensin_1::Extensin _1::Extensin_1::Extensin_1; Domain location=32-41::42-51::61-70::71-80
MASFVSFLVLLLAALILMPQGLATYYKPIKKPPVYKPPVYKPPVYKPPVYKPKPPVYKPKPPVYKPPYKKPPYKKPPYGNIVTYNFVAMHILDSCMHFNPS

SEQ ID NO: 126327 - protein, 197 aa, Glycine max
  Coding DNA Sequence Number=SeqID_9549
  Subcellular localization annotation: CTP_CleavageSite=19; ConfidenceScore=5.02e-01
MAFLFATLLQTTTSKTTTSSTHEGRRRSTNGVKRHREEEEEEPQRHGKWRKKERRRTIAAREVEEEKGKKKNHNGMGSEGHFGPFTFVAGSPSKNAGCPKQRRKLFDYLTACMLRGPLQLAWARRCVQRQSLLNGGAAMCDSGFENSSMSGITMVELVRWQRDGGGPCVWWRDGVGLMRNDAMMSVKDFENHQMQIR

SEQ ID NO: 126328 - protein, 58 aa, Glycine max
  Coding DNA Sequence Number=SeqID_9550
  Subcellular localization annotation: CTP_CleavageSite=25; ConfidenceScore=5.03e-01
MASLLCESHVAWKPPVVMAIQAQVQVASFSGESGHRFPVSLFRGRHMVEAFPEGTFFR

SEQ ID NO: 126329 - protein, 209 aa, Glycine max
  Coding DNA Sequence Number=SeqID_9551
  Gene Ontology: Mol. function=RNA-directed DNA polymerase activity; Cellular component=intracellular; Biological process=RNA-dependent DNA replication
MGSSDRIKLSIDSGTWNPMDEDMVSLDPIEFHSEEEPYKDRIDSLRTKEELRVTKLLTARFIWEIEYTTWLSNIVMVKKLSEKWRMCTNYTDLNKACPKDVYPLPTINRLVDRAAWHRLHNFLDVYSGVMPFALKIPGATYQRLMDKVFKIKSEEHVDDKVVKFEEAKSHAHDLAEITTRKIVITDGIFPMECFLLEMITLLTKFIDGP

SEQ ID NO: 126330 - protein, 102 aa, Glycine max
  Coding DNA Sequence Number=SeqID_9552
MANSYLSLLVLILVALLLTPQGLADESDSYYKPPVYKKPPVYKPKPKPPIHKPKPPVYKPKPPVYKKPPYGMRHSWLALHFNPLFVQCYGQVNTMHLIYVCH

SEQ ID NO: 126331 - protein, 71 aa, Glycine max
  Coding DNA Sequence Number=SeqID_9553
MNHRTVIVGGGGVFHGQIWNVFICRHVGYSRGWEWHGCTGDYPRASRCDGDNLTSIGGGGGVSATSKDLTA

SEQ ID NO: 126332 - protein, 61 aa, Glycine max
  Coding DNA Sequence Number=SeqID_9554
MERTSVESGPNGGAKEPKCGQHLSLGFQVATKGFLTNKGCRHNEESISSILVGTSTFTFAI

SEQ ID NO: 126333 - protein, 51 aa, Glycine max
  Coding DNA Sequence Number=SeqID_9555
MAAQEPPASLFLSTISQGKESKSLVPVIPLMDAIKFKFKSRHTSDDVIVCI

SEQ ID NO: 126334 - protein, 420 aa, Glycine max
  Coding DNA Sequence Number=SeqID_9556
  Gene Ontology: Mol. function=nucleic acid binding
  Homolog annotation: Hit_ID=Q9LTS7; Match level="QueryCoverage=77%, HitCoverage=48%, E-value=2e-31, Identity=30%"; Hit description =Arabidopsis thaliana genomic DNA, chromosome 5, P1 clone:MHM17
  Pfam annotation: Domain name=zf-CCCH; Domain location=117-142; Score =10.3; E_value=0.057; Accession=PF00642.15; Description=Zinc finger C- x8-C-x5-C-x3-H type (and similar)
  Pfam annotation: Domain name=zf-CCCH; Domain location=91-116; Score =11.9; E_value=0.035; Accession=PF00642.15; Description=Zinc finger C- x8-C-x5-C-x3-H type (and similar)
  Pfam module annotation: Pfam domain module=zf-CCCH::zf-CCCH; Domain location=117-142::91-116
MEPRTSGKKGIVCGVEVAISEETIECQKEDKTKLDNASKKNKCGGNKGKKKKANRKKRAEKNKQLGVKRLQLKHVQRPKVVSHCRHYLNGRCHEPCTHFARQSCMKGDDCPFDHQLSKYPCTNFVSKGSCYRGDACLFSHQVSTKEDIPTPSNMCRPELSPLLSGNANSSAPLNNNHGSSSVKQNHLTNSAGIHSCTSVEHKVTNTVLKQPTPPKGISFINLAKLSPSLSSLKQGTVTTKESPVQIGTREDQSVFHKTQNKVDIPKKLPTVTPKGINFLSFGKGSVCSFKSVNRDNGIKLPQLFNFGLPEQAKSSLNKDDYNKASDKTKQNAPQTDIFLTEILGKNQSVAEEMKSKLPEKTSVDVFMRDHSHSKSVQEGIKSSDNSQSSKGQKAFLSTLAFAAEHESDIKMKYPIGGLPI

SEQ ID NO: 126335 - protein, 247 aa, Glycine max
  Coding DNA Sequence Number=SeqID_9557
MDSSKASELAMYFPPYRRSQLRSNTYRAFVHLLSHLSAYNASIQASTQPLISPNNGSGRMDQENPEKEPKCYEVVHSDCLDPKDPICLKDIQEVQEIIEGVGDKDVDFTINKMVLDDIEHMMGMEDMSTQANGFDKEQELMNEFEQIMKGTEDLICDSEFIPLNLGLDNTQCDGGEVGLMDYQAEMEEGELSGDLGIDGNSFDVASADALILQQMEVDEVQEPENVTGNMIYPSKIEIQEKEKGCDS

SEQ ID NO: 126336 - protein, 205 aa, Glycine max
  Coding DNA Sequence Number=SeqID_9558
MLEEEFLMIFWNCSPIGTFPTVGDEDGVDVDIRDDSCALIGDGDGVGATSEDLVGIDTVDDDGIDDDRLSLGDICYAKGCYPNLQYTFLNPECYMKLLDAILKALEVTFKALTLSLRMLDATLKEPEVTFRMASKLFFTILNATFEVIFMVLNLYFRILHATFMELKMILAIFNATSKELNVTLKSLKLVKLFLRTVNVAIMTPL

SEQ ID NO: 126337 - protein, 225 aa, Glycine max
  Coding DNA Sequence Number=SeqID_9559
  Gene Ontology: Mol. function=nucleic acid binding; Biological process= DNA integration
  Pfam annotation: Domain name=rve; Domain location=3-132; Score=15.5; E_value=0.0003; Accession=PF00665.16; Description=Integrase core domain
MVLSTLDFDDFETCVVCIKDKDESSPRYFNTFIDDYSRYMHLYLLCSKDEALDAFRFFKVEVEKQCGKQIKIVRLDRGGKYYARVLTKTASKTPFELFKVRIYNPQEKKLDLRTIIRYFIGYAKKSKGYRFYFSSHNTRINAKFLENDLISESDQFLDIAFEKGHYDAQPSGSSEKIVVIHAPQVQAGVRQPIIDVPQFAEYDHVDQTIDEEQVPQQYDEATLRR

SEQ ID NO: 126338 - protein, 167 aa, Glycine max
  Coding DNA Sequence Number=SeqID_9560
  Gene Ontology: Mol. function=sequence-specific DNA binding; Cellular component=nucleus; Biological process=regulation of transcription
  Homolog annotation: Hit_ID=Q2HT21; Match level="QueryCoverage=81%, HitCoverage=21%, E-value=2e-16, Identity=43%"; Hit description=DNA -binding WRKY
  Subcellular localization annotation: CTP_CleavageSite=87; ConfidenceScore=5.33e-01
AIASTTSAAASMLLSGSMLSSDGLIYPNILESASLPFSQNLATLSTSAPFPTITLDLTQSTTNNSSQLLQGAPQDNQHIYSLLSPLLAQKFMSSATNIFYQNHQTKVSSLHGSQGTETASFVDTVNAATAAITGDPKFSAAVMAAITSIIGSSHPNINGTSGDPALQ

SEQ ID NO: 126339 - protein, 288 aa, Glycine max
  Coding DNA Sequence Number=SeqID_9561
  Gene Ontology: Mol. function=sequence-specific DNA binding; Cellular component=nucleus; Biological process=regulation of transcription, DNA-dependent
  Homolog annotation: Hit_ID=Q84QE3; Match level="QueryCoverage=33%, HitCoverage=31%, E-value=4e-16, Identity=52%"; Hit description =Avr9/Cf-9 rapidly elicited protein 126
MSFNGKRLVVDEIDFFTEKKKKSEDVDNQLVHHQMELPINTNLDLLITKSSTSNRSNMEEGPSESRDNTRNKFAAMLAELHIINAENQHLRELVDQINGAIEEKDKRDDMIISRSFLDIGIATKEDPSQQHSEAKLQESKNITELMECKNRDVVELDSGKDSAKSRRDKHESSETMSMIKKARVSVRTKTDSSMMDVNGESMGRRWQKGIHVRDLIIVAQWELLVQFGSKYPFVEGRSSFSWKYGMDYFSAVAPDTGTLTRDIFSIPYYPEKAGAPCILEPITIFRLT

SEQ ID NO: 126340 - protein, 118 aa, Glycine max
  Coding DNA Sequence Number=SeqID_9562
  Homolog annotation: Hit_ID=Q7Y049; Match level="QueryCoverage=94%, HitCoverage=22%, E-value=1e-32, Identity=52%"; Hit description=LAF3 isoform 1
MDGHMGLANSVALMLVGITNLIDDPKGGIVMRTAVGDHSADDRREALLRASNLALTRGVTTVVDMGRYFPGVTADLSWEDFSDVYLWVNSMSKMKVRVCLFFPLVTWSCLAENGKKIN

SEQ ID NO: 126341 - protein, 90 aa, Glycine max
  Coding DNA Sequence Number=SeqID_9563
MAHPRSIQNWSDAGKCTHHYRSAIRSSEEIDSDDSDSSTPNAKTIETPELHHSPNSLAGDRIDEVETQQRAPLPNGPRDIEDPMGNDRGS

SEQ ID NO: 126342 - protein, 83 aa, Glycine max
  Coding DNA Sequence Number=SeqID_9564
VFATHDDVLNWARVVVYEIGFVVVIIRSNTNTGMRGRTSFVVISCEESGWYRARKKDLVRTDTSSRKCGCPFKLCGKPVVGGQ

SEQ ID NO: 126343 - protein, 103 aa, Glycine max
  Coding DNA Sequence Number=SeqID_9565
MFGEGSYTEDSIKTGFQVTNGFELDKGGPTIRAREGPSWDSQLSGGEKRVANGELPLNNHETQLQTRRWRTHERKRNSWGSEKGLRMENCTKQSLRMAPNSKV

SEQ ID NO: 126344 - protein, 69 aa, Glycine max
  Coding DNA Sequence Number=SeqID_9566
  Homolog annotation: Hit_ID=Q8S563; Match level="QueryCoverage=75%, HitCoverage=7%, E-value=1e-18, Identity=84%"; Hit description=KAP-2
MVKQQEALLLLLDVGPSMHPALSEIEKVCSMLVQKKLIYSKYDEVGIVLFGTEVLLPIQTAVSLEKSCF

SEQ ID NO: 126345 - protein, 87 aa, Glycine max
  Coding DNA Sequence Number=SeqID_9567
MILNDLKHAFWPFQHDHTKTLFLRAATAANCVDRSDFVGESGSQIALAKAAQHRLDRGVWTSVRFGDMRRSLSDSDLVPLPLDVKKY

SEQ ID NO: 126346 - protein, 203 aa, Glycine max
  Coding DNA Sequence Number=SeqID_9568
MKEKPFLVSSHGWKRQRERVRDRERSLLKKERYLYFVLPPLHSLFVSDCSSSRLAIRSCENEDDLDDVPVVGHEEDVGGREREVGAGEHVGAGEQRDAGEQRDADASEQRDGVEVEVETNGYHSEELKIPINSDDEDKDVEVYPQYSQSSGVGEQKLELGMKFGTLDEFKFALREYSILMGKEFKWKTNDKQRSRAKMQEGIL

SEQ ID NO: 126347 - protein, 54 aa, Glycine max
  Coding DNA Sequence Number=SeqID_9569
MGSFIVGARSSYLGQNKFVCQGVGLGPNFHIIPQGTRNNDGLETTCKIGHGHSQ

SEQ ID NO: 126348 - protein, 102 aa, Glycine max
  Coding DNA Sequence Number=SeqID_9570
  Subcellular localization annotation: CTP_CleavageSite=64; ConfidenceScore=5.29e-01
METIFLSNFKRIRSAKKAEPLPSSFLPLFIAKQRRSLPPSSPRRARLLPPEATAFWRKNLEGPRCMNDNQFMELRIKVENGELANNTRQSIRGAPDSLVEDA

SEQ ID NO: 126349 - protein, 67 aa, Glycine max
  Coding DNA Sequence Number=SeqID_9571
MEVSCSGLRIMTTYGVYYYQQFLFSLASLIQETLSRKVPETESRKVASCQHLDKVAKTERYSREEEA

SEQ ID NO: 126350 - protein, 56 aa, Glycine max
  Coding DNA Sequence Number=SeqID_9572
MQNTLWYPCLVGWSWLWEISALGLSIAGAVAVAVAVGDNIIDPVKDEVLGPLNFFL

SEQ ID NO: 126351 - protein, 84 aa, Glycine max
  Coding DNA Sequence Number=SeqID_9573
MQSQGLALPPKPEVGPLVTRVSTKESCVYSSGNDPDTGDHDVDDLLYLMTLIIPQLFLKPLHMTETSMRAGNVDVYEFLEPQSI

SEQ ID NO: 126352 - protein, 298 aa, Glycine max
  Coding DNA Sequence Number=SeqID_9574
  Gene Ontology: Mol. function=RNA-directed DNA polymerase activity; Biological process=RNA-dependent DNA replication
  Pfam annotation: Domain name=AT_hook; Domain location=136-148; Score =14.9; E_value=0.061; Accession=PF02178.9; Description=AT hook motif
DDGEIEGDVNHRIQAGWMKWRKASGVLCDAKVPVKLKGKFYRTAVRPVILYGTECWAVKSQHENKVGVAEMRMSRWMCGKTRQDKIRNEAIRERVGVAPIVEKMVENRLRWFGHVERRPVDSVVRRVDQMERRQTIRGRGRPKKTIREVIKKDLEINGLDRNADDGGVGAEGGLSGNVKAVRKRGHARLGGGEDARVARKGRSGDPCFRNRGSGFSSCRSLYFTASATRSLIMAVGGRGTGGGGSHSGGEGREGLEGGEGGGSPIEAAGLREEAVEGHGLAPHLQLGLEFHGGREIAK

SEQ ID NO: 126353 - protein, 165 aa, Glycine max
  Coding DNA Sequence Number=SeqID_9575
  Gene Ontology: Mol. function=protein serine/threonine kinase activity; Cellular component=membrane; Biological process=protein amino acid phosphorylation
  Homolog annotation: Hit_ID=Q49N12; Match level="QueryCoverage=99%, HitCoverage=16%, E-value=7e-62, Identity=77%"; Hit description =Putative receptor-like protein kinase 2
  Pfam annotation: Domain name=Pkinase; Domain location=27-165; Score= -91.4; E_value=0.0041; Accession=PF00069.15; Description=Protein kinase domain
  Pfam annotation: Domain name=Pkinase_Tyr; Domain location=27-165; Score=-90.4; E_value=6.3e-07; Accession=PF07714.7; Description =Protein tyrosine kinase
  Pfam module annotation: Pfam domain module=Pkinase::Pkinase_Tyr; Domain location=27-165::27-165
MDVEIKGLKLQMGIFTLRQIKAATNNFNKANKIGEGGFGPVYKGNLSDGTIIAVKQLSSKSRQGNREFLNELGMISALQHPCLVKLYGFCVEGDQLLLVYEYIENNSLARALFGPAEYHIKLDWPTRQKICVGIARGLTYLHEESRLKIVHRGTSRPLMCCLIKI

SEQ ID NO: 126354 - protein, 34 aa, Glycine max
  Coding DNA Sequence Number=SeqID_9576
MVEKHCSSPSLPRILHKTLALEILAIPTQSIGYF

SEQ ID NO: 126355 - protein, 89 aa, Glycine max
  Coding DNA Sequence Number=SeqID_9577
  Homolog annotation: Hit_ID=Q1SZB7; Match level="QueryCoverage=46%, HitCoverage=7%, E-value=2e-15, Identity=95%"; Hit description=WD40 -like
MAKNKNITTCQPMELQKDACNSNPVCQAFDQDAKDGHDLLIGLNSGDVYSVSLRQQLQDVGKACRCFIVYYRLFIVHVVVAANNAVLYV

SEQ ID NO: 126356 - protein, 207 aa, Glycine max
  Coding DNA Sequence Number=SeqID_9578
  Homolog annotation: Hit_ID=Q69S84; Match level="QueryCoverage=99%, HitCoverage=73%, E-value=9e-33, Identity=45%"; Hit description=Kelch repeat-containing F-box-like protein
MPSVVDEEDSQKGSSGLWMWNMVKGIRIAKIIRGLLGQKDALDDMPFCGCAFGAIDGCLYVLGWPVKQTGTKLSVVVNGELYAFDPSNYVDSGRIKVYDQGEDEWKVVIGKVPVYDFTESESPYLLAGFRGKLHFITKDANHDISVLQADHCSNVDSSPSTSAPQSPKYMEDELLRESAETNEVVWKLVACKGFEQAELINCQVIDI

SEQ ID NO: 126357 - protein, 331 aa, Glycine max
  Coding DNA Sequence Number=SeqID_9579
  Homolog annotation: Hit_ID=Q941Y5; Match level="QueryCoverage=89%, HitCoverage=86%, E-value=7e-49, Identity=38%"; Hit description =Putative LRP1
  Pfam annotation: Domain name=DUF702; Domain location=129-287; Score =224.3; E_value=2.7e-64; Accession=PF05142.3; Description=Domain of unknown function (DUF702)
  Subcellular localization annotation: CTP_CleavageSite=45; ConfidenceScore=5.12e-01
MSMLGLRDLVLIAPTPSSLNHHQGQPFSENHTNTHTPNNIPLPSSAASLSVGFGIFPLLTATPCVPQSHHHHHNNEVQELGGGANSNTTTNYWNLKMCQQEVNNPPKKGVINVADHDDEKGIMENEENGVYGPNFRVCQDCGNRAKKDCIFRRCRTCCKGRGYDCNTHVKSTWIPSVRRREREITVASGGGGKRPRGIVGSSQKATVTSHSSNSNATTPRSLATSSFHQDGSLKQSLLGHVRAPAVFKCHRVSAIGNGEDEFAYLATVHISGHVFKGFLYDHGVDGKTANAVVPCVSELQVGNNCSGKNRECSSAIAIGVTNNNAYPASAT

SEQ ID NO: 126358 - protein, 99 aa, Glycine max
  Coding DNA Sequence Number=SeqID_9580
MAKNHENAAARANPIHAKRKYTRWTEEEQMPQARPSMHNSSIQSGNHQNVSILQQLQTTICIQLKMRLVIVLILNFFLSAEDDVSSVAANIEHFPFVSV

SEQ ID NO: 126359 - protein, 248 aa, Glycine max
  Coding DNA Sequence Number=SeqID_9581
  Gene Ontology: Mol. function=nucleic acid binding; Biological process= transport
  Homolog annotation: Hit_ID=Q8H6Q8; Match level="QueryCoverage=98%, HitCoverage=10%, E-value=4e-14, Identity=33%"; Hit description=CTV.20
MDRNILDSLFLNIHFHGPDMKEGSIPTALIYRIQYKVMNTRVSRVLLKPQRGETTLFITDLTKANVSLPRTIKWDEVTLPKKWVMDKATSSVPRPTLTIEQIKQDNFGKIPHLAYPEQLTTKKRRMTKSRSNPQLILLWNLMLLSDNFSIDKETLRKDFYSPEDEPQRRWFFQDYKGTNRKQIQDKFYEFVERVKINVLFFDWFHAYTIKKDIDYPWKQDIIGDPTTNVITNWQMKDAELIQSELPVN

SEQ ID NO: 126360 - protein, 43 aa, Glycine max
  Coding DNA Sequence Number=SeqID_9582
MDSVDPLTLTPREEIIPTLNDITCISAKWNRLYEIMARSLKHS

SEQ ID NO: 126361 - protein, 72 aa, Glycine max
  Coding DNA Sequence Number=SeqID_9583
MGCDEWQNPHRHHDPHLATTKRPNLVSYGQNHFEDLQRPHFASLMVGFSEGDDLWWWSLRWCKEEKEEECGV

SEQ ID NO: 126362 - protein, 263 aa, Glycine max
  Coding DNA Sequence Number=SeqID_9584
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=6e-39, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAFRGLHALAFRGLHVLAIRGVHALTFIGLHVLSFRGLHVLSFRGLDALTFKRLHALAFRGVHVLAFRGVHALAFRGLHVLTFRELHVLAFRGLHVLIFRGLHVLIFIGLQALAFRGLHLLALRGLHTFAVRGLHALTFRGLLALTFRGLHVLAFRGLHALTFRGLHVLAFRGLHALTFRGLHVLAIGGLHALTFRGLHILTFRGLHILTFRGLHVLTFRGLHVLTIRGLHVFAFRGLHVLTFRGLHALAIRRVAHPHL

SEQ ID NO: 126363 - protein, 150 aa, Glycine max
  Coding DNA Sequence Number=SeqID_9585
MEAMKEQMATMMEAMMSMNKIMEANAVAVAATSAVVEEDLTHPSGINQMNHPTSDMVGKDLRSTGGPHDVQIRNEHAFPSYGLPPNLHHPMWHTLPIRMSITPLLYSLRANNLNLIMNIFLNPWGRHMKCPNLVDFEPCLRYATEGQAVG

SEQ ID NO: 126364 - protein, 77 aa, Glycine max
  Coding DNA Sequence Number=SeqID_9586
VTGCTIYGEAHETGQCIPIEENTQEVHFMGNQQRQGYTQGGFSGFQQGPYNQQGQWRSHSGNQFNKDQGGPSNMPIQ

SEQ ID NO: 126365 - protein, 134 aa, Glycine max
  Coding DNA Sequence Number=SeqID_9587
  Gene Ontology: Mol. function=RNA-directed DNA polymerase activity; Biological process=RNA-dependent DNA replication
MMHVDGSTNQHGSGTGVILEGPNGVAMTQSLRFDFKAICNQAEYKALLAGLRLTKDEVQVTHISREVNEKADQKLNEFLSGLDIKHRVMSVEHPQTNGQAKASNKVILGELKKRVDGAKGRWVEELAKVLWAYR

SEQ ID NO: 126366 - protein, 43 aa, Glycine max
  Coding DNA Sequence Number=SeqID_9588
MSCQRTASAHSLSERSALSHNPLMRAKRSRFALSERAQTNPTI

SEQ ID NO: 126367 - protein, 147 aa, Glycine max
  Coding DNA Sequence Number=SeqID_9589
MTGRLLAGSLTFDCRIMHYIIVRILMLRSSNLAQAFEEDMILMWAFLTNCPIDWAHLIRYRMHKALRSSAPLPYSQLVTLFLRLFEIPLDSEPFVQVKRSFAIGVDAVTSFGYYAIDACFEGMDTRITQLEEDVSYLRRCFDLPPPS

SEQ ID NO: 126368 - protein, 224 aa, Glycine max
  Coding DNA Sequence Number=SeqID_9590
  Gene Ontology: Mol. function=RNA-directed DNA polymerase activity; Cellular component=mitochondrion; Biological process=RNA-dependent DNA replication
MHSPTNIQEVHKLNGRLASLSRFLLKPFYELLKKTKRILWDKTCEQAFLAFKRTIATLPILSRPRPGAPLLLYLSIIDEVVTLALITSAQQLKPYFQSHQVVDKMNYLIKQVLGKAKLARRMNSLEMTQPPQTGGPFYVDDASNVKGSRARIIHEGPDNITLEQALELNFRASNNQESNTRANLLSKLANSKKVGHFKNIIQETLQTPTIDVEEIMAREEEEPN

SEQ ID NO: 126369 - protein, 62 aa, Glycine max
  Coding DNA Sequence Number=SeqID_9591
MTFSVGFAYLKGVHVNNLVWALERQRPSPYECTENCVSRVYKLVVQVSHRQECEGKVQIVNW

SEQ ID NO: 126370 - protein, 65 aa, Glycine max
  Coding DNA Sequence Number=SeqID_9592
MAEPSKKRKGTSSQIKAFYSNLEIHEGTLMSEVYGIKMVIDQSLFYDLTKLPSEGVPFEGALIDD

SEQ ID NO: 126371 - protein, 80 aa, Glycine max
  Coding DNA Sequence Number=SeqID_9593
  Subcellular localization annotation: CTP_CleavageSite=50; ConfidenceScore=5.03e-01
MYDSTEFPFECKKWPQGSLPQRDPGRIKRLKEPVPLPNMTATVLGALSTSSASRPSRDGHFSGSDASSSGTTSIPTSRRR

SEQ ID NO: 126372 - protein, 86 aa, Glycine max
  Coding DNA Sequence Number=SeqID_9594
MGAKYLEVVKRGSHPNNGWSPDEIRTQNDHNLSLRFVGHDRAWAARHRMTIICLNMPPDTIASGWRKGVRNDHNLSSPTSQLAGLE

SEQ ID NO: 126373 - protein, 159 aa, Glycine max
  Coding DNA Sequence Number=SeqID_9595
DGVDDIVCEKYGISKEKWAQFCQTRRDPSWEDVRKKAQAIQKQNIAPHILSRGGYEYLEQKLLVEKTKKKLEVAAQSGSVDGIIDPPSPVRRHMKWKMVRTKKTGEMMTEAAKEIAEKIVCHFQLTIRIIFLYFVNAMRHRDPLSPMDVRMFSPLLLDV

SEQ ID NO: 126374 - protein, 56 aa, Glycine max
  Coding DNA Sequence Number=SeqID_9596
MAAHANSTATNSSQCDEEVRKVLLGKVVLPVCLGGNEPSSLSRAFGSAYVRLGSAC

SEQ ID NO: 126375 - protein, 104 aa, Glycine max
  Coding DNA Sequence Number=SeqID_9597
MMHLNGREVKKNQKNKELENITQGDPPKQKRSQGNEKKIEDDNITQVNVTLEAFEKHALREGNGRWKRNIWVHCEDEDKVPLWKTPQIKYYTHQANVANGMTLQ

SEQ ID NO: 126376 - protein, 70 aa, Glycine max
  Coding DNA Sequence Number=SeqID_9598
MVQNDHNLSLRAIGLDRLWMAKRMTKICLCVPSDSIISGWRKGVRMTIICLRMSHDLGVSMTEIVGRPTK

SEQ ID NO: 126377 - protein, 197 aa, Glycine max
  Coding DNA Sequence Number=SeqID_9599
  Gene Ontology: Mol. function=DNA binding
  Homolog annotation: Hit_ID=Q1S0F5; Match level="QueryCoverage=74%, HitCoverage=27%, E-value=7e-16, Identity=36%"; Hit description=IMP dehydrogenase/GMP reductase
MVRIAKVVKISVQELDRVKQNRNGVVGIPRKHLEEKAKALADQAINVFLAYHHSKESPVVAVLADAYDTFDRRCEKSDTRIVYCTPALYVWLVLHLFRHESRPICPLQGHHMCPEKGKAVWEQLLTSMVGASVNWFPRWKEGRARVLFSCEGFSNVPLIGTRGCINYNPVLAIRQLGYPMRGAPSDESITPFITTGF

SEQ ID NO: 126378 - protein, 120 aa, Glycine max
  Coding DNA Sequence Number=SeqID_9600
MDEFDAQVAWPGVQPSPSRGGGASAAQELEPEEPAAATTEGEDELTPPEPFYFDTGVHMAQEEETSTDQILEPSPTPIPDDAIPSAPASELEQPISQDSPAAQVLDLNEHAQEQPQEQDI

SEQ ID NO: 126379 - protein, 59 aa, Glycine max
  Coding DNA Sequence Number=SeqID_9601
MPSFRDLEQKWAPKVEALLGNNGGGRKEEEGCLCHMSPFEWSKKGPLSLLIATHTQPQK

SEQ ID NO: 126380 - protein, 182 aa, Glycine max
  Coding DNA Sequence Number=SeqID_9602
  Subcellular localization annotation: CTP_CleavageSite=15; ConfidenceScore=5.06e-01
PPTYATPTPAPPGPSAQDSQCFESMLLSLYQRQILLMQSLQVVWPGTQPSLVREGGGSGAQVPQQVQDASLEATILVPFVFKVGGTQVRQEAATPERSPQISPDPPSPMMDQSSPQQLADSPTTVHEMPADLSTPLLEIPEDPATPVLGLTTTPPATPVLHFTDEEATQDQDTQQDDQSQEF

SEQ ID NO: 126381 - protein, 146 aa, Glycine max
  Coding DNA Sequence Number=SeqID_9603
MSEIEEVQEQMKADMEAMKDQMTTMMEATMSMRKMMEVNAAVVATTSVATESKHHFPSYSLPPNYAPPNAVHVLEENVDHSTPIPLQSQQPQFGHTHVAQPIGETHEVPLNHALADFEPYPGYATEGQAFGGIPQLITLGGRRYHP

SEQ ID NO: 126382 - protein, 46 aa, Glycine max
  Coding DNA Sequence Number=SeqID_9604
MGAKHLTRTKEWSHVIEQRSPDEIRGKNAMSNATNEQHGCMRMMHN

SEQ ID NO: 126383 - protein, 70 aa, Glycine max
  Coding DNA Sequence Number=SeqID_9605
MGRKEGGGCRLLPPEGTAFCRNPMEECCGTLPIVQQCFLSISGMLRNFTDYLTMGVKYLEVVKRSLHATK

SEQ ID NO: 126384 - protein, 115 aa, Glycine max
  Coding DNA Sequence Number=SeqID_9606
MEREMITTIVGTLPVFYYEKLVGYTPSSFADLVFTSERIEVGLRRGKFDYPALMDRKSGANGENEKEGETHAVIVIPIWPNFYQLNNINTQPISALLITHHPISQEHPIIHKGDP

SEQ ID NO: 126385 - protein, 170 aa, Glycine max
  Coding DNA Sequence Number=SeqID_9607
  Homolog annotation: Hit_ID=Q1SMF0; Match level="QueryCoverage=88%, HitCoverage=28%, E-value=6e-22, Identity=39%"; Hit description =Tetratricopeptide-like helical
MMFCSGLDQLLLKTDLLPIIMRSDTQIGSRGRSSFVLIGCEMSGQYRCRKKDFVRRDIGSRKCGCPFKLCGKPVVGGQGWMVKLMCGIHNHELAKSLVEHSYAGRLTKDEKTIIADMTKSMVKPRNIMLTLKEHNVNSFTTIKQIYNARSAYRSSIRGSDTEMQHLMKTS

SEQ ID NO: 126386 - protein, 138 aa, Glycine max
  Coding DNA Sequence Number=SeqID_9608
MLEEKFVTIIDASSNEEKVHYKTWARSDRLSLMLMRMTVADNIKTTLSKIESAKRFIGLVGEYSQTADKSVVGTLMSTLTTMKFDGSHTMYEHVIEMTNITGIKELEKKFMKKHDKGKGSLKNNDDSLQIQKKGVKGK

SEQ ID NO: 126387 - protein, 301 aa, Glycine max
  Coding DNA Sequence Number=SeqID_9609
MRIDPQEFAARLCIPGRGFVLNAEGYPWKLLRKDLTTLAQTWSVLSNSNMTPTSHTSDLNMDTAGLVYGLVKGMDMNIGALISGQISTIAQSNSSRLGFPALITALCRARGVTSDSLTYESLSLAINLAYIKKNYSNVDDLTVNFRGARKSLQVVAPPGSILSVEQFIKKVSWPGPVPSAVREGEGPSAQVPQQPVVLVIHETAEASESQLRQEAATPERTPQTPEDPPSPGVELSFAQQVADPPAPVHERLSDPSTPIIEMPEDLTTPVLRLSSTPLATPVLHLTDEEDMQDQDTQGTQD

SEQ ID NO: 126388 - protein, 289 aa, Glycine max
  Coding DNA Sequence Number=SeqID_9610
  Gene Ontology: Mol. function=RNA-directed DNA polymerase activity; Cellular component=intracellular; Biological process=RNA-dependent DNA replication
MKVLDQAFVERDVTVNQLDSIVGNITACNNLSFSDEELPEEGRNHNLALHISVNCKSDALSNVLVDTGSSLNVMAKSTLDQLFYQGPPMRRSGVVVKAFDGSRKSVIGEVDLPITIGPFVFQITFQVMDIQAAYSCLLGRPWIHEAGAVTSTLHQKLKFVRNGRLITVSGEEALLVSHLSAFSFIGADETEGTSFQGLTVEGKKPEKSEVSFATWKSAQKVVQEGTGVGWGKVVQLLESKNREGLGFASFAGSSKNNVGSSSITSTFCSAGSSTTRQKPMLSWKMFLKR

SEQ ID NO: 126389 - protein, 63 aa, Glycine max
  Coding DNA Sequence Number=SeqID_9611
MADALATLSSMFKISPHGDLSCIEIECHIKHAHCCLIEEEEDARVKLAKCTACTSRLSEEEAH

SEQ ID NO: 126390 - protein, 46 aa, Glycine max
  Coding DNA Sequence Number=SeqID_9612
MASRSDQGSGLHRSTDKIMIGGDDRRKISQGGPEEEGRAVAESEMN

SEQ ID NO: 126391 - protein, 84 aa, Glycine max
  Coding DNA Sequence Number=SeqID_9613
  Gene Ontology: Mol. function=RNA-directed DNA polymerase activity; Cellular component=intracellular; Biological process=RNA-dependent DNA replication
MLTLDDSKIFPVIIFASLADEQEEKLLSVLKKHKKAIGWTLADIPGISPSTLKKEVTKLLQAGIIYPISDSQWVSPVQDFIGAL

SEQ ID NO: 126392 - protein, 46 aa, Glycine max
  Coding DNA Sequence Number=SeqID_9614
MPRAQNYIAHYSAYFLKRALEAAREAAFVEIPRFYLVLQEGSADEA

SEQ ID NO: 126393 - protein, 43 aa, Glycine max
  Coding DNA Sequence Number=SeqID_9615
MRCACNAKRNFSALSTTEESGRASILRPRAKRDVCLLPSSAHE

SEQ ID NO: 126394 - protein, 76 aa, Glycine max
  Coding DNA Sequence Number=SeqID_9616
  Gene Ontology: Mol. function=transporter activity; Cellular component= integral to membrane; Biological process=transport
  Homolog annotation: Hit_ID=Q2XFA5; Match level="QueryCoverage=99%, HitCoverage=15%, E-value=2e-18, Identity=57%"; Hit description=Major facilitator family transporter
RHPETHGVSAEQNREVDAAEHHHANIQQTIAQAVFQPFGVTFVARQFAQHRLLLTAAEPAGALDAVRQQPERQHTQ

SEQ ID NO: 126395 - protein, 398 aa, Glycine max
  Coding DNA Sequence Number=SeqID_9617
  Gene Ontology: Mol. function=transporter activity; Cellular component= integral to membrane; Biological process=transport
  Homolog annotation: Hit_ID=Q2XFA4; Match level="QueryCoverage=41%, HitCoverage=76%, E-value=3e-56, Identity=65%"; Hit description =Hydrolase, isochorismatase family
  Pfam annotation: Domain name=Isochorismatase; Domain location=43-220; Score=13.3; E_value=3.8e-07; Accession=PF00857.11; Description =Isochorismatase family
AIAAGGGKSGGADRQAGNYGRHCHYVRSAEGAGAGAGGAGRGRTAVRCVGYTTPGAALFAPGVVEAVAAAQGLLAAARQCAIPVIHTQIRYHPQHQQDGGIWVQKAPVMRDMVEGNPLAEFCPAVQPLAAEVVITKQYASAFFGTSLASMLMAQGIDTLLIAGCSTSGCIRASAVDALQYGFRAMVVRECVGDRHDAPHQANLFDIDSKYGDVSVSAAAETHNNISPTTGLLRPENTMTDVSTRPAALAAEDTASIYRKITWKLIPFLCLCYLAAYLDRINIGLAKLQMASDLALSETAAEQPDPAAGRRKDLDRAHYDYLGPALDRHAAGANADPVLHHPLFPRRGRSRFSAWRAVLSHQMVSLVAPQPHHCAVYDWPAALQPDWRTAFRLDHGAFS

SEQ ID NO: 126396 - protein, 50 aa, Glycine max
  Coding DNA Sequence Number=SeqID_9618
MADKSTLDAKALSKLKCTTVNLRIRDDNIITEHMDWDTSTKVAFERDLPA

SEQ ID NO: 126397 - protein, 122 aa, Glycine max
  Coding DNA Sequence Number=SeqID_9619
MEKKESTEETSCSKQKMENLTKGKTQRQVKLEETDHKNEEKKQTGEGEEMAKHSSEETTGEGWRRRHVEQPKLEAGCGWLCSNWKRREENRRRKKGRGTREIEREMELGIEEMDSCRVTCQS

SEQ ID NO: 126398 - protein, 303 aa, Glycine max
  Coding DNA Sequence Number=SeqID_9620
  Gene Ontology: Mol. function=exodeoxyribonuclease III activity; Cellular component=chloroplast ribulose bisphosphate carboxylase complex; Biological process=response to DNA damage stimulus
  Homolog annotation: Hit_ID=P09030; Match level="QueryCoverage=57%, HitCoverage=65%, E-value=6e-90, Identity=88%"; Hit description =Exodeoxyribonuclease III
  Pfam annotation: Domain name=Exo_endo_phos; Domain location=1-174; Score=27.9; E_value=3.6e-05; Accession=PF03372.13; Description =EndonucleaseExonucleasephosphatase family
  Pfam annotation: Domain name=SNARE_assoc; Domain location=192-296; Score=111.3; E_value=2.8e-30; Accession=PF09335.1; Description=SNARE associated Golgi protein
  Pfam module annotation: Pfam domain module=Exo_endo_phos::SNARE _assoc; Domain location=1-174::192-296
MAEIPSALGNITVINGYFPQGESRDHETKFPAKAKFYQDLQDYLTTELKKENPVLIMGDMNISPTDLDIGIGEENRKRWLRTGKCSFLPEEREWMERLLGWGLVDTFRNANPETQDRFSWFDYRSKGFDDNRGLRIDLLLASAPLAERCIETGIDYDIRSMEKPSDHAPVWATFKLAMIFFALYVLVSALSIPGAAILTLLGGTLFPLGEGIVLVSFASTLGATLAMLASRYLLGEWVQQRFAQQMKTVNAGMTHDGAGYLFALRLMPLFPFFLVNLLMGLTRMGVFRYWWVSQCDAARDVSF

SEQ ID NO: 126399 - protein, 202 aa, Glycine max
  Coding DNA Sequence Number=SeqID_9621
  Gene Ontology: Mol. function=nucleoside-triphosphatase activity; Cellular component=chloroplast
  Homolog annotation: Hit_ID=Q2PMM5; Match level="QueryCoverage=90%, HitCoverage=12%, E-value=5e-50, Identity=96%"; Hit description =Protein ycf2
MIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPKRRIFLANYQTITYSQTLRGANSFHFPSHGKPFSLRLALPPPSRGISVIGSIGTGRSYLVKYLATNSYVPFITVFLNKFLDNKPKGLLIDDSDDIDDSYDSDDIDR

SEQ ID NO: 126400 - protein, 75 aa, Glycine max
  Coding DNA Sequence Number=SeqID_9622
MRIAWKTKWMLELEYLETQSSVGFYSKNPFASSMVLPFEGVFGSFDRWKRKRMKNDEFWALWGLIWTIIEGEIAF

SEQ ID NO: 126401 - protein, 109 aa, Glycine max
  Coding DNA Sequence Number=SeqID_9623
  Gene Ontology: Mol. function=DNA binding; Biological process=DNA integration
  Homolog annotation: Hit_ID=Q1S3H4; Match level="QueryCoverage=75%, HitCoverage=18%, E-value=7e-09, Identity=32%"; Hit description =Integrase, catalytic region
MDQAGEEKNLHLSNLDEIRLKANENFMFYKKKPKKFHDTMIIKKDFRVGQKVFLYIFRLGFMSVEIKRDSKNKSFKVKGHRLNPFLPTPFLVEVVVEETSLLPPILPPP

SEQ ID NO: 126402 - protein, 89 aa, Glycine max
  Coding DNA Sequence Number=SeqID_9624
YVEEVDDGQRYTGREILTSLTLLLLTDSETMLFELEDEGSAYNVSEQRAHPCNHHFSGRSWSIYRGCSLESVATTTATRWRKRHTFMLT

SEQ ID NO: 126403 - protein, 350 aa, Glycine max
  Coding DNA Sequence Number=SeqID_9625
  Gene Ontology: Mol. function=nucleic acid binding; Cellular component= chromatin; Biological process=DNA integration
  Homolog annotation: Hit_ID=Q1RWN2; Match level="QueryCoverage=99%, HitCoverage=32%, E-value=1e-69, Identity=44%"; Hit description =Peptidase S8 and S53, subtilisin, kexin, sedolisin; Integrase, catalytic region; Zinc finger, CCHC-type
  Pfam annotation: Domain name=rve; Domain location=246-350; Score =20.7; E_value=0.00011; Accession=PF00665.16; Description=Integrase core domain
MTTKFNYVVCPIEEPNNMDTMTIDELQSSLLVHEQRMMSPAEEEQKKANYAEMEDKEEQEDEILLMTFVDYKEGKKDEWFLNSGCSNHMSSNKERFSELDENFRHKVRLGNDTHIVVKGKGSVQMVVNGIIHVITHVYYVPELKKCNVVHPKRGLIMEVNMSGNIMFVPTATMGAETTTCLQVDLEDNSQLWHNRLGHLSYDGLKTLLSKQMVKRLSSITTPRNICAHCLAGKQHRNAMPKKILWRASKKLQFVHADICGPIQPTLSSNKRYILSFIDDLSRKTWVYFLSEKSKTLSFFKSFKALVEKKVGESIICLRTDRGGEFTSKVFEEFCRNQGIRRQLISTYTPQ

SEQ ID NO: 126404 - protein, 71 aa, Glycine max
  Coding DNA Sequence Number=SeqID_9626
  Gene Ontology: Mol. function=protein disulfide oxidoreductase activity; Biological process=cell redox homeostasis
  Homolog annotation: Hit_ID=Q1RV70; Match level="QueryCoverage=93%, HitCoverage=48%, E-value=1e-19, Identity=73%"; Hit description =Glutaredoxin
MVEVTEGANLDEFGDEVAGDVKGDERLEAADGVAADEDGGDGVAVVVVGKGEGGDLVVVQFDDGGVDADGG

SEQ ID NO: 126405 - protein, 62 aa, Glycine max
  Coding DNA Sequence Number=SeqID_9627
  Subcellular localization annotation: CTP_CleavageSite=21; ConfidenceScore=5.06e-01
MAQVGTTKFYLTNGKREKFISASGGKVARRVVVGLRPERKERNTSTTQHNTSIVILKKFEYH

SEQ ID NO: 126406 - protein, 159 aa, Glycine max
  Coding DNA Sequence Number=SeqID_9628
  Gene Ontology: Mol. function=hydrolase activity, hydrolyzing O -glycosyl compounds; Cellular component=apoplast; Biological process =carbohydrate metabolic process
  Homolog annotation: Hit_ID=Q1RV62; Match level="QueryCoverage=73%, HitCoverage=41%, E-value=2e-18, Identity=62%"; Hit description =Glycoside hydrolase, family 32
MERGDVVDSGWGPKVQFSLANIIMEINASPHSINSVKYRNIPRQVWLHKSGKWLMQWPNEEVEKLRDKQVSIMREKLVGESTIEVSGIPASQMNRSIIESLREKGRICITSRVYPSFVIDKDAHLYVFYNGSQSVVISELNAWSMKQAKFGQEESIVKL

SEQ ID NO: 126407 - protein, 129 aa, Glycine max
  Coding DNA Sequence Number=SeqID_9629
MDSSDSDRGYSKREREDEDWEFSDKQKDRSRKFGANGKDDGEGFDGGAKRKRSSRTTTDGDDYDSRSKHGASIHGYKKPPHGEDQDLKIEKGGNETEQILAQTGVSCFLQLAVAYNMEFETSKDRVSGV

SEQ ID NO: 126408 - protein, 61 aa, Glycine max
  Coding DNA Sequence Number=SeqID_9630
MGAKYLEVVKRGSHPNNGWSPDKIRDAEFVSARLSPNSRNLNDKGRIICLCAFITRLAVPE

SEQ ID NO: 126409 - protein, 183 aa, Glycine max
  Coding DNA Sequence Number=SeqID_9631
  Gene Ontology: Mol. function=structural constituent of ribosome; Cellular component=ribonucleoprotein complex; Biological process =translation
  Homolog annotation: Hit_ID=Q9BBQ0; Match level="QueryCoverage=60%, HitCoverage=91%, E-value=8e-53, Identity=93%"; Hit description =Chloroplast 50S ribosomal protein L14
  Pfam annotation: Domain name=Ribosomal_L14; Domain location=62-183; Score=220.4; E_value=4.1e-63; Accession=PF00238.10; Description =Ribosomal protein L14pL23e
  Pfam annotation: Domain name=Ribosomal_L16; Domain location=1-113; Score=108.1; E_value=2.5e-29; Accession=PF00252.8; Description =Ribosomal protein L16
  Pfam module annotation: Pfam domain module=Ribosomal_L14::Ribosomal _L16; Domain location=62-183::1-113
MKGISYRGNHICFGRYALQALEPAWITSRQIEAGRRAMSRNVRRGGQIWVRIFPDKPVTVRPTETRMGSGKADNSGARELMCIRILGASNRRYAYIGDIVVAVIKQAVPNTNLERSEVIRAVIVRTCKELKRSNGIIIQYDDNAAVVIDQEGNPKGTRIFCAIARELRQLNFTKIVSFAPEVL

SEQ ID NO: 126410 - protein, 357 aa, Glycine max
  Coding DNA Sequence Number=SeqID_9632
  Gene Ontology: Mol. function=1-deoxy-D-xylulose-5-phosphate synthase activity; Biological process=isoprenoid biosynthetic process
  Homolog annotation: Hit_ID=P77488; Match level="QueryCoverage=100%, HitCoverage=57%, E-value=0.0, Identity=89%"; Hit description=1-deoxy- D-xylulose-5-phosphate synthase
  Pfam annotation: Domain name=TPP_enzyme_C; Domain location=71-250; Score=-36.4; E_value=0.0048; Accession=PF02775.11; Description =Thiamine pyrophosphate enzyme, C-term
LCDELRQYLLNSVSRSSGHFASGLGTVELTVALHFVYNTPFDHLVWDVGHQAYPHKILTGRRDRIATIRQKNGLHPFPWRAESEYDVLSVGHSSTSISAGLGMAVAAEREGKGRRTVCVIGDGAITAGMAFEAMNHAGDINPDMLVVLNDNEMSISENVGALNNHLAQLLSGKLYSTLREGGKKVLAGVPPIKELVKRTEEHLKGMVVPGTLFEELGFNYIGPVDGHDVQGLVATLKNMRDLKGPQLLHIMTKKGRGYAPAEKDPISFHAVPKFDPASGTLPKSAGGLPTYSKIFGDWLCETAAKDSSLMAITPAMREGSGMVQFSRDYPQQYFDVAIAEQHAVTFAAGLAIGGYKP

SEQ ID NO: 126411 - protein, 80 aa, Glycine max
  Coding DNA Sequence Number=SeqID_9633
MVEAFSQNIVTLTGLPMILLSESDLTNPWSARNVITHSLYVVVFGSCDDLELVFGEQMNRWMTMKNLMLEDTGTQRSDRM

SEQ ID NO: 126412 - protein, 85 aa, Glycine max
  Coding DNA Sequence Number=SeqID_9634
MKIASILDFSLCWVICGGGFGHFYEILGLNLTIVHQKKHIETECKTLGKDENMDLCSLSLLLQDDRLKVCLLQAIFLSISLEIVQ

SEQ ID NO: 126413 - protein, 191 aa, Glycine max
  Coding DNA Sequence Number=SeqID_9635
  Gene Ontology: Mol. function=nucleoside-triphosphatase activity; Cellular component=membrane; Biological process=protein catabolic process
  Homolog annotation: Hit_ID=Q1SX89; Match level="QueryCoverage=93%, HitCoverage=25%, E-value=6e-73, Identity=77%"; Hit description=DNA repair protein RadA; Peptidase M41, FtsH
  Pfam annotation: Domain name=FtsH_ext; Domain location=57-177; Score=- 14.5; E_value=0.042; Accession=PF06480.5; Description=FtsH Extracellular
IARRARDADEATEVAYLKELYHQNDPEAVIRVFESQPSLHNSPSALSEYVKALVKVDRLDESELLKTLRRGMSNSVTEEKTVGGLSALRSLGKSTKDNTIGTASNPIHMVAREGGNIKDQLWRTFRFIVVSFFMISGVGALIEDKGISKGLGINEEVQPSMESSTKFSDVKGVDEAKEELEEIVHYLRDPK

SEQ ID NO: 126414 - protein, 573 aa, Glycine max
  Coding DNA Sequence Number=SeqID_9636
  Gene Ontology: Mol. function=nucleoside-triphosphatase activity; Cellular component=membrane; Biological process=protein catabolic process
  Homolog annotation: Hit_ID=Q84LQ3; Match level="QueryCoverage=88%, HitCoverage=56%, E-value=2e-90, Identity=71%"; Hit description =Putative FtsH protease
  Pfam annotation: Domain name=AAA; Domain location=12-191; Score =251.8; E_value=1.4e-72; Accession=PF00004.19; Description=ATPase family associated with various cellular activities (AAA)
  Pfam annotation: Domain name=AAA_2; Domain location=9-138; Score= -40.2; E_value=0.01; Accession=PF07724.4; Description=ATPase family associated with various
  Pfam annotation: Domain name=AAA_5; Domain location=12-143; Score =18.7; E_value=6.6e-05; Accession=PF07728.4; Description=ATPase family associated with various
  Pfam annotation: Domain name=Peptidase_M41; Domain location=305-506; Score=385.3; E_value=9.5e-113; Accession=PF01434.8; Description =Peptidase family M41
  Pfam module annotation: Pfam domain module=AAA::AAA_2::AAA _5::Peptidase_M41; Domain location=12-191::9-138::12-143::305-506
RFTRLGGKLPKGVLLVGPPGTGKTMLARAIAGEAGVPFFSSSGSEFEEMYVGVGARRVRDLFSAARKRAPAIIFIDEIDAIGGKRNAKDQMYMKMTLNQLLVELDGFKQNEGIIVIGATNFPQSLDNALVRPGRFDRHVVVPNPDVKGRQQILESHMSKNTTKHNCPITPPSSLHNFKGEVVHTSAKISIVLMQNVPFKPHQITEITAISCCLKAQKLLARLNWMAYDAFFRVICFFLWAMIGYPLDTFVYELTPIYFEVYVLKADDVDLMIIARVTPGFSGADLANLINIAAIKAAMDGAKAVSMADLEHARDKIRMGSERKSAVISEESRKLTAFHEGGHALVAIHTDGALPVHKATIVPRGMALGMVTQLPDKDETSISRKQMLARLDVLMGGRVAEELIFGENKVTSGASSDLKKATSLAREMVTEYGMGNEVGLVTHDYEDDGRSMSSETRLLIEKEVKQFLERAYNNAKTILTTHNKELHALANALLEHETLSGTQIKALLAQVRSQMQQQQPQTLEAQNSSQSNTVPPSSSNPASAAASAAAAAATTAAATATAAAAKAKSAPVGS

SEQ ID NO: 126415 - protein, 256 aa, Glycine max
  Coding DNA Sequence Number=SeqID_9637
  Gene Ontology: Mol. function=nucleoside-triphosphatase activity; Cellular component=chloroplast
  Homolog annotation: Hit_ID=Q2PMM5; Match level="QueryCoverage=100%, HitCoverage=11%, E-value=1e-151, Identity=100%"; Hit description =Protein ycf2
MNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSK

SEQ ID NO: 126416 - protein, 83 aa, Glycine max
  Coding DNA Sequence Number=SeqID_9638
MQQWCRTEVQQQQQNRQYGWRIGLQRNHQPGWRFALFKKFPPFPYKKKKLLTAQASLLALRYSSKFSQRLFLCFVFDSNSLLS

SEQ ID NO: 126417 - protein, 92 aa, Glycine max
  Coding DNA Sequence Number=SeqID_9639
  Gene Ontology: Mol. function=zinc ion binding
  Homolog annotation: Hit_ID=Q1SXA1; Match level="QueryCoverage=88%, HitCoverage=22%, E-value=4e-15, Identity=47%"; Hit description=Zinc finger, SWIM-type
MYVVFVLMMSMLTSSNNVRARHVQLLEFSTITPLYIQPDHGISNGPNLSWVYCLLDQESCVTSIELKNSVSVCLSKCVFDGLFKLLDRVPSE

SEQ ID NO: 126418 - protein, 96 aa, Glycine max
  Coding DNA Sequence Number=SeqID_9640
  Gene Ontology: Mol. function=ribonuclease H activity; Biological process=DNA integration
MHEGSFGTHANGHAMARKILRVVIDYFTKWVEVASYANVTSSVVDFKIQHHNSTPYRPKMNGAVEAVNKNVKKIVQKMTVSYKDWHEMLPFALHGY

SEQ ID NO: 126419 - protein, 51 aa, Glycine max
  Coding DNA Sequence Number=SeqID_9641
MLVHSQIFEVLASNFESINEFLTSVKQHDLAKAEVLNILNIGPAADFELYP

SEQ ID NO: 126420 - protein, 66 aa, Glycine max
  Coding DNA Sequence Number=SeqID_9642
MAHEHKVADEYARVYAEKEARGRGNLLDSQMRSTRIVGSMPKETSIPTPRSPSRGRRPMHYLSPTS

SEQ ID NO: 126421 - protein, 75 aa, Glycine max
  Coding DNA Sequence Number=SeqID_9643
MNGSTFLREQHACMTNSPEPVVTLVCNSHVAWKPPPRVASCLQLETATTTSESAPGFGNRQSNWRVGFAEFSGVA

SEQ ID NO: 126422 - protein, 193 aa, Glycine max
  Coding DNA Sequence Number=SeqID_9644
MTNVAARKEEERTEIETHQESICQVTSIHHQLTNEEETPEVSSTPEYPYMATASYVGGKDKGRLELSIDDQNISFDLFEAMKHPDMGDACFEEEEVEQEITLSAATMILQSPLEKEPGYGRDCLACDEELDDSKDSCVDQVVFEELEKLRPAEKTKAELKTFLAHLKYVFLEEDETKPVIISNSLKKEEDQLV

SEQ ID NO: 126423 - protein, 190 aa, Glycine max
  Coding DNA Sequence Number=SeqID_9645
  Homolog annotation: Hit_ID=Q6ZG91; Match level="QueryCoverage=25%, HitCoverage=8%, E-value=3e-12, Identity=71%"; Hit description =Putative Anthranilate phosphoribosyltransferase
MVWCTQRMRNSCIFKGSKFDVEGLIQQVLFFAWCWMREGVKDFSQSFSVSSMNTGTTSKGTTQKSGPGDNRFSCVEDLEGLLFVEGAGLGGAGANPSLGLQHRLIGPGQCRTAIRRRQRRVSNVELGKPELLDGGPIQRDPRQTEPSLDPLAFGEWEKVKARVVVVAENGVWWGEKRFGIVNQNFHGVRV

SEQ ID NO: 126424 - protein, 330 aa, Glycine max
  Coding DNA Sequence Number=SeqID_9646
  Gene Ontology: Mol. function=nucleoside-triphosphatase activity; Cellular component=membrane; Biological process=protein catabolic process
  Homolog annotation: Hit_ID=Q1SX89; Match level="QueryCoverage=100%, HitCoverage=40%, E-value=1e-113, Identity=67%"; Hit description=DNA repair protein RadA; Peptidase M41, FtsH
  Pfam annotation: Domain name=AAA; Domain location=12-237; Score =282.0; E_value=1.2e-81; Accession=PF00004.19; Description=ATPase family associated with various cellular activities (AAA)
  Pfam annotation: Domain name=AAA_2; Domain location=9-138; Score= -41.8; E_value=0.014; Accession=PF07724.4; Description=ATPase family associated with various
  Pfam annotation: Domain name=AAA_5; Domain location=12-143; Score =19.5; E_value=5.8e-05; Accession=PF07728.4; Description=ATPase family associated with various
  Pfam annotation: Domain name=Peptidase_M41; Domain location=244-330; Score=-2.5; E_value=2.3e-10; Accession=PF01434.8; Description =Peptidase family M41
  Pfam module annotation: Pfam domain module=AAA::AAA_2::AAA _5::Peptidase_M41; Domain location=12-237::9-138::12-143::244-330
RFTRLGGKLPKGVLLVGPPGTGKTMLARAIAGEAGVPFFSCSGSEFEEMYVGVGARRVRDLFSAARKRAPAIIFIDEIDAIGGKRNAKDQMYMKMTLNQLLVELDGFKQNEGIIVIGATNFPQSLDNALVRPGRFDRHVVVPNPDVKGRQQILESHMSKVPFKPHQITEITAISCCLKAQKLLARVTYFLCWIFVSHQIQVLKADDVDLMIIARGTPGFSGADLANLINIAAIKAAMDGAKAVSMADLEHAKDKIQMGSERKSAVISEESRKLTAFHEGGHALVAIHTDGALPVHKATIVPRGMALGMVTQLPDKDETSISRKQMLATLD

SEQ ID NO: 126425 - protein, 185 aa, Glycine max
  Coding DNA Sequence Number=SeqID_9647
  Gene Ontology: Mol. function=transferase activity, transferring glycosyl groups; Biological process=metabolic process
  Homolog annotation: Hit_ID=Q6ZG91; Match level="QueryCoverage=81%, HitCoverage=35%, E-value=6e-51, Identity=55%"; Hit description =Putative Anthranilate phosphoribosyltransferase
MKDEDAVSRAQLGAFFAGMKILANAFPKATQWSEGETRAMKTFWPLLVRVLPPEVIFIADPEGELLAGDHLGFEEVQGVLKDVLPIQEGDEKPQGMILRSPPPVADVRSLTHYGEPYDGNTRFFRRTLFIAAVRSCYGESCLLHGVDWMAPKKQTKMLNDHKVLEILSLEMTKACMYITMTKPIA

SEQ ID NO: 126426 - protein, 37 aa, Glycine max
  Coding DNA Sequence Number=SeqID_9648
MPPFIRARSLLTRQAANSNGGTLHVATNPASASCEIG

SEQ ID NO: 126427 - protein, 51 aa, Glycine max
  Coding DNA Sequence Number=SeqID_9649
MTHLLNQMCINNGWRQRHLMKQTSMYIILDISAIAVKLERLLNLRILSEGT

SEQ ID NO: 126428 - protein, 85 aa, Glycine max
  Coding DNA Sequence Number=SeqID_9650
METIWKRFEQLNVCGKVHLKTKLREIAYPEKDSIENIIDVKADDSCGYWAIAALLGMGEESWSLVTMGKWMNVTDMGYVLLHDTM

SEQ ID NO: 126429 - protein, 121 aa, Glycine max
  Coding DNA Sequence Number=SeqID_9651
MDYWHKANESTKSATQCWICEHFPIVGSALTVEDYDERRPRACRWTSCKVLPVSTYRKRLDRLTPDVPGDTPRVPLVQQYDTFVEADVHQQPMAASTLDEVDVDVHHLGHVVQSLISWRGY

SEQ ID NO: 126430 - protein, 145 aa, Glycine max
  Coding DNA Sequence Number=SeqID_9652
  Gene Ontology: Mol. function=hydrolase activity, hydrolyzing O -glycosyl compounds; Cellular component=apoplast; Biological process =carbohydrate metabolic process
  Homolog annotation: Hit_ID=Q1RV67; Match level="QueryCoverage=84%, HitCoverage=21%, E-value=2e-40, Identity=64%"; Hit description =Glycoside hydrolase, family 32
EKFTPDADDLEGTNLNLLLDHGMFYASKSFFNYAKNRRILWGWSKECESTQDDYEKGWAGLQSIPRQVWLHKSGKWLMQWPIEEVEKLRDKQVSIMREKLVGESTIEVSGIPASQDSIENIIDVKADGNCGYRAIVVLLSMDEES

SEQ ID NO: 126431 - protein, 116 aa, Glycine max
  Coding DNA Sequence Number=SeqID_9653
  Gene Ontology: Mol. function=nucleoside-triphosphatase activity; Cellular component=membrane; Biological process=protein catabolic process
  Homolog annotation: Hit_ID=Q84LQ3; Match level="QueryCoverage=98%, HitCoverage=16%, E-value=3e-36, Identity=66%"; Hit description =Putative FtsH protease
MSNSVVEEKIVVGLSALRNSRKSTKDNTIGIASNPIHMVAREGGNIKYQLWRTFRFIVVSLFMISGVGALIEDEEISKGLGINEEVQPSMESSTKFSDVKGVDEAKEELEEIVHYL

SEQ ID NO: 126432 - protein, 176 aa, Glycine max
  Coding DNA Sequence Number=SeqID_9654
NVYTDNHSGISARQRDSKVSMTDLVSTEDDTFHLTDSKKVYTDDHSGISARQRDSKVSMTDLVSAEDDAFRLTDSKKVYTDDHSGISAHQRDSKVSMTDFVSAEDDGAGDDVSLCVLSGFSSYREQKGIYTDNHSGISARQRDSKVSVTDLVKVADKREALAHTYPPMRNSDLRSS

SEQ ID NO: 126433 - protein, 103 aa, Glycine max
  Coding DNA Sequence Number=SeqID_9655
  Gene Ontology: Mol. function=serine carboxypeptidase activity; Biological process=proteolysis
  Homolog annotation: Hit_ID=Q1EP77; Match level="QueryCoverage=60%, HitCoverage=13%, E-value=1e-14, Identity=69%"; Hit description =Serine carboxypeptidase (Carboxypeptidase D), putative
VPKPSVASYLSQELLAEQEVDRVHGLLAQPPVKLNNMLVISLSMKLKEEICSIGFSRPPINRNKNPFSYGSMENHKPEGQEVSAAGVNIDNHMNEGSGWINSA

SEQ ID NO: 126434 - protein, 90 aa, Glycine max
  Coding DNA Sequence Number=SeqID_9656
DADEAPLEVSICLHAFGILGFGSFSGVKSCEREDPFHPGLFVGDAGGFQSPTREPLNVGGLVPPHCSLKSVVSDDACPGACFVQRDATTL

SEQ ID NO: 126435 - protein, 199 aa, Glycine max
  Coding DNA Sequence Number=SeqID_9657
MNLAYIRKNCWNPEDLTGSIRGARRARARPAELHSTSTAPTLASTSSTPSIPAQIDSQRFEAMLQSIHQEQIILLQSLQVAAPPGSIPSVEHFREMVAWPGTQPFLHKEDEGEEAEETQVRQAVAATPERSLEATSEPPTPVVDLPSPQYTTDPSTPILEIPEDPTTPVLAMDTSPPTTSVLHLTDEEDVQTQDTQDQS

SEQ ID NO: 126436 - protein, 74 aa, Glycine max
  Coding DNA Sequence Number=SeqID_9658
MGARVIMEDGSVTYIVSRESPYISTTSPVETTAISGYLAKLHMDLVCKGLVCIMEGGGGNHVHKSRWCGGYCGA

SEQ ID NO: 126437 - protein, 62 aa, Glycine max
  Coding DNA Sequence Number=SeqID_9659
MAQVVSIKHNGGIHGNMSGLKENKVQSADQDNAEFKVHEIKDIGGSASDSKDAYDELVRVMN

SEQ ID NO: 126438 - protein, 68 aa, Glycine max
  Coding DNA Sequence Number=SeqID_9660
LEPDQFNPTQLVIKQQDWKNHNCLTPKRCGKGGRYHRGRYAPSCHHRRRACDARPLWERRWLDGVLGA

SEQ ID NO: 126439 - protein, 67 aa, Glycine max
  Coding DNA Sequence Number=SeqID_9661
METQHKLGGGDFLREASLMKIGEGIRPRRDNGCGGGFAVNFGVTIMHYLEVKENGNQRSNKERWRKR

SEQ ID NO: 126440 - protein, 112 aa, Glycine max
  Coding DNA Sequence Number=SeqID_9662
MAPQADFAKFGFEIEKLFGRQKSFGNGGNNPPATHQNLCQYKFYPTYGATKVVHMHVEDVKCNEAASRFISEKRTELQMKARRQTGRSSAASRVIRLFLWLRNEFEKSWTWV

SEQ ID NO: 126441 - protein, 135 aa, Glycine max
  Coding DNA Sequence Number=SeqID_9663
MLWVGGDCCSGWCGCTSSEMDEDQWMYGSIMSDEVHMNDENKHEAGMNEEQHVDCSDAFNTSLVFTTRDDVLQWARSVAYEIGFVAVIMKSDTNTGVVSIGLGRKILLEEILAVRNVGVPSSFIGNQWLKGKVEW

SEQ ID NO: 126442 - protein, 104 aa, Glycine max
  Coding DNA Sequence Number=SeqID_9664
  Homolog annotation: Hit_ID=Q6CQF2; Match level="QueryCoverage=39%, HitCoverage=50%, E-value=7e-11, Identity=75%"; Hit description =Kluyveromyces lactis strain NRRL Y-1140 chromosome D of strain NRRL Y- 1140 of Kluyveromyces lactis
MVAQARAVDMLVETSSSRLWMAARALGVPRHLRAPGVGLWAPHSARLETRTKESDMCASQRASKPHTCRDPKDGELCLSGAKPEETLVEARSDTDVQIVRLTWV

SEQ ID NO: 126443 - protein, 105 aa, Glycine max
  Coding DNA Sequence Number=SeqID_9665
MGEHKIEGRKRERREFEVASAYQRLDKLEVQSSPKDSCFIWESSFSKPHSSTELLGVAVPFDSLGKLSHAATIVEAIPCHSDMALGKNSAMRGEPSSPMIFNTIS

SEQ ID NO: 126444 - protein, 89 aa, Glycine max
  Coding DNA Sequence Number=SeqID_9666
MESSQSKSGRKQKKKRRKVPNQRVGESKKEKKENSQIKEWEKEKEGKKIPDQGSKEDRGNVQKGCWTRRYLNNTELSPNKQKEGKETTI

SEQ ID NO: 126445 - protein, 143 aa, Glycine max
  Coding DNA Sequence Number=SeqID_9667
  Subcellular localization annotation: CTP_CleavageSite=17; ConfidenceScore=5.07e-01
ARARPSDLPSTSVAHTPASTSVVAPAGSIPSIEQFLERDASSEATIPEPFIVKEETSETRVRQEATATLERSREVTSNPPTSVVDLSSPQHATDPSTPILEIPEDPTTPVLTLNTSSPATLVLHLTDEEDVKTQDTQDQSQEF

SEQ ID NO: 126446 - protein, 74 aa, Glycine max
  Coding DNA Sequence Number=SeqID_9668
MDSPRTKLGYDSRELRCCQEILRLGSWAIEEVVEQNRLRQWSNVGPDPKAETNQGKTVMQPQFVAPCRFLLLGS

SEQ ID NO: 126447 - protein, 81 aa, Glycine max
  Coding DNA Sequence Number=SeqID_9669
MAYTLATISSMIKVSPHGDLPCIDIKCRVELAHYCLIEEEKDASYANVTRKVVARFIKKEIICRYGLPRKIITDNATNLNN

SEQ ID NO: 126448 - protein, 71 aa, Glycine max
  Coding DNA Sequence Number=SeqID_9670
  Subcellular localization annotation: CTP_CleavageSite=41; ConfidenceScore=5.08e-01
MLQPYGINIGLKEHSNRVTPKAYAPKSTSGTLPTDSGLNINSSSLKGLNINSSPLKGLSINSSPLKGLMIV

SEQ ID NO: 126449 - protein, 114 aa, Glycine max
  Coding DNA Sequence Number=SeqID_9671
  Gene Ontology: Mol. function=chitin binding; Cellular component =extracellular region; Biological process=chitin metabolic process
  Homolog annotation: Hit_ID=UPI0000612705; Match level="QueryCoverage =83%, HitCoverage=92%, E-value=1e-10, Identity=30%"; Hit description =UPI0000612705 related cluster
WTLGTSTLTFRGLQALAFRGLHVLAIRGLHALTIRGLHPLAFNGRHVLNFRGLHALALRGLDILAVRGLDVLAFRGLHVLHFRGLHVLAFRGLRALAFSGLHSHTLREFKVLYP

SEQ ID NO: 126450 - protein, 189 aa, Glycine max
  Coding DNA Sequence Number=SeqID_9672
  Homolog annotation: Hit_ID=Q6MLK7; Match level="QueryCoverage=76%, HitCoverage=68%, E-value=1e-15, Identity=37%"; Hit description=YCE I like family protein precursor
  Pfam annotation: Domain name=YceI; Domain location=44-189; Score= -54.1; E_value=0.069; Accession=PF04264.3; Description=YceI like family
MKKISVIALVGVGLLMASCTKEKSAEASAAGQEQAVAESKGEVLAVDTVASVVNWKAYHKGGFAPRWGTLNVKSGDLSVEGNQVSAGNFVIDMTSIKVDPASVTEKDKKPEDLVTHLKTPDFFNVEKNPVSDFKITSVADLKEAPKDAVAGANKTISGNLTLLGKTMNVTFPAKVEATANSASIDAKFT

SEQ ID NO: 126451 - protein, 81 aa, Glycine max
  Coding DNA Sequence Number=SeqID_9673
MARHDTCQGLVWFKDKRDAPHYFHDTNAKMMIWKLHAKLVMHAPMWLSITRSTLIGRSGTILSARNFLYTKSNSVGQFVLN

SEQ ID NO: 126452 - protein, 78 aa, Glycine max
  Coding DNA Sequence Number=SeqID_9674
  Subcellular localization annotation: CTP_CleavageSite=38; ConfidenceScore=5.10e-01
MSPPPLRPHNHSQTHLKLSGWLPLQALRGLFSLSEWTEAVRLAGWPFAQRTCTTHPSSRFFLALSRGVLHSANGSLSQ

SEQ ID NO: 126453 - protein, 304 aa, Glycine max
  Coding DNA Sequence Number=SeqID_9675
  Homolog annotation: Hit_ID=Q1XP43; Match level="QueryCoverage=33%, HitCoverage=26%, E-value=8e-20, Identity=42%"; Hit description =Hypothetical protein precursor
MTIVNDKLYYYGNEFNYNTHSYTKTFGIIDVKTEQVISDKIIDQEYADAIKAPYGIAVNPITEDIYITDARNYVSTGFVYCFNKSGHFKWKTEGGNIPAHFTFLKILKIIPAVLVIFLLTGISGCKSDRDEESSFKGLEESYTINRFKVLNIPANVPGKLTWSIKDSIISEGSELDFISPYAKTYPLTLKIEQNGNVKTYQSTIIVNKEPGSYSKYIASVLDFRPAIGQFTNEIPEYLAGNTANTMLQKARESLIGSNSTMISLGGFGGYVVFGFDHTIPNMNGRDFKILGNAFWGNNANDPRS

SEQ ID NO: 126454 - protein, 57 aa, Glycine max
  Coding DNA Sequence Number=SeqID_9676
  Homolog annotation: Hit_ID=Q01B93; Match level="QueryCoverage=72%, HitCoverage=6%, E-value=1e-18, Identity=85%"; Hit description =Inframe stop codon
MVYWWHDKYRPKKPKYFNLVHTGYEWNKYNQTHYDHDNPPPKIVVRFWQVYRIAQVV

SEQ ID NO: 126455 - protein, 162 aa, Glycine max
  Coding DNA Sequence Number=SeqID_9677
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=98%, HitCoverage=77%, E-value=3e-31, Identity=42%"; Hit description =Protein ULTRAPETALA2
MKVNISSLVSVSLSVPWGVEGGRETYGFIAKTKTPLIKYYTHQANVANRKDSAMRKQNIHRDEFLHCKRCGKERRFHLKSTPDIKNYHDALNNKCWTCSLWPYQKITCDDDEEGSSLKASRGCSHSSTCQDCSTFYCEGCIKCRFEDCNCQECRDLMLYAKP

SEQ ID NO: 126456 - protein, 113 aa, Glycine max
  Coding DNA Sequence Number=SeqID_9678
  Subcellular localization annotation: CTP_CleavageSite=24; ConfidenceScore=5.04e-01
MSPPPLEPHNHSQTHLKLSGRLPLQSPFSGGLRTAKSLKTLWHFAPGDLQPFDPEIERTFHRLVRHSVHHDYPEHFVPHPGHYVIGEFDHSVVGDFEHPDFENSDFEHSDFEH

SEQ ID NO: 126457 - protein, 186 aa, Glycine max
  Coding DNA Sequence Number=SeqID_9679
  Pfam annotation: Domain name=Transposase_23; Domain location=39-109; Score=16.6; E_value=1.7e-05; Accession=PF03017.5; Description =TNP1ENSPM transposase
MQSQGLAVPPEPLVGPGPSGPRVSTNESCVNPSGNDPETGDSDRCGLYIEADPARLVAVGRVYERSTLVHNTPLLSGQVKVSVDEVKDADAPVPVPTDQVSLVGQALHTFLAWPTHLVKSLSHQVTVSPAKPPPKPDPEVDDPLYLMTLTIPELLLRPYQVPLQWTLADGGHPAQGTPSCLVLFIG

SEQ ID NO: 126458 - protein, 130 aa, Glycine max
  Coding DNA Sequence Number=SeqID_9680
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=10%, E-value=7e-43, Identity=58%"; Hit description=Chromo
MDQEKVQAVLNWPYPINLKQLRGFLGLTGYYRKFIKAAITKAPVLALPDFSKAFTLETDASGIGIRAVLSQEQHPIAFFSKKLTPRMQRQSAYIRESFAIIEAVAKFRHYLLGHRFVIKTDQRSLKSLTE

SEQ ID NO: 126459 - protein, 144 aa, Glycine max
  Coding DNA Sequence Number=SeqID_9681
  Homolog annotation: Hit_ID=UPI000065F7CF; Match level="QueryCoverage =48%, HitCoverage=10%, E-value=9e-07, Identity=40%"; Hit description =Homolog of Homo sapiens "Leucine-rich repeats and IQ motif containing 1
MGSKSTLRFNENPRAFAWISSPIYLESSYPMPLWDRIASGGPLGTSTLSFRGLHVLTFRGMHALATLGATCPHLQRTTCPRLQRTTRPHLQRTSRPHLQRVTHPHLQRTIRPPLERATRPHLQKTSRPHLQRVSQPTLRREDDA

SEQ ID NO: 126460 - protein, 106 aa, Glycine max
  Coding DNA Sequence Number=SeqID_9682
MPSTHDAIMYYNGKWNIPPQNKFVGCAFTGKNPKKFQIPSTCTIDELKDLIKQVAPKGIPPHGIHESQTTNEELLKVLVQSNYWKKYGPIEILAVFTKYVVEFEDE

SEQ ID NO: 126461 - protein, 108 aa, Glycine max
  Coding DNA Sequence Number=SeqID_9683
  Gene Ontology: Mol. function=transferase activity; Biological process= biosynthetic process
  Homolog annotation: Hit_ID=Q81KI5; Match level="QueryCoverage=99%, HitCoverage=28%, E-value=2e-54, Identity=99%"; Hit description =Glycosyl transferase, group 1 family protein
MMVFPSATETFGNVVLESLACGTPVIGANSGGVKNIITDGKTGVLCLPKNEDVFLSSIYSLLQNEEKLEQMGIAASSYAKSKSWDEIFRGLLSHYEEVLQHNASELLA

SEQ ID NO: 126462 - protein, 147 aa, Glycine max
  Coding DNA Sequence Number=SeqID_9684
  Homolog annotation: Hit_ID=Q47522; Match level="QueryCoverage=36%, HitCoverage=66%, E-value=2e-25, Identity=100%"; Hit description=LacZ protein
MEWGNFRSSHLPLTEYDCALDAESFSPGDQVSFLCYFLDRIPAARGIHYESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 126463 - protein, 232 aa, Glycine max
  Coding DNA Sequence Number=SeqID_9685
  Gene Ontology: Mol. function=oxidoreductase activity, acting on NADH or NADPH, quinone or similar compound as acceptor; Cellular component=photosystem II; Biological process=mitochondrial electron transport, NADH to ubiquinone
  Homolog annotation: Hit_ID=P31174; Match level="QueryCoverage=67%, HitCoverage=100%, E-value=1e-86, Identity=100%"; Hit description =NAD(P)H-quinone oxidoreductase chain J, chloroplast (EC 1.6.5.-) (NAD(P)H dehydrogenase, chain J)
  Pfam annotation: Domain name=Complex1_30kDa; Domain location=160-228; Score=129.6; E_value=8.6e-36; Accession=PF00329.9; Description =Respiratory-chain NADH dehydrogenase,
  Pfam annotation: Domain name=Oxidored_q6; Domain location=1-70; Score= 77.8; E_value=3.5e-20; Accession=PF01058.12; Description=NADH ubiquinone oxidoreductase, 20 Kd
  Pfam module annotation: Pfam domain module=Complex1_30kDa::Oxidored _q6; Domain location=160-228::1-70
MAPSLVRLYEQMPEPKYVIAMGACTITGGMFSTDSYSTVRGVDKLIPVDVYLPGCPPKPEAIIDAITKLREAKKCKVVCLLGLVKHGLIHRSLGFDYQGIETLQIKPEDWHSIAVILYVYGYNYLRSQCAYDVAPGGLLASVYHLTRLEYGIDQPEEVCIKIFVARKNPRIPSIFWVWKSADFQEKESYDMLGISYDNHPRLRRILMPESWIGWPLRKDYIAPNFYEIQDAH

SEQ ID NO: 126464 - protein, 38 aa, Glycine max
  Coding DNA Sequence Number=SeqID_9686
  Homolog annotation: Hit_ID=Q1RXP4; Match level="QueryCoverage=98%, HitCoverage=2%, E-value=8e-11, Identity=84%"; Hit description=AAA ATPase
DDELIDATGLGLVNDACVLYCERFMEFLIDLLSQLTTR

SEQ ID NO: 126465 - protein, 73 aa, Glycine max
  Coding DNA Sequence Number=SeqID_9687
  Homolog annotation: Hit_ID=Q9FMW4; Match level="QueryCoverage=95%, HitCoverage=32%, E-value=2e-19, Identity=63%"; Hit description =Similarity to ABA-responsive protein
MKVFSSKGEMCRIRYKVSIPLKRIKYVNQSRNVEKPTQKYIEIVTEDNFEFWFMGFLKYQKTFNYLELAISQA

SEQ ID NO: 126466 - protein, 68 aa, Glycine max
  Coding DNA Sequence Number=SeqID_9688
  Homolog annotation: Hit_ID=Q6TXD0; Match level="QueryCoverage=52%, HitCoverage=8%, E-value=1e-13, Identity=100%"; Hit description=3 -ketoacyl-CoA thiolase
  Pfam annotation: Domain name=Thiolase_C; Domain location=1-68; Score=- 32.1; E_value=0.0012; Accession=PF02803.8; Description=Thiolase, C -terminal domain
AFASQYVYCLKKLGLDPRKVNVNGGAIALGHPLGVTEVMLKSSERHLQLESLYYCDMFAHVHAVLQLC

SEQ ID NO: 126467 - protein, 545 aa, Glycine max
  Coding DNA Sequence Number=SeqID_9689
  Homolog annotation: Hit_ID=Q10D74; Match level="QueryCoverage=95%, HitCoverage=96%, E-value=1e-105, Identity=45%"; Hit description =Expressed protein
  Pfam annotation: Domain name=DUF719; Domain location=41-300; Score= -111.5; E_value=0.076; Accession=PF05334.3; Description=Protein of unknown function (DUF719)
MDNKTQQSESKQNDNDEEVAPKRQDPNPSSGGWGFSPLSFLSDLQKAAAVAAEEISRNAAVVAETASKSIVELQNKDEDSKSSKKVEGAEGSADEKESDDEGSKLRKSALERLEKASEESLLSQASIKGYFPLGGWAFVKSIFLALPPIGATLFTISELASLLGHAAWLFGEGECREEVAMNLNDVLVFCRLENSATNLSGSPKHDGPGAAGANASSLLETGKAFTAKGMQVLEYVGKETMDLLISETGIEVEKDKKEGEEQNDEDQLLEEVTFDRCFYIYGGPEQLEELEALSSHYALLFNRRKAKLSAEQKSVYDGKLKEVQQIFNLNTEIDRSNADSNKGKTIKKGNEGSSDEMKNLHDSSVGKAAEMAGGFANALAGLAANDILQRTNARLESLHSEGVHRLSEMCCFAVSQLLVLGKSIISRANNTEDEADDDKANVEWPEDVSAKANIIRINAQTMIGYVKAVSHSFITGISDVTEAYQAAIKAVTSESLSVVTQKSVQEKASAFSEHLRADQTTAACKIQDGMQFLAHVLISTSMNAA

SEQ ID NO: 126468 - protein, 187 aa, Glycine max
  Coding DNA Sequence Number=SeqID_9690
  Subcellular localization annotation: CTP_CleavageSite=52; ConfidenceScore=5.66e-01
MSHLLSAATTFSRFQLLTLNNTFTTQPPFLGFKGTSCFFEKHSCCLSVKPFCASQKRGANIFCSMNMSAQQSDDHGKMKLDQLIDKVQKLWDSSPEPVKKFPHNKALDNFIQLILDLILVVVKYLAVPVFAVTSLSEMSYCAHERKLVFVPLPVLFGVAVAGILKETALQLSPRLRVRSLVGHHFIF

SEQ ID NO: 126469 - protein, 63 aa, Glycine max
  Coding DNA Sequence Number=SeqID_9691
MSSATLITCSLYCFTSPVGKITRAALVFFIKGGAKEEKIGVKREEMGFGLKRKGSHEESKMDD

SEQ ID NO: 126470 - protein, 1521 aa, Glycine max
  Coding DNA Sequence Number=SeqID_9692
  Gene Ontology: Mol. function=RNA-directed DNA polymerase activity; Cellular component=chromatin; Biological process=chromatin assembly or disassembly
  Pfam annotation: Domain name=Chromo; Domain location=1270-1318; Score= 28.3; E_value=2.7e-05; Accession=PF00385.14; Description='chromo' (CHRromatin Organisation MOdifier
  Pfam annotation: Domain name=RnaseH; Domain location=709-827; Score= -24.2; E_value=0.01; Accession=PF00075.14; Description=RNase H
  Pfam annotation: Domain name=Thiolase_N; Domain location=1371-1521; Score=-2.2; E_value=1.6e-12; Accession=PF00108.13; Description =Thiolase, N-terminal domain
  Pfam annotation: Domain name=rve; Domain location=963-1119; Score =99.2; E_value=1.2e-26; Accession=PF00665.16; Description=Integrase core domain
  Pfam annotation: Domain name=zf-H2C2; Domain location=904-945; Score =18.8; E_value=0.0011; Accession=PF09337.1; Description=His(2)-Cys(2) zinc finger
  Pfam module annotation: Pfam domain module=Chromo::RVT_1::RnaseH::Thio lase_N::rve::zf-H2C2; Domain location=1270-1318::449-618::709 -827::1371-1521::963-1119::904-945
MADQPHNTSSSPLETAILKLTTLQVSLGETVHSMAQKFDELLLRLPSTSPSPSPQPTPSISPVPAHNHRMKLDIPRFDGTDPFGCFISGLTPEIRREVQSLQPLTLVQAAGLARLQEEKLLDTRSSFRNRAPPVLSVPPPRQNSTPALLQAPSSPATSARPPPVKRLSPAEIASRRERGLCFTCEEKYHRGHRCASRVFLLVAAEDDHPDPLIEDLDPGPDPPDSPNPTAAQISFNSLSGNLAPETLRLLGLASGHHVVILVDGGSTHNFIQEELVQSIGLPTQTTTPLRVLVGANIVLGVQWLKTLGPILIDYSLMTMKFFYDQRLIELRGDTDLTINMLTPPQLRRFLKHNEHASCFHIAVLTEAVPDEPSQLLDPQIQALIDHFGPLFQTPTSLPPARITDHHIHLFPQATPVNVRPYRYPHYQKQEIELKVESMLQKGLIRPSTSPFSSPVLLVRKHDQSWRFCVDYRALNAITIRDRFPIPTIDELLDELGHACWFSKLDLLQGYHQIRMHSSDIAKTAFRTHHGHYEFKVMPFGLCNAPSTFQATMNMLFRPFLRRFLIVFFDDILIYSITFTDHVLHLQQAFQVLLENQFVLKLSKCTFAQTEVEYLGHVVSQRGVEPVSSKVDAVRQWPLPQSAKALRSFLGLAGFYRRFIKGYATIAAPLVAATITEPFQWTPSAQEAFDQLKQALSEAPVLTLPDFQLPFTIETDASGIGMGAVLSQKGHPIAYFSKQFPPKLRHSSTYVRELFAVTSAVKRWRQYLLGHKFTIITDHRSLKELLTQVVQTPEQHTYLARLMGYDFQIQFRSGATNQAADALSRLSEEDSSLSLILSVPCLTFMEELRKQLAQNESYQSKLQDIQATPANFPDFSISNNLILRKGRIWLPPHLPLLPTLLTEYHATPTDGHLGVAKTIARLTDNFYWDGLRDDVARFVSTCLDCQHSKYETKRAAGLLCPLPVPHRPWEDLSLDFITGLPVFQGNTTILVVVDRFSKGIHLKMLPTSHTAYTAAALFMNIVGKIHGLPRSMISDRDPLFLSRFWQDLFRLSGTHMRMSSSYHPQSDGQTEALNRAIEQYLRAFIHRRPSSWGKLLLWVEWSHNTSWNAATGSTPYEITFGKKPFNYPAYLAGDSKIDAVDDMITNREDTFRLIRKKLLKAQELMKKYVDAKRRHVEYQVGDWVMVKLRPHRQNSAKPSSSSSSDKLQKCFYGPFEITERIGPVAYRLKLPEGARIHPVFHCSILKPFKGSPASADSVCLPDQFAHGQLIVSPLAILDYRYNSDNPDSPWEVLVQWEGLDPDETSWESWTQLSRDYHLEGKVNFQGPWDDRQRGVQQVIEVQQANPRQGTNNNTETQIEGRAKRIINKPSYLKDFVAYRTAICKAKRGGFKDTLPDDLLATVLKAVIEKTNVNPAEVGDIVVGTVLAPGSDRGIECRMAAFYAGFPETVPLRTVNRQCSSGLQAVSDVAAYIKAGFYEIGIGAGLESMTVDRVNRLRNINPKVETFAEARDCLLPMGITSEN

SEQ ID NO: 126471 - protein, 83 aa, Glycine max
  Coding DNA Sequence Number=SeqID_9693
  Gene Ontology: Mol. function=oxidoreductase activity
  Homolog annotation: Hit_ID=Q39224; Match level="QueryCoverage=97%, HitCoverage=24%, E-value=5e-10, Identity=46%"; Hit description=SRG1 protein
MEPETAKLGSSLLVDSVKELAKEALIKVPERYVHPNIEPPILFHKDTLPQLPIIDLNKLLSEDVTELEKLDFACKEWGFFQMQ

SEQ ID NO: 126472 - protein, 221 aa, Glycine max
  Coding DNA Sequence Number=SeqID_9694
  Gene Ontology: Mol. function=ribonuclease H activity
  Homolog annotation: Hit_ID=Q9FMW4; Match level="QueryCoverage=97%, HitCoverage=96%, E-value=3e-57, Identity=54%"; Hit description =Similarity to ABA-responsive protein
  Pfam annotation: Domain name=GRAM; Domain location=101-179; Score =38.9; E_value=1.8e-08; Accession=PF02893.10; Description=GRAM domain
  Subcellular localization annotation: CTP_CleavageSite=65; ConfidenceScore=5.06e-01
MASFLQELLIGFPFTSAAYLGEKSSKRYLPDPATQYITSTTSSKQGGVNSVLTRMNKLGRKTNIFATGLKEHVKLGQKITDTVKGKLSLGARILQVGGVKKVFMQLFSVKDGEKLLKASQCYLSTTSGPLAGLLFISTDKVAFCSERSIKAYSSKGHLIRIHYKVVIPLEKIRSINQSQHVKKPSPKYIEIVTVDDFDFWFMGFLNYQKAFKYLKQVISQA

SEQ ID NO: 126473 - protein, 214 aa, Glycine max
  Coding DNA Sequence Number=SeqID_9695
MPELRHDKTLLPTTTAVRVCQRDKGKDTFSDARKLSRQLVSRPYHAGWAMWDANMKGVHNEGSTSSSIYKSPRRCDAMMDVACTWELAKNMGALDGRDENGVLTRMVALDGRDKSKFEKLGNREGSGRGVKWGAVKKLVVNEQVDMLCLRETKKEMVDRTTCQALWGDLEVKWATSPAVNSAGGILCIWSESSFVPKKELIGSGLNFTRRYLEG

SEQ ID NO: 126474 - protein, 193 aa, Glycine max
  Coding DNA Sequence Number=SeqID_9696
  Gene Ontology: Cellular component=integral to membrane
  Homolog annotation: Hit_ID=Q9ZUM2; Match level="QueryCoverage=93%, HitCoverage=62%, E-value=1e-54, Identity=56%"; Hit description =Expressed protein
  Pfam annotation: Domain name=DUF1084; Domain location=11-191; Score =104.3; E_value=3.6e-28; Accession=PF06454.2; Description=Protein of unknown function (DUF1084)
MGSEGVPSTVAEVMSVAAVELTDASSWWHDIDDSPLWQDRMSYTLAVLYGIVATVALVQLARIHLRVPEYGWTTQKRLKPEVFEYREWNIVQHILLDVPSLAFFTTYALLVLFWAEIYYQASLICGAFASTWLARAVSTDGLKPSFYTINIVVYVVQITLWLILWWKPISGLLILSKMFFAEKNEVESRITTP

SEQ ID NO: 126475 - protein, 361 aa, Glycine max
  Coding DNA Sequence Number=SeqID_9697
  Gene Ontology: Mol. function=oxidoreductase activity; Cellular component=proton-transporting two-sector ATPase complex; Biological process=flavonoid biosynthetic process
  Homolog annotation: Hit_ID=Q39224; Match level="QueryCoverage=95%, HitCoverage=96%, E-value=9e-91, Identity=47%"; Hit description=SRG1 protein
  Pfam annotation: Domain name=2OG-FeII_Oxy; Domain location=204-304; Score=159.9; E_value=6.4e-45; Accession=PF03171.10; Description=2OG -Fe(II) oxygenase superfamily
MEPETTEELVIPYSVKELLAKEALTKVPERYVRPDIDPPILSNKDSLPQLPVIDLNKLLAEEVKGPELEKLDLACKEWGFFQLINHATSSELVEDVKKGAQELFNLSMEEKKKLWQKPGDMEGFGQLIDKPKEEPSDWVDGFYILTLPSHSRKPHIFANLPQPFRENLEVYCNEMRDLAINMYVLIGKALGTEPNEIKDTLGESGQAIRINYYPPCPQPENVLGLNAHTDASALTILLQGNEVEGLQIKKDGTWVPVKPLPNAFIVSLGDVLEVVTNGIYKSSEHRAVVNSQKERLSIATFSGPEWSANIGPTPSVVTPERPALFKTIGVADFYQGYLSPQHRGKSYINNVLRIRNENIKG

SEQ ID NO: 126476 - protein, 76 aa, Glycine max
  Coding DNA Sequence Number=SeqID_9698
MGLFLMLQRFPVESKGRCKKLQEVCNLMMGYSSSSLLHFDPELGSDRLAYSGLLFLKGEAESNKFLKRSFKKCSFF

SEQ ID NO: 126477 - protein, 179 aa, Glycine max
  Coding DNA Sequence Number=SeqID_9699
  Gene Ontology: Mol. function=ribonuclease H activity
  Homolog annotation: Hit_ID=Q1RYI2; Match level="QueryCoverage=51%, HitCoverage=14%, E-value=2e-25, Identity=47%"; Hit description =Ribonuclease H
MVKLGWSLCGKRNSLWVQILRKKYKCGDSIVPNVNVLQPGSNTWRGICHNWENVTANLEWRIGDGNSVNFWNQLWVPSQDPLAHKSTCVVLSDLEAESNSNASIQAQSGSAFVGVILRDHCGFVVVSCVVDIGICPVVSAESWVVCINWCSYCLTKRIQEVHYGVGFLACYQSPEAWVS

SEQ ID NO: 126478 - protein, 384 aa, Glycine max
  Coding DNA Sequence Number=SeqID_9700
  Gene Ontology: Mol. function=phospholipid binding; Cellular component= coated pit; Biological process=endocytosis
  Homolog annotation: Hit_ID=Q9FRH3; Match level="QueryCoverage=99%, HitCoverage=99%, E-value=2e-69, Identity=37%"; Hit description =Putative clathrin assembly protein At1g25240
  Pfam annotation: Domain name=ANTH; Domain location=30-294; Score =146.9; E_value=5.3e-41; Accession=PF07651.6; Description=ANTH domain
MRLWIKASGALKDTYSIWIAKLSPSGPCRNPDLETVIIKATSHDEQCMDYKNVQRVFKWLRISPLYLKPLLYIVSMRMEKTRSWVVALKGLMLTHALFCFDLPAVQKMGRLPFDLSHFSDGHVNPNKAWVFNAFVRSYFAYLDQKSAFVRLEAMKGTKRGSKEKEETVMEELQGLEKLLGLIDLLLQIKPRNPNMNVVLVLEAMDCIMDEVLEVYDKFSVRVHRVVSMIIDIGGKEEARVGLDVVRKAELQGGKISMYFDFCRDIGVINVSECPEIVRIDEKDIHELLKIVRDGGVSKKENLEGDNNNAIVVYEGNNCRAITTILEQKQLDFKTVITDHWEVFDDVMDTSLPIATSANPFVDSLSIVPYIPVCNNHVLPDLIVL

SEQ ID NO: 126479 - protein, 205 aa, Glycine max
  Coding DNA Sequence Number=SeqID_9701
MEMMKLSCFLHKKQTISNQMSCYSMMWKFTSPQESEVPRTSLKTQHLIELLCCLSSILCNFIRHPFVTKEFNKLVKFFKYIRFPAILPVPQQQDDVGLTGSAYYAMQTLHRRIVYVEEITLLSKGMTFSHWKKQPKVFREKNVLTHSLCQVYSPITEMNASKISRHFDGKPWTLQNPLTEMRIFTFFACITNILHYLFIGFLICI

SEQ ID NO: 126480 - protein, 609 aa, Glycine max
  Coding DNA Sequence Number=SeqID_9702
  Gene Ontology: Mol. function=nucleic acid binding; Cellular component= mitochondrion; Biological process=metabolic process
  Homolog annotation: Hit_ID=Q1SZV4; Match level="QueryCoverage=73%, HitCoverage=57%, E-value=3e-28, Identity=22%"; Hit description =Pentatricopeptide repeat
  Pfam annotation: Domain name=PPR; Domain location=194-228; Score =14.8; E_value=0.13; Accession=PF01535.11; Description=PPR repeat
  Pfam annotation: Domain name=PPR; Domain location=229-263; Score =11.8; E_value=0.3; Accession=PF01535.11; Description=PPR repeat
  Pfam annotation: Domain name=PPR; Domain location=267-301; Score =10.8; E_value=0.39; Accession=PF01535.11; Description=PPR repeat
  Pfam annotation: Domain name=PPR; Domain location=336-370; Score =16.9; E_value=0.075; Accession=PF01535.11; Description=PPR repeat
  Pfam annotation: Domain name=PPR; Domain location=371-405; Score =10.9; E_value=0.39; Accession=PF01535.11; Description=PPR repeat
  Pfam annotation: Domain name=PPR; Domain location=406-440; Score =34.5; E_value=3.6e-07; Accession=PF01535.11; Description=PPR repeat
  Pfam annotation: Domain name=PPR; Domain location=441-475; Score =44.4; E_value=3.9e-10; Accession=PF01535.11; Description=PPR repeat
  Pfam annotation: Domain name=PPR; Domain location=476-510; Score =31.5; E_value=2.9e-06; Accession=PF01535.11; Description=PPR repeat
  Pfam annotation: Domain name=PPR; Domain location=511-545; Score =28.6; E_value=2.2e-05; Accession=PF01535.11; Description=PPR repeat
  Pfam annotation: Domain name=PPR; Domain location=546-580; Score =18.4; E_value=0.026; Accession=PF01535.11; Description=PPR repeat
  Pfam module annotation: Pfam domain module=PPR::PPR::PPR::PPR::PPR::PP R::PPR::PPR::PPR::PPR; Domain location=194-228::229-263::267-301::336- 370::371-405::406-440::441-475::476-510::511-545::546-580
  Subcellular localization annotation: CTP_CleavageSite=54; ConfidenceScore=5.27e-01
MNTQFCRTPPPHHVHAPIIPTCHFPSLHTVSPSHHHRRFFFFHANFSASPTPILEEEPSSSNTPTIIHVVDVNFAADVQKQYSKPEPENLNEFLCGLFEDPKTKELAFDYYQRLKERPEFRPEKPTLKHVIRYLVSLKSWGSILSVSEDFKVYHVLPDRATCSRLVKFCIEHRKFRVAESLLYVFKDDSKVAFLAFSSAMRSYNKLHMFRNTVLVFERMKSSNVVLDSRGYLHIMEAYSKLNECEKVVQLFREFESRKLRGSSYLAQIYVILCESLARHGRAFEALDFFTEMAKKGISEYSIYSKLIYSFASLREVVVAEELLREAKGKMTIKDPEVYLKLVHMYIEEGLLEKTLEVVKEMEDADVKVSDCILCTVVNGFSKKRGFLAAVKVFEELISKGYESGQVTYASVINAYWRLGQYSKAEEVFLEMEQKGFDKCVYAYSTMIVMYGRTGRVRSAMKLVAKMKERGCKPNVWIYNSLIDMHGRDKNLKQLEKLWKEMKRRRVAPDKVSYTSIIGAYSKAGEFETCVKFFNEYRMNGGLIDRAMAGIMVGVFSKVGLVDELVKLLQDMKAEGTRLDQRLYQSAWNAFKDAGLQIQARWMKESFLVT

SEQ ID NO: 126481 - protein, 439 aa, Glycine max
  Coding DNA Sequence Number=SeqID_9703
  Gene Ontology: Mol. function=RNA-directed DNA polymerase activity; Biological process=RNA-dependent DNA replication
GVNSLGIGQIGQLKAGWIGFLYLLNGSLNGVETAGFKINPLGRQFGIAGESASTRVGRLCIKRKIEVVETEIKGNQVEEGAAGRSLGDYALKRIHYEAKSKNKVMLGGGAKQSKGGSQTILYGKDEVRAAVCECGSFKSPGPNGLNFKFIKEFWDVWDPQNLNDYIPISLIGYIYKIVAKILARRLKKVMATIIDERQSAFIEGRHLLHNDLVSFNRALLGKWRWNLFQHTGALWAKVLESKYGGWRNLDEARRNHKEMWVADKVLERLVEGGQAAFDGKVPEMMLEGKMELAASFMEDIEDGYHLLNEVVADENCILQQQHHTIQQMGVEPNLQDRWIWKGDVSGLYLEGSRLHLLNEVVADENDDGAFTIIWKMKIPSKVAHFVRGLVRDRLPKRANLRRRNVILAWTETVTMFPASPKEHFLQHSYCKAPEIIQNR

SEQ ID NO: 126482 - protein, 166 aa, Glycine max
  Coding DNA Sequence Number=SeqID_9704
MRGGDKTPKPTSSHAKRSLQDHSKEEINTLELASIRLAYNTDHGLQNARTEHDIRKGTQRCQLQEDGCIRHRLTLWQTKDQDFRGQKCSLWKLFFAECERAIAGAEEEIGKAHVPLRQRKIFKWDSERGGKKEGDSLDVVKKAELQGGKISMYFDFCKDIEVINVS

SEQ ID NO: 126483 - protein, 54 aa, Glycine max
  Coding DNA Sequence Number=SeqID_9705
MGPAAKTRKKCFIILGEVDYIDHMTQSTLLKIKVYGYARKLAKIGIEEALVDLT

SEQ ID NO: 126484 - protein, 263 aa, Glycine max
  Coding DNA Sequence Number=SeqID_9706
  Homolog annotation: Hit_ID=Q7XHJ1; Match level="QueryCoverage=37%, HitCoverage=54%, E-value=2e-23, Identity=57%"; Hit description =Pheromone receptor-like protein
  Pfam annotation: Domain name=DUF1645; Domain location=82-245; Score =96.8; E_value=6.6e-26; Accession=PF07816.2; Description=Protein of unknown function (DUF1645)
  Subcellular localization annotation: CTP_CleavageSite=56; ConfidenceScore=5.77e-01
MEVVVAVPPPPPPSSSMDFNFDSNCSSPYITAPSSPQRFGNFFFSAPTSPTRRHSSASTPNTTQDEFEFDFSGHLQRPSLSAEELFLGGKIRPLKPLSPSSSRRREKRVIQESPPSQQRKLGKERASSFSVSSTTFSLGDKSNSSKTSESISNSSFLSSISFGKGYRKWRLKDFLLFRSASEGRASDKDPFRKYAVLSKTTAHEDVRNVSSGSVSRRRGPVSAHELHYTVNRAASVELKKKTLLPYKQGFLGCLAFNPAMHGS

SEQ ID NO: 126485 - protein, 854 aa, Glycine max
  Coding DNA Sequence Number=SeqID_9707
  Gene Ontology: Mol. function=transferase activity; Cellular component= mitochondrion; Biological process=metabolic process
  Homolog annotation: Hit_ID=Q8S5U6; Match level="QueryCoverage=72%, HitCoverage=95%, E-value=2e-87, Identity=30%"; Hit description =Putative indole-3-acetate beta-glucosyltransferase
  Pfam annotation: Domain name=PPR; Domain location=133-167; Score =12.6; E_value=0.24; Accession=PF01535.11; Description=PPR repeat
  Pfam annotation: Domain name=PPR; Domain location=173-207; Score=8.7; E_value=0.7; Accession=PF01535.11; Description=PPR repeat
  Pfam annotation: Domain name=PPR; Domain location=208-242; Score =39.2; E_value=1.5e-08; Accession=PF01535.11; Description=PPR repeat
  Pfam annotation: Domain name=PPR; Domain location=243-277; Score =37.0; E_value=6.6e-08; Accession=PF01535.11; Description=PPR repeat
  Pfam annotation: Domain name=PPR; Domain location=278-312; Score =46.1; E_value=1.2e-10; Accession=PF01535.11; Description=PPR repeat
  Pfam annotation: Domain name=PPR; Domain location=313-347; Score =48.1; E_value=2.9e-11; Accession=PF01535.11; Description=PPR repeat
  Pfam annotation: Domain name=PPR; Domain location=348-382; Score =54.2; E_value=4.5e-13; Accession=PF01535.11; Description=PPR repeat
  Pfam annotation: Domain name=PPR; Domain location=383-417; Score =50.6; E_value=5.2e-12; Accession=PF01535.11; Description=PPR repeat
  Pfam annotation: Domain name=PPR; Domain location=418-452; Score =48.4; E_value=2.4e-11; Accession=PF01535.11; Description=PPR repeat
  Pfam annotation: Domain name=PPR; Domain location=453-487; Score =44.0; E_value=5.1e-10; Accession=PF01535.11; Description=PPR repeat
  Pfam annotation: Domain name=PPR; Domain location=488-522; Score =48.4; E_value=2.4e-11; Accession=PF01535.11; Description=PPR repeat
  Pfam annotation: Domain name=PPR; Domain location=523-557; Score =52.0; E_value=1.9e-12; Accession=PF01535.11; Description=PPR repeat
  Pfam annotation: Domain name=PPR; Domain location=558-592; Score =19.0; E_value=0.017; Accession=PF01535.11; Description=PPR repeat
  Pfam annotation: Domain name=PPR; Domain location=608-642; Score =24.0; E_value=0.00054; Accession=PF01535.11; Description=PPR repeat
  Pfam annotation: Domain name=PPR; Domain location=643-677; Score =19.2; E_value=0.014; Accession=PF01535.11; Description=PPR repeat
  Pfam annotation: Domain name=PPR; Domain location=678-711; Score=1.4; E_value=5.1; Accession=PF01535.11; Description=PPR repeat
  Pfam annotation: Domain name=PPR; Domain location=713-747; Score =11.8; E_value=0.29; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR; Domain location=133-167::173-207::208-242::243-277::278-312::313-347::348 -382::383-417::...
  Pfam module annotation: Domain location=418-452::453-487::488 -522::523-557::558-592::608-642::643-677::678-711::713-747
  Subcellular localization annotation: CTP_CleavageSite=64; ConfidenceScore=5.57e-01
MAFPSSSSSSNHSLIADKAIAFLKRHPQRLASLSPHFTPQAASYVLLNSQSDQRTLLNFLTWAQAQAQAHNFFFTPHCKCLALHILVRFKLYRTAHSLAADLAATLPDPTGASLFRHLHDTFHLCSSPFSSSAVFDLVVKSLSRLGFVPKALTLLHLANRHGFAPTVLSYNAVLDALLRRSSSNHRDYDDAERVFRDMVRNGVSPNVYTYNVIIRGVVSQGDLEKGLGFMRKMEKEGISPNVVTYNTLIDASCKKKKVKEAMALLRAMAVGGVAANLISYNSVINGLCGKGRMSEVGELVEEMRGKGLVPDEVTYNTLVNGFCKEGNLHQGLVLLSEMVGKGLSPNVVTYTTLINCMCKAGNLSRAVEIFDQMRVRGLRPNERTYTTLIDGFCQKGLMNEAYKVLSEMIVSGFSPSVVTYNALVHGYCFLGRVQEAVGILRGMVERGLPPDVVSYSTVIAGFCRERELGKAFQMKEEMVEKGVLPDTVTYSSLIQGLCLQQKLVEAFDLFREMMRRGLPPDEVTYTSLINAYCVDGELSKALRLHDEMVQRGFLPDNVTYSVLINGLNKKARTKVAKRLLLKLFYEESVPDDVTYNTLIENCSNNEFKSVEGLVKGFCMKGLMNEADRVFKTMLQRNHKPNAAIYNLMIHGHSRGGNVHKAYNLYMELEHSSFACHTVAVIALVKALAREGMNDELSRLLQNILRSCRLNDAKVAKVLVEVNFKEGNMDAVLNVLTEMAKDGLLPDGGIHSSAPATPQLSKASFLARTELELIGDILKTVITKRDKAPLICCISPSGSEILCARMRFHGRVVAYSGRPPPALEGFGSYWFEKAIAEWENAGGKVAYRLELPEDS

SEQ ID NO: 126486 - protein, 443 aa, Glycine max
  Coding DNA Sequence Number=SeqID_9708
  Gene Ontology: Mol. function=DNA binding; Biological process =regulation of transcription
  Homolog annotation: Hit_ID=Q1EPE4; Match level="QueryCoverage=68%, HitCoverage=83%, E-value=7e-53, Identity=41%"; Hit description=Myb DNA-binding domain-containing protein
  Pfam annotation: Domain name=Myb_DNA-binding; Domain location=246 -297; Score=36.6; E_value=8.3e-08; Accession=PF00249.21; Description =Myb-like DNA-binding domain
MGLVVPEEELSLDLRPSFVPKTITDFLCHLSTTPNASHKVSLLDDFVHRLELELAKIQAFKRELPLCMFLLNDAISALKVESEKCRACKSEPVFEEFIPLKKECDQRKEIEKEKECRDKKNWMSSFQLWNNDDKADNNNNAYECDKKHNYRVENKNNGEKRKSVTKDLFQYGRIRNGEKGFVIPFSSYPATKEEKEDCVANGLSLQTPGTAVKSTREGSGCRTSSCRVGSSAPSPLHQPQSSRKQRRCWSPELHSRFIKALEVLGGSQAATPKQIRELMRVDGLTNDEVKSHLQKYRLHTQRVPVATAANFSRSAVDLGGLWMHNESLKGGSSGSPQGPLQLATQSGEATSQTEGDNMIDDDDEKLLQHLRWILEFHDLVVDLVNSSLDDLYLISCTCCIPLCQNRKGKLSSNSQFCSPVFSNSCEGGCEIRHPGQVQIYHAS

SEQ ID NO: 126487 - protein, 171 aa, Glycine max
  Coding DNA Sequence Number=SeqID_9709
  Gene Ontology: Mol. function=zinc ion binding
  Homolog annotation: Hit_ID=Q6Z6H7; Match level="QueryCoverage=86%, HitCoverage=31%, E-value=5e-16, Identity=36%"; Hit description =Armadillo/beta-catenin repeat protein-like
MAVKSFYELPLPLTHQGGHVSGNKNLGLMDEICKSIAEKGGIDAILRRIDDSGEQGNKAVAKVCCSLLSKLNDSFSCLIDKLAGSDANKSTIVGKGGLQFSYRNSKNGWTLDIMIVVEMWKGCNQGLQDYVYYFGDLAIQAMEKSREQANFNRLVSIGFVDFNVQTEAERT

SEQ ID NO: 126488 - protein, 68 aa, Glycine max
  Coding DNA Sequence Number=SeqID_9710
MLVSARQRACLPPVDERTTKGAGDDVSLCVSTGSFAPGRRKVRVTIRTTKGAGDDVSLCPSTGSFVPG

SEQ ID NO: 126489 - protein, 183 aa, Glycine max
  Coding DNA Sequence Number=SeqID_9711
  Homolog annotation: Hit_ID=Q1SWX1; Match level="QueryCoverage=100%, HitCoverage=42%, E-value=8e-15, Identity=27%"; Hit description=IMP dehydrogenase/GMP reductase
MGSSQAPWLKKRFYQVMIKSLGVASLKELGQLMGQLQRQAFRKAYGKIWDLTMVEVSTEAIASLAQYYDQPLRCFTFGDFQLLPTVEEFEEILGCPLGGRKSKCLEAKARTLASQDEWAPFMDVLALLIFGVVLFPNVDRLVDLAMIDAFLAFHDRKESPVVAILADLYDTFDRRCEKNSARI

SEQ ID NO: 126490 - protein, 78 aa, Glycine max
  Coding DNA Sequence Number=SeqID_9712
MTYVRIAPARHLVDPNKSNRVLGFPALIIGLCQFHGVPVTPSKVIRPPTNRAFIKKYCAPRQAQGETHNNLGMASSGQ

SEQ ID NO: 126491 - protein, 137 aa, Glycine max
  Coding DNA Sequence Number=SeqID_9713
  Gene Ontology: Mol. function=endonuclease activity
  Homolog annotation: Hit_ID=Q6ZHJ5; Match level="QueryCoverage=61%, HitCoverage=10%, E-value=9e-22, Identity=54%"; Hit description =Pentatricopeptide (PPR) repeat-containing protein-like
  Subcellular localization annotation: CTP_CleavageSite=46; ConfidenceScore=5.54e-01
MRSTFTLFRSLALSLPHLPWPRPFLFPRPRQFPRLAVTAPESEVLRSAEAEARGPEVEMEVLELSAVPEEWRRARVAWLCKELPAHKAGTLVRILNAQKKWMRQEDATYVLVHCLRVRENETAFKGEGKNLRLYSGL

SEQ ID NO: 126492 - protein, 359 aa, Glycine max
  Coding DNA Sequence Number=SeqID_9714
  Gene Ontology: Mol. function=endonuclease activity; Cellular component=mitochondrion; Biological process=embryonic development ending in seed dormancy
  Homolog annotation: Hit_ID=Q6ZHJ5; Match level="QueryCoverage=100%, HitCoverage=45%, E-value=1e-118, Identity=55%"; Hit description =Pentatricopeptide (PPR) repeat-containing protein-like
  Pfam annotation: Domain name=PPR; Domain location=12-46; Score=7.1; E_ value=1.1; Accession=PF01535.11; Description=PPR repeat
  Pfam annotation: Domain name=PPR; Domain location=164-198; Score =15.7; E_value=0.1; Accession=PF01535.11; Description=PPR repeat
  Pfam annotation: Domain name=PPR; Domain location=199-233; Score=4.3; E_value=2.3; Accession=PF01535.11; Description=PPR repeat
  Pfam annotation: Domain name=PPR; Domain location=234-268; Score =18.3; E_value=0.029; Accession=PF01535.11; Description=PPR repeat
  Pfam annotation: Domain name=PPR; Domain location=303-336; Score =11.1; E_value=0.36; Accession=PF01535.11; Description=PPR repeat
  Pfam module annotation: Pfam domain module=PPR::PPR::PPR::PPR::PPR; Domain location=12-46::164-198::199-233::234-268::303-336
MMQRNWYRFDFALATKLADYMGKERKFSKCREVFDDIINQGRVPSESTFHILVVAYLSAPVQGCLDEACSIYNRMIQLGGYQPRLSLHSSLFKALVSNPGILSKNYLKQAEFIYHHLVTTGLDVHKEIYGGLIWLHSYQDSIDKERIAELREAMLRAGFEEDREVLLSILRACAREGEVDEAEKTWVKLLKFESEPPALAFVYKMEVYSKVGMPMKSLDIFREMQSKLGRTDVAAYNQIIEILCKAQESELAESIMEDFVRSGLKPVTPSYVYLLSMYFTLELHDKLEEAFYQCLEKCRPNCTLYSIYLNSLVKIGNIDKAEDIFNQMNRDATIGVNARSCNIILSGYLSSGNHLKAEK

SEQ ID NO: 126493 - protein, 189 aa, Glycine max
  Coding DNA Sequence Number=SeqID_9715
  Homolog annotation: Hit_ID=UPI00006A17C9; Match level="QueryCoverage =68%, HitCoverage=100%, E-value=1e-10, Identity=30%"; Hit description= UPI00006A17C9 related cluster
GYTPSPWVLVTLTVERTTRPRLERTTRPHHQRAARPHHQRTACPRLERATRPHLGGLHVLTIRGLHALTSRGLHVLALRGLHTLTLGTSYPRLGRTTRPRQQRAARPHLQRTTCPRLERATRPHLGGLHALTFRGLHVLALRGLHALTLEGCTPSPPEDYMSSPLRGLHALTLGTSYPRLGRTTRPRQQ

SEQ ID NO: 126494 - protein, 246 aa, Glycine max
  Coding DNA Sequence Number=SeqID_9716
  Gene Ontology: Mol. function=protein binding; Cellular component =integral to membrane; Biological process=protein amino acid phosphorylation
  Homolog annotation: Hit_ID=Q1T435; Match level="QueryCoverage=93%, HitCoverage=26%, E-value=4e-34, Identity=39%"; Hit description =Leucine-rich repeat; Leucine-rich repeat, cysteine-containing type
  Pfam annotation: Domain name=LRR_1; Domain location=110-132; Score =13.6; E_value=0.72; Accession=PF00560.23; Description=Leucine Rich Repeat
  Pfam annotation: Domain name=LRR_1; Domain location=135-157; Score =9.5; E_value=4.7; Accession=PF00560.23; Description=Leucine Rich Repeat
  Pfam annotation: Domain name=LRR_1; Domain location=159-181; Score =10.6; E_value=2.9; Accession=PF00560.23; Description=Leucine Rich Repeat
  Pfam annotation: Domain name=LRR_1; Domain location=189-210; Score =18.3; E_value=0.027; Accession=PF00560.23; Description=Leucine Rich Repeat
  Pfam annotation: Domain name=LRR_1; Domain location=212-234; Score =13.5; E_value=0.78; Accession=PF00560.23; Description=Leucine Rich Repeat
  Pfam annotation: Domain name=LRR_1; Domain location=55-82; Score=6.5; E_value=18; Accession=PF00560.23; Description=Leucine Rich Repeat
  Pfam annotation: Domain name=LRR_1; Domain location=84-107; Score =5.2; E_value=30; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=110-132::135-157::159 -181::189-210::212-234::55-82::84-107
KLYLGRYSDDVGAPKIDDGDHWLSNLISLTHLSLYNISNLNTSHSFLQMIAKLPKLRELRLFDCSLSDHFILSLRPSKFNFSSSLSILDLSVNSFTSSMILQRLSNVTSNLVELDLSDNLLEGSTSNHFGHVMNSLEHLDLSSNIFKGEDLKSFANICTLHSLYMRENHLSEDLPSILHNLSSGCVKHSLQELDLSDNQITGSLTDLSVFSSLKSLFLDGNQLSGNIPEGISLPFHLKFLSIRSNS

SEQ ID NO: 126495 - protein, 111 aa, Glycine max
  Coding DNA Sequence Number=SeqID_9717
MEKMNVHIITKGTPKEQENDVGNDRDHDLAKGHLGAVAACPSELKLNPKAASQMLAWESWDLEKTRKRPFCLPFLVSFVFLIETPNGSLLCTITGAQHCKSTSKDQKINEQ

SEQ ID NO: 126496 - protein, 56 aa, Glycine max
  Coding DNA Sequence Number=SeqID_9718
  Homolog annotation: Hit_ID=Q9CA40; Match level="QueryCoverage=57%, HitCoverage=22%, E-value=3e-08, Identity=63%"; Hit description=Nudix hydrolase 1
MVDVDVVKEQVPQNLEPTKCDGWDWYEWDHLSHPLFGPLEKMDARKFVKRLIQKQH

SEQ ID NO: 126497 - protein, 113 aa, Glycine max
  Coding DNA Sequence Number=SeqID_9719
MKAQVEKDEGPEAETLSRLLIVAEGPSNPCGVYPDLSSFTGSGVYLDLSSFIGSGVYPDLSSFTGSGVYPDLSSFTGSGVIQISVACIKRYAPREVHITKLNNGSSQEICGIL

SEQ ID NO: 126498 - protein, 421 aa, Glycine max
  Coding DNA Sequence Number=SeqID_9720
  Gene Ontology: Mol. function=transporter activity; Cellular component= integral to membrane; Biological process=transport
  Homolog annotation: Hit_ID=Q65YW9; Match level="QueryCoverage=30%, HitCoverage=35%, E-value=1e-52, Identity=78%"; Hit description=FMNH2- dependent dimethyl sulfone monooxygenase
MASRVSDWYFTNGNTPQGVRQQVDDIRAKAAVNQHAVKIGLNGFVIARESEQEAQAVLQEIIAKANPDAVKGFQHEVKNAGSASPEGEGNWAKSSFEDLVQYNDGFKTNLIGTPQQIAERIMEQKRAGVDLLLLAFLHFHEEVEFFGREVIPRIARSRPASSAIAICSALTANSISSGSCQLPLTSCSMPKHSGPSAASPYPTHCAMPESFEAWRWSRQQAGHRDEDRQRSQQPDQTLIAQLLQRPHTGQIGGDRHDLIDEQHAARLELTNAIILCERGKPANQGIKQQRLAGHEQRNLPADRGTPRRTRYGDLCRALLKRRGIFQLWQPRQQRDQRRNQPDRQRQTPAGAAQFGQRHGHAGGDAGGDAHGHGIQPDITRGVRGVIPLNQRRQQDVGRRDPAAENQRTQPQCRFAAADSQQ

SEQ ID NO: 126499 - protein, 408 aa, Glycine max
  Coding DNA Sequence Number=SeqID_9721
  Gene Ontology: Mol. function=transferase activity, transferring hexosyl groups; Biological process=carbohydrate metabolic process
  Homolog annotation: Hit_ID=Q2VJ73; Match level="QueryCoverage=73%, HitCoverage=70%, E-value=1e-166, Identity=97%"; Hit description =Zeaxanthin glucosyl transferase
MLCRELPAVLKRLQVDGVIADQMEAAGGLVAEALRLPFVSVACALPVNREAAIPLAVMPFRFAQDEKALQRYQASSDIYDRIMRRHGAVIARHARTFGLPERHGLHQCLSPLAQISQLVPAFDFPRQQLPACYHSVGPLRTPVASGALAAPWPALRQPVVYASLGTLQGHRFRLFLHLAQACRNQQLSLVVAHCGGLTANQAHQLRLAGAAWVTDFVDQRAALQHAQLFITHAGLNSALEALECGTPMLALPIAFDQPGVAARIEWHGVGRRASRFSRVAQLEQHLQQLLSDDRYRLRICSPHLRFCYWRVRRSRLAIIPGRSIAKTSAKRSSAGSNRCFRRAGPVIRYASPPCVASWMVNIARLPRRILPGTCSRCSVPRYAPQRRSARSHPPGSDWRMAGCYRRRR

SEQ ID NO: 126500 - protein, 78 aa, Glycine max
  Coding DNA Sequence Number=SeqID_9722
MTMLVSACYQTLSLTDSKRVFVRITAWKSFCMDNHLGISAYHLTSRVRIAKGGAVDKSEAFAPTYPQFLMRNSDLRSS

SEQ ID NO: 126501 - protein, 276 aa, Glycine max
  Coding DNA Sequence Number=SeqID_9723
MAFLGETSSQTIVNSRLAFIYPNGSIIHNDTGVYFQTSTPVPIRVPNRCDFASLKTRIHNTLQLSDKQFLDEIHYRKPFTDTGNQIRFECIKLINDDDVNTMLMCNDQFSCVGPIELLCTVGRTPDGIINLLERTMPRIHDAILYYNGKWNMPPQNKFVRCAFTGKNPKKFQIPSTCTIDELKNLIKQVAPKGIPPLGIHESQTVRRLFFRQPAHLEYSDTLIKYDINELRTNEELLKVLVQSNYWKKYGPIEILAVFAKYVVTIEDEVTGTSLNN

SEQ ID NO: 126502 - protein, 283 aa, Glycine max
  Coding DNA Sequence Number=SeqID_9724
  Gene Ontology: Mol. function=protein dimerization activity
  Homolog annotation: Hit_ID=O81190; Match level="QueryCoverage=75%, HitCoverage=34%, E-value=7e-20, Identity=26%"; Hit description =Putative transposase
  Pfam annotation: Domain name=hATC; Domain location=123-200; Score =14.8; E_value=0.0009; Accession=PF05699.5; Description=hAT family dimerisation domain
MFVSYEWTNNKLSKEKAKGKEATKTILMPALWNNVLYILKVMAPFVKVLRLVDSEKKPAMGYIYEAKEKTKEAIIKSFEYNERSIRKSLKLLTMGGLANFITPCMQLVVNGLCVCIKKFVLDEEVRQKILTKLQAHKMGGAQWWRSYGLSTPNLQQLAIKIFRLTCSALGCECNWSVFEQKRNSLEHKRLHKLVYAKYNQALVKKYNYRDEIDPISLNDIDECNEWLVGQMDGDDENDDGLPWDVVLEASGIGQPMTYTRQRTKKRNEPLGVEDAAPKTKEVK

SEQ ID NO: 126503 - protein, 356 aa, Glycine max
  Coding DNA Sequence Number=SeqID_9725
  Gene Ontology: Mol. function=RNA-directed DNA polymerase activity; Biological process=RNA-dependent DNA replication
  Homolog annotation: Hit_ID=Q8H6Q8; Match level="QueryCoverage=99%, HitCoverage=47%, E-value=2e-30, Identity=33%"; Hit description=CTV.20
MPIERSIEFANKFPNQILDKTQLQRFLGCLNYVGEFVPYLNNIVKPLHDRLKKNPPPWSDLHTQTVKEIKVKVQSIKCMYLPIPQAFKIVETDASDIGIRNLPKGRKEYRQRSQTGSSRANHQEIITSSGSPTQAGSSTQKTNLEGSSTQISSIKPEPSTQESPKPATAKQTSADYAWPTETLQALQDMGLTKFPKIIKKSWADIASESDDESESNLQTMIQNASMIKTVTNTKGKLPLAKAQTPPTKQTNNYIYKNKFTTVLQMEPEFWDKNPFKATAKAFPPGFHYKPTTVLKTRTFYELILVDSNSVSIKHFKDPKDQTLNTHSTIQILKVLQPRHFGSDLNKGKRFSVPFDP

SEQ ID NO: 126504 - protein, 100 aa, Glycine max
  Coding DNA Sequence Number=SeqID_9726
  Subcellular localization annotation: CTP_CleavageSite=33; ConfidenceScore=5.23e-01
MLRTAPFSLFIGKRGRRLPPSSPGRAGRQPPPPFSYKKAEGGCSKDPSAPWLCISAVLGEKNCFREENPSRGASVTLPRCFRKQIREGFRPFFIRSSFFN

SEQ ID NO: 126505 - protein, 40 aa, Glycine max
  Coding DNA Sequence Number=SeqID_9727
MKHCICNYGHNPRRKGRKSYSFSMPLSKLSTVAGPHVFGV

SEQ ID NO: 126506 - protein, 98 aa, Glycine max
  Coding DNA Sequence Number=SeqID_9728
  Gene Ontology: Mol. function=nucleoside-triphosphatase activity; Cellular component=membrane; Biological process=protein catabolic process
  Homolog annotation: Hit_ID=Q1SX89; Match level="QueryCoverage=91%, HitCoverage=17%, E-value=4e-33, Identity=61%"; Hit description=DNA repair protein RadA; Peptidase M41, FtsH
  Subcellular localization annotation: CTP_CleavageSite=39; ConfidenceScore=5.20e-01
MTFFPLSQRFTHLGGKLPKGVLLAGPPGTGNTMVRNLFSAARKRAPAIIFIDEIDVIGGKRNAKDQMYMKMTLSQLQVELDGFMQNEGIIVIGATNFP

SEQ ID NO: 126507 - protein, 237 aa, Glycine max
  Coding DNA Sequence Number=SeqID_9729
  Gene Ontology: Mol. function=hydrolase activity
  Homolog annotation: Hit_ID=Q9AWW1; Match level="QueryCoverage=86%, HitCoverage=63%, E-value=5e-56, Identity=50%"; Hit description =Esterase/lipase/thioesterase family protein-like
  Pfam annotation: Domain name=Abhydrolase_1; Domain location=2-208; Score=-11.8; E_value=0.065; Accession=PF00561.10; Description =alphabeta hydrolase fold
  Pfam annotation: Domain name=BAAT_C; Domain location=40-216; Score= -85.9; E_value=0.073; Accession=PF08840.1; Description=BAAT  Acyl-CoA thioester hydrolase C t
  Pfam annotation: Domain name=Peptidase_S9; Domain location=4-217; Score=-55.0; E_value=0.001; Accession=PF00326.11; Description=Prolyl oligopeptidase family
  Pfam module annotation: Pfam domain module=Abhydrolase_1::BAAT _C::Peptidase_S9; Domain location=2-208::40-216::4-217
MALLVLTSLANTNNRDMSCPIPQQNFKGGESEGSFQYGNYYREAEDLRAVVQHFCEQKYAIKAIVGHSKGGNVVLLYASKYKDIHIVVNISGRFNLARGMEGRLGKKFIQRIKQDGYIDVKNKRGKIMYRVTEESLMDRLSTITHLACLLIPQDCSVLTIHGSMDEIVPAEDALEFAKFISNHELCFIEGADHEYTYHQDELTSLVLEFIKIHIDKDKDTSKQARFGRVHKPIHSRL

SEQ ID NO: 126508 - protein, 242 aa, Glycine max
  Coding DNA Sequence Number=SeqID_9730
  Gene Ontology: Mol. function=nucleoside-triphosphatase activity; Cellular component=membrane; Biological process=protein catabolic process
  Homolog annotation: Hit_ID=Q1SX89; Match level="QueryCoverage=79%, HitCoverage=28%, E-value=3e-70, Identity=70%"; Hit description=DNA repair protein RadA; Peptidase M41, FtsH
  Pfam annotation: Domain name=Peptidase_M41; Domain location=81-240; Score=176.3; E_value=7.7e-50; Accession=PF01434.8; Description =Peptidase family M41
MAYDAFFRVTCFFLWAMIGNPLDTFVYELTPIYFEVYVLKVDDVDLMIIARVTPGFSGADLANLINIAAIKAAMDGAKAVSMADLEHARDKIRMGSERKSAVISEESRKLTAFHEGGHALVAIHTDGAFPVHKATVVPSGMALGMVTQLPDKDQTSISRKQMLADLDVCMGENEVTSGASSDLREATSLAREMVTEYGMGNEVGLVTHDYEDDGRSMSSETRLLVEKEVFSVGGTQLMHLGV

SEQ ID NO: 126509 - protein, 89 aa, Glycine max
  Coding DNA Sequence Number=SeqID_9731
  Homolog annotation: Hit_ID=Q1T3J8; Match level="QueryCoverage=55%, HitCoverage=9%, E-value=3e-09, Identity=56%"; Hit description =Leucine-rich repeat, typical subtype
  Subcellular localization annotation: CTP_CleavageSite=39; ConfidenceScore=5.24e-01
MRFSLSKLKFSIASESNRFSRSPIDGWTSNKFVHPERSSSSSFGTLEKSGVSIRYLELPISIIFRHENFCGEKWWPIIADTVHEGLLVA

SEQ ID NO: 126510 - protein, 73 aa, Glycine max
  Coding DNA Sequence Number=SeqID_9732
MVEDEIEGDATKQYSLLWRYNQNPNFQHYPTAFVVVETETKDSWRWFLTCMLEDIGIEKKGLANVCQEMFDNV

SEQ ID NO: 126511 - protein, 189 aa, Glycine max
  Coding DNA Sequence Number=SeqID_9733
  Gene Ontology: Mol. function=hydrolase activity, hydrolyzing O -glycosyl compounds; Cellular component=chloroplast; Biological process=carbohydrate metabolic process
  Homolog annotation: Hit_ID=Q1SWW1; Match level="QueryCoverage=94%, HitCoverage=40%, E-value=4e-64, Identity=58%"; Hit description =Glycoside hydrolase, family 1
  Pfam annotation: Domain name=Glyco_hydro_1; Domain location=1-186; Score=-162.2; E_value=1.5e-10; Accession=PF00232.9; Description =Glycosyl hydrolase family 1
HARPVIFGDYPESMKSSVGSRLPKFTKAQSEGLKSSIDFLGVNYYTTYYAENAAPTDLDWLYIYPKGIHLLMVHIKDKYKNPNIYVNENGIAEARNDSIPVDEALNDGIRIRYLKSHLRLLLQAIKEGVNVKGYYAWSFSDSFEWDAGYTVRFGHVYVDYNNNLKRYLKSSAFWLKKFLLNDNNKVLSY

SEQ ID NO: 126512 - protein, 173 aa, Glycine max
  Coding DNA Sequence Number=SeqID_9734
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1SWW1; Match level="QueryCoverage=96%, HitCoverage=32%, E-value=1e-71, Identity=72%"; Hit description =Glycoside hydrolase, family 1
  Pfam annotation: Domain name=Glyco_hydro_1; Domain location=1-173; Score=-165.3; E_value=2.1e-10; Accession=PF00232.9; Description =Glycosyl hydrolase family 1
MLQSDIKLVKDIGLDSFRFSISWTRIFPKGKGAVNGLGVEFYNNLIDEVLSNDLKPFVTLFHWDFPQALEDEYGGFRSSNVVEDFRKYADFCYKTFGDRVKHWVTINEPLSYSINGYNGGTFAPSRCSKYVANCSAGDSSIEPYIVGHYLLLAHEAAATLYKKKYQVYFKHIF

SEQ ID NO: 126513 - protein, 89 aa, Glycine max
  Coding DNA Sequence Number=SeqID_9735
MDPLEREALEAVMLQSVIEASLVEVNDDIIEIDLCAALVPLKPIFDKENVDIGTYILHPEMQQLELEKLNLTNIAKYASNVPNDSKIES

SEQ ID NO: 126514 - protein, 264 aa, Glycine max
  Coding DNA Sequence Number=SeqID_9736
  Gene Ontology: Mol. function=oxidoreductase activity, acting on paired donors, with oxidation of a pair of donors resulting in the reduction of molecular oxygen to two molecules of water; Cellular component=membrane; ...
  Gene Ontology: Cellular component=Biological process=fatty acid biosynthetic process
  Homolog annotation: Hit_ID=Q84KG7; Match level="QueryCoverage=99%, HitCoverage=86%, E-value=6e-45, Identity=52%"; Hit description =Sphingolipid delta-8 desaturase
  Subcellular localization annotation: CTP_CleavageSite=54; ConfidenceScore=5.08e-01
MAQSSSNGTVAAGETDGAPPETASRRETSPSKESSPHQESLWSASRTNRRRSVALESGSEGVEKARGDDEEGQMLEIGVEVEAVACNVVGVVVPLPPADADSGEDIAGENLDCSVEAGVEHDIHVHARAVREQDSTEGEREKDEYKGEEDGSGVALAVEEVERGEVGEELAVVGGGGGDGVVREEVGGGEGGEEEGGGVRGVQGEEGVSGVGAGEAEEGEGAAGVAVEPGGDVVDLAVDGDPGVVARVVLAELIGGNVGCGRVH

SEQ ID NO: 126515 - protein, 157 aa, Glycine max
  Coding DNA Sequence Number=SeqID_9737
MVPSRFPRTWFGRLLTLMDEGDLSGASCGFAVIDGLMEVHWGLANLLLEMGKKETTDTCHMWFSNAQHFMLENEIPMKKLGNKLVLRHGNKLVEWDLLACLSYIRDVYNGIRASMTKCLEFNSCCSHYSNEKEGSLMCLLVSMIYRSTRSSMMFVIS

SEQ ID NO: 126516 - protein, 84 aa, Glycine max
  Coding DNA Sequence Number=SeqID_9738
MAKVAVAFLLTKDKADSGSDIESGASLFRVALRFEGLISKGGCLLGFLVKTKGLGLDEGGLSFLLVYSGNFSTMLIFTKVTHFN

SEQ ID NO: 126517 - protein, 252 aa, Glycine max
  Coding DNA Sequence Number=SeqID_9739
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1SWW1; Match level="QueryCoverage=98%, HitCoverage=49%, E-value=1e-100, Identity=67%"; Hit description =Glycoside hydrolase, family 1
  Pfam annotation: Domain name=Glyco_hydro_1; Domain location=1-250; Score=-36.8; E_value=7.5e-17; Accession=PF00232.9; Description =Glycosyl hydrolase family 1
MNHKILHSARQKGQIGITNPTHYFLPKSQSAADYKAASRALDFFFGWYSDPVFYGDYPESMKSSVGSRLPKFTKAESEGLKNSIDFLGVNYYTTYYAEHAEPVSANRTFYTDILASLSSKYLWQNQTDLNWLFIFPKGIHLLMAHIKDKYKNLPIYITENGMAESRNDSIPVNEARKDSIRIRYHDGHLKFLLQAIKEGVNLKGYYAWSFSDSFEWDAGYTVRFGLIYVDYKNNLKRYPKFSAFWLQKFLLK

SEQ ID NO: 126518 - protein, 90 aa, Glycine max
  Coding DNA Sequence Number=SeqID_9740
  Gene Ontology: Mol. function=ATP binding
  Homolog annotation: Hit_ID=Q9FI52; Match level="QueryCoverage=50%, HitCoverage=14%, E-value=3e-19, Identity=86%"; Hit description =Nucleotide-binding protein
MENADIPENANEHCPGPQSESAGKSDACEGCPNQQICATAPKGPDPAREVSKSFPPQSRCLQHCIEEHSATALHPSVFCHSSLYVFLISV

SEQ ID NO: 126519 - protein, 69 aa, Glycine max
  Coding DNA Sequence Number=SeqID_9741
MALHCGLCKNRNRGALRVTESYCVADVASLVYDKLESKEKLCRRHLRFFGDVYEKSEEFKILWNSIVNN

SEQ ID NO: 126520 - protein, 69 aa, Glycine max
  Coding DNA Sequence Number=SeqID_9742
MHKGEKMKNKKVAMAGVSLSEACALSENHSLSKALSPLSELGESGGESAKHSLTLSAPSSLSGKSLTRA

SEQ ID NO: 126521 - protein, 64 aa, Glycine max
  Coding DNA Sequence Number=SeqID_9743
  Homolog annotation: Hit_ID=Q1T6B2; Match level="QueryCoverage=76%, HitCoverage=6%, E-value=2e-20, Identity=96%"; Hit description =Exocyst complex component Sec6
MWQRNLIGECLQPNEAVHQTVSVIFEDPGVQELLVKLYQKEWSEGQVTEYLVATFGDYFGDVKM

SEQ ID NO: 126522 - protein, 48 aa, Glycine max
  Coding DNA Sequence Number=SeqID_9744
MRESWEDSPDRSAWYGQVSITAVNGKWSPTAEAKQPPSCNGGLCSGQD

SEQ ID NO: 126523 - protein, 60 aa, Glycine max
  Coding DNA Sequence Number=SeqID_9745
MIDGGVDAKRVVAAEEVETAEGFELWILLTQRKGVVQQIKNQKCQMLTKGEEPVELRRPR

SEQ ID NO: 126524 - protein, 71 aa, Glycine max
  Coding DNA Sequence Number=SeqID_9746
MVRNSGRKTWWSIHMLVRCNSQHSYKVRVGLKVLTDLSGQCRLSRNFIEIKRACGKRTSGMWIHAYLAPAA

SEQ ID NO: 126525 - protein, 58 aa, Glycine max
  Coding DNA Sequence Number=SeqID_9747
MELSNSTIEALPQNYAEQYKREIFIDERKDDEPKLYSRPTIQPWQLYSRHLPTLLIAA

SEQ ID NO: 126526 - protein, 69 aa, Glycine max
  Coding DNA Sequence Number=SeqID_9748
KVSSSEEDPEEDPKEIPPEPAVDALDFPKGDEDPLPEVDSPEDVMSASEADSTEESGPGGIATSGGSSS

SEQ ID NO: 126527 - protein, 281 aa, Glycine max
  Coding DNA Sequence Number=SeqID_9749
  Gene Ontology: Mol. function=nucleic acid binding; Biological process= DNA integration
  Homolog annotation: Hit_ID=Q1RWN2; Match level="QueryCoverage=55%, HitCoverage=12%, E-value=8e-35, Identity=45%"; Hit description =Peptidase S8 and S53, subtilisin, kexin, sedolisin; Integrase, catalytic region; Zinc finger, CCHC-type
MSSEGYFVQPTIPRFDDHYDHWSMLMENFLQSKEYWHIFESGVETSNADVALTETQQKELEGLKLKDLKVKNYLFQVIDRSILETILCKETSKDIWDSIKKKYEGSNRIKRAQLQALRKEFEMLHMKNDESSSLLAHEQKMNQDTIIEEQALKASTSSRGRGKGIERSGRGRGRGNQNNNSGRGDQNNNGGRGHRVSTKLPKFGQGIPGQVHEQPNSETGPVMPSDLGWIYPTGRAKPDGDKTPKTQQEKPPQGACIHHTWNVYHGDLENESPTTMVDLLR

SEQ ID NO: 126528 - protein, 127 aa, Glycine max
  Coding DNA Sequence Number=SeqID_9750
  Gene Ontology: Mol. function=DNA binding; Biological process=DNA integration
MFLKDKDHERNHERREKEVENAAIPEKPLKHVKETFHSKLDSKLYKRKAEKRYNNRVKPRSFLTSDLVLRKYGGSEKDPSEGKLAATWEGPFRDTKVLENEAYQLEHLSDKAIPRTWNITHLKFYYS

SEQ ID NO: 126529 - protein, 120 aa, Glycine max
  Coding DNA Sequence Number=SeqID_9751
MTHAACIQVALILPMGLAFLLIDTTSRTGVFQIVEEIGIQRSVAGVHACCMLCSFCRVSVLMVSSSSCSSNMSINSGCVDGDLLWMQDKHVSQHIWNEEEDKKLHIRRVVPTYQGQEEIP

SEQ ID NO: 126530 - protein, 121 aa, Glycine max
  Coding DNA Sequence Number=SeqID_9752
  Gene Ontology: Mol. function=metal ion transporter activity; Cellular component=integral to membrane; Biological process=metal ion transport
  Homolog annotation: Hit_ID=Q6VM17; Match level="QueryCoverage=94%, HitCoverage=31%, E-value=5e-25, Identity=51%"; Hit description=Metal transport protein
MPRFRGIAIPLVGKSRRFLLSDADVFAAAKAFAAGVILATGFVHMLRDSWDALKDPCLGTDSRAWAKFPFTGFFAMVSTLFTLFVDFVATEYYEYREARGRVEHGKVVDYEGSDEATLLET

SEQ ID NO: 126531 - protein, 248 aa, Glycine max
  Coding DNA Sequence Number=SeqID_9753
  Gene Ontology: Mol. function=sequence-specific DNA binding; Cellular component=nucleus; Biological process=regulation of transcription, DNA-dependent
  Homolog annotation: Hit_ID=Q9SZI6; Match level="QueryCoverage=68%, HitCoverage=53%, E-value=3e-22, Identity=38%"; Hit description =Putative GATA transcription factor 20
  Pfam annotation: Domain name=GATA; Domain location=112-147; Score =66.8; E_value=7.2e-17; Accession=PF00320.17; Description=GATA zinc finger
MILHDGSSSNCNSSFNISPETVVMVDPLSSACDRRNLPSEEESKNNDHGSGNKWMSSKMRLMKKMMRPSISPTTDKAINSSPRFQNHQGLESRRYSQRSPRNNNGSSTPRVCSDCNTSTTPLWRTGPKGPKSLCNACGIRQRKARRAMAEAANGLVTPIACEKTRLHNKEKKSRMNHFAQFKNKYKSTTTTTTTTVGSSEGVRKLEYFNNFAISLRSNNSDFEQMFPRDEVAEAALLLMDLSCGFVHL

SEQ ID NO: 126532 - protein, 807 aa, Glycine max
  Coding DNA Sequence Number=SeqID_9754
  Homolog annotation: Hit_ID=Q84UR3; Match level="QueryCoverage=99%, HitCoverage=99%, E-value=0.0, Identity=47%"; Hit description=Proline- rich protein family-like
  Subcellular localization annotation: CTP_CleavageSite=51; ConfidenceScore=5.03e-01
MREENPSENRSKASKFSDQNQAPKPQNTKGANPNNNSRTRLWGAHIVKGFSADKKTKPLASKKLTSSTTTTISENVVTNQNNNKPFVPSSNSRVKRSLIGDLSCSINPAQVHPHAFPTHRRQSSTDLFTELDHMRGLLQESKERESKLNAELAECRKKVSEVDEVMKRVDLLEQEKAILTEQLGALTCEEVKGEEEQHKEVKVQNLELEVVELRRLNKELQMQKRNLSCRLSSLDAQLACPNKSSEILNFRNSPNVWGSEFGAAVVFVLVADSCGLSDVVAKIKAEASLLRLTNEDLCKQVEGLQISRLNEVEELAYLRWVNSCLRNELKNTCSALNSDKPSSPHSVVSSSGDCVSSFSDQATRYSNCGSENRFNMVKKPKKWPITSDHLSQVEFQGSLIRKNWIESDVGGSPRRRHSISGSNYSEEEVVLSKRRQSDCFVCSKEMEKESVPLSVQQSGLEIVQRPQHFGNFQEANKLLVSSDVEKRALRIPNPPPRPSCSISSKTKQETSAQVPPPPPPPPPPPPMNSASRSNTTMVKREPQVVELYHSLMKRDSRKDSSNGGLSDAPDVADVRSSMIGEIENRSSHLLAIKADIETQGEFVNSLIREVNNAVYQNIDDVVAFVKWLDDELCFLVDERAVLKHFDWPEKKADTLREAAFGYQDLKKLESEVSSYKDDPRLPCDIVLKKMVALSEKMERTVYNLLRTRDLLMRHCKEFKIPIEWMLDNGIIGKIKLSSVKLAKKYMKRVAVELQAKSALEKDPAMDYMLLQGVRFAFRIHQFAGGFDAETMHAFEELRNLASLLNKT

SEQ ID NO: 126533 - protein, 163 aa, Glycine max
  Coding DNA Sequence Number=SeqID_9755
  Subcellular localization annotation: CTP_CleavageSite=32; ConfidenceScore=5.05e-01
MASSRGMFTSTFLKVFKISFSASSIFLFGIALGGKGRGIRGYYSEWRLLSLAEIAYSGWSFVSLTLLRKVEEEPQLLVVFVVTDAIVVAVLEEEHMACLDQQHSGKEEQTVVVVEDLSISNLDDSSNLDCIYCLKGHNYSAIVGFAAEEVYYKCLQHKLHVAH

SEQ ID NO: 126534 - protein, 372 aa, Glycine max
  Coding DNA Sequence Number=SeqID_9756
  Gene Ontology: Mol. function=protein serine/threonine kinase activity; Cellular component=membrane; Biological process=protein amino acid phosphorylation
  Homolog annotation: Hit_ID=Q9LYI8; Match level="QueryCoverage=83%, HitCoverage=41%, E-value=6e-77, Identity=46%"; Hit description=MAP3K delta-1 protein kinase
  Subcellular localization annotation: CTP_CleavageSite=57; ConfidenceScore=5.34e-01
MKHLLRKLHIGGGAATINPSPNHNALSSHAHNHTPPPSTSTLPSPSVVSDRSPVVVEAQNEVADFNLLQEEEFQMQLALAISASDSDRRDTAESAQIDAAKQISLGYSASLTDTHALVQFQSLRYWNYNVIGYDEKVMDGFYDVYGVTSNLVERGKMPLLVDLQTASVSGDVDCEVILVNHVVDLELNHLERKACSLVEECCVSELGLVLSGLLQKLADVVVNRMGGPVVNAEKLTKMWAMRGRELRDSMQTIVLPLGCLDVGLSRHRALLFKVLADRINIPCMLVKGSYYTGTDDGAVNLIKADDGSWYICSIELETLHCTFTLHHHGDPDFRGRVSKINFTSLFPFFLLLLLCKTLRLLCDEEAGPPLCN

SEQ ID NO: 126535 - protein, 141 aa, Glycine max
  Coding DNA Sequence Number=SeqID_9757
MTCPLDESISCFHIKVDPWVLVPITFRGLYVLAIRGLHILACRGLHALAFRGLRVLIFSVLYIHTLGEYKQYSAQRPQCQSPPANVSVGLCRHDIGKDHAHKTPSGPKEVQQGPGVSSFGYGPLSILPGCPSPQRVHAIVT

SEQ ID NO: 126536 - protein, 71 aa, Glycine max
  Coding DNA Sequence Number=SeqID_9758
MSNCEIWLTRQGILDLPQEVMELVVIMEGITKMFQKAQKLQEIVLLFWCLDDLRHEVFKALVISKNDKRIA

SEQ ID NO: 126537 - protein, 174 aa, Glycine max
  Coding DNA Sequence Number=SeqID_9759
  Gene Ontology: Mol. function=chromatin binding; Cellular component =chromatin; Biological process=chromatin assembly or disassembly
  Homolog annotation: Hit_ID=Q1SAV4; Match level="QueryCoverage=78%, HitCoverage=48%, E-value=2e-29, Identity=38%"; Hit description =Integrase, catalytic region
MVVNRFTKGAHFGALPSTYTTHKVALLFMDIVCKFHGFPRSLVSDHDLWFTFLSLVEWSYNTVVHFATGMSLFEATYGETPPSIPKYLDGSSQVKAVDVIMSTRAQLHFDLQRHLSKAQDAMKRLADSHHHEVVYVVGTLGVCAASPILPNPLLDPFTLNSPNLFMAIFAFRSV

SEQ ID NO: 126538 - protein, 106 aa, Glycine max
  Coding DNA Sequence Number=SeqID_9760
  Subcellular localization annotation: CTP_CleavageSite=23; ConfidenceScore=5.03e-01
MVASDGTSSGWWQRDWRCQRWSVAGLVVTERRTRGVNHRSKGLQKEFATTKRQRQVPTPLPPLSFSCSMQWSEWNRILGSEEVIVIDPQGMYRRNYSGLCENAEGC

SEQ ID NO: 126539 - protein, 220 aa, Glycine max
  Coding DNA Sequence Number=SeqID_9761
  Gene Ontology: Mol. function=RNA-directed DNA polymerase activity; Cellular component=chromatin; Biological process=one-carbon compound metabolic process
  Subcellular localization annotation: CTP_CleavageSite=17; ConfidenceScore=5.11e-01
MSSKKTTTNLLRYNFSKSFMVAQKPCGFGGTLVGSPVLRNKKRYPIHPRVYRWLEWGKCGCGGIWDTREVVQSILEKGGHNEREYGESKLLEFALDAELGGLKLGANTTVDKSTTIANHDLKGINGSGRKSQEIRSPSLHQIVGTPTIYQYHNLVMINVPINAKRCRGKHVKHRVKAELRGDEKMEARFTSMANYPFIIAVITEASVSTIGQFFGSKTLD

SEQ ID NO: 126540 - protein, 112 aa, Glycine max
  Coding DNA Sequence Number=SeqID_9762
MGGHGSREGKRRKWVNVNSCVAAMEFQGRNKIQIGLISWLWRSSDDEGGGDNTGSVEMMQELIRDLWGWFEGFWRSNNGSVKLVEELVKDRWGGLGGFGEVAIATSFFLFLF

SEQ ID NO: 126541 - protein, 271 aa, Glycine max
  Coding DNA Sequence Number=SeqID_9763
  Gene Ontology: Mol. function=phospholipase C activity; Cellular component=outer membrane-bounded periplasmic space; Biological process=intracellular signaling cascade
  Homolog annotation: Hit_ID=Q1XLA9; Match level="QueryCoverage=99%, HitCoverage=75%, E-value=1e-83, Identity=57%"; Hit description =Hypothetical protein precursor
MKKAAVFLLSLSPYFLLWAQRQNLDDGKMNEIQVIGSHNSYKKAILPEVYDFLAKKDSLHSLPKIQYEHIAIPEQLDLGLRNLELDVYADSKGGKYAHPKILDLVKTKQPFDPEGKMKKPGYKMIHITDIDYQTWYYTLEECLKDLKKWSDAHPDHDPIFITLEPKDGRANTFGTEPEHYTSQLFDDLDNELKKYLGKNKIITPDDIRGSYTTLNEAVLHKNWPTVKNAKGKFLFVLDNNGENRDLYIKGHASLSGRMIFTNSVPGTPEAA

SEQ ID NO: 126542 - protein, 141 aa, Glycine max
  Coding DNA Sequence Number=SeqID_9764
MDISKDTDIPVIMGRPFMLTASCIVDMGKRKLELGFEDQKIDFDLFVEDKLAPEHNVCLWVMGEGQEVLKVRNKTGARRPRARPVEVPSTSAAPHPTSTSAVPPPARMTTTPSTLPLVDFQRFEAMLRSIHQGQSILLQSL

SEQ ID NO: 126543 - protein, 104 aa, Glycine max
  Coding DNA Sequence Number=SeqID_9765
  Homolog annotation: Hit_ID=Q5U8L6; Match level="QueryCoverage=41%, HitCoverage=17%, E-value=3e-11, Identity=72%"; Hit description =AP2/EREBP transcription factor ERF-2
MEEQESDRWILSVKLILIRGGWFLELVVSKPRKSEKGSSSDHSSCAARLRPRFTPMKSEMIAPPHIVFRLLMAYTVPGPPKRLIDQTVESEGLGDVAGFGWLGG

SEQ ID NO: 126544 - protein, 967 aa, Glycine max
  Coding DNA Sequence Number=SeqID_9766
  Gene Ontology: Mol. function=phospholipase D activity; Cellular component=plasma membrane; Biological process=lipid catabolic process
  Homolog annotation: Hit_ID=Q9LRZ5; Match level="QueryCoverage=99%, HitCoverage=84%, E-value=0.0, Identity=61%"; Hit description =Phospholipase D p1
  Pfam annotation: Domain name=PH; Domain location=272-398; Score=19.7; E_value=0.011; Accession=PF00169.19; Description=PH domain
  Pfam annotation: Domain name=PLDc; Domain location=544-571; Score =44.2; E_value=4.6e-10; Accession=PF00614.12; Description =Phospholipase D. Active site motif
  Pfam annotation: Domain name=PLDc; Domain location=928-955; Score =35.9; E_value=1.4e-07; Accession=PF00614.12; Description =Phospholipase D. Active site motif
  Pfam module annotation: Pfam domain module=PH::PLDc::PLDc; Domain location=272-398::544-571::928-955
  Subcellular localization annotation: CTP_CleavageSite=29; ConfidenceScore=5.10e-01
MATEQLMSSAGGGSSRYVQMKSSPPPSPPAAAAEEISSVPSFRHSGAEANRIFEELPKAAIVSVSRPDASDISPMQLSYTIQVQYKQFPRTKVSAFANLLLAFTSFLVVRVESVSFLPTGGYLYVSFAFQFKWELTKKAHQVFILHFALKKRAFIEEIHEKQEQVKEWLQNLGIGEHTAMAQDDDEGDDETVPLHTEETHESAKDRDVPSSAALPIIRPALGRQHSIADRAKRAMQGYLNHFLGNISIVNSREVCKFLEVSKLSFSPEYGPKLKEEYVMVKHLPKIQKDDDSRKCCLSDCFSCCNDNWQKVWAVLKPGFLALLADPFDTQPLDIIVFDVLPASDGNGDGRLSLASEMKERNPLRHSFKVTCGIRSIRIRVKSSSKVKDWVAAINDAGLRPPEGWCHPHRYGSFAPPRGLVEDGSQAQWFIDGRAAFEAIAFSIEAAKSEIFICGWWLCPELYLRRPFHTHASSRLDNLLEAKAKQGVQYSPYNNQVVTKIYILLYKEVALALKINSVYSKKKLLSIHENVRVLRYPDHFSTGVYLWSHHEKLVIIDNHICFIGGLDLCFGRYDTSEHKVGDFPPLTWPGKDYYNPRESEPNSWEDTMKDELEREKYPRMPWHDVHCALWGPPCRDIARHFVQRWNYAKRNKAPYEQAIPLLMPQHHMVIPHYLGRSREIQIESRNTDNHRVLKREDSFSSSSQDQDIPLLLPQEPDGLDTHEGDQKLNGVISFSHHLDKPRRISSGLPFSFRKAKIVAVGPDTPMKGFVDDLDSEHGLEKMSLDRVAHFDLQSTKPQWWETQERGDQGGFAEESGQVGPLASCRCQVIRSVSQWSAGTSQTEESIHNAYCSLIEKAEYFIYIEGGLDDSGAASVRAIMHWQYRTICRGQNSILHNLYELLGSKIHDYISFYGLRSYGRLSNGGPVATSQVYVHSKIMIVDDCITLIGSANINDRSLLGSRDSEKQVS

SEQ ID NO: 126545 - protein, 254 aa, Glycine max
  Coding DNA Sequence Number=SeqID_9767
  Gene Ontology: Mol. function=transmembrane receptor activity; Cellular component=membrane; Biological process=defense response
  Homolog annotation: Hit_ID=Q1SI46; Match level="QueryCoverage=78%, HitCoverage=18%, E-value=7e-43, Identity=49%"; Hit description =Leucine Rich Repeat, putative
  Pfam annotation: Domain name=NB-ARC; Domain location=7-254; Score= -27.7; E_value=1.6e-08; Accession=PF00931.13; Description=NB-ARC domain
MVLFPSLVNGLARTVSLKKDKNCRKDGGRKVLEALAKEARKNELLLTSSGIVKSSKANNVASVFTKKGHKRFNQDGFIVWEKEIFSRLLENVVKIDNPNAFPIDVDRRIGSMKVLIVLDDVNDSDHLQKLLRTPYKFGLGSRIIVTTRYVQVLNANKANETNQLGEFSLDKALELFNLNAFKQSDHQWEYDELSKRVVNYAKGNPLVLKVLAQLLCGKNKEEWEGMLDTLKRMPPADVYKVMKLSYDELDRKKQ

SEQ ID NO: 126546 - protein, 233 aa, Glycine max
  Coding DNA Sequence Number=SeqID_9768
  Gene Ontology: Mol. function=phospholipase D activity; Cellular component=endoplasmic reticulum; Biological process=lipid catabolic process
  Homolog annotation: Hit_ID=Q9LRZ5; Match level="QueryCoverage=89%, HitCoverage=19%, E-value=9e-91, Identity=76%"; Hit description =Phospholipase D p1
  Pfam annotation: Domain name=PLDc; Domain location=120-147; Score =35.9; E_value=1.4e-07; Accession=PF00614.12; Description =Phospholipase D. Active site motif
MKEHGYLLPELPCLSGDEMIRNRVLEALYRRIMRAYNDKKSFRVIVVIPLLPGFQGGLDDSGAASVRAIMHWQYRTICRGQNSIMHNLYELLGSKIHDYISFYGLRSYGRLSNGGPVATSQVYVHSKIMIVDDCITLIGSANINDRSLLGSRDSEIGIVLEDREFIGSYMDGKPWKAGKFSLTLRLSLWSEHLGLPIGEVNQIMDPVVESTYRDIWMATAKASFLFIFVILAK

SEQ ID NO: 126547 - protein, 169 aa, Glycine max
  Coding DNA Sequence Number=SeqID_9769
MVLRSSSKEISTLPQQMFKGFGISLMNTLRCSSCKQQMELHDSMSKGPFQGVLKHNKDCAPDFGCQSPEPFRKINKRNNKFRIWDEHLTKANIDDSRAVLPTTSEDGTLTPLQLTTDLKPYLPSLRSLLHTHNIRSVWDAISNQEAVKIVGLTPHKEKSNSKDGEMRHG

SEQ ID NO: 126548 - protein, 713 aa, Glycine max
  Coding DNA Sequence Number=SeqID_9770
  Gene Ontology: Mol. function=triacylglycerol lipase activity; Biological process=lipid metabolic process
  Homolog annotation: Hit_ID=Q8L570; Match level="QueryCoverage=91%, HitCoverage=99%, E-value=0.0, Identity=53%"; Hit description=Lipase class 3-like protein
  Pfam annotation: Domain name=Lipase3_N; Domain location=34-107; Score= 56.2; E_value=1.1e-13; Accession=PF03893.7; Description=Lipase 3 N -terminal region
  Pfam annotation: Domain name=Lipase_3; Domain location=160-336; Score= 72.2; E_value=1.7e-18; Accession=PF01764.16; Description=Lipase (class 3)
  Pfam module annotation: Pfam domain module=Lipase3_N::Lipase_3; Domain location=34-107::160-336
MATAAGAAVMLYYVLSRRLARKEEDEGEDHGGEAPATLLESIVTLSETLRFTYSETLGKWPIGDLAFGINYFMRKQGNLAVASVYAGSDCVQLKGDEIIVELYELLRLLTLCMLFSKKPFPVFLDSAGFSLDDVLIQKPKAGLLKPAFTIIRDTQSKCLLLLIRGTHSIKDTLTAATGAVVPFHHSVLNDGGISNLVLGYAHCGMVAAARWIAKLCTPTLLKALGECPHFKVKIVGHSLGGGTAALLTYILREQKEFSSSTCVTFAPGISLNFLGGDMRFPITLLQHIIIVKDVLYQCSLYLAACMTWELAESGKHFITTIINGSDLVPTFSTSSIDDLRSEVTASSWLNDLRDQVEHTKVLNVVYRSATALGSRLPSISSAKARVAGAGAILWPVTSGTQVVMKRAQSVAEAVVRTRSSLSSWSCMSARRRNVGPSVNSKTEDLTETSLISERSTDSHMTEEVVREPMLKDESTSSSGGSGHDDTDEEEQLIPANEDITASAVDDFTEGQLWYELEKELQRQDNTMNIDAQEEAAAAKEITEEENQLVDAAAECSCSSITTSDNLDSHRFYPPGRIMHIVSVPLSDESNSNPDDPLEEHVGLYETPRELYSKLRLSRTMINDHYMPMYKKMMELLIRELEKEGSSEAADGDVAVVREERFALDSSLSSVTGVGGDDRRAAEDMAGDAYGGSVGGCCSLRIRDAAISITTPRS

SEQ ID NO: 126549 - protein, 102 aa, Glycine max
  Coding DNA Sequence Number=SeqID_9771
MAKDGTYFSIFIRIILKPLPPPNHTPQTTVYSLASGQLLLEIYEKYEALLSSCCHVACKSTTGVSIVHKQVSAKSFCNVSTADTIQLSKSRPSIIDASLHKY

SEQ ID NO: 126550 - protein, 123 aa, Glycine max
  Coding DNA Sequence Number=SeqID_9772
MEMARSMLKEKGLPNTFWAEAIYTNWEAKNVAKSNIHVLVQQYQEEVQEVAKEASMLLSPLQQQDSSSESTPSRVRSLVDIYESCNTTMIDPKCYEESSKKQRQLRKSNSSTTREKPKMQTLL

SEQ ID NO: 126551 - protein, 260 aa, Glycine max
  Coding DNA Sequence Number=SeqID_9773
  Homolog annotation: Hit_ID=Q9FKZ3; Match level="QueryCoverage=44%, HitCoverage=37%, E-value=3e-50, Identity=82%"; Hit description =Protein ASYMMETRIC LEAVES2
  Pfam annotation: Domain name=DUF260; Domain location=7-107; Score =221.2; E_value=2.4e-63; Accession=PF03195.5; Description=Protein of unknown function DUF260
MSSSNSPCAACKIQRRKCTQECVFAPYFPPDNPQRFAYVHKVFGASNVAKLLNELNAAQREDAIKSLAYEAEARLRDPVYGCVGLISILQHRLKQLQSELHRAKKELASYVGPQAMLPPPPPPPLLPPQSPRTFSLFPFKTAPTNQQDLFGFHDDGGASASHGVLNHHLALFSPSPAVDHAFSHPPMHSLALPHHSHLTRSPMQPRHQTDPEIFIDNLKQHFQEFHGQPCCHGGCMDVAAAEEGKKGDIRGLVEVVRVMK

SEQ ID NO: 126552 - protein, 173 aa, Glycine max
  Coding DNA Sequence Number=SeqID_9774
MMLESDVNGNIDRSMFGSVDFDENVDDHEDITLEGEDGEYNEDVDDCGDQEEQYEEYENDDVVEYENMGVETLVGKLSSKRMFAHELVRPKRGPRLEKRKRLSKNVTRCGCEATCHVHVDVQTSRWYVSVWHFDHNHYFLETIHSLLLPLNRKIGESDMMQICNFTKVGIQPP

SEQ ID NO: 126553 - protein, 310 aa, Glycine max
  Coding DNA Sequence Number=SeqID_9775
  Gene Ontology: Mol. function=DNA binding; Cellular component =chromatin; Biological process=DNA integration
MASNNVPLLAPPVFTGKNDEMWVVKMRRQLKAFDLWKVMETTEPPALEENPTVAQIRFHSKQVAKRAKALTILHSVVDDDVLNLKREFEALKMNEAKNIKDFMTRLMKPKDLNLMSNEKASKFEQWNHSMKEMTTIEDNNTWQLVDKLEDKNSIGVKWVYTVKLNLNGSINKYKTKLVVKGYAQQPGIDYVETFSPVTKMNTIRILVALAAEMKCKIWHLDVKSAFLNRNLTEEIYKQAPRAWYNNIDAYFSSQGFRSENDATLYVKRLLDGGSLIVSVYVDDFLMTSNNQQEVQQLIVEMQNQFQISNL

SEQ ID NO: 126554 - protein, 303 aa, Glycine max
  Coding DNA Sequence Number=SeqID_9776
  Homolog annotation: Hit_ID=Q93YG8; Match level="QueryCoverage=34%, HitCoverage=9%, E-value=4e-33, Identity=73%"; Hit description=TCTR2 protein
  Pfam annotation: Domain name=DUF1230; Domain location=202-302; Score =108.4; E_value=2.1e-29; Accession=PF06799.2; Description=Protein of unknown function (DUF1230)
MAPEVLRNEPANEKCDVYSFGVILWELTTTRIPWQGLNPMQVVGAVGFQNKRLEIPEDVNPVVAQIIRDCWQTWDGFDLMQGATLAAIILTTDVSSLPTSTFDCPKNKLNTLNEVVYNIAIVIILKAVPWFKEPEQLNWDWTQPIQKRAGSLPNICISAVEGEAEEAIMAIRGIGMSFSAPSTTRPILSLNPRFLSAPETECPVPHEQQPINEYQSLSTSFPFSWAAGDVVEYASRLFVTGASFALLLGLPVAWFGSAGAQAEPAKRLLCAASSGLFAVTLAVVRMYLGWAYVGNRLLSATVE

SEQ ID NO: 126555 - protein, 101 aa, Glycine max
  Coding DNA Sequence Number=SeqID_9777
  Pfam annotation: Domain name=DUF1230; Domain location=1-48; Score= -59.8; E_value=0.0022; Accession=PF06799.2; Description=Protein of unknown function (DUF1230)
MPLHEFSLFCFWVIWVKTAEVLARDRLLGSFFVKPVLGRLKITLVSLATSLLVCALILINIDGDQNLTSKEPRVRVVPGVYNDDSARLFEPDAFRDELDLQ

SEQ ID NO: 126556 - protein, 142 aa, Glycine max
  Coding DNA Sequence Number=SeqID_9778
  Gene Ontology: Mol. function=protein binding; Cellular component =integral to membrane
  Homolog annotation: Hit_ID=Q1HTV4; Match level="QueryCoverage=98%, HitCoverage=74%, E-value=1e-47, Identity=50%"; Hit description=Green ripe-like 1
  Pfam annotation: Domain name=DUF778; Domain location=27-142; Score =166.3; E_value=8e-47; Accession=PF05608.2; Description=Protein of unknown function (DUF778)
MELNASYDVEHSHSTQRIQHELWPLDPIDPKKAKEDGVVLDFSGSYLVNVDDFAFGPVARYLQLDRRQHGYLHAEYGTAIAWDDALQTSLRYFENKTHNLFTCNCHSFVANCLNRLCYGGSMNWNMVNVGALVIFKGHWVDF

SEQ ID NO: 126557 - protein, 237 aa, Glycine max
  Coding DNA Sequence Number=SeqID_9779
MCGTEGVTQYIESNAFLISIFKARFPPKTCLFSILIASKVVQTQSSMCISLKNPRCQGNGLEVLYLIVIRGLRNQNHQIRVQVRKEPTLFEKLKCCYKNILPHNVPEFLDKIEKAERSFIWGNQEGGKKMHVVSWNTIIRPKVYGGITMCNLKHMNLACNMKLGWMLRNDGNSLWCQVLKGKYARQGLISSSLIAKPQDSLIWKFVVEIWPQLVMGLGLLEMGEWSMFGKLDGSTMS

SEQ ID NO: 126558 - protein, 392 aa, Glycine max
  Coding DNA Sequence Number=SeqID_9780
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=1e-58, Identity=31%"; Hit description= UPI00006A17C9 related cluster
LHVIAFRGLHALTFRWLHTLTFRWLHALSFRGLHALAFRGLYAFTFRGLHVFTFRGLHAPTFEGLHALTLRGLQVLAFRGPRLHVLAFRGLHALAIRRLHVLAFRGLHALAIRGLHVLAFIGLHALTFRGLHVLAIKGLHVFTFRGLHVLGFRGLHALAIRGMHVLAFVGLHALEGQHVLASKGTTHPRLQRTTRPRLRGLQALAFRGLHVLAIRGLHVLAIRGLHTLTFRGLHILTFRGLHVLTFRGLHVLIFRGLHVLTFRGLHALTFRVLHALAIRGMHVLAFVGLHALEGQHVLASKGRHVLAIKGLHVLTFRGLHVLTFRGLHILAFRGLHVLAFKGRHALAFRGLHILHFKGLHVLPFRGLHVLAFRGLHTLALSGLHIHTLREFK

SEQ ID NO: 126559 - protein, 270 aa, Glycine max
  Coding DNA Sequence Number=SeqID_9781
  Gene Ontology: Mol. function=heat shock protein binding; Cellular component=integral to membrane; Biological process=protein folding
  Homolog annotation: Hit_ID=Q850Z3; Match level="QueryCoverage=94%, HitCoverage=95%, E-value=1e-31, Identity=32%"; Hit description=DnaJ -like protein
  Pfam annotation: Domain name=DnaJ; Domain location=45-106; Score =94.2; E_value=3.8e-25; Accession=PF00226.21; Description=DnaJ domain
MGRRMGQDQSDYKTQLVLEVCSISTRSVVCVHRHVSNHAKPSFIDWYCILGVEENAGMNTIRKQYHKLALQLHPDKNTHPKAEIAFKLVSEAHICLSDAAKRKAFDLKRHKNFCFECNRIPYSTSKHVPGNSNCSTFKTWNIIRDSRSYKVLRNIRDMRERLKEETKVIENCLRKNSMSKKESPLYNPDDYRHGSSFKHKVEKEIPIFNPLKYLYKGYPHLRCNVYKNSEACWYLHTQNLVDTDKGEAKYASPVFEVRSQRSMLTRSKFA

SEQ ID NO: 126560 - protein, 66 aa, Glycine max
  Coding DNA Sequence Number=SeqID_9782
  Homolog annotation: Hit_ID=Q8GTE6; Match level="QueryCoverage=46%, HitCoverage=7%, E-value=2e-07, Identity=77%"; Hit description =Transportin-like protein
MCLRVLGILKAMNNLIMLLWAFYEDFWMIISWSKIFGTLAEDVGGELNQVFMLTLSCHQIEKLHEL

SEQ ID NO: 126561 - protein, 66 aa, Glycine max
  Coding DNA Sequence Number=SeqID_9783
MIGFDQVVVAGVPRGEKWEGVERERRLPWVTRGGWGLPNLQWRMTFPKAFMEVLCHFHLDHNPVSF

SEQ ID NO: 126562 - protein, 391 aa, Glycine max
  Coding DNA Sequence Number=SeqID_9784
  Gene Ontology: Mol. function=oxidoreductase activity, acting on other nitrogenous compounds as donors, with NAD or NADP as acceptor; Cellular component=cytoplasm; Biological process=aromatic compound biosynthetic process
  Homolog annotation: Hit_ID=Q8ZH75; Match level="QueryCoverage=71%, HitCoverage=100%, E-value=1e-123, Identity=76%"; Hit description =NADPH-dependent 7-cyano-7-deazaguanine reductase
  Pfam annotation: Domain name=GTP_cyclohydroI; Domain location=284 -382; Score=19.0; E_value=2.4e-05; Accession=PF01227.12; Description =GTP cyclohydrolase I
MTNQVLLQAGKIVLAPHLQQRQRLLRKLRVHVAGKLRGIERGKVRLQLNIQRALNGCQRGWQAKVLRLPQDTLIQFTDDAGRWHAVQLCAGGKMAVLLLPVRYITGVVTVMSSENRDTALSGLTLGKPTAYVDRYDNTLLQAVPRSLNREPLGLYPDNLPFHGADIWTLYELSWLNSKGVPQVAVGEVVLSADSVNLIESKSFKLYLNSFNQTIFADWGAVRQTLERDLSACANGQVSVALFRLSEVEGQPIGHFAGDVIDEQDITISDYGFNADYLASATGSEVVEETLVSHLLKSNCLITNQPDWGSVMIRYQGPRIDREALLRYLISFRQHNEFHEQCVERIFNDIQRFCQPAALTVYARYTRRGGLDINPWRSNVPFTPGYSRLVRQ

SEQ ID NO: 126563 - protein, 143 aa, Glycine max
  Coding DNA Sequence Number=SeqID_9785
MFTFDETNITSSRKEFVDDIADTLEDTQNEEKNLKRKRDDEDKDDQDDTAQENDNLPKEWKTSRNHPLDNCHTLISSGDLCLMICDLSLVLVRCLAPIIRQFVKFQDMPENQKILMHNPPFQNILEVGLLKEEATGRQAPPRF

SEQ ID NO: 126564 - protein, 141 aa, Glycine max
  Coding DNA Sequence Number=SeqID_9786
MNKGLSFVLLILLIHYNNVVNANNKNCVTEDCLIGNNDLESEFYFGSHVARMLYDVSQSVSGQTGNSNNKAVNCPQSNGYRTCLPSKNGGGPNQSCGDYTRWTMVLEKLKLRGRQEEETVMYKLKNIGISMGILNDLIPCT

SEQ ID NO: 126565 - protein, 334 aa, Glycine max
  Coding DNA Sequence Number=SeqID_9787
  Gene Ontology: Mol. function=nucleic acid binding
  Homolog annotation: Hit_ID=Q1SPG0; Match level="QueryCoverage=30%, HitCoverage=26%, E-value=8e-27, Identity=63%"; Hit description=Zinc finger, SWIM-type
MDVEFGNTLDGVKFDTTIEIVIKRRGDVYNLDVGNLYCEDFASGLTLKTRKREEKMIQGGCNARFHVHVNFSNDHWFLVMWWLLMLHIGRINMCSFVIFFGVNHHNQTIVFAIGLITNETEETYVWLLEQFVDAMKGNTPSCVITDGDIAMKNAIRKVFPNAHHRCLTYFIFMELQSNYYSNDANYAFHSSFQFLESWSKTTKDSICGLYVVSSIYWDSTLISRYATLVHISREACEYAHREKEDFDNLMELLTGEISRLKLKYKSVEEEKVEDATPRSKVRVTENLKIRNVTNGIRDDLSPSRVRFKDELGGSWWACSTSIVSHQNERDLEVV

SEQ ID NO: 126566 - protein, 130 aa, Glycine max
  Coding DNA Sequence Number=SeqID_9788
  Homolog annotation: Hit_ID=Q2QLN8; Match level="QueryCoverage=53%, HitCoverage=28%, E-value=4e-12, Identity=52%"; Hit description =Expressed protein
MNICLYKLKASLHFSFIPQQGNVEHISISSDAKNLVTSDFKDQHEAAEGVLLDDDLNEPTMREKLASLSVLDGNKSRSDIEQESSVPAKPPSADSVHVLLKQALNVDDRTLLLDCLFTQNEKVLFLSYFY

SEQ ID NO: 126567 - protein, 288 aa, Glycine max
  Coding DNA Sequence Number=SeqID_9789
  Homolog annotation: Hit_ID=Q2R1C3; Match level="QueryCoverage=26%, HitCoverage=10%, E-value=2e-18, Identity=54%"; Hit description=HAT family dimerisation domain containing protein
MDISNQVKEQGEDTKPLWNYVSKIKGLSGGCGNFEKITPSNPTELTKMDNETTLRIERSKKKHVSLPPMSNQETTNVDPKKIKTLEARNPHYRKAFSFAANNNCIPGYQPPEKTSYQFHGCESMTKSGPMFSKALDCSYEVKDRDFIAEQMRDVIIEADDINKAKFVKETALDDIWWDKVDYILSFTTPIYDILRKTDTDVVCLHLVYEMWNSMIENVKVIYRHERKGEGEESTFYKGKAAYNIPPPYLRIAKSLWVMGYEEKRRSNGGKVLVTNSWCSCTYTSKDCS

SEQ ID NO: 126568 - protein, 154 aa, Glycine max
  Coding DNA Sequence Number=SeqID_9790
  Gene Ontology: Mol. function=peptidyl-prolyl cis-trans isomerase activity; Cellular component=membrane; Biological process=protein folding
  Homolog annotation: Hit_ID=Q9SP02; Match level="QueryCoverage=97%, HitCoverage=77%, E-value=1e-72, Identity=84%"; Hit description =Peptidyl-prolyl cis-trans isomerase CYP20-1 precursor
  Pfam annotation: Domain name=Pro_isomerase; Domain location=1-152; Score=321.7; E_value=1.3e-93; Accession=PF00160.11; Description =Cyclophilin type peptidyl-prolyl cis-
MATKITSRIVMGLFGKAVPKTAGEKGTGKSGKPLHYKGSSFHRIIPSFMLQGGDFTHGNGMGGESIYGEKFADENFKLKHTGPGLLSMANAGPDTNGSQFFITTVTTSWLDGRHVVFGRVLSGLDVVYNIEAEGTQSGTPKSKVVIVDSGELPL

SEQ ID NO: 126569 - protein, 90 aa, Glycine max
  Coding DNA Sequence Number=SeqID_9791
  Subcellular localization annotation: CTP_CleavageSite=74; ConfidenceScore=5.32e-01
MMRHSNSNEPARSLPPLGWCKPSGGHQTQKNQTFTHHQVNPQMQSNTSSSKKAKSTNLGLIMEREEKRELYQIRCSSEENNVGDDMEGEI

SEQ ID NO: 126570 - protein, 100 aa, Glycine max
  Coding DNA Sequence Number=SeqID_9792
  Gene Ontology: Biological process=intracellular protein transport
  Homolog annotation: Hit_ID=Q1SF28; Match level="QueryCoverage=74%, HitCoverage=10%, E-value=6e-22, Identity=72%"; Hit description=Epsin, N-terminal; ENTH/VHS
MVGPNFMDEIDCGSFFDHIDDLLDFPVKDVDGGAATLPSVAANIVKELSDFILKRLDHKSPIVKHKTLRLIKYAVGKCGVEFRREMQRHSVAIRQLLHYK

SEQ ID NO: 126571 - protein, 91 aa, Glycine max
  Coding DNA Sequence Number=SeqID_9793
MVALLFLLALKIFKMFLTNGEVREGFQQVQVILEQAPLLPNKDDFLSSWGLSYESLSNEEEDLTMWLAGISSMEGKSSREGKTRNELQHLL

SEQ ID NO: 126572 - protein, 86 aa, Glycine max
  Coding DNA Sequence Number=SeqID_9794
FIPDQVVTDQLDPYEAYRSTSSVRLILIKGNEAYLDGGKVPSLHVHNADGGEEGSKPNENDTTVQTEGRRIAEAQMEAQLAGVRNA

SEQ ID NO: 126573 - protein, 113 aa, Glycine max
  Coding DNA Sequence Number=SeqID_9795
  Gene Ontology: Mol. function=zinc ion binding; Cellular component =COPII vesicle coat; Biological process=ER to Golgi vesicle-mediated transport
  Homolog annotation: Hit_ID=Q9ZQH3; Match level="QueryCoverage=90%, HitCoverage=13%, E-value=7e-19, Identity=50%"; Hit description =Expressed protein
  Subcellular localization annotation: CTP_CleavageSite=74; ConfidenceScore=5.03e-01
MLGLRKKEEEAWQRGPQCCVSQWTRTPARAPTCSEVSLSCRSPPPTRTPVLCRTTLTMTSCPSERTVGPTSTPTASSSSDPGPGHGPAPSATTSMDSPTTPSTTTLALNPVPR

SEQ ID NO: 126574 - protein, 830 aa, Glycine max
  Coding DNA Sequence Number=SeqID_9796
  Gene Ontology: Mol. function=protein serine/threonine kinase activity; Cellular component=integral to membrane; Biological process=protein amino acid phosphorylation
  Homolog annotation: Hit_ID=Q9LY50; Match level="QueryCoverage=98%, HitCoverage=97%, E-value=0.0, Identity=46%"; Hit description =Receptor kinase-like protein
  Pfam annotation: Domain name=Pkinase; Domain location=520-806; Score =144.9; E_value=2.1e-40; Accession=PF00069.15; Description=Protein kinase domain
  Pfam annotation: Domain name=Pkinase_Tyr; Domain location=520-806; Score=113.3; E_value=6.8e-31; Accession=PF07714.7; Description =Protein tyrosine kinase
  Pfam module annotation: Pfam domain module=Pkinase::Pkinase_Tyr; Domain location=520-806::520-806
  Subcellular localization annotation: CTP_CleavageSite=51; ConfidenceScore=5.35e-01
MTPPFTLSLSLFSILAVTAVHGLGSAATTAVTYGTATVCGIVAGEPQHRIQCSRNGSRVVPLTLPNASFDAISGGRSFFCGLRSGGRSLHCWDTAATTASFRPKRVFHSDVVQLADVAVGDSQVCAREVQSGVVRCWRGSGGAQFSSPSESLRFRSITCGCGFSCGIVKESGRVVCWGDDNEGANRKGSISDEIHREFKNFTMSSLVAGVSHVCGLTLHGALVCKGNNDSGQLGYNNNNNGGVFLTTSLDHFSGLALGEDFTCGIRTRNGVVVCWGGGFDSNVVKGVSFESLVAGLDYVCGLTTRNLTVVCWGKGRFFHHVPSEVPLGVILPGPCVEGACSGSCGTYPDSGALCHGSGSICYSCQTEIPLAVPLLPPSSSTTTQAVPNQEQPSSRGGKNKNLKEFLVFFIVGSVGAFVGLCTILYFIWICARRFLLRRKEVVVGGGNNNSVKPTSSESDAYVDIIPMPNFGSNGTTFRTFSSKSRGSRRLGRHRSGSSSKRVDRTESFSLSELATATENFSLCNKIGAGSFGSVYKGMLRDGREVAIKRGDSTSTMKKKFQEKEIAFDSELTMLSRLHHKHLVRLIGFCEENDERLLVYEYMSNGSLYDHLHDKNNVDKSSSILNSWRMRIKIALDAARGIEYIHNYAVPPIIHRDIKSSNILLDSNWNARVSDFGLSKIWHETEQELMSTTKAVGTVGYIDPEYYVLNVLTTKSDVYGLGVVMLELLTGKRAVFKPEDGSGPMGVVEYTGPKIASGELWSVLDYRVGHPEVNEVESIQIMAYTAMHCVNLEGKERPEMTDIVANLERALAFIEGTPTSLSFASFSAPLE

SEQ ID NO: 126575 - protein, 131 aa, Glycine max
  Coding DNA Sequence Number=SeqID_9797
  Gene Ontology: Mol. function=structural constituent of ribosome; Cellular component=ribonucleoprotein complex; Biological process =translation
  Homolog annotation: Hit_ID=Q9XF97; Match level="QueryCoverage=79%, HitCoverage=37%, E-value=3e-12, Identity=42%"; Hit description=60S ribosomal protein L4
MKARKAKLILFGGLHSGGLDAVAASEDEGGNGGGSDGEDNNATLLATQWVLSPWNTRDMGDDTIDSPELDRGLVVDAVVDDIGLSTILVDVGVYEVDDEVLVAMSLSKVCAVTRERVVAAIANESEEELST

SEQ ID NO: 126576 - protein, 35 aa, Glycine max
  Coding DNA Sequence Number=SeqID_9798
MIPNVGGFALGLVQMVLYDIYRKGTESEKEQGLGI

SEQ ID NO: 126577 - protein, 178 aa, Glycine max
  Coding DNA Sequence Number=SeqID_9799
  Homolog annotation: Hit_ID=Q1S717; Match level="QueryCoverage=95%, HitCoverage=20%, E-value=3e-20, Identity=35%"; Hit description =Ovarian tumour, otubain
MVWMNNMLIVRMHSILLRCLVPEMMFCSGLDPLFMKMDLWRSLSGQYRSRKKDFVRKDTRSRKYGCPFKLSGKPVVGGKGWMVKLMYGIHNHELAKSLVGHPYAERLTKDEKTIIVDITKSMVKPRNILLTLKEHNANSCTTIKQIYNARSAYRSSIKGSDTEMQHLMKLLERDQYIH

SEQ ID NO: 126578 - protein, 75 aa, Glycine max
  Coding DNA Sequence Number=SeqID_9800
MDDGVPKGLGEVSGCHCSGVFGCGLVLLLEVGAGARDGVVVVSLVWFLLLKILFHQEGSVVVNGKLSEEDKSTLQ

SEQ ID NO: 126579 - protein, 124 aa, Glycine max
  Coding DNA Sequence Number=SeqID_9801
  Gene Ontology: Mol. function=sucrose transporter activity; Cellular component=integral to plasma membrane; Biological process=sucrose transport
  Homolog annotation: Hit_ID=Q9M535; Match level="QueryCoverage=74%, HitCoverage=18%, E-value=8e-15, Identity=46%"; Hit description =Sucrose transport protein
MAVGNILGHATGSYSGLHNISPFTKTKACDVYCANLKSCFFLSIALLLTLSTLTLSYVKEKTVMTSVDVDDGGGTVPKTMREGFKGFWDGLKNAIQGASQTLTCGSQRHCLTVNIQLRCPGPTL

SEQ ID NO: 126580 - protein, 322 aa, Glycine max
  Coding DNA Sequence Number=SeqID_9802
  Gene Ontology: Mol. function=endonuclease activity; Biological process=response to biotic stimulus
  Homolog annotation: Hit_ID=Q9MB25; Match level="QueryCoverage=99%, HitCoverage=99%, E-value=2e-69, Identity=76%"; Hit description=S1-1 protein
  Pfam annotation: Domain name=Bet_v_I; Domain location=1-180; Score =103.6; E_value=5.8e-28; Accession=PF00407.9; Description =Pathogenesis-related protein Bet v I family
  Pfam annotation: Domain name=Bet_v_I; Domain location=191-322; Score =24.4; E_value=6.9e-08; Accession=PF00407.9; Description=Pathogenesis- related protein Bet v I family
  Pfam module annotation: Pfam domain module=Bet_v_I::Bet_v_I; Domain location=1-180::191-322
MVVLTFTDEFTSSVQPRRLFKALILDAPNLIPKLMPEAIKNVQLAEGNGGPGSIQEITIAEGKLHHFTLIFTLPFLLLFVTTNMDPSGNIKQLKHRIDAIDLEKLTYSYAVIDGDAALEKVDSISHEIKFEATEEGGCKTKNVSKYHPKEGVDVKEEDFKAAREEGLALLKVVDAYLVANPEAYAEGTINSGFFTFTDEFTSTVQPGRLFKALVLDAPNLIPKLMPEAIKNIQLVEGNGGPGSIQEITIVEGQLFQTEMTNKEIIIGNAFNAGDKIKHLKHRIDVIDQEKLTYSYAVIEGDGALEKVDSIAHEVKFEATEEG

SEQ ID NO: 126581 - protein, 266 aa, Glycine max
  Coding DNA Sequence Number=SeqID_9803
  Gene Ontology: Mol. function=protein binding; Cellular component =nucleus; Biological process=regulation of transcription, DNA -dependent
  Homolog annotation: Hit_ID=Q7XIY9; Match level="QueryCoverage=83%, HitCoverage=95%, E-value=6e-76, Identity=61%"; Hit description =Putative MAGE
  Pfam annotation: Domain name=MAGE; Domain location=25-217; Score =165.9; E_value=1e-46; Accession=PF01454.9; Description=MAGE family
MANAAEDFSQFGISKEEKDKLVGELIRYMLFKTHQNSGCPIKREELTQLVTKNYHQRNLPTFVINEAKEKLSFVFGYEMRELQRTQPSSKARTQSSQQSVADSKSYILISQLPPNVYEKYVVDVNTAHLSGFTFVIISIVYLAGGKIPEENLWSQMRRMGLGETESSHPVLGNVKQAFELLVQQRYLQKDKVNGPEGNTVYYELAERALDGPMNDRIKEYISQLKQIEQIVLRIVQICFTADQGGLKFCGLSLCSTSVTYKQTENK

SEQ ID NO: 126582 - protein, 72 aa, Glycine max
  Coding DNA Sequence Number=SeqID_9804
MGIVTTERKQVCAVAPARLYKAMAFDFDKSTVKYYTKDNAQLTEEFLKDNKEKSEAFTHALVDYIVANPDYN

SEQ ID NO: 126583 - protein, 150 aa, Glycine max
  Coding DNA Sequence Number=SeqID_9805
  Homolog annotation: Hit_ID=Q9ZPW2; Match level="QueryCoverage=36%, HitCoverage=28%, E-value=3e-18, Identity=83%"; Hit description =Anaphase-promoting complex subunit 10
  Pfam annotation: Domain name=APC10; Domain location=54-150; Score= -82.0; E_value=0.026; Accession=PF03256.7; Description=Anaphase -promoting complex, subunit 10 (APC10)
MKIIFKDKLVKLYVARKAEENHSLKFLVERVKIQMSTSWAIGLNKLYTCTNHVFYIAQLTSVIAKTDVNESAVAFLKPYTALGTVVGAQRSKLSTLPVNKVVFKLDESYTPSKVSIRASDGFHNLKEIKTVELVKPTGWVYLSLSGADPR

SEQ ID NO: 126584 - protein, 256 aa, Glycine max
  Coding DNA Sequence Number=SeqID_9806
  Gene Ontology: Mol. function=molecular_function; Cellular component =membrane; Biological process=auxin mediated signaling pathway
  Homolog annotation: Hit_ID=Q9LI65; Match level="QueryCoverage=92%, HitCoverage=63%, E-value=1e-62, Identity=46%"; Hit description =Nodulin-like protein
  Pfam annotation: Domain name=DUF6; Domain location=67-196; Score =41.7; E_value=2.4e-09; Accession=PF00892.11; Description=Integral membrane protein DUF6
MKKLSAKAKVLGTFVCIGGALMLILYKGVPLINQQPEHIADKGTIRSSASKLKKWIIGSLLLTAGCFLWSSWFLIQASISKKYPCQYSSTAILSFFASIQSAILTLVIDRSNAKWILKGKLEIMTVVYAGLVGSGLCYVAMSWCVKQRGPVFTSAFTPLLQMFVAVLDFSILHEEIYLGSVAGSVLVISGTYILLWGKSKEEEQCAVKGTQESQEDEECKNNLEASSNVPSKLSPNEEQGFSELQVKQLAITVTRS

SEQ ID NO: 126585 - protein, 50 aa, Glycine max
  Coding DNA Sequence Number=SeqID_9807
  Subcellular localization annotation: CTP_CleavageSite=15; ConfidenceScore=5.18e-01
MGLTTINVRSQRRIMASPPASPPPPPPPSTPSDASASPFAVKRTRKASRL

SEQ ID NO: 126586 - protein, 316 aa, Glycine max
  Coding DNA Sequence Number=SeqID_9808
  Homolog annotation: Hit_ID=Q9ZU41; Match level="QueryCoverage=88%, HitCoverage=72%, E-value=1e-30, Identity=60%"; Hit description =Predicted by genscan and genefinder
  Pfam annotation: Domain name=DUF789; Domain location=16-308; Score =61.5; E_value=1.2e-20; Accession=PF05623.3; Description=Protein of unknown function (DUF789)
MKLYGIIVLIKLGLGGNEQRIKRWKTMEGELHAYFVLGDLWESFKEWSAYGAGVPLVLDGSECVTQYYNVSLSAIQLYVHPSKPSPRLRRPSQRDSESATETSSDSSSGYCHEKGAKSVHGTWNQDNSSDARYQCSKRVSLSKPLTSSSSDENESCNPPNSYFLPPDFRPYTSISRVEDIPELRSFLSKLGFFGLVSNIQNTHWSNTREHECLLPDFPFPINSSFAKYVLMSLFSFCLSNDGFHLCSRGMNLSSKLSLPIFGLAFHKLKASVWDPDEVSEGQKANSLLRAADNWIRLLQVNHPDYNYFMSHYPYWR

SEQ ID NO: 126587 - protein, 198 aa, Glycine max
  Coding DNA Sequence Number=SeqID_9809
  Gene Ontology: Mol. function=nucleic acid binding; Cellular component= intracellular
  Homolog annotation: Hit_ID=Q8GT87; Match level="QueryCoverage=86%, HitCoverage=85%, E-value=1e-28, Identity=41%"; Hit description=Fiber protein Fb2
  Pfam annotation: Domain name=Di19; Domain location=7-193; Score =189.1; E_value=1.1e-53; Accession=PF05605.3; Description=Drought induced 19 protein (Di19)
MDSDSWISTRMSSSSRRYHSRSDLYVEESEGSDDFRAEFLCPFCAEDYDVVSLCCHIDDHHPIQAKNGRKRRVRKVGSGSTMSILRKELREGALHSLLGGSSYLASCNSEPDPLLSSFMFNPAVTDDSASAKPPSVEDALVKESSKDDFLERTSGLTIVYGYRKPQQLQLSEEDQVEKARRFEFVQGLLMSTILDDML

SEQ ID NO: 126588 - protein, 673 aa, Glycine max
  Coding DNA Sequence Number=SeqID_9810
  Gene Ontology: Mol. function=two-component response regulator activity; Cellular component=nucleus; Biological process=two -component signal transduction system (phosphorelay)
  Homolog annotation: Hit_ID=Q71BZ1; Match level="QueryCoverage=98%, HitCoverage=97%, E-value=0.0, Identity=57%"; Hit description=Type-B response regulator
  Pfam annotation: Domain name=Myb_DNA-binding; Domain location=209 -259; Score=46.6; E_value=8.5e-11; Accession=PF00249.21; Description =Myb-like DNA-binding domain
  Pfam annotation: Domain name=Response_reg; Domain location=29-142; Score=91.3; E_value=3e-24; Accession=PF00072.14; Description =Response regulator receiver domain
  Pfam module annotation: Pfam domain module=Myb_DNA-binding::Response _reg; Domain location=209-259::29-142
MNLSHGKGSTSSSPLKAGDTVSDQFPAGLRVLVVDDDPTCLMILERMLRACLYEVTKCKRAEVALSLLRENKNGFDIVLSDVHMPDMDGFKLLEHIGLEMDLPVIMMSADDGKQVVMKGVTHGACDYLIKPVRIEALKNIWQHVVRMRKNGLRDVEQSGSMEEGDRPPKGSDDGNYSSSVNEAKSSKKRRDEDEEGDERDDSSTLKKPRVVWSVELHQQFMAVVNQLGIDKAVPKKILELMNVPGLTRENVASHLQKYRLYLRRLSGVSQQQGNLSNSFMSSQEATFGGTSINGIDLQTLSAAGQFPSQSLAKFQAAGLGRTTAKAGMPMSLSDQKNLFSFENPRLRFGEGSLQHLSNSKPINLLHGILTNMEPKQLANLHQSTQPLGSLNMRVNSPATQNKPLLMQMTQSQPRGQLLSENASSHVTRYPSSLVQPTVPNGISSGVLGNAIAGTSNITTTYNPVQQNSSLLSFPMNQTNEMSASNFHLRSTPGITSIPNKGMFHEEGTSGVKGSGGFVQGYDMFNDLHHQKSHDWDLTNTGMTYDASQHANPLQGNIDVSPSVLVHQSFPSMQQTVQNRDTTSIGKAMFSTGEGMHQSSLQNIGQHHNNLLLDNSVRVKAERIPDPSCQINNLFSDQYGQEDLVSAFLKQQEGVGTAENEFDFDGYSLDNIPV

SEQ ID NO: 126589 - protein, 617 aa, Glycine max
  Coding DNA Sequence Number=SeqID_9811
  Gene Ontology: Mol. function=protein transporter activity; Cellular component=nuclear pore; Biological process=intracellular protein transport
  Homolog annotation: Hit_ID=Q94KA9; Match level="QueryCoverage=83%, HitCoverage=96%, E-value=0.0, Identity=88%"; Hit description =Importin alpha 2
  Pfam annotation: Domain name=Arm; Domain location=106-147; Score =48.6; E_value=2.1e-11; Accession=PF00514.13; Description =Armadillobeta-catenin-like repeat
  Pfam annotation: Domain name=Arm; Domain location=149-197; Score =38.4; E_value=2.4e-08; Accession=PF00514.13; Description =Armadillobeta-catenin-like repeat
  Pfam annotation: Domain name=Arm; Domain location=199-240; Score =38.6; E_value=2.2e-08; Accession=PF00514.13; Description =Armadillobeta-catenin-like repeat
  Pfam annotation: Domain name=Arm; Domain location=242-281; Score =35.2; E_value=2.2e-07; Accession=PF00514.13; Description =Armadillobeta-catenin-like repeat
  Pfam annotation: Domain name=Arm; Domain location=283-323; Score =48.7; E_value=1.9e-11; Accession=PF00514.13; Description =Armadillobeta-catenin-like repeat
  Pfam annotation: Domain name=Arm; Domain location=325-366; Score =51.8; E_value=2.3e-12; Accession=PF00514.13; Description =Armadillobeta-catenin-like repeat
  Pfam annotation: Domain name=Arm; Domain location=368-408; Score =55.5; E_value=1.7e-13; Accession=PF00514.13; Description =Armadillobeta-catenin-like repeat
  Pfam annotation: Domain name=Arm; Domain location=411-451; Score =35.2; E_value=2.2e-07; Accession=PF00514.13; Description =Armadillobeta-catenin-like repeat
  Pfam annotation: Domain name=HEAT; Domain location=112-149; Score =3.0; E_value=19; Accession=PF02985.12; Description=HEAT repeat
  Pfam annotation: Domain name=HEAT; Domain location=155-199; Score =5.5; E_value=9.2; Accession=PF02985.12; Description=HEAT repeat
  Pfam annotation: Domain name=HEAT; Domain location=248-283; Score =10.5; E_value=2.3; Accession=PF02985.12; Description=HEAT repeat
  Pfam annotation: Domain name=HEAT; Domain location=289-325; Score =10.4; E_value=2.3; Accession=PF02985.12; Description=HEAT repeat
  Pfam annotation: Domain name=HEAT; Domain location=331-368; Score =8.9; E_value=3.5; Accession=PF02985.12; Description=HEAT repeat
  Pfam annotation: Domain name=HEAT; Domain location=374-410; Score =5.9; E_value=8.3; Accession=PF02985.12; Description=HEAT repeat
  Pfam annotation: Domain name=HEAT; Domain location=417-453; Score =0.6; E_value=36; Accession=PF02985.12; Description=HEAT repeat
  Pfam annotation: Domain name=IBB; Domain location=4-97; Score=147.9; E_value=2.7e-41; Accession=PF01749.10; Description=Importin beta binding domain
  Pfam module annotation: Pfam domain module=Arm::Arm::Arm::Arm::Arm::Ar m::Arm::Arm::HEAT::HEAT::HEAT::HEAT::HEAT::HEAT::HEAT::IBB; Domain location=106-147::149-197::199-240::242-281::283-323::325-366::368 -408::411-451::...
  Pfam module annotation: Domain location=112-149::155-199::248 -283::289-325::331-368::374-410::417-453::4-97
MSLRPNARTEVRRNRYKVAVDADEGRRRREDNMVEIRKSKREESLQKKRREGLQAQQQFPTPLQAASIVEKKLESLPAMVAGVWSDDNSQQLEATTQFRKLLSIERSPPIEEVIQAGVVPRFVEFLVREDFPQLQFEAAWALTNIASGTSENTKVVIDHGAVPIFVKLLSSPSDDVREQNTKTLKFQAVWALGNVAGDSPKCRDLVLSHGALIPLLAQLNEHAKLSMLRNATWTLSNFCRGKPQPPFEQVRAALPALERLVFSNDEEVLTDACWALSYLSDGTNDKIQAVIEAGVCPRLVQLLLHPSPSVLIPALRTVGNIVTGDDMQTQTIINHGALPCLLSLLTHNHKKSIKKEACWTISNITAGNRDQIQAVVEAGLIAPLVNLLQNAEFDIKKEAAWAISNATSGGTHEQIKYLVSQGCIKPLCDLLVCPDPRIVTVCLEGLENILKVGEAEKSMGNSGDVNLYAQMIDEAEGLEKIENLQSHDNNEIYEKAVKILETYWLEDDDETLPTGDGAQPGTWLDGAGLMLGLLSESSLGGVGSWGFGWVRTGQFNYHVQIRRVVVGGFNSSIMTLLEVYVVFKVYIFAGHNYGEVLCCSSRDHIMWQWMGFLECGF

SEQ ID NO: 126590 - protein, 692 aa, Glycine max
  Coding DNA Sequence Number=SeqID_9812
  Gene Ontology: Mol. function=zinc ion binding; Cellular component =nucleus; Biological process=carbohydrate metabolic process
  Homolog annotation: Hit_ID=Q1S4D5; Match level="QueryCoverage=79%, HitCoverage=89%, E-value=0.0, Identity=54%"; Hit description=FAR1; Zinc finger, SWIM-type
  Pfam annotation: Domain name=FAR1; Domain location=66-283; Score =204.7; E_value=2.2e-58; Accession=PF03101.5; Description=FAR1 family
  Pfam annotation: Domain name=SWIM; Domain location=488-521; Score =34.5; E_value=3.7e-07; Accession=PF04434.8; Description=SWIM zinc finger
  Pfam module annotation: Pfam domain module=FAR1::SWIM; Domain location=66-283::488-521
VVVTDDRMSEGTSLVLESSENGTDLSQDDIGTIEEIPEETILSRQTSVNLVPFIGQRFVSQEAAYEFYCSFAKQCGFSIRRHRTRGKDGVGRGVTRRDFTCHRGGYPQIKPSDDGKVQRNRKSSRCGCQAYMRIVKRSDFDVPEWRVTGFRNIHNHELLKSNEVHLLPAYCPISPDDKGRICMFAKAGMSVRQMLRLMELEKGIKLGCLPFTEIDVRNLLQSFRNVDRDNDAIDLIAMCKRLKDENHNFKYEFKIDSNNRLEHIAWSYSSSIQSYEAFGDAVVFDTTYRVEAYDMAFLGFMKGKAPQTILTDHNMWLKEAIAVELPETKHGFCIWHILSKFSDWFSLFLGSQYDEWKAEFHRLYNLELVEDFEEGLTSTCQSESINAFIQQFLSAQSQLDRFVEQVVEIVDFNDRAGAKQKMQRKLQKVCLKTGSPIESHAATALTPYALSKLQEELVLAPQYASFLVDEGCFQVRHHSQSDGGCKVFWVPCQEHISCSCHLFEFSGILCRHVLRVMSTNNCFHIPDQYLPARWRGNNSSSVNHYRGTTSRDQPERIQFLESMVSTFLVESIETEERLDVACDQISMVLSRIKTFPRSPHGVNDIAYSYPSDSLILPEVEDTDGMIPGFTITNPHDSITTGKLKERRARDVVDLTRKRRQFSMPLCAQYGHDASDCSIMASDNMSGDALGYL

SEQ ID NO: 126591 - protein, 266 aa, Glycine max
  Coding DNA Sequence Number=SeqID_9813
  Pfam annotation: Domain name=DUF1218; Domain location=70-195; Score =19.6; E_value=0.00021; Accession=PF06749.3; Description=Protein of unknown function (DUF1218)
MPQRMAVTHADLEPSRSKTDLSSKTGAFLMVLTILIGLFCFILCLIAEATRSEVTWMDTGGKENGAKSECVYSGSGKVPLLCAASAFVGLAFAMVMEHAYMLIAVSKSSPSLLTWDPDSPSAKSLTWQAGFFFITTWICFGIAEILLLAALSVESGHLKNWSKPRTGCYSIREGLFSAAGVFALATVFLAAGLYLTALRAQRMSEEHANVRREVLEASALYASPPRSPQPQYMSTVARENPTTRETQNELLLSVFPTPFIKSHGFV

SEQ ID NO: 126592 - protein, 62 aa, Glycine max
  Coding DNA Sequence Number=SeqID_9814
  Homolog annotation: Hit_ID=O81644; Match level="QueryCoverage=91%, HitCoverage=5%, E-value=7e-15, Identity=64%"; Hit description=Villin- 2
MLVLKKCIIITDGEAKPMEGELSKSLLENYKCYLLDCGAEVFVRVGRVTQVKERKAECEAAE

SEQ ID NO: 126593 - protein, 110 aa, Glycine max
  Coding DNA Sequence Number=SeqID_9815
MGRHILLELWKKCLVLRLRANSESETESIGGVSDEANEEMYGDHGTRGVSHRGGRREDRSTMMSKNSKCPEGVATHGINVLHTSTFKDDMLYKEVECHEGMSNMLACSKK

SEQ ID NO: 126594 - protein, 123 aa, Glycine max
  Coding DNA Sequence Number=SeqID_9816
ILERAFQPLMMVASMEKGLGCGNEGRPMRSKAGEKIFGALREMSSLFSVLLVLSLSHPGKITLSSRNPGGSQEWLKVSLSVDYRMRLVGEKRLWNIVRVYFGCGGFGGGGGCGGGCGGGRRRR

SEQ ID NO: 126595 - protein, 183 aa, Glycine max
  Coding DNA Sequence Number=SeqID_9817
MLRNLADYIIIPFLTYGMLRNLTNYAMMLPFDFRCVTEPLRIVHQYFLLFFGMSRNFTNCLMMGAKHLTRTKQRSHVIKQRSPDEIRGPYHSSFFFTSSKWCDQKGEYLQKGLQCSITVIIASRWSEWVHLDLEGEMKVLEKRTLDVEASNKLNKEEVEKLEATLAIAKRERNAEKEERIGVE

SEQ ID NO: 126596 - protein, 55 aa, Glycine max
  Coding DNA Sequence Number=SeqID_9818
MDRLWLLLYKWSDMQYHMPPYCTCTNVAGEIVEIGQVKDFKVGDKVLAKLNHQVF

SEQ ID NO: 126597 - protein, 109 aa, Glycine max
  Coding DNA Sequence Number=SeqID_9819
KVQHRRHDRPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 126598 - protein, 100 aa, Glycine max
  Coding DNA Sequence Number=SeqID_9820
GVVLAEVLLADSRFTRPDMGFHPTKLNFVPSDADEAPLDVSICLHAFGIVGCGSFSGVKSCEREVNVGGLVPPHCSLKSVVSDDACPGACFVQRDATTLS

SEQ ID NO: 126599 - protein, 129 aa, Glycine max
  Coding DNA Sequence Number=SeqID_9821
MRHHPLGNKPWKEELHHQESALDKKLREEALTEEMNEREWHLQSPFLLLHSTAIDFQEAKDFIDEEDPRPTSSTWSYIKTQEKIQGLGNGWCRLRRCCGIKGANEGKGEIWEQRAERAVVRDKRRESLI

SEQ ID NO: 126600 - protein, 187 aa, Glycine max
  Coding DNA Sequence Number=SeqID_9822
MEEFDAQVAWPRDQPYSSRGGGVSTAQEPVVGEHHPQKMVQGKFVPNFGEPLGMEAKCLKKKGKYGEGTNAKVKVILWMNALLEPKLLNPRKTMNCWQPNPITSLESPSDSFLCVHCCMIGDEMQSSWAKLNSWAKHIFTTKHSFSALSTKENLAERQHQSRTLIVVGAFSQAKLETGAKPNFTYSR

SEQ ID NO: 126601 - protein, 266 aa, Glycine max
  Coding DNA Sequence Number=SeqID_9823
  Gene Ontology: Mol. function=protein serine/threonine kinase activity; Biological process=protein amino acid phosphorylation
  Homolog annotation: Hit_ID=Q1S890; Match level="QueryCoverage=79%, HitCoverage=24%, E-value=3e-72, Identity=62%"; Hit description =Protein kinase; Hydroxymethylglutaryl-coenzyme A reductase
  Subcellular localization annotation: CTP_CleavageSite=26; ConfidenceScore=5.45e-01
MMSMILALWHVLKSRTLPGKCSLKCSAGMKKFFPNSKRRKCYRILANNSTTLVLVRAKFVYKNYDGLGKSPKFFVCIGIAIAASINLVESDPWSEEFLWTFHKDTLSFCLNAIPKGGSLVISSPEIRPLPQGAYTNGMEDFPIKLIRKSYRINCGHSNDSIRYPLDPFDRIWDADRSFTLFHVATGFKIQLSFKQSSLVKKPPPVVLQTGRVLARRNTLTYSDAILPRRGSITRAMARRLQEYWARDAGEGHRILISFRVDFGRMD

SEQ ID NO: 126602 - protein, 403 aa, Glycine max
  Coding DNA Sequence Number=SeqID_9824
  Gene Ontology: Mol. function=ubiquitin-protein ligase activity; Cellular component=ubiquitin ligase complex; Biological process =protein ubiquitination
  Homolog annotation: Hit_ID=Q2HVY1; Match level="QueryCoverage=99%, HitCoverage=100%, E-value=1e-174, Identity=77%"; Hit description=U box
  Pfam annotation: Domain name=U-box; Domain location=5-80; Score=77.3; E_value=4.9e-20; Accession=PF04564.6; Description=U-box domain
MDEIEIPAHFLCPISLQLMRDPVTVCTGITYDRENIERWLFSCKNNTCPVTKQCLLNHDLTPNHTLRRLIQSWCTLNASLGVERIPTPKSPIDRTQIVKLLTEAKRFPEKQLKCLTRLRSIAFEGQRNKTCLESAGVIEFLVSTMKNNNTQEDSTVLSEAAIEVLFHLNLSEARVKALINNEEFHFIESLFHVLRLGNYQSRAFATMLLRSAFEVADPIQLISVKTALFVEIMRVLRDQISQQASKAALKLIVELFPWGRNRIKGVEGGAVLVLVELLLGASERRTCELILIALDQLCGCAEGRAELLNHGAGVAIVSKKILRVSHVASDRGVRILASICRYSANARVLHEMLQVGAVSKLCLVLQVNCSLKTKERAKEILQLHSVVWKNSPCIPVPLLSSYP

SEQ ID NO: 126603 - protein, 415 aa, Glycine max
  Coding DNA Sequence Number=SeqID_9825
  Gene Ontology: Mol. function=ubiquitin-protein ligase activity; Cellular component=ubiquitin ligase complex; Biological process =protein ubiquitination
  Homolog annotation: Hit_ID=Q3HLY8; Match level="QueryCoverage=99%, HitCoverage=99%, E-value=4e-92, Identity=45%"; Hit description=U-box protein
  Pfam annotation: Domain name=U-box; Domain location=5-82; Score=81.9; E_value=2e-21; Accession=PF04564.6; Description=U-box domain
MTEIETPQFFLCPISLQIMKDPVTTVTGITYDRESIEQWLLKAKDCTCPITKQRLPRSTEFLTPNHTLRRLIQAWCSANEANGVDQIPTPKSPLSIANVEKLVKDLEVSSRFQRALEKLHDLAIENGRNRRCMASAGVAEAMVHVITKSFIQGNKTTSCVEEALRILGLLWSSANNMVDNDNMKRMVGENFDFLNSLTWVLQLQTKNNVKVINEAMPILKLTIEAKDSTPLGNLKLEFFKVVVSVMKNRELTQQAVKSALHVLIETCPLGRNRMKIVEAGAVVELIELALEKPEKNMTELIFILLAHLCSCADGREQFLQHAAGIAVVSKRILRVSPTTDDRALHIFSLVSKFSASNEVVQEMLRVGAVSKLCMVLQADCASYLKEKARGVLRLHSKTWNNSPCIQVYLLTRFHR

SEQ ID NO: 126604 - protein, 98 aa, Glycine max
  Coding DNA Sequence Number=SeqID_9826
METDAEREDSQFTSICAEINELEGAINLRKLRRKVERCCLDRQSVHHRGAGDASKLKLLSLLLSDGFILGWDFTWESFMSSTLCNFVVFSKRKFYINL

SEQ ID NO: 126605 - protein, 164 aa, Glycine max
  Coding DNA Sequence Number=SeqID_9827
MVVPIAVVVTNANENHHHRHIEFVLQADLIQSTLSISRLIFTNSSVAQENVFVAELVVQKPLVEKVAFTSDKDIEAQGPTQGLGGPITKARAKKTKETLQQLVAIILEVVLAAYSSLSGLGNPRRGLVRDVLTQHVASLPSEYTVSSRAQLAKPKFTYSRLASL

SEQ ID NO: 126606 - protein, 483 aa, Glycine max
  Coding DNA Sequence Number=SeqID_9828
  Gene Ontology: Mol. function=transporter activity; Cellular component= integral to membrane; Biological process=auxin mediated signaling pathway
  Homolog annotation: Hit_ID=Q8GV76; Match level="QueryCoverage=99%, HitCoverage=72%, E-value=0.0, Identity=76%"; Hit description=Auxin efflux carrier protein
  Pfam annotation: Domain name=Mem_trans; Domain location=1-483; Score =253.7; E_value=3.7e-73; Accession=PF03547.8; Description=Membrane transport protein
MEQFPETAASIVSFKIDSDVVSLDGRDFLETDAEVGDDGKLHVTVRKSNASRRSFMMTPRPSNLTGAEIYSLSSSRNPTPRGSNFNHADFYSMMGYAPRHSNFGAADMYSVQSTSRGVTPRPSNFEENCGSAGAMQQQTISSPRFGFYPAVQTLPAAYPAPNPEFSSGLTKSVSKNSQTQPQLQTQTQPQVQAQVAPPAPPPQVAQPANSGNKTSHDAKELHMFVWSSSASPVSEAGGLHVFSGADFGASDQSGRSDQGAKEIRMLVADDHPQNGETNKAAAEGEFGGEELKFPAKEGEQAEEEGGKAGPAGLNKLGSSSTAELHPKAAVAGAGKHMPPASVMTRLILIMVWRKLIRNPNTYSSLIGVIWSLVAFRWHVHMPKIIEKSISILSDAGLGMAMFSLGLFMALQPKIIACGNSVATFAMAVRFLTGPAVMAAASIAVGLRGTLLRIAIVQAALPQGIVPFVFAKEYNVHPAILSTA

SEQ ID NO: 126607 - protein, 217 aa, Glycine max
  Coding DNA Sequence Number=SeqID_9829
  Gene Ontology: Mol. function=zinc ion binding
MTIVPKNRLKSSWWWQFCNIEDFNDDNFTKTVLEIANPHGLTQLVPSLPHSLMSCPHFVPHSSVVEGASIVIEDFVGIRIPLMPSPTPSQKKVNFLVTYHFVNALKPHSSSSRAKLSMRNILPKFGFKNRAPSILLDVEKGVTIATQEGSFSVHQEKSSIPRSVSFTKMFTPKIKRTSSLPIEELGLRAMSRSAHKSGLAQEGPRGEAQCMLSARSA

SEQ ID NO: 126608 - protein, 82 aa, Glycine max
  Coding DNA Sequence Number=SeqID_9830
MDEKDEEGEKVEKIHNIVIGKRLATTTNATSTATKKGKNVKVSYPFDSMFVKSVDASSYMKINEKVFYLLDSFVEEIGEMFK

SEQ ID NO: 126609 - protein, 74 aa, Glycine max
  Coding DNA Sequence Number=SeqID_9831
MRKKKETWKPTVVCVGPWSPQNMKKGVRLSCPLARLLGPNFELCKRKEPAPTSSILSPLYKPTMHIMIIITRLR

SEQ ID NO: 126610 - protein, 131 aa, Glycine max
  Coding DNA Sequence Number=SeqID_9832
MTRARAKKAQEALEHMVTILRAVQMQGEAQHLEAHKGKLLVLWFFLEPTDLIRNSPNSCGDPLGLSNLDVCGAYLIFYLSRFLFVFGLSTFFRLCLRPEFSQVHSARFLTLNGSSERHVSPHFGITQIRVL

SEQ ID NO: 126611 - protein, 90 aa, Glycine max
  Coding DNA Sequence Number=SeqID_9833
  Subcellular localization annotation: CTP_CleavageSite=45; ConfidenceScore=5.12e-01
MGALNRQGFQGYNQGGPLGFNQGRNFTQGSSWRNHPGNQFNKEQRSQPGQNSNQGIDLYEKTNIHVQLQDHGIIHQELGDTSGKISQTNG

SEQ ID NO: 126612 - protein, 85 aa, Glycine max
  Coding DNA Sequence Number=SeqID_9834
MASYGSELVLTHLLSLKWRLQSSFFLLHSTAIDLQEAKDSIDEEDPRPTSSIWSYIMWYQEHLRLVPYMMPMKKLSCGAELWLDL

SEQ ID NO: 126613 - protein, 237 aa, Glycine max
  Coding DNA Sequence Number=SeqID_9835
  Homolog annotation: Hit_ID=Q98KJ7; Match level="QueryCoverage=41%, HitCoverage=52%, E-value=4e-15, Identity=46%"; Hit description =Probable transcriptional regulator
  Pfam annotation: Domain name=HTH_3; Domain location=145-199; Score =66.8; E_value=6.8e-17; Accession=PF01381.12; Description=Helix-turn -helix
MGQSLAEHFHCSLTAEPALKEQAFGQFEGMPLELLRQKHPNYANALFRLDAEYCPPGGESLAHASQRGTLAILKEGTVDSFPRYAHPNASIENPSCQSHHYLSTMFTPRLRIANSCSSDDAGESEGEMDKTEKNQIVDSDIAQLLLKHRKARNWTVTELAQRSGVSQAMISKIERGVSSPSATILSRLANAMNITLSKLFAELEQHQNSLVRFAHQQQHWTDEQSGIIRWTLSPAGA

SEQ ID NO: 126614 - protein, 101 aa, Glycine max
  Coding DNA Sequence Number=SeqID_9836
  Subcellular localization annotation: CTP_CleavageSite=10; ConfidenceScore=5.28e-01
MSLPGAVHASSTYESGAPRSYCVALFTNSPFSTFLRSPMNVIAWHCSCILHLRVWNPAKLLRSALRQYSVLHFLTEPHECHCLALFMHPPPTSLEPREVMA

SEQ ID NO: 126615 - protein, 336 aa, Glycine max
  Coding DNA Sequence Number=SeqID_9837
  Gene Ontology: Mol. function=glutamyl-tRNA reductase activity; Biological process=tetrapyrrole biosynthetic process
  Homolog annotation: Hit_ID=Q2QM36; Match level="QueryCoverage=83%, HitCoverage=80%, E-value=5e-65, Identity=53%"; Hit description =Expressed protein
MIGLPEPENEFRRDFRRPVSVRMAVDGAGPVNTRERVFGASIRIRHGQQGRKIMLLGVTLIVTVTRDLEFPPKCPVLNDDERVAAREREELRAHAEIFEGDLRHHGVASAGGVAPPELGRVGEDLDEGFVFEAEAEAGRGFGVFGIEGWGEEEGVVGVFEGVERDAVLGEEGEVGVGRVVEESGGEEAASGGDKGRGGAEGGFGGDEFVTEKRGKRESERWEGEEEKKRSHKGEKWRSVLVRKRKAILREGFLEERWKNLEGLEWELLEWEMARLKRLMSSSSSEGEMGGKEWGFGGRIRGARKKRIGRERRREKVNTNGLENIEFPGEWKAYRRN

SEQ ID NO: 126616 - protein, 34 aa, Glycine max
  Coding DNA Sequence Number=SeqID_9838
MTTILHLVMDNKKMRPIICKTKADLNKTFKEATK

SEQ ID NO: 126617 - protein, 579 aa, Glycine max
  Coding DNA Sequence Number=SeqID_9839
  Gene Ontology: Mol. function=ubiquitin thiolesterase activity; Cellular component=transcription factor TFIID complex; Biological process=ubiquitin-dependent protein catabolic process
  Homolog annotation: Hit_ID=Q9C585; Match level="QueryCoverage=98%, HitCoverage=65%, E-value=0.0, Identity=57%"; Hit description =Ubiquitin-specific protease-like protein
  Pfam annotation: Domain name=DUF1055; Domain location=88-213; Score =2.1; E_value=5.2e-07; Accession=PF06337.3; Description=Domain of Unknown Function (DUF1055)
  Pfam annotation: Domain name=UCH; Domain location=263-573; Score =123.9; E_value=4.7e-34; Accession=PF00443.19; Description=Ubiquitin carboxyl-terminal hydrolase
  Pfam module annotation: Pfam domain module=DUF1055::UCH; Domain location=88-213::263-573
MVCASEDCSDNSQRPDSHKDQRVYFVPHRWWKDAQDSMPADSDKKKGIAFASFPGSSYAGPMKIINNIFNSDLVFSLRREDDLQHIRENGEVGVSGRDFALVSGDMWLQALKWHSDSKNVMKDDKGFSATDSDMADVYPLQLRLSVQRETNSFGVRISKKDNAVELFKRACKMFSVDSETLCMWDYSDQITFLMNDKNQILLELQVYGLSDSIRCREGKKDEMANFSGSASLKMNDTYDGANSDCMNSNSLTFSSGPGEAGSLGLTGLQNLGNTCFMNSSLQCLAHTPKLVDYFLEDYIREINHDNPLGMNGEIALAFGDLLRKLWAPGASPVAPRTFKSKLARFAPQFSGFNQHDSQELLAFLLDGLHEDLNRVKCKPYIEVKDGDDRPDEEVADEYWHNHLARNDSVIVDVCQVDYIAIGLLWKKLISFFVGRGVTFLLKGQYKSTLVCPVCRKVSVTFDPFMYLSLPLPSTTMRTMTITVSGNGGEMPQLSPYTITVPKNGRFEDLTRALSIACALGADETLLVAEVYNNCIIRFLEDPTDSLSLIRDADKLVAYRFLKYNADAPLVVFINQRMEE

SEQ ID NO: 126618 - protein, 86 aa, Glycine max
  Coding DNA Sequence Number=SeqID_9840
MMIWEQRAKLVMATARWVLKHPVYGIVILRLGIYTKYESGDPTVMWLRMPLDLWVMVTKGGVVDKSWTFAPTYPQFVMRNSDLRSS

SEQ ID NO: 126619 - protein, 284 aa, Glycine max
  Coding DNA Sequence Number=SeqID_9841
  Gene Ontology: Mol. function=ubiquitin thiolesterase activity; Cellular component=cytosol; Biological process=ubiquitin-dependent protein catabolic process
  Homolog annotation: Hit_ID=Q9C585; Match level="QueryCoverage=93%, HitCoverage=29%, E-value=1e-77, Identity=55%"; Hit description =Ubiquitin-specific protease-like protein
  Pfam annotation: Domain name=UCH; Domain location=95-278; Score= -15.6; E_value=1.6e-05; Accession=PF00443.19; Description=Ubiquitin carboxyl-terminal hydrolase
QYVYGKLTLNWKAFGIPVVDMLYSVTNGSDLRNLYLKWFYPFQNPIEEALENCLVFKETEEDTETEATTPSLGSNVNGLDTPSDGGMEFYVTDEKGTIKNSKILMNEPLVINGELRLLHVLVCWSEEQLKKYNTQLCSSLPEVFKSGFLAKRPQESVSLYKCLEAFLQEEPLGPEDMWYCPGCKEHRQASKKLDLWRLPEILVIHLKRFQYSRYLKNKLETYVDFPVDNLDLSAYITHGNGESYNYTLYAVSNHYGSMGGGHYTAFVHLMVWDMRNGFETIEMV

SEQ ID NO: 126620 - protein, 501 aa, Glycine max
  Coding DNA Sequence Number=SeqID_9842
  Gene Ontology: Mol. function=protein serine/threonine kinase activity; Cellular component=membrane; Biological process=protein amino acid phosphorylation
  Homolog annotation: Hit_ID=Q9S971; Match level="QueryCoverage=93%, HitCoverage=53%, E-value=1e-104, Identity=40%"; Hit description=ARK3 product/receptor-like serine/threonine protein kinase ARK3
  Pfam annotation: Domain name=B_lectin; Domain location=70-183; Score =136.6; E_value=6.7e-38; Accession=PF01453.15; Description=D-mannose binding lectin
  Pfam annotation: Domain name=PAN_2; Domain location=340-408; Score =114.5; E_value=3e-31; Accession=PF08276.2; Description=PAN-like domain
  Pfam annotation: Domain name=S_locus_glycop; Domain location=197-322; Score=164.5; E_value=2.6e-46; Accession=PF00954.11; Description=S -locus glycoprotein family
  Pfam module annotation: Pfam domain module=B_lectin::PAN_2::S_locus _glycop; Domain location=70-183::340-408::197-322
MEILSFMIIFACIFVPSLKISLAIDSINLLQSVRDGETLVSKGGKFELGFFSPGSSQKRYLGIWYKNIPNKTVVWVANGANPINDSSGIITLNNTGNLVLTQKTSLVWYTNNSHKQAQNPVLALLDSGNLVIKNEEETDPEAYLWQSFDYPSDTLLPGMKLGWDLRTGLDRRYTSWKSPDDPSPGDVYRALVLHNYPELYMMKGTQKLYRYGPWNGLYFSGQPDLSNNTLFNLHFVSNKDEIYYTYTLLNDSDITRTITNQTGQIDRYVWDENGQTWRLYRYYPKEFCDSYGLCGPNGNCVITQTQACQCLKGFSPKSPQAWFSSSDWTGGCVRNKGLSCNGTDKDKFFKFKSLKVPDTTYTFVDESIGLEECRVKCLNNCSCMAFTNSDINGEGSGCVMWFHDLFDMRQFESVGQDLYIRMAASESDSQEPVSRHKNNTPKIVASSIAAICGVLFLSTYFICRIRRNRSPRNSADDVIVTLEATCMTYPAILIDGMWLSK

SEQ ID NO: 126621 - protein, 73 aa, Glycine max
  Coding DNA Sequence Number=SeqID_9843
MPCQVGHCKPKRKYRGCLVQKGISCSMDDGPTGYWPLANWQRPTLGQDKVKSPIYLAIFLSDKIHATHTHASN

SEQ ID NO: 126622 - protein, 43 aa, Glycine max
  Coding DNA Sequence Number=SeqID_9844
MMDKRLSLWMKHTMYPKKGQMVTLSKMKSTVQVVLFEDERVTH

SEQ ID NO: 126623 - protein, 195 aa, Glycine max
  Coding DNA Sequence Number=SeqID_9845
  Gene Ontology: Mol. function=protein serine/threonine kinase activity; Cellular component=membrane; Biological process=protein amino acid phosphorylation
  Homolog annotation: Hit_ID=Q7XJ40; Match level="QueryCoverage=99%, HitCoverage=25%, E-value=2e-52, Identity=51%"; Hit description =Receptor-like protein kinase ARK1
  Pfam annotation: Domain name=Pkinase; Domain location=3-164; Score= -87.8; E_value=0.0025; Accession=PF00069.15; Description=Protein kinase domain
  Pfam annotation: Domain name=Pkinase_Tyr; Domain location=1-149; Score=-146.0; E_value=0.0016; Accession=PF07714.7; Description =Protein tyrosine kinase
  Pfam module annotation: Pfam domain module=Pkinase::Pkinase_Tyr; Domain location=3-164::1-149
MYIHQDSRLRIIHRDLKPSNILLDENLSPKISDFGVARTFGGDESEGMTRRVVGTYGYMAPEYAVDGSFSVKSDVFSFGILALEIVSGTRNKGLYQTDKSHNLVGHAWTLWKAGRELDLIDSNMKLSSCVISEQFPDDRPPMKSVIPMLEGHMEMVEPKEHGFISVNVLGELDLHSNPQNTSSSNYVTITMLEGR

SEQ ID NO: 126624 - protein, 65 aa, Glycine max
  Coding DNA Sequence Number=SeqID_9846
MAEDEDLEPYISVGVATSPYPSTLVLSNSNSLQTIEEREKKLPPSGISSGSSRVAERNCSGGAKW

SEQ ID NO: 126625 - protein, 373 aa, Glycine max
  Coding DNA Sequence Number=SeqID_9847
  Gene Ontology: Mol. function=metal ion binding; Cellular component =intracellular; Biological process=protein kinase C activation
  Homolog annotation: Hit_ID=Q6YWL6; Match level="QueryCoverage=97%, HitCoverage=57%, E-value=2e-67, Identity=39%"; Hit description =Pentatricopeptide (PPR) repeat-containing protein-like
  Pfam annotation: Domain name=PPR; Domain location=185-219; Score =28.7; E_value=2e-05; Accession=PF01535.11; Description=PPR repeat
  Pfam annotation: Domain name=PPR; Domain location=220-254; Score =20.4; E_value=0.0066; Accession=PF01535.11; Description=PPR repeat
  Pfam annotation: Domain name=PPR; Domain location=256-290; Score=6.1; E_value=1.4; Accession=PF01535.11; Description=PPR repeat
  Pfam annotation: Domain name=PPR; Domain location=328-362; Score=2.8; E_value=3.5; Accession=PF01535.11; Description=PPR repeat
  Pfam module annotation: Pfam domain module=PPR::PPR::PPR::PPR; Domain location=185-219::220-254::256-290::328-362
MYFDEYTYNFVLGACARSPSASTLWVGRQLHARIVKHGFESNILVPTTKIYFYASNKDIISARRVFDEMPRRSTVTWNAMITGYSSQKEGNKKYALNALSLFIDMLVDVSVIKPTGTTIVSVLSAVSQIGMLETGACIHGFAEKTVCTPEDDVFIGTGLVDMYSKCGCLDSALSVFWRMNQKNILTWTAMTTSLAIHGKGKQALEVLYKMGAYGVKPNEATFTSFLSACCHGGLVEEGLILFHEMKRTFGMMPQIKHYGCIVDLLGRAGNLEEAYDFIMRMPINPDAVIWRSLLGACKIHGDVVMGEKVGKFLLQLEEWSSAESPKSEDYIALSNVYALAEKWDDVEIVRKTMKSKGILSKAGSSAVQTVSMA

SEQ ID NO: 126626 - protein, 59 aa, Glycine max
  Coding DNA Sequence Number=SeqID_9848
MEAIRRGISDSSKEYLNPCIGDRFVTNKAFIHNKGYLDQSKEEKENPFALALNQGQDLS

SEQ ID NO: 126627 - protein, 114 aa, Glycine max
  Coding DNA Sequence Number=SeqID_9849
GAADVDAGVGAAEVEGSSAGLALALLTPRIEIVRSSGVGNPSLEVLDWAIEVIWPEISTPMSISMRETKPKINLALSTVKIFPGWPSKFKMNPQPGNLQYLEYARKVSLSANTT

SEQ ID NO: 126628 - protein, 266 aa, Glycine max
  Coding DNA Sequence Number=SeqID_9850
  Gene Ontology: Mol. function=strictosidine synthase activity; Cellular component=cellulose and pectin-containing cell wall; Biological process=biosynthetic process
  Homolog annotation: Hit_ID=Q9C586; Match level="QueryCoverage=99%, HitCoverage=82%, E-value=5e-97, Identity=56%"; Hit description =Putative strictosidine synthase-like
  Pfam annotation: Domain name=SGL; Domain location=35-264; Score= -67.6; E_value=4.2e-05; Accession=PF08450.2; Description=SMP -30GluconolaconaseLRE-like region
  Pfam annotation: Domain name=Str_synth; Domain location=130-203; Score=81.1; E_value=3.5e-21; Accession=PF03088.7; Description =Strictosidine synthase
  Pfam module annotation: Pfam domain module=SGL::Str_synth; Domain location=35-264::130-203
MPAWSEVPTDRDKDNSLQKSEVLIVNQVQGPESIAFDPLGRGPYTGVADGRILFWNGQSELCNPKESASPMSYVETEHICGRPLGLRFDKNTGDLYIADAYYGLMKVGPQGGLATSLATEAEGVPLRFTNDVDIDTEGNLYFTDSSTNFQRRVLKYNLATKETTVLMRNVQFPNGISLSKDASLFVFSEGMNGRLRKYWLKGVKAGTSEILAILPGFPDNVRVNGNGDFWVAIHCRRFHAVVVKYSPEGKLLRILEDSEGKVVRTV

SEQ ID NO: 126629 - protein, 533 aa, Glycine max
  Coding DNA Sequence Number=SeqID_9851
  Gene Ontology: Mol. function=transferase activity; Biological process= cell adhesion
  Homolog annotation: Hit_ID=Q8RWC5; Match level="QueryCoverage=80%, HitCoverage=96%, E-value=1e-148, Identity=65%"; Hit description =Fasciclin-like arabinogalactan protein 16 precursor
  Pfam annotation: Domain name=Fasciclin; Domain location=270-403; Score=19.9; E_value=8.1e-05; Accession=PF02469.12; Description =Fasciclin domain
  Pfam annotation: Domain name=Fasciclin; Domain location=53-176; Score= 91.9; E_value=2e-24; Accession=PF02469.12; Description=Fasciclin domain
  Pfam module annotation: Pfam domain module=Fasciclin::Fasciclin; Domain location=270-403::53-176
  Subcellular localization annotation: CTP_CleavageSite=29; ConfidenceScore=5.17e-01
MDRHSIPGVSNLCIFLFLVSLFPQALTLRVSSPSSPTGQINSNSILVALLDSHYTELAELVEKAMLLQKLEDTVATHNITIFAPTNEALYRNLDPDFKRFLLQPANLHSLQTLLLSHITPALIGSQTLTRHVTTLSDHNLKLSENLTTVDQARVTHPNVVTRPDGVIHGIDRLLLPRSVEDDFNRRRSLRSISAVKPEPAPEVDPRTHRLKKPPPPAKPGSLPELPIYDAMAPGPSLAPAPAPGPGGPHHHFNGERQVKDFIHTLLHYGGYNEMADILVNLTSLDVEMGRLVSEGYVLTVLAPNDEAMAKLTTEQLSEPGAPEQIMYYHIIPEYQTEESMYNAVRRFGKVRYDTLRLPHKVVAQEADGSVKFGHGDGSAYLFDPDIYTDGRISVQGIDGVLFPAAEEDAERVRPVTQTGQNATKLVVKHRRVGLEDLNCDQYEVENKKKFLKGETEVFEKKLRVLCCLELKQDKRVEKPSGGENCWKQHAGCLEPLDSILDSPLVNEEAHVFVASKISQNNEVRLQLVVSFTR

SEQ ID NO: 126630 - protein, 78 aa, Glycine max
  Coding DNA Sequence Number=SeqID_9852
MYPVSAWVFKCVVWDAWTLEGRQMGVEKRFVVILSFGGHIRHESSEFGLGPCYYYVLCVFSKERLISWCNPVRGILIG

SEQ ID NO: 126631 - protein, 411 aa, Glycine max
  Coding DNA Sequence Number=SeqID_9853
  Gene Ontology: Mol. function=zinc ion binding
  Homolog annotation: Hit_ID=Q2HT04; Match level="QueryCoverage=78%, HitCoverage=81%, E-value=8e-73, Identity=62%"; Hit description=Zinc finger, RING-type
MLVSREKALAKSVLVATIQLLSESLNNIWRIDFVFNSNSYVVGVKEAPSAPCVGNLSVSKIQQAKNYLRQWKESGTLGSIHLEMPPYFIIQHWGILSYNMYVLPVGASDADLEERIIQHLAAAAAMGRARHVARREGQRNRSSAQGRQHFLVFSTHPNSPPMAPASSSPSQRGDDEPTPTIDVANLSPTPATGEESSQPTLVSPVQAEQVSASGSGTTALATDHQGSSYNNRRSPNQSSPSSQDRAGPSELQSFSESLKSKLNAVSTRYKESISKSTRGWKERWFSRNNTMSDLGSEVRREVNAGIATVSRMMERLETRDNNRSNSNSAPSNIEDGSVQGSNDQTLTAGNEGGSLVRDNNTKASCAAGRNRIAHWGCEIPWMALPIGWRRPGNWLGGSGFEYPAKNPQILT

SEQ ID NO: 126632 - protein, 125 aa, Glycine max
  Coding DNA Sequence Number=SeqID_9854
MEKLNSKEQHHDNNEKKNYEGEDSLGWKSLNKGNNTSERFYSQSTGKGRDKNKNIVETSVNNVIEETSKKPRLNWGEGLAMFEKKKTKGDGVSAATVATPAFGAFSSFSDILLDSINYSFLWPFN

SEQ ID NO: 126633 - protein, 153 aa, Glycine max
  Coding DNA Sequence Number=SeqID_9855
  Gene Ontology: Mol. function=oxidoreductase activity; Cellular component=nucleus; Biological process=rRNA processing
  Homolog annotation: Hit_ID=Q1SAX7; Match level="QueryCoverage=95%, HitCoverage=60%, E-value=1e-55, Identity=95%"; Hit description =Nucleotide binding protein, PINc
MGKAKKGPKFAVMKKIVTSKAIKSYKEEVLNPEKKNLMKEKLPRNVPTHSSALFFQYNTALGPPYRVLVDTNFINFSIQNKFWFYIYTFTWNAPFKVAVCDMELIMFDFGSGERDDGLLICKMHPLYYGLCDGRTREVRPKISCSSKVDVMSS

SEQ ID NO: 126634 - protein, 193 aa, Glycine max
  Coding DNA Sequence Number=SeqID_9856
ETGKASEVEVKDVKLNHPEEGSNAAKTKNKSMLPTSKASPISTPKSSKPASKTPNKTVTPASSTRKGSSPSLTMRQITSVEDKSMIKKQGLSVSFCNQTMTMAVRSKTMAVRSKTMARRLEAFLVPRSETKKKKKKKKKKKKTTKTKVLVVTKKKKKKKTTKTKVLAVTKKKNKKKLYLGNVATCHGRKEAVQ

SEQ ID NO: 126635 - protein, 182 aa, Glycine max
  Coding DNA Sequence Number=SeqID_9857
  Gene Ontology: Mol. function=peroxidase activity
  Homolog annotation: Hit_ID=Q2HT09; Match level="QueryCoverage=78%, HitCoverage=84%, E-value=2e-51, Identity=72%"; Hit description=Acid phosphatase/vanadium-dependent haloperoxidase related
  Pfam annotation: Domain name=DUF212; Domain location=18-173; Score =111.4; E_value=2.7e-30; Accession=PF02681.5; Description=Divergent PAP2 family
  Subcellular localization annotation: CTP_CleavageSite=9; ConfidenceScore=5.24e-01
MADVTANLQAATTASTPYALPTNLPLLSAFLSFALAQFLKIFTSWYKEKRWDSKRLLDSGGMPSSHSATVSALAVAICLQEGAGSPAFAIAVVLACIVMYDATGVRLHAGRQAELLNQIVCELPPEHPCSNVRPLRDSLGHTPLQRFYRSSWNSIFHVWLILIIAAPTFHSPIAIIFMLRSC

SEQ ID NO: 126636 - protein, 122 aa, Glycine max
  Coding DNA Sequence Number=SeqID_9858
  Gene Ontology: Mol. function=oxidoreductase activity; Cellular component=nucleus; Biological process=rRNA processing
  Homolog annotation: Hit_ID=O82346; Match level="QueryCoverage=73%, HitCoverage=45%, E-value=7e-41, Identity=86%"; Hit description =Expressed protein
  Pfam annotation: Domain name=Fcf1; Domain location=1-83; Score=174.5; E_value=2.6e-49; Accession=PF04900.3; Description=Fcf1
MAELEKSGQKYHVALRIAKDPRFERILCTHKGTYADDCLVERVTQHKCYIVATCDRDLKRRIRKIPGVPIMYITKRKYSIERLPEATIGGGRYSYLVKFIVTNMNLNLVCWTTQHCIALFRN

SEQ ID NO: 126637 - protein, 92 aa, Glycine max
  Coding DNA Sequence Number=SeqID_9859
  Gene Ontology: Cellular component=nucleus; Biological process=mitotic cell cycle
  Homolog annotation: Hit_ID=Q2HT10; Match level="QueryCoverage=70%, HitCoverage=10%, E-value=2e-16, Identity=67%"; Hit description=Barren
MDLQVILAFHHLQLITLASCTLEAGVTIYSLRVDSVHSEAYKVLARMNRACQDTEQDTTLGNVNAESGQASRKEVGKKVDSLGIWIEIIHFV

SEQ ID NO: 126638 - protein, 114 aa, Glycine max
  Coding DNA Sequence Number=SeqID_9860
MAKAHLTRHSSQFVASHQIDQDVTGKRMGWLRVEVGGEGLAADGGGAGCTGLGPFKLIIVGAHEERARGRLDTSGHRNPVLWPVVGLELKVFAIEMSFSEFMQLFGNRNRNGLI

SEQ ID NO: 126639 - protein, 712 aa, Glycine max
  Coding DNA Sequence Number=SeqID_9861
  Gene Ontology: Mol. function=cellulose synthase (UDP-forming) activity; Cellular component=membrane; Biological process=cellulose biosynthetic process
  Homolog annotation: Hit_ID=Q2HT17; Match level="QueryCoverage=99%, HitCoverage=100%, E-value=0.0, Identity=66%"; Hit description =Cellulose synthase
  Pfam annotation: Domain name=Cellulose_synt; Domain location=9-712; Score=271.8; E_value=1.4e-78; Accession=PF03552.5; Description =Cellulose synthase
MANQGHDLPLYEKIWVKRKFQRVIDTLILVLLLLLLSYRLFSSNNFTFPWFLAFICESWFTFTWIVILNTKWSPAVTITHPNRLLLRVPESEFPPVDLLVTTADHVLEPPIITVNTVLSLLALDYPTNKLACYVSDDGCSPLTFYALVEASKFAKFWVPFCKKNCVQVRAPFRYFSDIATNKSEDSLEFKQEWLQMKDMYDNLCQKIEEVTGKTIPFQLDGEFAVFSNTDQRNHPTIIKVILENMGDLLDGLPHLIYISREKRPQYHHNYKAGAMNVLTRVSGLMTNAPFILNVDCDMFVNNPKIVLHALCILMDSQRGKEVAFVQCFQQFYDGIKDDPFGNQWMITFKNIIMGMAGLQGPFYGGTNAFHRRNAIYGLYPDEIESERKGKLEGKILIEKFGSSKEFIKSSAQALGGSAFSANDITTFNFIEAATQVSNCEYEYDTCWGKQMGWLYGSISEDVPTGLNIQRKGWRSECCTPDPIAFTGCAPGGILSTMLQQKRWASGLTVVFFGKHSPITGMLFGKTQFRAGLSFFWLTNWGLRGLFLVCYIALLAFCIITNTNIFPKRMCIIRTTTASFLGFLSAMLKLSGISDSVFEITDKKPSTSGADGNNADAGRFTFEESPVFVIGTTILLVHMTAMLIKFLGLQPTHSGNGCGLGESISSMYVIVCYWPYLKGLFARGKYGIPLSTICKSAVLALVFVHFCRSNVIS

SEQ ID NO: 126640 - protein, 336 aa, Glycine max
  Coding DNA Sequence Number=SeqID_9862
  Gene Ontology: Mol. function=sequence-specific DNA binding; Cellular component=nucleus; Biological process=regulation of transcription
  Homolog annotation: Hit_ID=Q2HT21; Match level="QueryCoverage=100%, HitCoverage=57%, E-value=2e-39, Identity=37%"; Hit description=DNA -binding WRKY
MARGGGLSIDSDPIGSFLPHEPIVLNSFPEDNKDNNNSRQQHKWKLGTNMDATVSRKSSPSSTSNTNTTIPFQDHLTSDDKMPHLDEMNFFPNKSNKDDDDDNNLASASTSAPPSLDHLHHTHDHSSAILGLKVNTGLNLLTTNASSDQSMVVDDDISPNSGDKRAKSEMVVLQVELERMKTHLVSLMKDQMDKEDDKQQPHQVFDGKLEEKQAGNGGGALVPRQFMDLGLATNADTNETSHSHSSSVIRSQDSPPTNNTEVASKKNGGASDEGLVFDQDKKEFGRGIEREDSPSDQGVAANNNVPKFSPPRNVDQAEATMRKARVSVRARSEAPM

SEQ ID NO: 126641 - protein, 121 aa, Glycine max
  Coding DNA Sequence Number=SeqID_9863
  Gene Ontology: Mol. function=hydrolase activity
  Homolog annotation: Hit_ID=Q8LDC7; Match level="QueryCoverage=90%, HitCoverage=46%, E-value=9e-36, Identity=63%"; Hit description =Putative carboxymethylenebutenolidase
  Pfam annotation: Domain name=DLH; Domain location=2-119; Score=-45.3; E_value=0.00037; Accession=PF01738.9; Description=Dienelactone hydrolase family
MASEIANLKIVGAAIAFYAVPASQLADPAQAKAPVQAHFGELDNYVGFSYVTAAKALEEKLKASGVPHEVHIYPGNAHAFMNRSTEVIQRMKNMGMLDEDEASVQLAWSRFETWMTHYLSC

SEQ ID NO: 126642 - protein, 168 aa, Glycine max
  Coding DNA Sequence Number=SeqID_9864
MGTRGCISYNLVLAIRQLGYPMRGTPLEEELVPVISRGFNKTNMDVLQKVRKAWEVVQKKDKELRGSNNGPIGGYCKWLKAHVQGLDWLPSLRTAKREEVEAPEEDEEVQALRATLEQAQTVKERFKSVALKIRKENAELRDINIATTKALEQETKRARREEHDRNKF

SEQ ID NO: 126643 - protein, 80 aa, Glycine max
  Coding DNA Sequence Number=SeqID_9865
MNFDDAKEGSNKAASKDKHLLQDSLKIASTNKTLFKDSLKIKPCLKTMGFKVMQGSGNRLPEGKNEKELLKRVLNLNLNM

SEQ ID NO: 126644 - protein, 222 aa, Glycine max
  Coding DNA Sequence Number=SeqID_9866
  Gene Ontology: Cellular component=integral to membrane; Biological process=transport
  Homolog annotation: Hit_ID=Q8P7X4; Match level="QueryCoverage=98%, HitCoverage=63%, E-value=2e-53, Identity=49%"; Hit description=VirB8 protein
  Pfam annotation: Domain name=VirB8; Domain location=59-222; Score =39.7; E_value=6.6e-10; Accession=PF04335.3; Description=VirB8 protein
MFRKKDPGNSPKVEQSVAKAVSYEITVADMARRSERRAWWVATGSLLMSLALAGGYYYMLPLKEKVPFLVMADAYTGTATVARLSGTFQGETITSNEAINRSNVAQYVLARESYDSAVMGLRDWELVFVMSTDPVAQSMRVRYAGNNPQNPFVMYGRERAIRVKILSITPLGAEPNGSFRGASVRIQRSLLDKRTGVATYLDNQLVTMRFGYNQNLALSEQD

SEQ ID NO: 126645 - protein, 148 aa, Glycine max
  Coding DNA Sequence Number=SeqID_9867
  Gene Ontology: Mol. function=aspartic-type endopeptidase activity; Cellular component=lysosome; Biological process=sphingolipid metabolic process
  Homolog annotation: Hit_ID=Q5PT35; Match level="QueryCoverage=78%, HitCoverage=25%, E-value=8e-29, Identity=53%"; Hit description =Aspartic proteinase 9
MNVFSGCVNVCYVLFFPHYSVYSRRCDTVQLRLLAICTQDTSQANLALRIKMAQFLILGSSAEIRYGTGQISGFFSQDYVKVGDLIVLTRILLKQLESISVGKVSPIWYNMLNQHLLAQPVFSFWLNRNTDEKQGGQIVFGGVDSDHY

SEQ ID NO: 126646 - protein, 398 aa, Glycine max
  Coding DNA Sequence Number=SeqID_9868
  Gene Ontology: Mol. function=protein serine/threonine kinase activity; Cellular component=cell cortex; Biological process=protein amino acid phosphorylation
  Homolog annotation: Hit_ID=Q9FLQ2; Match level="QueryCoverage=84%, HitCoverage=75%, E-value=4e-73, Identity=44%"; Hit description =Similarity to NPK1-related protein kinase
  Pfam annotation: Domain name=Pkinase; Domain location=3-257; Score =242.3; E_value=1e-69; Accession=PF00069.15; Description=Protein kinase domain
  Pfam annotation: Domain name=Pkinase_Tyr; Domain location=3-257; Score=47.3; E_value=2.3e-15; Accession=PF07714.7; Description =Protein tyrosine kinase
  Pfam module annotation: Pfam domain module=Pkinase::Pkinase_Tyr; Domain location=3-257::3-257
  Subcellular localization annotation: CTP_CleavageSite=28; ConfidenceScore=5.16e-01
MEWTRGFIIGRGSSATVYTVTSSHSSTVAAVKSAELTLSNSEQLQREQRILSCLFSPHIVTYKGCNITEDKNNTLWFNLFMEYMPFGTLSQEIHRRGGGRLSEPATVHYTRQVLQGLEYLHNNGVVHCDIKGGNILIGEDGAKIGDFGCAKFANDSSAVIGGTPMFMAPEVARGEEQGYPADVWALGCTVLEMATGFAPWPNVEDPVTVLYHVAYSDDVPEIPCFLSEEAKDFLGKCFRRNPKERWSCSQLLKHPFLGEFSSNDKEIQESNSCSPTSILEQRFWNSVEEAEAECVSVSGNVVQIKSFEDSPMDRVRSLALSSGDPFWELDDENWITTRGSEAGASSCDGLNLDVNSRISGYLCDDYYKCRDVSVVVDNFNFERGNSEMLLPLKLEFFL

SEQ ID NO: 126647 - protein, 153 aa, Glycine max
  Coding DNA Sequence Number=SeqID_9869
  Gene Ontology: Mol. function=aspartic-type endopeptidase activity; Cellular component=lysosome; Biological process=sphingolipid metabolic process
  Homolog annotation: Hit_ID=Q5PT35; Match level="QueryCoverage=98%, HitCoverage=34%, E-value=8e-51, Identity=57%"; Hit description =Aspartic proteinase 9
  Pfam annotation: Domain name=SapB_1; Domain location=80-118; Score =50.6; E_value=5.4e-12; Accession=PF05184.5; Description=Saposin-like type B, region 1
FCASKCSAIDDSGTSLLAGPTGAIAQINHAIGAVGVVNQECKAVVAQYGKTILDKLINEALPQQSVVDKTIEKTSYSWNDAGCTACEMAVVWIKNPLRLNETEDQILDYANALCDMLPSPNGESVVECSTLSEMPNVSFTIGGKVFELSPEQE

SEQ ID NO: 126648 - protein, 60 aa, Glycine max
  Coding DNA Sequence Number=SeqID_9870
MDFVPGFGFVTETAGSECPFVHSGSATHEVQRQGLLILYGADHHTLENKYFMNTVVKIVM

SEQ ID NO: 126649 - protein, 136 aa, Glycine max
  Coding DNA Sequence Number=SeqID_9871
  Gene Ontology: Mol. function=carboxypeptidase activity; Biological process=aromatic compound metabolic process
  Homolog annotation: Hit_ID=Q04219; Match level="QueryCoverage=98%, HitCoverage=17%, E-value=4e-37, Identity=51%"; Hit description=TNP2
  Pfam annotation: Domain name=Transposase_21; Domain location=7-136; Score=110.2; E_value=5.9e-30; Accession=PF02992.5; Description =Transposase family tnp2
MTSQIDTKMRWHKDRKYEDGQLRHLADSITWKTLDSKYPSFAVDPRNVRLGLTSDGFNPFGIISPSNNIWPVVLVPFNLPPWMCMKDTFFIMSLLIPGPTALGNDIDVYLQPLLEKLKELWEKDVVSYDTSTEETF

SEQ ID NO: 126650 - protein, 146 aa, Glycine max
  Coding DNA Sequence Number=SeqID_9872
  Gene Ontology: Mol. function=oxidoreductase activity; Cellular component=cellulose and pectin-containing cell wall; Biological process=lignin catabolic process
  Homolog annotation: Hit_ID=Q655H5; Match level="QueryCoverage=95%, HitCoverage=34%, E-value=2e-44, Identity=60%"; Hit description =Putative PS60
  Pfam annotation: Domain name=Cu-oxidase_2; Domain location=27-115; Score=-19.9; E_value=0.066; Accession=PF07731.4; Description =Multicopper oxidase
MARTVRLQNSAPIINGKQKYAVNGVSFIPADTPLKFNLGSIPDNPTGSGGYLQTSVLAENPQDTVQSWQVDGHHFYVVGMDGGQWSAASRGVSQVMDCSVHGFGQFRNVDCEIRELGSSVFRATIHGEMSTQNQVMLCFVAGAIGH

SEQ ID NO: 126651 - protein, 97 aa, Glycine max
  Coding DNA Sequence Number=SeqID_9873
MNLEGKTKDCLKSCFDLEYMGIRLELHATMVEEGTLMNLQGKTKDCLKSCFDLECMGIRPELHATMVEEGKTRLLPIIQYLLIHRCPRWKNIWDEMS

SEQ ID NO: 126652 - protein, 151 aa, Glycine max
  Coding DNA Sequence Number=SeqID_9874
MPFLKNLSSKNVTIECCPNTRHFRRLKDPQSTKYFNDEDLPLTKAILSCIEDASCSCSKLWSCMLRALSYAEQVVKLMDSLVMAGKATVEMNKELNTRKWEHPCCTKLLFSQICYFDTAQTSLMHGFKLLKDDAYVSLLHSINVLMPIDEF

SEQ ID NO: 126653 - protein, 41 aa, Glycine max
  Coding DNA Sequence Number=SeqID_9875
MRLIFLGLRSRDKTKAKAQDPSPSQFDAPDSNAISCTALFF

SEQ ID NO: 126654 - protein, 221 aa, Glycine max
  Coding DNA Sequence Number=SeqID_9876
  Homolog annotation: Hit_ID=Q2QYU1; Match level="QueryCoverage=64%, HitCoverage=25%, E-value=3e-42, Identity=60%"; Hit description =Nodulin-like family protein, expressed
MTKRFDFALEYLTPIIAGSIPNNKQFVNIYGCGLWSRTLMMDKVVGGRGMVIWSVVVAVDSGRVHIARTGWFAAALVPTPIAFILLAISGSGAALHIGTALIGLSSGFVFSAAVSITSELFGPNSVGVNHNILITNIPLGSCLYGLLAALVYDSNARKPRHTIWLHKMSMCMGRKCYLQTFVWWSCISMVGLGSSFFLYIRTKQAYENFERNNNRNSVAPE

SEQ ID NO: 126655 - protein, 308 aa, Glycine max
  Coding DNA Sequence Number=SeqID_9877
  Homolog annotation: Hit_ID=Q2QYU1; Match level="QueryCoverage=96%, HitCoverage=50%, E-value=8e-61, Identity=45%"; Hit description =Nodulin-like family protein, expressed
  Pfam annotation: Domain name=Nodulin-like; Domain location=4-159; Score=12.0; E_value=2.3e-11; Accession=PF06813.4; Description =Nodulin-like
MHNKSSLNRVFLLCLIAGCSICWFNTICYVLCIKHFPANRSLALSLSISFNGVSAALYTLIANAINSNDATLYLLLNAIVPVLISGLVLIPILNQPQPQPHSVDTIQRDTSVFLCLNILAFVTGLYLLFLYSFSYTTAIARVILIGAIFLLVLLFFLPGIVYSREWSCFTVPTSFSFYSSRFTRAVPDDDELYKELISIKEDSTRNRSAQSTREKKCCIVNMLEREKFSMLGEEHSAKLLVRRWDFWLYYLAYFCGGTIGLVYSNNLGQISQSLGHSSQTSSLVTLYSACSFFGRLLAASPDFLSRYF

SEQ ID NO: 126656 - protein, 215 aa, Glycine max
  Coding DNA Sequence Number=SeqID_9878
  Gene Ontology: Mol. function=prephenate dehydratase activity; Cellular component=cytoplasm; Biological process=L-phenylalanine biosynthetic process
  Homolog annotation: Hit_ID=Q8LAP1; Match level="QueryCoverage=96%, HitCoverage=46%, E-value=2e-52, Identity=53%"; Hit description =Putative chorismate mutase/prephenate dehydratase
  Pfam annotation: Domain name=PDT; Domain location=46-215; Score=87.6; E_value=3.7e-23; Accession=PF00800.9; Description=Prephenate dehydratase
MVGYILVLELDVIVANNAILLSVLGQEPLSISDIVAALDDGAKVQISYKGIPGSYSEDAALKAYPNCETVSCNDFEEAFKAVEIWWADKVILPIENTSGGSIQRNYDLLLCHRLHIVGEVQLATNLSLLALPGIRTEYLKRVLSHSQAKLHVAGTFLDVAFELSDDFLTKLGVARENVDDTAGAAQIIASNGLYDAGAIASIRAAEICGLNVLAE

SEQ ID NO: 126657 - protein, 120 aa, Glycine max
  Coding DNA Sequence Number=SeqID_9879
MLLSSTVIHICVRVVMLVRMIRTHLFAATRVKSCPDKHSSCTIASLSSCARTVGRPPISGGGPGTDKSKLLAPHPGACCPSMHSSCTIASLSGCARTVGRPPISRGGPGTDKRKQLAPHM

SEQ ID NO: 126658 - protein, 101 aa, Glycine max
  Coding DNA Sequence Number=SeqID_9880
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=90%, HitCoverage=20%, E-value=1e-39, Identity=66%"; Hit description=DNA -directed RNA polymerase beta' chain
MAVHVPLSLEAQAEARLLMFSHTNLLSPAIGDPISVPTQDMLIGLYILTSGNRRAYQQKRINFDSPLWLRWRLDQRIISSREVPIEVHYESLDHIDGWYLR

SEQ ID NO: 126659 - protein, 125 aa, Glycine max
  Coding DNA Sequence Number=SeqID_9881
  Homolog annotation: Hit_ID=Q64EX4; Match level="QueryCoverage=53%, HitCoverage=15%, E-value=3e-18, Identity=56%"; Hit description=MtN19- like protein
MVNMEFISNAMILSFSILLLLPSTSYSLYQKPENHIKTAIFVTGSFEMGPGSIATKTFENIKFPKGHVGIKSFDAELVDQEGNSIPSYETYLHHWFAHAEYTIPATGGGGDSPHVQKENIPMEKG

SEQ ID NO: 126660 - protein, 129 aa, Glycine max
  Coding DNA Sequence Number=SeqID_9882
MHKALRANAPLPYPQLVTLFLRHFQIPLDGEPFVQVKRSFAIGAGAVTSFRDRKDRDGQWLKKDTLPQQDERTPSPPPLRDDSTALMNEVLSELRGLYTYVGMDTRITQLEEDVTYLRRCFDLPPPSKS

SEQ ID NO: 126661 - protein, 210 aa, Glycine max
  Coding DNA Sequence Number=SeqID_9883
  Gene Ontology: Mol. function=DNA binding
  Homolog annotation: Hit_ID=Q1SDS1; Match level="QueryCoverage=82%, HitCoverage=33%, E-value=3e-16, Identity=32%"; Hit description=IMP dehydrogenase/GMP reductase
MLADLYDTFDRRCEKSSTRICCTPALYVCLVSHLFLQEVRHACPLEGRRSCTEKGGANWDQLLANKEGASINWFPRWKEGRTGVLISCGGFPNVPLMGTRGCISYNPVLAIRQLGYPMRGAPLEDELTPIISRGFNKTNVETLQKVRKAWEMLQKKDKELRGSNNGPIGGYRKWLRAHVQGLDWLPSFRTAKKEEVEAPQGILLSDHQQL

SEQ ID NO: 126662 - protein, 69 aa, Glycine max
  Coding DNA Sequence Number=SeqID_9884
DSFEDQATQGSFVPHGCQDVLAAAIGRPEHLGRVRAAGAGVTIKQYFGSAPWTSRSSSSLPPEELQQLT

SEQ ID NO: 126663 - protein, 149 aa, Glycine max
  Coding DNA Sequence Number=SeqID_9885
  Gene Ontology: Mol. function=transporter activity; Cellular component= integral to membrane; Biological process=transport
  Homolog annotation: Hit_ID=Q6J1S8; Match level="QueryCoverage=88%, HitCoverage=43%, E-value=2e-46, Identity=68%"; Hit description =Nodulin 26-like protein
  Pfam annotation: Domain name=MIP; Domain location=4-149; Score=-33.7; E_value=1.3e-07; Accession=PF00230.10; Description=Major intrinsic protein
MDISLGRKSFWARSLLMSAAIGAAIEKEKSQGSVVGCAVISGVTVMIIICSIGHISGAHLNPAVTISFAVIKHMPWKNVPVYIGAQVLASVSAAFALKLIFHPFMSGGVTVPSVGYGQAFAAEFMVSFTLMFVVTAVADGTRVVSILLY

SEQ ID NO: 126664 - protein, 115 aa, Glycine max
  Coding DNA Sequence Number=SeqID_9886
MGKLDHLEERLRAIEGGEDYAFANLEELFLVPNIITPPKFKVLDFDKYKGITCPKNHLKMYCRKMGAYANLIHSFQESLIGVVVTWYTNLEPSRVHSWEDLVVVFVRQCQYNVFG

SEQ ID NO: 126665 - protein, 87 aa, Glycine max
  Coding DNA Sequence Number=SeqID_9887
CGVEWKKSEALRVERLNLDSVVNGEFSAFALFYLAVIAYAVGWWVYARIVDVENLLCTIARPPPSTTCDGVVPGDMSRGVRRPWGRQ

SEQ ID NO: 126666 - protein, 127 aa, Glycine max
  Coding DNA Sequence Number=SeqID_9888
  Gene Ontology: Mol. function=N-acetyltransferase activity; Biological process=metabolic process
  Homolog annotation: Hit_ID=P37613; Match level="QueryCoverage=98%, HitCoverage=99%, E-value=2e-46, Identity=73%"; Hit description =Hypothetical protein yhhK
  Pfam annotation: Domain name=Acetyltransf_1; Domain location=40-118; Score=15.8; E_value=0.042; Accession=PF00583.14; Description =Acetyltransferase (GNAT) family
MKLTIIRLQHFSDQDRIDLGKIWPSQDPAALMLDENHRIYAARFNERLLGAVRVTLRGVEGELSDLCVREVTRRRGVGQYLVEETLSDNPNINSWRVADSGVEDRGVMAAFMQALGISAQQNGREKH

SEQ ID NO: 126667 - protein, 154 aa, Glycine max
  Coding DNA Sequence Number=SeqID_9889
  Homolog annotation: Hit_ID=Q1T293; Match level="QueryCoverage=44%, HitCoverage=11%, E-value=4e-12, Identity=50%"; Hit description =Ribonuclease H
MAFDKGWQRIWLECDSTSEVAPFSSVVSVPWRIWNRWKRCIDLRKSMNFVVSLIFREGNDSADKLAIYGLDNMGFIREAQFESRREVATETKAGQRQQSSWVGSKSQSDRRTRRDDDDNNNNNNNNNNNNNNNNSNNNNNDDDDETKGCCCLWF

SEQ ID NO: 126668 - protein, 190 aa, Glycine max
  Coding DNA Sequence Number=SeqID_9890
MAKVDEVQEWMKADMEAMKEQMATMMEAMMSMKKIMEVNAAAIATVSVVSGVDPTPPSGLKLINHPTAVFPPYGLPSNYTPPNENVNNSTPILIESQQTQSDHAHVSQPMGDTHEMPHHNLADFKPCLGYATEGQTVGGIPLQNTLEGLQYHPQPHPLHSTVGKNPHAMAEMGKLDHLEERLMAIERGGD

SEQ ID NO: 126669 - protein, 70 aa, Glycine max
  Coding DNA Sequence Number=SeqID_9891
MSLPSALHVSSIIKRGASGDWEICSSVFFRIGSFAKHVKKEGVETKIVITERAGWTKSVSYLCFPLISVE

SEQ ID NO: 126670 - protein, 501 aa, Glycine max
  Coding DNA Sequence Number=SeqID_9892
  Gene Ontology: Mol. function=two-component sensor activity; Cellular component=integral to membrane; Biological process=two-component signal transduction system (phosphorelay)
  Homolog annotation: Hit_ID=UPI00005F731C; Match level="QueryCoverage =99%, HitCoverage=45%, E-value=1e-173, Identity=59%"; Hit description= COG2202: FOG: PAS/PAC domain
  Pfam annotation: Domain name=GGDEF; Domain location=396-501; Score =67.3; E_value=5e-17; Accession=PF00990.12; Description=GGDEF domain
  Pfam annotation: Domain name=PAS; Domain location=20-132; Score=51.0; E_value=3.9e-12; Accession=PF00989.14; Description=PAS domain
  Pfam annotation: Domain name=PAS; Domain location=274-386; Score =34.5; E_value=3.7e-07; Accession=PF00989.14; Description=PAS domain
  Pfam annotation: Domain name=PAS_3; Domain location=169-262; Score =91.3; E_value=2.9e-24; Accession=PF08447.1; Description=PAS fold
  Pfam annotation: Domain name=PAS_3; Domain location=42-135; Score =57.1; E_value=6e-14; Accession=PF08447.1; Description=PAS fold
  Pfam annotation: Domain name=PAS_4; Domain location=26-137; Score =17.8; E_value=0.0035; Accession=PF08448.1; Description=PAS fold
  Pfam annotation: Domain name=PAS_4; Domain location=280-391; Score =44.2; E_value=4.5e-10; Accession=PF08448.1; Description=PAS fold
  Pfam module annotation: Pfam domain module=GGDEF::PAS::PAS::PAS _3::PAS_3::PAS_4::PAS_4; Domain location=396-501::20-132::274 -386::169-262::42-135::26-137::280-391
MAVVMHAFRVEKQHIVESESRFRSALEYSAIGMALVSPQGKWLQVNQALCALLGYTPEALHKLTFQEITHPDDLTADLSQLHDLLDGHISSYTMEKRYIRSDGQTVWALLAVSLVRDAEGLPLYFISQVEDISDLKRSQAENNRLVERITLANQVGGVGIWEWVMSQENFTWDQRMFELYDLNPDQTPTLALWRTLLVPEDRDRTDRELAALLADPKPFVMEYRIVTRHGSVRHIRGQGNVILDDQGRPLRMIGTNIDMTELKSLAEALHEEKERLHITLDAIGEGVISTDSHLRITFMNPVAEQMCGWPLDLAIGMPVAGVVRLTNGKDGPEIENLTQYPRQWPADYALVLHSRDGRYFDVQQSVSPLKTLDGETMGAVMVLQDVTASRELMKKLSYSASHDALTGLPNRASFEKQLKAAIVAGGEPSPPHSLVFLDLDRFKAVNDTAGHAAGDALLRDIAQLMRHQLRNSDCLARLGGDEFGLILFDCRPEQAKSLMQQ

SEQ ID NO: 126671 - protein, 43 aa, Glycine max
  Coding DNA Sequence Number=SeqID_9893
GLEPLIVLTDSVFALQMLKFILRLVNNSGILSIGQSIYSSDIH

SEQ ID NO: 126672 - protein, 66 aa, Glycine max
  Coding DNA Sequence Number=SeqID_9894
MTLVSACYHALSLRDSKRKFAGYRQVSPHATGHLGHGNKGGVVDKSRSFAPTYPQFVMRNSDLRSS

SEQ ID NO: 126673 - protein, 71 aa, Glycine max
  Coding DNA Sequence Number=SeqID_9895
MKTILQRRHHHGHQRCRDGQNPNFSKRIKGWVSKVMVMVLISTMEGETKRRMTTTVKTRIMKTILLIISST

SEQ ID NO: 126674 - protein, 91 aa, Glycine max
  Coding DNA Sequence Number=SeqID_9896
MLESFKQQDQMSVLELYIKKDVAGGSMFHYANSLTSCGNYLSNDETQPTTNLSNLHIDEDDDDDDDDDDDDDYLVSNSYVEKSLDEDDSLD

SEQ ID NO: 126675 - protein, 55 aa, Glycine max
  Coding DNA Sequence Number=SeqID_9897
MGKVEGLHILKMRVQDGEGVEPFILNLPPLFITKIEEVLAAELAQASWLLIGEAF

SEQ ID NO: 126676 - protein, 180 aa, Glycine max
  Coding DNA Sequence Number=SeqID_9898
  Gene Ontology: Mol. function=nucleoside-triphosphatase activity; Cellular component=mitochondrion
  Homolog annotation: Hit_ID=Q2PMM5; Match level="QueryCoverage=57%, HitCoverage=4%, E-value=2e-54, Identity=99%"; Hit description =Protein ycf2
MSRELLTSQTDLPTSIYKHWFIKNTQEKHFELLIHCQRWLRINSSLSNGFFRSNTLSESYQYLSNLFLSNEALLDQMTKTLLRKRWLFPDEMVVAICSNNESLIPYIDNTHSSLGTSGAKVIEWHILLGEGAGRTISKQITHSFDREDHQDFVIRCRTYSNSNKRSQYYALKRTRTSTLF

SEQ ID NO: 126677 - protein, 148 aa, Glycine max
  Coding DNA Sequence Number=SeqID_9899
  Gene Ontology: Mol. function=structural constituent of ribosome; Cellular component=mitochondrial large ribosomal subunit; Biological process=translation
  Homolog annotation: Hit_ID=Q9VJ38; Match level="QueryCoverage=87%, HitCoverage=73%, E-value=2e-68, Identity=90%"; Hit description=39S ribosomal protein L13, mitochondrial
  Pfam annotation: Domain name=Ribosomal_L13; Domain location=16-110; Score=-13.7; E_value=0.00043; Accession=PF00572.8; Description =Ribosomal protein L13
MCADKRSPHYVTCARFVVVDDCGDHVVLINTREIALPGDEWVKRVYFHHTGYPGGASWTLAWELHSKDPTLVMKKAVYNSMKGNLQRRHTMQRLHLYADDQVPKDILANVTNQIRTPRTVPQRLDHIDKETLENFPTIMDYPKDYILR

SEQ ID NO: 126678 - protein, 336 aa, Glycine max
  Coding DNA Sequence Number=SeqID_9900
  Gene Ontology: Mol. function=RNA-directed DNA polymerase activity; Cellular component=cellular_component; Biological process=RNA -dependent DNA replication
  Homolog annotation: Hit_ID=P21329; Match level="QueryCoverage=90%, HitCoverage=40%, E-value=9e-80, Identity=60%"; Hit description=RNA -directed DNA polymerase from mobile element jockey
MGKRIDDYGGSATNLDVFPPLWDFKTPIPAGDAIPNGLACKPSYTARSGTADKKSKGQKSAWRRPFRQQDAETAPHKGSAPEKQHTEVDGYRPISLLPALGKMMERVILDRILQLEAVTRRIPKWQFGFRRSHGTPEQLHRVVNFALEAMEQKMYSVAVFMDIKQAFDRVWHDGLLCKLKGMLTPQLFQLIESFLRDRSFRVAVDGVKSTRRSICAGVPQGSVLGPTLYTLFTADMPAPQEILGVDEDDALIATYADDTVVLTRCRDIDVASEALQQYVSSFEKWALNWNIGINASKCANKTQLQQAYNNGQAIGHGKSRKDGMAACTLQQAVSAQ

SEQ ID NO: 126679 - protein, 258 aa, Glycine max
  Coding DNA Sequence Number=SeqID_9901
  Gene Ontology: Mol. function=membrane alanyl aminopeptidase activity; Cellular component=extracellular region; Biological process =proteolysis
  Homolog annotation: Hit_ID=Q9VJ39; Match level="QueryCoverage=97%, HitCoverage=33%, E-value=1e-109, Identity=77%"; Hit description =CG10602-PA, isoform A
  Pfam annotation: Domain name=Peptidase_M1; Domain location=15-256; Score=-135.1; E_value=6.8e-05; Accession=PF01433.10; Description =Peptidase family M1
MGRLGTVDPSSYSEPDLITTEHSALNWTVDFAATKLRGSVLHRFNVLSTNLDKIVSDKDMSFYHFCFKYIFPFQLLDVRDINVTNATLLADGSELPINYFISDPVSDIGQKLTLELPAGTAKGNLNVRIDYETANNASGLQWLTPEQTLGKQHPYMFSQCQAIHARSVVPCQDTPSVKFTYDAVIQHPKELTALMSAIIDKKQEGQTSFKQEVPIPAYLLAIAIGKLVSRPLGPNSNVWAEEAIVDACAEDFPRQPQC

SEQ ID NO: 126680 - protein, 152 aa, Glycine max
  Coding DNA Sequence Number=SeqID_9902
MAVWIQNSNHRSVEAPPRESGGDTTPTTMMRMSELAYPNIDANDKHMPMTIATIVKNVCQLHLSPKCKGKTPTKSILQIESEMNTHKYTIDDNIFRLSWGISMTKRLSELKRKLLGLLEKIRGSKLCIISDETPPNEHCKATRNNNEPELPT

SEQ ID NO: 126681 - protein, 863 aa, Glycine max
  Coding DNA Sequence Number=SeqID_9903
MTKKSQRRPVQYEKDKSGCMWGFINMFDFRHGHSTRKMIADKRQSSKHAVGVVHSKNKFEMLGNLDEVCHGSSGNGESRRPTVATAANKPSVKKLIEEEMFIDQNTMKDTYSAQIESKESRLRREVLLKLDTKRKKKSYRKNRDKEDTNDLNLDSTLKSKFTHNQHSRKQLKDNLDLDKMIEDFCHLKDAYSMMHGNDGEVEVNAQSNHRQAISENARDAICEFVDQMILNGKDPAEARKFLCSHQLMEVLQLISSDKELFLSLLQNPNSLLLKCVQEFRNSQGTNEKEYGCVTGSNFSEQDHGNLEQNREIVNHKKHKFFRKKEKSQSKTSINENENTNSSSRIVILKPGQIGLQNFETRNNLASYQDTHDSVKYNGPSVRGSSHFSLAEIKKKLKHAMGKERHANPGHPAAEIQNKWPISKAIGKDNVGMRSPNKDHFFIEKIARPTTGGLKGDKTGTAKDSELIVEHENGTYPKQRVSNLYIEAKKHLSEIVGNGDEKIDLSSRNISRTLGKILSLPEYNFSPLSSPGRDWEHHFVTAQTRFSSSDKIWEANKDNVSSKQGTFVGDLDQEMDNSGKQSSICDERSDNKVQEIKSEDISHVDKAKKFSPVRDEIVTEGDVESAKEVSVLESSSEPVDLSAGKEDQNYGISETSDCARCSQSSKQDVTEVNKPTTSPLSSPPHSSTTKKIEELESVTEEPGRPSPVSVLDTPFSEDDINPGYSRFQPVELCHDLKLINDCINDVLMEVCRNYFGVSPCVSFKNPSIRLSPNMKKVVLMVWEGVCWHFLPLPPPRTLDKIIKKDMDKNGAWLDHSLEAETIGFEMGEAILTELMEDTILSCVSNSPESECSQLQFEYKANDNS

SEQ ID NO: 126682 - protein, 581 aa, Glycine max
  Coding DNA Sequence Number=SeqID_9904
  Homolog annotation: Hit_ID=Q2HTJ2; Match level="QueryCoverage=94%, HitCoverage=26%, E-value=0.0, Identity=66%"; Hit description=2-oxo acid dehydrogenase, lipoyl-binding site
MDAVRQLPLNPYKLKCDKEPLNSRLGAPDFHPQTPNCPEETLTREYLQSGYRDTVEGLEEAREISLTQVPHFNKNIVLKCKEAIRKRLRAINESRAQKRKAGQVYGVALSGSQLGRSGIFPELRPCGEDFQKKWIEGLSQQHKRLRSLADHVPHGYKRASLLEVLIKNNVPLLRATWFIKVTYLNQVRPGSVGISSGAADKIQLSRSDVWTKDVINYLQTLVDEFLSKNALHSASHGRERSPQIPYTGSLQNKNDPLLSVSDGEGPSLHFRWWYIVRLLQWHHAEGLLHSSLVIDWVFNQLQEKELLEVWQLLLPIIYGFLETIVLSQSYVRTLAGLALRVIRDPAPGGSDLVDNSRRAYTAYAVVEMLRYLILVVPDTFAALDCFPLPSSVISHTMNDGSFVLKSTEAAGKIKNSSDDFGHIISCIQKHTEDLAKSASPGYPGHCLAKVAKALDKSLVLGDLRVAYKFLFEELCGGTVSEGWVSKVSPCLRDFRSTPPRDIKFTGRKDLSQVHIAVRLLLMKIRDVKISQKQTNENHRASHLAKNSSQCQNWNYVGNVSRSKSSSKSMGSSVFESPACGA

SEQ ID NO: 126683 - protein, 275 aa, Glycine max
  Coding DNA Sequence Number=SeqID_9905
  Gene Ontology: Mol. function=protein binding; Cellular component =vacuolar membrane; Biological process=GPI anchor biosynthetic process
  Homolog annotation: Hit_ID=Q1RUL1; Match level="QueryCoverage=89%, HitCoverage=90%, E-value=1e-118, Identity=80%"; Hit description=Per1- like
  Pfam annotation: Domain name=Per1; Domain location=72-268; Score =294.7; E_value=1.7e-85; Accession=PF04080.3; Description=Per1-like
MLKMLDGWVCAFLLVLYCSVEVIDASAGDADPRYRVCITQCQETGCVAQRCFPNCKFSSDGEFIDRPWYMQQEPLYLQWKKWDCQSDCRYYCMLDREKERESHNLGPVKYHGKWPFRRIYGMQEPASVAFSALNLAMHFHGWVSFFILIYYKLPLKDGKKAYYEYAGLWHMYGLLSLNSWFWSAVFHSRDVDITEKLDYSSAVVLLGYSLILAILRTFSIRDEATRVMVAAPLIAFVTTHVMYINFYLLDYGMSCHVIFILLLPRLRVDCRNNSA

SEQ ID NO: 126684 - protein, 247 aa, Glycine max
  Coding DNA Sequence Number=SeqID_9906
  Homolog annotation: Hit_ID=Q2HTJ2; Match level="QueryCoverage=15%, HitCoverage=1%, E-value=5e-11, Identity=86%"; Hit description=2-oxo acid dehydrogenase, lipoyl-binding site
  Subcellular localization annotation: CTP_CleavageSite=43; ConfidenceScore=5.55e-01
MQRYHAGSCTSAVNNSTIGGPSARDPGRSDSPSLPANFAWSLLSNQKKGRNKAAVLRQNREQRIKHQARAIEVYRLSGNCHNLARKSRRYCWRREVVVVHPDSGLTTEKVEIEDYPPQNPLIAFVTGNKRGTTSHQQNRARTEQNPDRDTCYEQYATTQWTQGRDRAENVVAVKRRAEGGVVRIEVIVAIDGFAKWVKSRILGHLQTNRLGQQRGFVSKPDLREIGMEWIMRSWMRKIAILCNLHET

SEQ ID NO: 126685 - protein, 1524 aa, Glycine max
  Coding DNA Sequence Number=SeqID_9907
  Homolog annotation: Hit_ID=Q2HTJ2; Match level="QueryCoverage=99%, HitCoverage=66%, E-value=0.0, Identity=65%"; Hit description=2-oxo acid dehydrogenase, lipoyl-binding site
MMFWKNQGLLKRPQLKEALQIYLNERRLILRGPLSMSHDDANGSNLSALKKKKYPASTKDEVSAVPIDQRNVISTTISSKSAKDNANIEELRTAISVLLQLPNCSSNLSTTGDESEGSVRRPIGSPYSKIDPVEGTPGCEECSRAKRQKLSEERSSFVQGHSPVQSDDDDAWWVKKGMKSPEPLKVDQSQKSTKQVTKIRQKNVRKTQSLAQLAASRIESSQGASTSHVCGNKVSCPHHKTAMDGEGQRSVDCIQTSHFGDIVSIGKALKQLRFVEKRALAVWLLTVVRQVIEEVEKNIGKVGQFGRPFPVADDRGSIRWKLGEDELSVILYLMDISDDLVSAVKFLLWLLPKVLNSPNSTIHSGRNVLMLPRNVENQVCDVGEAFLLSSLRRVPGSKLLYLFLLMLHFLSSLIRYENILVAADLIPEALSSAMHRAATVIASIGRVSGSGALAFARYLLRKYSNVASVIEWEKTFKTTSDARLSSELESGGSVDGELGLPLGVPAGVKDHDDFFRQKISGGRLPSRVGAGMRDIVQRNVEEAFHYLFGKDRKLFAAGTPKGPALEKWDNGYQIAHQIVMGLIDCIRQTGGAAQEGDPSLVSSAVSAIVGSVGPTLAKMPDFSSGNNHSNIMSATNSLNYARCILRMHITCLCLLKEALGERQSRVFDIALATEASNALAGVFTPSKASRSQFQMSPEAHDSSNTISNDMGSNSIKVVAKTTKIAAAVSALLVGAIVYGVTSLERMVAVLRLKEGLDVAQFVRNARSNSNGNARSVMAFKVDSSIEGHVHWFRLLVGNCRTICEGLVVELLGEPSIMALSRMQLMLPLNLVFPPAYSIFAFVRWRPFMLNATVREDMNQIYQSLSMAITDAIKHLPFRDVCFRDCQGLYDLMAADASDSELATLLEFNGSDMHLKSTAFVPLRSRLFLNAMIDCKMPPSIYTKDDGSRMSGLGESKIKFTDSESKLQDLLVHVLDTLQPAKFHWQWVVLRLLLNEQALVERLENRDVSLVDAIKLSSPSTEKASAASENENNFIQILLTRLLVRPDAAPLFSELIHLFGRSLEDSMLLQGKWFLAGQDVLFGRKTIRQRLHNIAMKKNLSVKTQFWEPWGWCSPSTDPLTIKGDNKKFDSTSLEEGEVVEEGMDLKRCQQQVTERALIELLLPCIDQSSDESRNSFASDMMKQLSYIEQQITAVTGGSKPVGSAPPGVEGQPNKVNNRKNMRGGGPALARRQTVAADSSPPSPAALRASMSLRLQLLLRFLPILCTDREPSVRSMRQFLATVIFRLLGSRVVHEDADISVNAVPFLPIREAESSSEVASAAFVDSSSGSLFDRLLLVLHGLLSSYPPSWLRAKPVSKTISEPTREISGIDRELLEALQNDLDRMQLPDTIRWRIQAAMPMLIPSMRCSLSCQPPSVSNSALVCLQPSITNPGSNSSSSTIPQRNSVLSRVASNASGKSKLQDNDLEIDPWTLLEDGAGSYPSAGNTASIVSGDHANIRATSWLKGAVRVRRTDLTYVGAVDDDS

SEQ ID NO: 126686 - protein, 72 aa, Glycine max
  Coding DNA Sequence Number=SeqID_9908
  Gene Ontology: Mol. function=DNA binding; Biological process=DNA integration
  Homolog annotation: Hit_ID=Q1SRA3; Match level="QueryCoverage=91%, HitCoverage=11%, E-value=1e-20, Identity=65%"; Hit description =Integrase, catalytic region
MHHIANAEPIDNIEALEEQVWRATMLEELKAIEKNHTWKLVELPAKKKPIDVKWVFKLKLNPNGTIAKHRPN

SEQ ID NO: 126687 - protein, 122 aa, Glycine max
  Coding DNA Sequence Number=SeqID_9909
MGLGATAIDLEEPSSNTKGKRQGSTSSGTHPHKRKMGEKEGIVASLDKMANSFNRMVEKMDGKVDDEDIQEVLREAALIPDFNRQQWAKAIKWLADDPKQLAIVKTLPIHQKTDYVLTHLGE

SEQ ID NO: 126688 - protein, 61 aa, Glycine max
  Coding DNA Sequence Number=SeqID_9910
MSSACPSSTRFKSLFDGGWLTFQEDSLNVKTNPLANHGGSVVNAVEEWEPEAEVDGRRVNL

SEQ ID NO: 126689 - protein, 99 aa, Glycine max
  Coding DNA Sequence Number=SeqID_9911
MGRDQKMSMRSRRQKVNTITKKNKHALRHPYQTRAKTKIISEIEEVQEQMKADMEAMKDQMTSMMEPKMSMRRIMEDNMATVATTSTATEADLTHPGIN

SEQ ID NO: 126690 - protein, 134 aa, Glycine max
  Coding DNA Sequence Number=SeqID_9912
  Gene Ontology: Mol. function=electron carrier activity; Cellular component=integral to thylakoid membrane; Biological process =electron transport
  Homolog annotation: Hit_ID=P49161; Match level="QueryCoverage=99%, HitCoverage=80%, E-value=9e-44, Identity=86%"; Hit description =Apocytochrome f precursor
  Pfam annotation: Domain name=Apocytochr_F_C; Domain location=48-134; Score=46.2; E_value=1.5e-13; Accession=PF01333.10; Description =Apocytochrome F, C-terminal
PISNAYPIFAQQGYENPREATGRIVCANCHLANKPVDIEVPQAVLPDTVFEAVVRIPYDMQVKQVLANGKKGALNVGAVLILPEVIDIIPPGPELLVSEGESIKLDQPLTSNPNVGGFGQGDAEIVLQDPLRVQ

SEQ ID NO: 126691 - protein, 126 aa, Glycine max
  Coding DNA Sequence Number=SeqID_9913
MDRFTLTLNGSQELPRLLARAKAMADVYSAPEEVHGLFNYCQHMVELISRSKKVNTITKKNECALRNPYQTRAKTKIMSEIGEVQEQMKADMKAIKDDAILPPKGHLIEDSKKIGPEMQEKALGFS

SEQ ID NO: 126692 - protein, 61 aa, Glycine max
  Coding DNA Sequence Number=SeqID_9914
MALPYSIPSGYFRAFCTSDPSTPFLQMPEDPTTPVLAVDTSPPTTPVLQLTDEEDGQTQDT

SEQ ID NO: 126693 - protein, 253 aa, Glycine max
  Coding DNA Sequence Number=SeqID_9915
  Gene Ontology: Mol. function=transporter activity; Cellular component= integral to membrane; Biological process=transport
  Homolog annotation: Hit_ID=UPI00005F7683; Match level="QueryCoverage =70%, HitCoverage=38%, E-value=2e-81, Identity=85%"; Hit description =COG0477: Permeases of the major facilitator superfamily
MPGCHQNLTEMCENGAVKVWSPFLPMISNSRLPTERRHRGVPLVAREPTHGWAFTVFTSFREMVMTVHHSVTQQGSPASAADARLETTSGRKDFWRATFSCWLGTAMEYADFALYGLAAGIIFGDVFFPEATPAMALLSSFATWSVGFIARPIGALLFGWIGDRKGRKVVMISTIILMGASTTLIGLIPSYATIGLWAPACLVLLRFTQGLGAGAELSGGTVMLGEYAPVERRGLVSSVIALGSNSGTLIASL

SEQ ID NO: 126694 - protein, 355 aa, Glycine max
  Coding DNA Sequence Number=SeqID_9916
  Gene Ontology: Mol. function=transporter activity; Cellular component= integral to membrane; Biological process=transport
  Homolog annotation: Hit_ID=Q8ZRG4; Match level="QueryCoverage=97%, HitCoverage=83%, E-value=1e-172, Identity=83%"; Hit description =Putative inner membrane protein
  Pfam annotation: Domain name=MFS_1; Domain location=1-310; Score =91.6; E_value=2.5e-24; Accession=PF07690.6; Description=Major Facilitator Superfamily
  Pfam annotation: Domain name=MFS_Mycoplasma; Domain location=78-310; Score=-148.2; E_value=0.027; Accession=PF07672.4; Description =Mycoplasma MFS transporter
  Pfam annotation: Domain name=Sugar_tr; Domain location=1-350; Score= -20.5; E_value=3.1e-06; Accession=PF00083.14; Description=Sugar (and other) transporter
  Pfam module annotation: Pfam domain module=MFS_1::MFS_Mycoplasma::Suga r_tr; Domain location=1-310::78-310::1-350
MLTLAVRPVGALIFGRLAEKYGRRPILMLNIVLFSLFELLSAWSPNFAAFLTFRVIYGVAMGGIWGVASSLAMETIPDRSRGLMSGIFQAGYPCGYLLASIVFGLFFEQVGWRGMFLIGALPILLLPFIYFKVPESPVWLAARERKENHALLPIIRQHWKICIYMVLLMACFNFFSHGTQDLYPTFLKVQHQFDAHTVSIIAIGYNIAAMLGGITFGSLSERIGRKKAIMLASFLALPVLPLWAFSSGSWAIGIGAFLMQFMVQGAWGVVPTYLTELVPANARAVLPGFVYQLGNLIASVNATLQSRIAEAHGGNYGLGMAIVAGTVAVLICVFVAFGRETRGIEISGAVAKETR

SEQ ID NO: 126695 - protein, 138 aa, Glycine max
  Coding DNA Sequence Number=SeqID_9917
  Gene Ontology: Mol. function=aminoacyl-tRNA ligase activity
  Homolog annotation: Hit_ID=Q8YC25; Match level="QueryCoverage=66%, HitCoverage=61%, E-value=6e-22, Identity=56%"; Hit description =Regulatory protein
MAGPVHHFIHAQHARFCPERCLQLAVIQPGVAACDNQHHALFHFQRQGFGDLPRRHAMYACGQFYGGSAFRHLDDVDIRCVFGKEVPYRLQAHFFLRYRSVRRPECDSAGSSCGAPSRRYAGSWCDTADYHCRRTGIC

SEQ ID NO: 126696 - protein, 74 aa, Glycine max
  Coding DNA Sequence Number=SeqID_9918
MATAEAWERETKKARKEEHDQSKVDSWHQEATMWTDRFALTLNRSQELPRLLAKAKAMADTYSALEEIHELLSY

SEQ ID NO: 126697 - protein, 124 aa, Glycine max
  Coding DNA Sequence Number=SeqID_9919
  Homolog annotation: Hit_ID=Q1STZ2; Match level="QueryCoverage=72%, HitCoverage=19%, E-value=1e-09, Identity=36%"; Hit description=IMP dehydrogenase/GMP reductase
MDLCGLVHFIKVKGLDVTSLKELGRLMGPLQRQAFHKVYEKILDLTAAEVFTEAVVSLTQYYDQPLRCFTFGDFQMVPTVEEFEEILGCPLGGRKPYLFSGFLPSLSKIAAVVGDSIKELDHMK

SEQ ID NO: 126698 - protein, 137 aa, Glycine max
  Coding DNA Sequence Number=SeqID_9920
FIEANAKILQRIRKAWNTMERKDKELRGSSNGVIGDYHKWLKSRMQGITWLPKLTGLSGKEAEIPEESEEVQALKAELEKTRLVKEKLKVVVTRVRKECDKLKDINMTTVEALEQETKKARKEEWSRNTFRGALWGS

SEQ ID NO: 126699 - protein, 110 aa, Glycine max
  Coding DNA Sequence Number=SeqID_9921
  Gene Ontology: Mol. function=protein binding; Biological process =xylan catabolic process
  Homolog annotation: Hit_ID=Q1SWI7; Match level="QueryCoverage=77%, HitCoverage=13%, E-value=1e-30, Identity=70%"; Hit description =Leucine-rich repeat
MLDLSYNHLKGNIPTGTQLQTFDASSFIGNNLCGPPLPIYCSSNGKTHSYEGSDEHGVNWFFVSMTIGFIVGFWIVIAPLLICRSWRGRVAERKEGKDRRCGEMELRITK

SEQ ID NO: 126700 - protein, 67 aa, Glycine max
  Coding DNA Sequence Number=SeqID_9922
MESAFPDSDAVERRLVVKGTDDLGLDGFAPGEHHLSIVKPFISCGPFGEVIEIKENLPHKLCYALNS

SEQ ID NO: 126701 - protein, 175 aa, Glycine max
  Coding DNA Sequence Number=SeqID_9923
KGSACDVGSKYTLEGHICDLGNEGALIVPRLYAIFVLRIAFLGKTNSPNVCLRRKWPRGSLPQRGPGRIKRPKEPVPLPNMTATALGVLNTSSASRPSGGEIVRRRWASLVTPMAKFDPDIVLEFYANAWPTEEGGQECEYGQRRNRSDGFDEEDIAQLLCIPGQDFARTAAGKR

SEQ ID NO: 126702 - protein, 158 aa, Glycine max
  Coding DNA Sequence Number=SeqID_9924
MSLVVVVSFSFVSQFGLALLFGWFCDFTFFSLVEKFLLQFSFAEVDWEKLSFSLVDNFILQFSFAEFDWEKLRVCDYKVMACVADKIKLIDGSREALKLFVRITYLWFIGIPGKTEQAEMVVVDSDGYEIHVVCKQDQLKSRKANLKENLTYVIHNFK

SEQ ID NO: 126703 - protein, 79 aa, Glycine max
  Coding DNA Sequence Number=SeqID_9925
MYKDNWTQPWPMGSEIYPEVHENHRAFFSSSSPILLELLAHGSSDWSLPRKDCIHNIDNIFPTECELPSFSLVPAVFDK

SEQ ID NO: 126704 - protein, 45 aa, Glycine max
  Coding DNA Sequence Number=SeqID_9926
MARKGVFSPYRVEERINEFQQPRDLRSNPFQGGGNDAILCRKVIG

SEQ ID NO: 126705 - protein, 40 aa, Glycine max
  Coding DNA Sequence Number=SeqID_9927
MASIIAAICSFMASMSASICSCTSFTSPITLALAQVRIRG

SEQ ID NO: 126706 - protein, 152 aa, Glycine max
  Coding DNA Sequence Number=SeqID_9928
  Homolog annotation: Hit_ID=Q9AVH2; Match level="QueryCoverage=27%, HitCoverage=14%, E-value=3e-17, Identity=97%"; Hit description =Putative senescence-associated protein
MARHKVTRTHTHTHSRRHKGEEGLGREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQTVPLVLG

SEQ ID NO: 126707 - protein, 126 aa, Glycine max
  Coding DNA Sequence Number=SeqID_9929
SPHQLDLAPYASEPYNAQWNAPGLLRDKHTLRSNRILGKMEVDEPWLGLWLPLDYRVDMGASQHRTPEFRWVLWFDLGMAFMDNWVVGKEMGCYWLSNDIVGMIKFASFQTHFDPFAGEDHIRKAG

SEQ ID NO: 126708 - protein, 249 aa, Glycine max
  Coding DNA Sequence Number=SeqID_9930
  Gene Ontology: Mol. function=peroxidase activity
  Homolog annotation: Hit_ID=UPI000050FD18; Match level="QueryCoverage =98%, HitCoverage=61%, E-value=2e-37, Identity=37%"; Hit description =COG4950: Uncharacterized protein conserved in bacteria
  Pfam annotation: Domain name=CMD; Domain location=109-191; Score =40.0; E_value=7.9e-09; Accession=PF02627.10; Description =Carboxymuconolactone decarboxylase family
AGWSKEGIVTLAQLIAFVSFQSRLIAGLRLLNDRPVATSDASVAAGIWHTTPTTVTGKAAPVAFTQQELGWEPWLAAKPLAEFRDDEVAILAKFGHTDSDYFRLMGRNLPVLDQRTLTDKGIFYTPGGLPRAERELAATVASKIIGCIYCASVHARKASQLSKDDDAVEALLAVRPGQSLTEGQSARWQAEINFASALSVTPPAATPLHLAALEKEGLDTLAQLDLVQSAAFFAWANRLMLTLGEPWLA

SEQ ID NO: 126709 - protein, 124 aa, Glycine max
  Coding DNA Sequence Number=SeqID_9931
MEAMKEQMTTMMESMMSIRKMMQVNTTTVIVISTATEVDPTHPFGLNQVNRPVLNMTGQGGEALGSTGDPHFVQVQSKHSFPPYGLPPNYTPPNVAHAPDENVDNSAPISIESQHPQSGHAHVP

SEQ ID NO: 126710 - protein, 65 aa, Glycine max
  Coding DNA Sequence Number=SeqID_9932
MAPQTPYKDKLLNHEGSIEKDGVVSDELVSTEEDYKHAIYEGPCMDCSGPLYHCSEVASLLPYKC

SEQ ID NO: 126711 - protein, 371 aa, Glycine max
  Coding DNA Sequence Number=SeqID_9933
  Gene Ontology: Mol. function=protein dimerization activity; Biological process=proteolysis
  Homolog annotation: Hit_ID=Q39PN6; Match level="QueryCoverage=81%, HitCoverage=63%, E-value=1e-113, Identity=68%"; Hit description =Peptidase M20D, amidohydrolase
  Pfam annotation: Domain name=M20_dimer; Domain location=244-349; Score=15.8; E_value=0.0043; Accession=PF07687.4; Description =Peptidase dimerisation domain
RIPRPAVAGCVGEGRAPARGAKAPEAAGRLGHRDGPEPLPRPDRQRTAAQQGAAGQGRSEAGMSAVEHLQDFFQQQSPRMAALADSIWSLAELRYAETASARLHIDALEQAGFRITRGVAGIPTAFLAEWGHEGPVLAFLGEYDALSGLNQQSGALVCTPSTDSPGLAGHGCGHHLLGTSAHFAAIALQEHLRRSGAKARVRYYGCPAEEGGSGKTFMARAGVFDDVDTALTWHPASFSGVFSQSTLANIQAKFVFHGKASHAAHSPHLGRSALDAVELMNVGVNYLREHMPTDARVHYAITDSGGLSPNVVQARAEVLYLVRAARNHEAAALYERVQNVARGAALMTDCRLEIVFDKACSNLLQNRTLNQ

SEQ ID NO: 126712 - protein, 114 aa, Glycine max
  Coding DNA Sequence Number=SeqID_9934
AIEEGVDYAFADMAKWRLVPDVVIPPKFKVPDFDKYKGTTCPKNHLKMYCRKMGAYVKDEKLLMHFFQESLIGVAVTWYTNLESSRGSGSSSSTTNDGEGDDNNDSGHITVVLL

SEQ ID NO: 126713 - protein, 63 aa, Glycine max
  Coding DNA Sequence Number=SeqID_9935
MAVKHSYLFVKNGSFDLDNLIFMEPNDDAQSEEDLDDDDGDGDGDESDDIHGDDPIRGLDMLL

SEQ ID NO: 126714 - protein, 83 aa, Glycine max
  Coding DNA Sequence Number=SeqID_9936
MSGFTRNSPQISASPHQLDLAPYASEPYNAQWNAPRLLRDKHTLRSSRILGEMEVDEPWLGLWLPLNYQVVLVIGSAVDKLCG

SEQ ID NO: 126715 - protein, 89 aa, Glycine max
  Coding DNA Sequence Number=SeqID_9937
MAELCLVPNVVISPKFKVPDFDKYKGTTCPKNNIKIYYRKMGAYAKDEKLLMHFFQESLTGAAVTWYTNLEPFQVHSWKDLLFAFIRKY

SEQ ID NO: 126716 - protein, 33 aa, Glycine max
  Coding DNA Sequence Number=SeqID_9938
MGVVWMLISPVVRHNRVMDNDGTGQATADSVMA

SEQ ID NO: 126717 - protein, 39 aa, Glycine max
  Coding DNA Sequence Number=SeqID_9939
MGPGHIPFLLLAPHRTKLCSRLRIHEEDALATSWGYPCE

SEQ ID NO: 126718 - protein, 117 aa, Glycine max
  Coding DNA Sequence Number=SeqID_9940
MAIKWGYSMDGLEGRNNRHTKIWKNLEDLNVKVPSFQGSCDPEAYLKWGMKIEKEIKEEIQWNAGGNMVGDEDLDEKEVCSKRISKETYRRREVGNLNVSCVLEEGIWPLNAEGGKD

SEQ ID NO: 126719 - protein, 283 aa, Glycine max
  Coding DNA Sequence Number=SeqID_9941
  Gene Ontology: Mol. function=RNA-directed DNA polymerase activity; Biological process=RNA-dependent DNA replication
MMEAMMSMKKIIEVNATAVAATSAIVEVDPTPPSGLNQINHPTSDIVGQGGKELGSTGGPYCLQIQNKHAFLPYGLPPNYTPPNVAHTPDENVNNSTPIIIESQQPQSDHAHVSQPLGETHEIQHHNLANFKPHLGYATEGQAVGGVPLPTTLDSPQFRPQPQPLHFAVGRVPPAMVERKKLDQIEERLRAIEGGRDYAFADMEELCLVPDVVIPLKFKVPDFDKYKETTCPKNHMKLYCRKIGAYSKDEKLLMHFFQESLTGAAVTWQYQYNSDMASDRMQL

SEQ ID NO: 126720 - protein, 62 aa, Glycine max
  Coding DNA Sequence Number=SeqID_9942
  Subcellular localization annotation: CTP_CleavageSite=29; ConfidenceScore=5.31e-01
MSPPPLEPHNHSQTHLMLLGRLPLQAPFSAAHPSSRFFLALSRGVLRSTDGSLSQKIGLASG

SEQ ID NO: 126721 - protein, 126 aa, Glycine max
  Coding DNA Sequence Number=SeqID_9943
MACRDHHGHPLLLFSRLLQSPLPSRDNQVRWHVVTIMVSLLGLSLVVGRMGFVTFQKEMCKIFKIGAKGSILRHFLAPGPTRKLRDEVTSSPGRAKLAWASKLLQEESSSSPRRAAMQPPPLISYK

SEQ ID NO: 126722 - protein, 265 aa, Glycine max
  Coding DNA Sequence Number=SeqID_9944
  Gene Ontology: Mol. function=heat shock protein binding; Cellular component=integral to membrane; Biological process=protein folding
  Homolog annotation: Hit_ID=Q10NS2; Match level="QueryCoverage=87%, HitCoverage=81%, E-value=1e-68, Identity=57%"; Hit description=DnaJ domain containing protein, expressed
  Pfam annotation: Domain name=DnaJ; Domain location=42-102; Score =59.3; E_value=1.2e-14; Accession=PF00226.21; Description=DnaJ domain
MGDTNHASTVDDDLLLKNFFAEVSEVERDNEVLRILSCFKLNPFEYLNLSFDSSIDDVKKQYRKLSLMVHPDKCKHPQAKEAFGALAKAQQLLLDQNERDYILSQVNSAKEELRAKRKKQLKKDTASKMKSLVEEGKYDKQYEQSEEFRQELKVKVRELLTEQEWRRRKMQMRISEEEGRLKRDEEEQKEMWKRKREHEEEWEGTREKRGGKKNKKGEIRPPKLKTEDPNKSYVQRPVKRGYLLYQLDTFKQIYYWGHLRHVNGM

SEQ ID NO: 126723 - protein, 424 aa, Glycine max
  Coding DNA Sequence Number=SeqID_9945
  Homolog annotation: Hit_ID=Q10NR6; Match level="QueryCoverage=35%, HitCoverage=38%, E-value=4e-17, Identity=39%"; Hit description =Expressed protein
MSTCMSKKIQGQSLSIEEENMLVVQKQGIVTILGSNHDAPTTSLRRTLSADMSSKTWLSQNGFSLMKKTSSSEELSYSSLTKSTISDSSSSDEDNCEEAKQDQFQIWNTIQKEQQHEDNKPGQVDVWSSILVQKANEETLKLSTTPYVHPLVRRSKSCLSEKSLEICTESLGSETGSDGFSSYSPSETEEKEEEKEEESMQITHEEDFQVPKQNYAEKKSLPRSFPPPLPSLHMRSHRDNGRLFLQAVSVPSQNNFCAQRENGRLVLTFADVEVAEEEEEFDEAEEFESVIEEAKTPMLRLLSSGFGLALMMNKPIGLLGTDANVKSPKWSEKFNDVVNFKDVDTVQHSHPLPPRPRQHGSIHKKAFNAYEYYWRTKPTTKVAPASNTFTFQHNNNYSSLENNLKSCKDSRRSFLIWEPYCIAT

SEQ ID NO: 126724 - protein, 67 aa, Glycine max
  Coding DNA Sequence Number=SeqID_9946
MEKKASIEGHGHGFEVVKAEEVGDKDHGIGDNVVGNKEEGLSKGNVMVGHRDNFTSKSALGVDINGK

SEQ ID NO: 126725 - protein, 148 aa, Glycine max
  Coding DNA Sequence Number=SeqID_9947
  Gene Ontology: Mol. function=phosphoprotein phosphatase activity; Cellular component=nucleus
  Homolog annotation: Hit_ID=Q1S5Z7; Match level="QueryCoverage=81%, HitCoverage=13%, E-value=2e-37, Identity=64%"; Hit description=DNA topoisomerase II; Serine/threonine-specific protein phosphatase and bis(5-nucleosyl)-tetraphosphatase
MVPETDHDPAAQNHAAAAPAPDAAEGEQLAEPPSSGDGSPEQAAASAPQSPVVGPRLAPTYTVVNAILEKKEDGPGPRCGHTLTAVAAVGEEGTPGYIGPRLILFGGATALEGNSAASGTPSSAGNAGIRHPPPPTCYKCIYVMWSAF

SEQ ID NO: 126726 - protein, 110 aa, Glycine max
  Coding DNA Sequence Number=SeqID_9948
MKPPDVQEDHIFLKAFPYWHTLISSRYHCLTACNLWLTASRKKTSVVTKFVKFRNVTEKESPKKAKRVYLVKKGEVQIAIRPTWAFQILPPEGGCFWRKQPGSPGRAELA

SEQ ID NO: 126727 - protein, 181 aa, Glycine max
  Coding DNA Sequence Number=SeqID_9949
  Gene Ontology: Cellular component=outer membrane
  Homolog annotation: Hit_ID=Q6H7M7; Match level="QueryCoverage=87%, HitCoverage=30%, E-value=2e-16, Identity=30%"; Hit description =Putative outer envelope membrane protein OEP75
MTQLRPNSIVIVVSQWSRSTGSPFSLVIGSLCIKHPNLFGGSEKLDVSWDKGLYDSNVLVAYRRPRPEWLAQQSFVLQHSLSPEIGVHGIPVNNFSRSGSGGINLSRLSVGMDLKEPASSKWSSTTSIKFEHVRPLNDDGRAICRDYDGFPLTSSGNPHDSMVVLKQESQFAKANDNSFFH

SEQ ID NO: 126728 - protein, 369 aa, Glycine max
  Coding DNA Sequence Number=SeqID_9950
  Gene Ontology: Mol. function=hydrolase activity
  Homolog annotation: Hit_ID=Q9FIR8; Match level="QueryCoverage=82%, HitCoverage=74%, E-value=2e-57, Identity=41%"; Hit description =Arabidopsis thaliana genomic DNA, chromosome 5, P1 clone:MXC17
MTLCSFMVISTTLTSSILTNFAKIAKWESEKEQGMMDQCLVVHIPDKQPHDLHHQPTESVFASAIDPKHANQIVRRLNQIAPLEDLRHVKRIQKKVLEGGQIELLVILCLAHEGNNQLDNMPPLLQELISSHQLSPFITKVCKYAATSKEEWQEQCKFWPTSYHPRTYNIDGITGFSEEDSQSVLKFMQSAVEMATSDGMVVNAAVIVDPSAKQIISSACDQIFSWNTCKDNNCYRKPELSSSHPISSSRCNPHEPLHSNSSSNQLKQSYTDVACLYPRQWTEQQSHSQSSYYWHPLRHAAIVAIESSAARDRYLFSSEGNSEDRYLELDSDNSSWTSSPAKRQKTVCANLPICMKCYHAIPTKVLRTT

SEQ ID NO: 126729 - protein, 108 aa, Glycine max
  Coding DNA Sequence Number=SeqID_9951
KTDLTPSCMLHSARGDIAQLVELRSCNWVVAITEDRNMPLKDSTETKTGCQERRGVGGSPRVSSFGILGKRIKLALANSLMHYLPFNPLSEMWQKEKESMDRPHRLHP

SEQ ID NO: 126730 - protein, 107 aa, Glycine max
  Coding DNA Sequence Number=SeqID_9952
  Homolog annotation: Hit_ID=Q9LXK4; Match level="QueryCoverage=63%, HitCoverage=3%, E-value=2e-07, Identity=55%"; Hit description =Guanine nucleotide-exchange-like protein
MAGGAAGGFVTRAFDSILKECSSVKKFPELQKAIQNYTDITKQASQKKQSEVNQAAPSAESGSCINESANARGEAVCVLGALPLPRSLTRCARSFGCGERYQLTQRR

SEQ ID NO: 126731 - protein, 70 aa, Glycine max
  Coding DNA Sequence Number=SeqID_9953
MEEKVKLKTNGALRSTYLKLFHGIAAKDKGEEVHENPMVFFSSSSPTLLEPLAHGSGDWSLPKEDCIKYV

SEQ ID NO: 126732 - protein, 102 aa, Glycine max
  Coding DNA Sequence Number=SeqID_9954
MREIPGPCWTYPGPKGAWSAPYLQIDKWHQQSTEPRECSSVSGWRNQLTLRQGEVGIMIAGLDVAEQQRHPYLGQGGHVGGHDPHPSPSSSPGVTPSTPTYK

SEQ ID NO: 126733 - protein, 238 aa, Glycine max
  Coding DNA Sequence Number=SeqID_9955
  Gene Ontology: Cellular component=endoplasmic reticulum
  Homolog annotation: Hit_ID=Q1S1U9; Match level="QueryCoverage=99%, HitCoverage=100%, E-value=3e-78, Identity=60%"; Hit description =Reticulon
  Pfam annotation: Domain name=Reticulon; Domain location=67-238; Score= 209.4; E_value=8.3e-60; Accession=PF02453.8; Description=Reticulon
MASGDTDSFSDKVEEKFHDHNSDSDSYSDSDDDHNNRPPPKTTVSNNVYRLFGRDQPVHKVLGGGKPADILLWRNRRSTGVVLGAGTAFWIFFELMQYHLITFICHLLIVSLAALFLWSNASVFIHKSSLHIPHVALPEECVHQVASALTIEINRAFVIVREIGTGRDLKKFLSSSLVVMFAFTDFVQTVAAEVGLIKKYEDQVDALGEKAMIEIKKQYAVFDAKVLSQIPIAGFKKD

SEQ ID NO: 126734 - protein, 750 aa, Glycine max
  Coding DNA Sequence Number=SeqID_9956
  Gene Ontology: Mol. function=nucleoside-triphosphatase activity; Cellular component=membrane; Biological process=cell division
  Homolog annotation: Hit_ID=Q1SK92; Match level="QueryCoverage=94%, HitCoverage=89%, E-value=0.0, Identity=52%"; Hit description=AAA ATPase, central region; DEAD/DEAH box helicase, N-terminal
  Pfam annotation: Domain name=AAA; Domain location=440-624; Score =257.8; E_value=2.3e-74; Accession=PF00004.19; Description=ATPase family associated with various cellular activities (AAA)
  Pfam annotation: Domain name=AAA_3; Domain location=440-566; Score= -8.5; E_value=0.0027; Accession=PF07726.2; Description=ATPase family associated with various
  Pfam annotation: Domain name=AAA_5; Domain location=440-572; Score =13.1; E_value=0.00018; Accession=PF07728.4; Description=ATPase family associated with various
  Pfam module annotation: Pfam domain module=AAA::AAA_3::AAA_5; Domain location=440-624::440-566::440-572
MFGGASWILLNSNSGFLILSLIGSNNCTLHLINQLVLDFSKHLRNLHPASRAILLSGPAEPYQQNLARALAHYFKSKLLLLDITDFLLEMQRKYGCPRKEPSFLQQAELEVPEEVALELFGKVHYIDRVVKLKIPAILQSFAGMPLLHVIRLALPNMFMFSAPLKCTSGFCFDEKLFVQSLYKVLVSISETSSVILYIKDVEKLFVRSTRLHNLFQKLIKKLSGSVLILGSQIIDSEDDCTEIDEKLSMLFPYNIEIKPPQEDAHLASWRTKLIKDKEKSLFQDSRNHIAEVLAANDVDCDDLEKVNHADTMLLSNCIEEIVASAISHHLMETKHPEYRNRKLVISHKSLSHVLNIFQESESNLENKDSNKEDALATKKDGDNEFEKRMRAEVVPANEIGVTFEDIGALDDIKELLEDVVMLPLRRPDLFKGGLLKPYKGILLFGPPGTGKTMLAKAIANEAGASFINVSISNITSKWFGEDEKNVRALFSLAAKVAPTIIFIDEVDSMLGKRTKYGEHEAMRKIKNEFMAHWDGILTKPGERILVLAATNRPFDLDEAIIRRFERRIMVGLPSAENREMILKTLLAKEKYEHIDFNELSTITEGYTGSDLKNLCTAAAYRPVREVLQQERLKEKEKKKTEAEVQRSEDASDAKGDKEDGVITSRCLNIQEKKKTEAEVQSSENASDAKGDKDHQVITLRPLNMEDMRLAKSQVAASFAAEGSIMSELKEWNELFGEGGSRKKQQLTYFL

SEQ ID NO: 126735 - protein, 1368 aa, Glycine max
  Coding DNA Sequence Number=SeqID_9957
  Gene Ontology: Mol. function=RNA-directed DNA polymerase activity; Cellular component=chromatin; Biological process=chromatin assembly or disassembly
  Pfam annotation: Domain name=Chromo; Domain location=1260-1308; Score= 20.6; E_value=0.0037; Accession=PF00385.14; Description='chromo' (CHRromatin Organisation MOdifier
  Pfam annotation: Domain name=RVP; Domain location=254-358; Score= -1.2; E_value=0.0052; Accession=PF00077.10; Description=Retroviral aspartyl protease
  Pfam annotation: Domain name=RVP_2; Domain location=241-363; Score= -34.3; E_value=0.00047; Accession=PF08284.2; Description=Retroviral aspartyl protease
  Pfam annotation: Domain name=RnaseH; Domain location=725-844; Score= -33.5; E_value=0.077; Accession=PF00075.14; Description=RNase H
  Pfam annotation: Domain name=rve; Domain location=954-1110; Score =98.7; E_value=1.8e-26; Accession=PF00665.16; Description=Integrase core domain
  Pfam annotation: Domain name=zf-H2C2; Domain location=895-936; Score =23.3; E_value=0.00029; Accession=PF09337.1; Description=His(2) -Cys(2) zinc finger
  Pfam module annotation: Pfam domain module=Chromo::RVP::RVP_2::RVT _1::Retrotrans_gag::RnaseH::rve::zf-H2C2; Domain location=1260 -1308::254-358::241-363::465-634::1-85::725-844::954-1110::895-936
  Subcellular localization annotation: CTP_CleavageSite=53; ConfidenceScore=5.02e-01
MEGRALAWFQWMSSNGQFTSWPVFLQALQTRFAPSNYEDPSGSLFKLIQKTTVAEYLSEFEELANRVVGLPAPFLLSCFVSGLAPEIRREVMINQPLTVAQAAGLARLHEEKLRDLRFDFRQPNRPRPLQLPPVAPPQTSPLPTYTPPRASTLPPLLPLPPRPNPQPPPMFRRLTSEELASRRERGLCFSCDEKFHKGHRCAPRVHLLIADDEDPLDPAGSNINPPDPPDPLPGPLDGPDSPAHLSINSLAGHLAPETLRLLGTISGVPVLVLIDGGSTHNFIQEPLVHQLGLPCQSTSPLKVMVGNGQHLQCHTICSSTTLVLQHHSFTMDLYVLPIAGANIILGVQWLQSLGPVLTDYTKLTMQFFHDDSLYFHITVLPVDSAQPLTKPVDPQVQHLLHQFAILFQDPTTLPPARDTDHQIHLLPHATPVNVRPYKYPYYQKREIEAQVETMLQRGLIQPSKSPFSSPVLLVKKSDNTWRFCVDYRALNALTIKDRFPIPTIDELLDELGGASCFSKLELLQGYHQIRMQPEDIPKTAFRTHHGHFEFKVMPFGLCNAPSSFQATMNTLFRPYLRRFIIVFFDDILIYSGSLSDHLRHLQATFQILYENHFVLKLSKCLFAQSEVEYLGHLVSHRGVQPVTSKLDAIAQWPIPRSVRALRSFLGLAGFYRRFIQGYATIAAPLVKATTVEPLQWNSSTQAAFDTLKQALISAPVLSLPDFQLPFTIETDASAIGMGAVLSQRGHPIAYFSKPFSPKLLRASTYVRELFAITAAVKKWRQYLLGHSFIILTDHRSLKELMSQVVQTPEQHTYLARLMGYDYQIQYRSGSHNQAADALSRLPENPSQALLILSVPCLTFLEELHTQLAANSSFQHLFQELPSDIPIIKTLLTEYHATPTGGHAGVAKTVARLTTNFYWTGLRDDVMRFIATCVDCQVTKYETKKTAGLLCPLPVPTQPWSDLSLDFICGLPPYRGNTTILVVVDRFSKGIHLGMLPQSHTALAVARLFLDLVVKIHGLPRSLVSDRDPLFISQLWQELFKSSGTQLRMSSTYHPQSDGQTEVLNRVVEQYLRAFVHRKPTSWGKLLPWVEWSHNTSWMASTGTTPYEITFGRKPFNFPDYLAGSSKIEAVEEILTDRDTTFQLVRKKLLKAQSKMKLYADQHRRDVQFTVGDWVLVRLRPYRQFSAKDKHHTNEKLARRYYGPFQVVAKLRPVAYRLALPEGVRLHPVFHCSKLKPFRGDPDSSSPLPLPATFHENQPLVSPLSILDFRRETSDPQSPWQVLVQWQGLPPEETSWEDWHQLCQDYHLEDKVILQGPRDDTSTEDTELGKEDAEEEDDLSKREEEDRGVQREGKPKRKVIKPNYLKDYV

SEQ ID NO: 126736 - protein, 274 aa, Glycine max
  Coding DNA Sequence Number=SeqID_9958
  Gene Ontology: Mol. function=nucleoside-triphosphatase activity; Cellular component=integral to membrane; Biological process =translation
  Homolog annotation: Hit_ID=Q1S1V3; Match level="QueryCoverage=98%, HitCoverage=48%, E-value=1e-104, Identity=70%"; Hit description=AAA ATPase
  Pfam annotation: Domain name=ABC_tran; Domain location=2-156; Score =70.9; E_value=4e-18; Accession=PF00005.17; Description=ABC transporter
  Subcellular localization annotation: CTP_CleavageSite=66; ConfidenceScore=5.21e-01
SHGTLLLNSAPLVPSTFRKLSSYVPQHDHCLPLLTVSETFLFAAKLLKPKTSNLAAIVSSLLSELRLTHLSNTRLARGLSGGERRRVSIGLCLLHDPAVLLLDEPTSGLDSTSAFKVMRILKQTCVSRNRTIILSIHQPSFKILACIDRILLLSKGQVVHHGSVATLQAFLHSNGFTVPHQLNALEYAMEILSQLNEAKPVTPPSIPESPERSSSVISVSDGGVRSSREIIRFWKIIYRTRQLLLTNTAEALLVGLVLGTIYINIGFDKEGIEK

SEQ ID NO: 126737 - protein, 660 aa, Glycine max
  Coding DNA Sequence Number=SeqID_9959
  Gene Ontology: Mol. function=steroid hormone receptor activity; Cellular component=nucleus; Biological process=regulation of transcription, DNA-dependent
  Homolog annotation: Hit_ID=Q1S1V4; Match level="QueryCoverage=99%, HitCoverage=98%, E-value=0.0, Identity=80%"; Hit description=SPX, N -terminal; Major facilitator superfamily MFS_1
  Pfam annotation: Domain name=MFS_1; Domain location=255-651; Score =56.5; E_value=8.5e-14; Accession=PF07690.6; Description=Major Facilitator Superfamily
  Pfam annotation: Domain name=SPX; Domain location=2-148; Score=115.7; E_value=1.4e-31; Accession=PF03105.10; Description=SPX domain
  Pfam annotation: Domain name=Sugar_tr; Domain location=248-624; Score= -153.8; E_value=0.047; Accession=PF00083.14; Description=Sugar (and other) transporter
  Pfam module annotation: Pfam domain module=MFS_1::SPX::Sugar_tr; Domain location=255-651::2-148::248-624
MVAFGKKLKERQIQEWQGYYINYKLMKKRVKQYAQQIQLGTLDRRHVLKDFSRMLDNQIEKTVLFLLEQQGLLASRIAKLGEEHEVIQQEPHISRIAELREAYRAVGQELLKLLFFVEVNAVGLRKILKKFDKRFGYKFTDYYVKTRANHPYSQLQQVFKHVGFGAVVGALSRNLHELQENQESQGSFLSIYDQPTLPLQDPVIDSIRAAIDRLSNSTNFLNFLGQHALIMHEELPAPVDERVDEQSYHFMSLFLNLANTFLYMVNTYIIVPTADDYSMSLGAAPTVCGIVIGAMAVAQVFSSVYFSAWSNRSYLRPLIFSSIVLFLGNVLYALAYDLNSIWILIIGRLLCGAVNRRYISDCVPLKIRMQASAGFVSASALGMACGPALAGLLQTNFKIFNITFNQDTLPGWLMTIAWLIYLVWLWITFKEPYREIEEKHVPHQSNAENNALEKGIKQPLLTSLKDKVDEDDDQDYEDSEEAPEDSHQPANSIGAAYRLLTPSVKVQLLIYFMLKYAMEILLSESSVITTYYFNWTTSTVSIFLACLGLTVLPVNIIVGSYISNMFEDRQILLASEIMVFLGILFSFNVIFPYTEPQYICSGLLMFVSAEVLEGVNLSLLSRVMSSRLSRGTYNGGLLSTEAGTLARVIADATITLAGYG

SEQ ID NO: 126738 - protein, 447 aa, Glycine max
  Coding DNA Sequence Number=SeqID_9960
  Gene Ontology: Mol. function=catalytic activity; Cellular component =intracellular; Biological process=metabolic process
  Homolog annotation: Hit_ID=Q1S1V5; Match level="QueryCoverage=94%, HitCoverage=90%, E-value=0.0, Identity=45%"; Hit description =Tetratricopeptide-like helical
  Pfam annotation: Domain name=PPR; Domain location=134-168; Score =43.7; E_value=6.1e-10; Accession=PF01535.11; Description=PPR repeat
  Pfam annotation: Domain name=PPR; Domain location=169-203; Score=7.0; E_value=1.1; Accession=PF01535.11; Description=PPR repeat
  Pfam annotation: Domain name=PPR; Domain location=205-239; Score=5.5; E_value=1.7; Accession=PF01535.11; Description=PPR repeat
  Pfam annotation: Domain name=PPR; Domain location=271-305; Score=1.1; E_value=5.6; Accession=PF01535.11; Description=PPR repeat
  Pfam annotation: Domain name=PPR; Domain location=33-67; Score=21.0; E_value=0.0044; Accession=PF01535.11; Description=PPR repeat
  Pfam module annotation: Pfam domain module=PPR::PPR::PPR::PPR::PPR; Domain location=134-168::169-203::205-239::271-305::33-67
MAVGNALVDAYAGGGMADEAWSVIGMMNHRDIITYTTLAARLNQQGDHEMALRVITHMCNDEVKMDEFSLASFISAAAGLGIMETGKQLHCYSFKSGFERCNSVSNSLVHSYSKCGSMRDAYRVFKDITEPDRVSWNGLISGLASNGLISDALSAFDDMRLAGVKPDSVTFLSLIFACSQGSLLNQGLDYFYSMEKTYHITPKLDHYVCLVDLLGRGGRLEEAMGVIETMPFKPDSVIYKTLLNACNLHGNVPLGEDMARRCLELDPCDPAIYLLLASLYDNAGLPDFGDKTRKLMRERGLRRSPRQCWMEVKSKIYLFSAREKIGNDEINEKLESLITEIKNRGYPYQESEDKLYHSEQLALAFGVLSVPTLAPIRINKNSLICTHCHSFIMLLTQFVDREIIVRDRKRFHVFKDGQCSCRAMSMKPERGPRLVRPGLKAVAKIGV

SEQ ID NO: 126739 - protein, 293 aa, Glycine max
  Coding DNA Sequence Number=SeqID_9961
  Gene Ontology: Mol. function=sequence-specific DNA binding; Cellular component=nucleus; Biological process=regulation of transcription
  Homolog annotation: Hit_ID=Q1S1V6; Match level="QueryCoverage=87%, HitCoverage=85%, E-value=8e-67, Identity=53%"; Hit description=DNA -binding WRKY
  Pfam annotation: Domain name=WRKY; Domain location=179-235; Score =108.1; E_value=2.5e-29; Accession=PF03106.6; Description=WRKY DNA -binding domain
  Subcellular localization annotation: CTP_CleavageSite=87; ConfidenceScore=5.04e-01
MAEDWDLFAIVRSCQSATTTIPQTTTNNTSSSLVTSTIKEEIYDAFSSPNIVPPNTNEFQELHQLFTPFNPTNNTSAPGINPNSPYFAEQESQQISEHLHIWPHFVPEQSSTPSFNRFHDQQQQQQINQLQALQKHEFRLPQNISPTVSPNAQPQTPKSRKRKSQQKKMVCHVTADNLSADLWAWRKYGQKPIKGSPYPRCSSSKGCMARKQVERSNTEPDMFVVTYTGDHSHPRPTHRNSLAGSTRSKTLVTNPPPSPGSLSCFQATPFSSSSSSPPHSPTSPEEDPRKPPI

SEQ ID NO: 126740 - protein, 247 aa, Glycine max
  Coding DNA Sequence Number=SeqID_9962
MGNCFFGAMSDPDAAAIKVITSNGGIMEFSAPVTVSFITNEFPGHAIFRSHDLFWKPLSQFEELEPGQSYYLLPFSNRNNNNNNNNSNNNIDTLPCDGENVNVVVRQGHVRSQSVPTISNPALYRMSLDYHHHNQGMGLLKRSSNNNIDAFSSRSSGVVNSSNSIGGGGSSRFWKVKLVITPEQLLDILAQEARTKELIESVRMVAKCGINAGGAISNSAAGMISDQWSLSSSSWSISSKIDALVGI

SEQ ID NO: 126741 - protein, 115 aa, Glycine max
  Coding DNA Sequence Number=SeqID_9963
  Gene Ontology: Mol. function=metal ion binding; Biological process =metal ion transport
  Homolog annotation: Hit_ID=Q1S1V9; Match level="QueryCoverage=99%, HitCoverage=85%, E-value=1e-23, Identity=54%"; Hit description=Heavy metal transport/detoxification protein
MKVVSNLSGVESVSVDMKEQKLTLIGDIDPVVAVGKLRKLCHTDIVSVGPAKEENKGKNNKEEKKKPAVAENQNHQNLDDMVKAYEAYHHMHNQMRQPAYYYISVEENPNACVIC

SEQ ID NO: 126742 - protein, 394 aa, Glycine max
  Coding DNA Sequence Number=SeqID_9964
  Gene Ontology: Mol. function=binding; Cellular component=thylakoid; Biological process=photosynthesis
  Homolog annotation: Hit_ID=Q2HPC2; Match level="QueryCoverage=99%, HitCoverage=99%, E-value=1e-106, Identity=53%"; Hit description=SGT1
  Pfam annotation: Domain name=CS; Domain location=159-237; Score=1.7; E_value=0.015; Accession=PF04969.6; Description=CS domain
  Pfam annotation: Domain name=SGS; Domain location=299-394; Score =161.5; E_value=2.2e-45; Accession=PF05002.5; Description=SGS domain
  Pfam annotation: Domain name=TPR_1; Domain location=2-35; Score=11.7; E_value=0.22; Accession=PF00515.18; Description=Tetratricopeptide repeat
  Pfam annotation: Domain name=TPR_1; Domain location=36-69; Score =26.3; E_value=0.00011; Accession=PF00515.18; Description =Tetratricopeptide repeat
  Pfam annotation: Domain name=TPR_1; Domain location=70-103; Score =22.9; E_value=0.0011; Accession=PF00515.18; Description =Tetratricopeptide repeat
  Pfam annotation: Domain name=TPR_2; Domain location=2-35; Score=14.2; E_value=0.48; Accession=PF07719.7; Description=Tetratricopeptide repeat
  Pfam annotation: Domain name=TPR_2; Domain location=36-69; Score =23.5; E_value=0.00077; Accession=PF07719.7; Description =Tetratricopeptide repeat
  Pfam annotation: Domain name=TPR_2; Domain location=70-103; Score =18.5; E_value=0.024; Accession=PF07719.7; Description=Tetratricopepti de repeat
  Pfam module annotation: Pfam domain module=CS::SGS::TPR_1::TPR_1::TPR_ 1::TPR_2::TPR_2::TPR_2; Domain location=159-237::299-394::2-35::36 -69::70-103::2-35::36-69::70-103
MASDLELKAKEAFEDDNYDLAYDLLTQAIGLSPNNADLYADRAQVNIKVNNLTEAVSDANKAIELNPSHSKAYLRKGTACIKLEEYQTAKAALEMGASLAPGDSKFTDLIKDCDELIAEESGVIPIQEESTTQGAATKAVEAENDLPEPPTVTVVKPKYRHEFYQKPDEMVITIFAKGIPRDSITVDFGEQILSVTINIPCKDAYVFQPRLFGKKLRIIDFPLSDHTLQMPLISEYKPHYYYSPLAFGWMLLKAYGLKLASLDPFYHGFHVTCIISYPMNLAVARGEKPTYPSSKPKITDWDKLEAQVKKEVCWYTSFPYPNTSFQEKEEKLDGDAALNKFFRDIYQDADEDTRRAMSKSFVESNGTVLSTNWKEVGSMKVQESPPDGMELKKW

SEQ ID NO: 126743 - protein, 290 aa, Glycine max
  Coding DNA Sequence Number=SeqID_9965
  Gene Ontology: Mol. function=ornithine cyclodeaminase activity; Cellular component=cytoplasm; Biological process=visual perception
  Homolog annotation: Hit_ID=Q1S1V7; Match level="QueryCoverage=97%, HitCoverage=82%, E-value=4e-99, Identity=63%"; Hit description =Aconitate hydratase, N-terminal; Ornithine cyclodeaminase/mu- crystallin
  Pfam annotation: Domain name=OCD_Mu_crystall; Domain location=19-290; Score=21.8; E_value=3.8e-11; Accession=PF02423.6; Description =Ornithine cyclodeaminasemu-crystalli
  Subcellular localization annotation: CTP_CleavageSite=14; ConfidenceScore=5.18e-01
MAATTNKDEAISTSASSSSSPVFISTETLFTILTHHTLMNHLQSTLPKASTILQTPIRQHHSLFPSSSLLLMPSWSSSPSLPYIGVKLVTHFPQNSSINLPGVQGSYVLFSSTTGQTLASMNSTELTLYRTSSRHDSEVLVMNSGKGDKFGQSGEFGGVSFEGCGCLDEVVGFGDIVSCATNSETPLVKGVRLKGGAHLDLVGSFKPSMMECDDEAIRRGKVFVDNEAALVEAGELVGAFERGVIKRDEIGGSLVELVRGDKVGRSSSEQITVFMSVGSAVVDMLAAVCL

SEQ ID NO: 126744 - protein, 126 aa, Glycine max
  Coding DNA Sequence Number=SeqID_9966
MEESSGFPVLFGGENSNPPDDGGKDKILGLQLSARLQNNGLKDKIFLGLELIARLQHRTRGLRHLTRIHGVDLTNETQDTYLYLFHSPLCFLLNEYCSTRTYVKNYEHIFELIDIKDTMKFRKCQE

SEQ ID NO: 126745 - protein, 248 aa, Glycine max
  Coding DNA Sequence Number=SeqID_9967
  Homolog annotation: Hit_ID=Q1RUD8; Match level="QueryCoverage=51%, HitCoverage=28%, E-value=3e-09, Identity=30%"; Hit description=IMP dehydrogenase/GMP reductase
MARVSKVVKIAAQELDRVKQNINGLVEIPMKHLEGKAKALADQGEWTSFVDVLALSVFGIVLFQNVDELVDLAVTGAFLAYHHNKESLVIAVLDDAYDTFDLRCEKSSARIVCCTPALYVWLVSHIFRHESRPVCPLQGHRMCAEKGKTNWEELLAGFPNVPLMGTRGFSEGNAKILQRVQKAWNAVERKDKELRGSNNAEVPAEREEVQALKAKLERTRVVKEKFKMAATRVRGTELEFVIMVIAVS

SEQ ID NO: 126746 - protein, 105 aa, Glycine max
  Coding DNA Sequence Number=SeqID_9968
  Homolog annotation: Hit_ID=Q5JK63; Match level="QueryCoverage=63%, HitCoverage=16%, E-value=1e-23, Identity=76%"; Hit description=Group II intron splicing factor CRS1-like
ALLPSCTETRNKKHETVKVFCKPCKPGQGHEYAQELARLSGGIPLQIIGDDTIIFDCGKNYEQPEVMSPIDTLSKNKARIRRGDFFVHETYGAYKSVEELWDGEI

SEQ ID NO: 126747 - protein, 139 aa, Glycine max
  Coding DNA Sequence Number=SeqID_9969
  Subcellular localization annotation: CTP_CleavageSite=21; ConfidenceScore=5.17e-01
MFGKRKTPKISNANMSTTYPLAGGRRETHGCVFQERKMRGVAINVFSRKTSKKPERCGLRTLIVKGSGVVFTHGKGVSLAPTYSSIVIRKSDLRNSSRTERWLSCFNPFFARYILTKQKLFKALDHLNDLLILLKGEKH

SEQ ID NO: 126748 - protein, 84 aa, Glycine max
  Coding DNA Sequence Number=SeqID_9970
MKPKKILDEASLSSSESKTQHDHRSTSTPYGSHRPGYRSLIDRQTHTKHNIIAKVIYKYGQNNGQKGKRNINKEEDTIKTLHTD

SEQ ID NO: 126749 - protein, 114 aa, Glycine max
  Coding DNA Sequence Number=SeqID_9971
MAKAEHPRRKLVIKIFPPGSKVSYSCGANTPKDSIVSKVCELKNKKGYYAMTMWVNTENPSESCVTDSRISRTEMATRLTLKTSPKYDFSPNAYGAFWADQHPHADKDGSRLTM

SEQ ID NO: 126750 - protein, 344 aa, Glycine max
  Coding DNA Sequence Number=SeqID_9972
  Gene Ontology: Mol. function=DNA binding; Cellular component=nucleus; Biological process=regulation of transcription, DNA-dependent
  Homolog annotation: Hit_ID=Q0PJI5; Match level="QueryCoverage=94%, HitCoverage=98%, E-value=1e-108, Identity=65%"; Hit description=MYB transcription factor MYB136
  Pfam annotation: Domain name=Myb_DNA-binding; Domain location=54-131; Score=32.4; E_value=1.6e-06; Accession=PF00249.21; Description=Myb -like DNA-binding domain
MVSKNPNPSEALNLDPSGMSLPGILPFAAAAAAAVSFEDPAKKTRKPYTITKSRESWTEPEHDKFLEALQFFPSDHQYLPYHPNSDTGTIGLITFDSSELKLIFDRDWKKIEAFVGSKTVIQIRSHAQKYFLKVQKSGTSEHLPPPRPKRKAVHPYPQKASKNVPVLSQVSGSFQSSSALLEPGYILKHDSSAMPKTSIIDTTVSSWSNNYLQKTTNVLHGQKQKVNNCCSSSESPRAQLVGESNGRGNNSHPLRVLPDFAEVYNFIGSVFDPNITGHVQKLKRMDPIDVETVLLLMRNLSINLASPDFEDHRRLLASYEVEPEVDKYINADRTMLDVRLKSAT

SEQ ID NO: 126751 - protein, 119 aa, Glycine max
  Coding DNA Sequence Number=SeqID_9973
MYNYHVKGRAPDLESVLADFMTYQASSKDYQWESEWQPYFHNEAVGLSNLDDLLMQFKGTIDSMQQAFKRAETQIGKLVDDMINVVVRREKEYAEIETHQEIILQLTQYIIIDHQRRKR

SEQ ID NO: 126752 - protein, 138 aa, Glycine max
  Coding DNA Sequence Number=SeqID_9974
MDNYLKGIIKRSMLFFNTFALALLSNIYILMFLVITSALKGLEDTPQPKSKAGARWIVVKTIGSREIEGTLHPMDNYLKGIIKRSMLFFNTFALALLSNIYILMFLVITSALKGLEDTPQPKSKAGARWIVVKLTFNI

SEQ ID NO: 126753 - protein, 100 aa, Glycine max
  Coding DNA Sequence Number=SeqID_9975
MSPLLTENTWATTLRVSHLVVSEQVGPFGHEVMAVRNKRERLLTKSLNNLALVMANQGGDGGAATYQAEWRKRRVERRRHFKEKMSQEEAHHHRKPRIRA

SEQ ID NO: 126754 - protein, 130 aa, Glycine max
  Coding DNA Sequence Number=SeqID_9976
  Gene Ontology: Mol. function=lipoic acid binding; Cellular component =glycine cleavage complex; Biological process=glycine decarboxylation via glycine cleavage system
  Homolog annotation: Hit_ID=P0A6T9; Match level="QueryCoverage=96%, HitCoverage=99%, E-value=1e-54, Identity=79%"; Hit description =Glycine cleavage system H protein
  Pfam annotation: Domain name=GCV_H; Domain location=10-130; Score =217.3; E_value=3.4e-62; Accession=PF01597.9; Description=Glycine cleavage H-protein
MAMSNVPNELKYRDSHEWVRKEADGTFTVGITEHAQELLGDMVFVDLPDVGASFAAGDDCAVAESVKAASDIYAPLSGEIVAVNEALGDAPELVNSEPYAAGWLFRIKASDESELDAMLDAAAYKASIDE

SEQ ID NO: 126755 - protein, 104 aa, Glycine max
  Coding DNA Sequence Number=SeqID_9977
  Gene Ontology: Mol. function=chitin binding; Cellular component =extracellular region; Biological process=chitin metabolic process
  Homolog annotation: Hit_ID=UPI0000612705; Match level="QueryCoverage =89%, HitCoverage=91%, E-value=1e-13, Identity=32%"; Hit description =UPI0000612705 related cluster
MYYASSSSEDYTSSPSEGYTPLPSEDYTSSPSEDYTSSPSVGYTSLPSEGYTSSPSEGYTPSPSEDYTSSSLEGCTPSPSEGCTPSALKGDTSSTSEGCTPPRL

SEQ ID NO: 126756 - protein, 178 aa, Glycine max
  Coding DNA Sequence Number=SeqID_9978
  Homolog annotation: Hit_ID=Q8H6Q8; Match level="QueryCoverage=82%, HitCoverage=5%, E-value=8e-12, Identity=27%"; Hit description=CTV.20
MSIMVSSEHSWEDCQSANGDIPYENLSYGQLISYVQKVALKICQDDKIQRQLAKEKAQTKKDLETSEEETETETSSSVFSDENLNLIQQDDQLSSTDDDDKQINTLTREQDLLFEAINSIPDPQEKKVFLEKLKKTLEVKPRPKDFIANNKFDVSNILKRLENSSTKPMTIQGSPNRR

SEQ ID NO: 126757 - protein, 100 aa, Glycine max
  Coding DNA Sequence Number=SeqID_9979
MGETHEIPHHNLTDFKPCLGYATEGQTVGGIPLQNTLEGPQFRPQPQPFYGKMVGYTPSSFANLVFTGERIKVGLEREDENEGETLAMTIIPTQSNFPSA

SEQ ID NO: 126758 - protein, 142 aa, Glycine max
  Coding DNA Sequence Number=SeqID_9980
  Gene Ontology: Cellular component=cellulose and pectin-containing cell wall
  Homolog annotation: Hit_ID=Q9SII5; Match level="QueryCoverage=97%, HitCoverage=38%, E-value=3e-46, Identity=61%"; Hit description =Expressed protein
  Pfam annotation: Domain name=Phi_1; Domain location=2-139; Score =40.6; E_value=2.1e-12; Accession=PF04674.3; Description=Phosphate -induced protein 1 conserved region
MTLSLNYAWVGNSEKQCLEVCAYPFAVPGYIGSGGPGHLILSNGDIEVDDMVSVIGHKLAELSSNPLVNAWYADEDPTAPTEIEDLYEGLYEMGGGGGYIGSIMKDDEGRTFNLNGRNGRKFLVQWIWSPILKACAGPNALD

SEQ ID NO: 126759 - protein, 116 aa, Glycine max
  Coding DNA Sequence Number=SeqID_9981
MIEQMNKISPHMQTLSRNYCKDKIYHELELVNSELKLGITLSAPLSSSTTTILLLNQLVSGSWRKESTRWRKKVESGSQWSSETATTHGGAVAVLMMDSTTNSALYYPVVIHKNQW

SEQ ID NO: 126760 - protein, 46 aa, Glycine max
  Coding DNA Sequence Number=SeqID_9982
MLLDNWENTGFLEARVSQTVEHESQREKSHSAPMMNSSLAPLLSQK

SEQ ID NO: 126761 - protein, 54 aa, Glycine max
  Coding DNA Sequence Number=SeqID_9983
MEKGISLPMEKGFKILLFPIIDSLGNPLKFYRLYSQKPCNKLFMHVQHVHIVIM

SEQ ID NO: 126762 - protein, 123 aa, Glycine max
  Coding DNA Sequence Number=SeqID_9984
MYDLIRHKTSRLDHSIQCLGFQEFKKLMCPIIMSLLRLNEGNWQHKSMTVIYHIFYGSYLVKKLSSHEKLQWVKRLHLSLDVHLFGNMIVYDSLDLDCCTCPAPLGTLEIVGDLGVLGDLGDF

SEQ ID NO: 126763 - protein, 93 aa, Glycine max
  Coding DNA Sequence Number=SeqID_9985
MYIHPSILLPYPKCKLPKDICGAIILALSEMNACPKKMENMCKPKMPHGLFPYKNHALMPLRHFTEHLVGARLGINSKRTGTMWHVPLLQNAL

SEQ ID NO: 126764 - protein, 76 aa, Glycine max
  Coding DNA Sequence Number=SeqID_9986
  Gene Ontology: Mol. function=transcription factor activity; Biological process=regulation of transcription, DNA-dependent
  Homolog annotation: Hit_ID=Q2XGJ2; Match level="QueryCoverage=95%, HitCoverage=24%, E-value=3e-21, Identity=65%"; Hit description =Transcriptional regulator, LysR family
MATHQAGVITVSCIPTAAFYFLPSVIRDYNNDYPNIRIRILEHSASDCLEAVLNGDADFGIPMINITHPNIDFAPA

SEQ ID NO: 126765 - protein, 209 aa, Glycine max
  Coding DNA Sequence Number=SeqID_9987
  Homolog annotation: Hit_ID=Q5SDQ9; Match level="QueryCoverage=99%, HitCoverage=28%, E-value=5e-40, Identity=48%"; Hit description =Uncharacterized conserved protein
MVGWHRYGALASTRQPGLAVGEIDSGGGGLHRAIGVRADAGNAAGTYRSATLALVAQRGGYAPMIGGLGYVAASGYSGSTLNSFAAKDLWVQQPDRDQTERALTVAPLDLPGGRSAGSDAVSSPRVLSDLFWLGRYGERAENLVRLLSVTRERFHEYRYRQFMEASECVPVLLKALGDITGTDTAAEDLGTQLWSLTVDKERSGSLAQS

SEQ ID NO: 126766 - protein, 131 aa, Glycine max
  Coding DNA Sequence Number=SeqID_9988
  Gene Ontology: Cellular component=integral to membrane
  Homolog annotation: Hit_ID=Q5PH70; Match level="QueryCoverage=55%, HitCoverage=19%, E-value=4e-13, Identity=53%"; Hit description =Putative membrane protein
MGADLPMILILSGVIGGLIAFGMIGLFIGPVVLAVSYRLVSVWMHEAPAPDDDPETAIEALAEHEEPQPDKQSGPAANAVSAGFMAILCFEKWDGIRDRCPTVAGHQAGVTDYALAASSSARLSQVSTTVS

SEQ ID NO: 126767 - protein, 159 aa, Glycine max
  Coding DNA Sequence Number=SeqID_9989
MGNQQRQGYTQGRFSGFQQGPYNQQGQWGTHPDNQFNKDQGGSSNTLTHPNIFQRRTKLEETLTQFMQVGQLAKQIADKSSNSFGANTENNPKKECKAVMTRSKKFVKAEDEESVVYKEQMGEKIGADVEENDVKGKENQEKGKKIMVQNKKIKREKKK

SEQ ID NO: 126768 - protein, 139 aa, Glycine max
  Coding DNA Sequence Number=SeqID_9990
MHNALRLNSPLPYPHLFTLFLQHFNIPLDSEPYVPIKKSFLIGAAMVASFGYRKERDGSWVKKDTQPNDDEGQLPVEGDSSLLQSILDRFDELQTYVGERFDALEQQVDMRFDAMDSRITKVEEDVTIIGDCLDLPPPP

SEQ ID NO: 126769 - protein, 154 aa, Glycine max
  Coding DNA Sequence Number=SeqID_9991
MKELYANLYDPEDKSPKQVWVRGHLIKFDADSLNTFLHTLVILEQVESLPAYSRFCRLRLDPQELIARLCIPGRGFELNADGLPLKILRKNLTTMAQTWSVLSFSNLALTSHTSDITLDRARLIYELIMKMDMNLGSLISGQISLIAQHDSSRL

SEQ ID NO: 126770 - protein, 146 aa, Glycine max
  Coding DNA Sequence Number=SeqID_9992
  Gene Ontology: Mol. function=nucleic acid binding; Biological process= DNA integration
MEGNCSVVIQRILPPKHKDPRVVTIPCSIGEVAVGKALIDLGASINLMSLSMCRRLGELEIMPTHMTLQLADRSITRPYGVIKDVLVKVKHLIFLADFVVVYIKEDVDIPLILGRPFMSTNKDLPDQNVCLKVHVMEERRPERKGP

SEQ ID NO: 126771 - protein, 160 aa, Glycine max
  Coding DNA Sequence Number=SeqID_9993
MVGAGLKKDLRVSRVVPGGYFTKTCHGKEEGGTSTLGERSTTDSCAMIYFTGEVSAQLVELRSCNWVVAITGWMSNCPGGNDSILRAVKNVEEGFLIWDPGEEDQAGPCEQLDALSPFNPLSEMWQKEKESMDRPHRLHPVGTTRSPQGRLRHPGVADRP

SEQ ID NO: 126772 - protein, 127 aa, Glycine max
  Coding DNA Sequence Number=SeqID_9994
MGSCGPEKIKAIQEWPTPKSVGDIRSFHVLESFYRKVLERIKNNAYKLDLPEEHGVSNTFNITDLAFRKHPQAIFGMGIFSKRLLMLPILKYAYVERHFLLLIHTLQGMNSKRVGAMWHAPLLQDAT

SEQ ID NO: 126773 - protein, 126 aa, Glycine max
  Coding DNA Sequence Number=SeqID_9995
MTKLCLVPDVVISPKFKVPDFDKYKGTTCPKNHPKFLNLPFFKDTTRTQHVLIMEEFQGIPLSIKYVHGERNTQGLILIVLIYILPTFENEPRRVQRNARNWNQRGGTQTEEGFQHPKGQTFPPCG

SEQ ID NO: 126774 - protein, 149 aa, Glycine max
  Coding DNA Sequence Number=SeqID_9996
  Homolog annotation: Hit_ID=Q6CQF3; Match level="QueryCoverage=37%, HitCoverage=59%, E-value=2e-08, Identity=72%"; Hit description =Kluyveromyces lactis strain NRRL Y-1140 chromosome D of strain NRRL Y- 1140 of Kluyveromyces lactis
LVPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVSAAGRAPH

SEQ ID NO: 126775 - protein, 66 aa, Glycine max
  Coding DNA Sequence Number=SeqID_9997
MWDTLQLTHEGTTDVKRSRVNTFTHEYELFRMNTNENIQRNGSPRNMKWNFNVSTKMKRLTRENEA

SEQ ID NO: 126776 - protein, 241 aa, Glycine max
  Coding DNA Sequence Number=SeqID_9998
  Gene Ontology: Mol. function=N-acetyltransferase activity; Biological process=metabolic process
  Homolog annotation: Hit_ID=Q3BW73; Match level="QueryCoverage=79%, HitCoverage=76%, E-value=1e-63, Identity=66%"; Hit description =Putative acetyltransferase
  Subcellular localization annotation: CTP_CleavageSite=71; ConfidenceScore=5.50e-01
RTASVRGSRARAFPARGARHQGYGCAGWRCPPGRSSVHRPVRNRNSPPRSGPRRPLCLRRQLPGACPCHIRQLVAVGLLDPRVAAQFLGQHAGAHIDLRHGVLAQLAEAEAAVEEQGGIGAMVEEDFAGHLRVAQLGEALRVCIERTADATATTAAGDHDAVDIEERGVQLLLEPGEIAAVVLAVAAEADQEAGQVAVALGDAEILSGFIEQAQAGRIQGKDGQASVVVQSQDGIELVLAH

SEQ ID NO: 126777 - protein, 97 aa, Glycine max
  Coding DNA Sequence Number=SeqID_9999
MYKAKWTQPWPMGLEIYLEVHENPRVFLSSSSSILLEPLAHGSCDWSLPRKDCISNLTCSYYGGVSGHSIEHCMTLKHKVQSLINAGWLIFEEDNCL

SEQ ID NO: 126778 - protein, 190 aa, Glycine max
  Coding DNA Sequence Number=SeqID_10000
  Gene Ontology: Mol. function=two-component sensor activity; Cellular component=integral to membrane; Biological process=two-component signal transduction system (phosphorelay)
  Homolog annotation: Hit_ID=Q5DZJ3; Match level="QueryCoverage=50%, HitCoverage=27%, E-value=2e-11, Identity=38%"; Hit description=Two component sensor histidine kinase
AGGQRLTAGIGGDAPPGGLPPRQRAAPAAAPGTDGRRDRAGGCLSGTDAHAHAGSPAFPAGCCRRNACAGLPGPVRADPGGECDPPWHRSLRRRRRSGGAGAAPASAAAVWRCGLAPAAGGTATRCRRAAAVTGPGVWCMIATALIADDEPLLRQALAAQLAQAWPQLQVVAQARNGREALQAFETLQPQ

SEQ ID NO: 126779 - protein, 180 aa, Glycine max
  Coding DNA Sequence Number=SeqID_10001
MGEIEELQERIKADMEAMKEQMATMMEAMMSMKKIMEVNAAAVVATSTVAKVDLVREAKSWEVWAAPIFVQVQNKHAFLPYGLPPKYTPPNVAHTPDENVNNSTPILIESQQPQSDHAYEVPHHNLADFEPYLEYATEGQVVGGVPLPNTLKGPLISPTTITLAFCSGESPSCYGGKGKI

SEQ ID NO: 126780 - protein, 134 aa, Glycine max
  Coding DNA Sequence Number=SeqID_10002
  Gene Ontology: Mol. function=chitin binding; Cellular component =extracellular region; Biological process=chitin metabolic process
  Homolog annotation: Hit_ID=UPI0000612705; Match level="QueryCoverage =82%, HitCoverage=92%, E-value=8e-16, Identity=28%"; Hit description =UPI0000612705 related cluster
MTVPLNESISCFLIRVNPWVLVSIAFRGLHSLAFRGLHTPAFRGLDALDFRGQHILDFRGLYALAFRGLQVLTFRGLHVLAFRGLHVLVFRGLHALAFRGLHVLTFRGLHVLTFRGLHALAFKGLHVLPFKGLH

SEQ ID NO: 126781 - protein, 88 aa, Glycine max
  Coding DNA Sequence Number=SeqID_10003
MITGLFQFYGVPVPPSKVIKPLLIEFSSRSTVPLGRRKARHHNSLEMDDNGQQTHHHHLQSPSAHPQKVRSLPTTHGRPIGNQVQSQR

SEQ ID NO: 126782 - protein, 147 aa, Glycine max
  Coding DNA Sequence Number=SeqID_10004
MELDLRWEALNGNFYNVLLGTTFRLEPLSMSTLAITCSMHLTDTCKALLCPLPSAGISSSAKRNSPASSSDTSFLPQPSLPSAKSFIGTSSPGCISRLGGANMRTLRVMPLSPVILVTLADSELILVTSSFLPPGGAYLYGTARLSW

SEQ ID NO: 126783 - protein, 176 aa, Glycine max
  Coding DNA Sequence Number=SeqID_10005
TIASILEEEAHFSDSTSSDSPSSRESATYLPEVVIMADEHQQRVTLEDYSSREAKRWLYSFKGTSLKTWKEVVEQFLKKYFPESKTTEGKAAISSFHQFLDDSLSEALERFRGGKIKLKTPEEATDLIENMSANDHATQRCTICGGTHEFGLCIPFEEQTQEVSYMGNQQRQGYNQ

SEQ ID NO: 126784 - protein, 111 aa, Glycine max
  Coding DNA Sequence Number=SeqID_10006
MAAQLIHDRVEMECLEGAWETLEGNTRCRFRGTIRFTATSLVHPDEPVHTLQRIVEWILPTPTPYHLVEPVQVIEVTSSEEDPEEDLEELPPEPAVDALDFLEGDEDPLPE

SEQ ID NO: 126785 - protein, 135 aa, Glycine max
  Coding DNA Sequence Number=SeqID_10007
  Pfam annotation: Domain name=Transposase_23; Domain location=45-115; Score=-4.6; E_value=0.0036; Accession=PF03017.5; Description =TNP1ENSPM transposase
MQSQLQSQIQSQGLALPPEPEVGTSAAHVSTKGSCVDPSPTSPDTGDSNKCGLYIEENPSRLVTLGRVYEGSTTVHNIPLLHGQVKVGVEEVKDAEAHIPVPTNEVILVGQTLNTFLAWQTLITTGNCVSSKTSR

SEQ ID NO: 126786 - protein, 299 aa, Glycine max
  Coding DNA Sequence Number=SeqID_10008
  Homolog annotation: Hit_ID=Q6CQF2; Match level="QueryCoverage=25%, HitCoverage=92%, E-value=3e-18, Identity=64%"; Hit description =Kluyveromyces lactis strain NRRL Y-1140 chromosome D of strain NRRL Y- 1140 of Kluyveromyces lactis
SFAPIPKSDERFARQYRCGPPPEFPLASPRSGIVHHLSGPDRYALTRTLHRRSGSVGGATHRGIPPISFLAPYGFTRPLTRTHVRLLWSVFQDGPNGGAHRPTPGSAQVPRHAKGARMPSTIAMDDVSHEHINSPGLGPPIAIRVRVNVPESIGGTGSHRFHIPTGTHRRPPSASPPDNFKHSLTLFSKSFSSFPRGTCSLSVSRQYLALGRNLPPDWGCIPKQPDSPTAPRGATGSGHDGALTLSGAPFQGTWARSATEDASPDYNSDAEGDRFSWWAFPGSLAVTKGILVSFFSSAY

SEQ ID NO: 126787 - protein, 493 aa, Glycine max
  Coding DNA Sequence Number=SeqID_10009
  Gene Ontology: Mol. function=RNA-directed DNA polymerase activity; Biological process=RNA-dependent DNA replication
MSSFLSKSTIGMGGSDSGGSIELPMMDQEVISIGDWRILVGVPGTTSHPLRRGKGSGSGDVRESPYVRRSHSPRSSLSTPAVVGYEWVKLASLEDSCMLAVQACGRDNFPFLRAASGSSPFFYMYRCLFEVLGLILPLTAFQCALLEDSNVAPSQLHPNSWAMLTEKIGWVSLNNMSKKLFEGPEDDSVSCMCLTVGLRMFDRVFISLSFELSVVVHDNGVWEAVPTNKVFLGEFLHFAGRSFRQWPCFYPLGIGGAQTVEIVKRGAWNFCNLLASSAPLGEVEGICPECWLVVAGSHHFGGKGASSSVEIANPFTKLSHNIVCLLGVIQSGSSSSLAITSSAFMVGAWIVSWMIVLRCPTFLVLANFESRLSQNLFDGLVHFDYHLITLEVGPESSGKGGWCFPLSCIRAELTALSATKRYRSRGTPGLGRLKIGGVAMDASVATYPSAGGRRETRGMRVPRKEYARSRHQRLFEENVGKTGKDAIYELLSE

SEQ ID NO: 126788 - protein, 275 aa, Glycine max
  Coding DNA Sequence Number=SeqID_10010
  Homolog annotation: Hit_ID=Q1SKD7; Match level="QueryCoverage=53%, HitCoverage=45%, E-value=1e-10, Identity=27%"; Hit description =Ankyrin
MAPRKLASKRSRKDKAAEGTSSAPEYDSHRFRSAEHQQRFEAIKGWSFLRERRVQLRDDEYTDFQEEIVRRRWASLVTPMAKFDPDIVLEFYANAWPTVEGVRDMRSWGQECEYGQRRNRADGFDEEAIAQLLCIPGQDFAQTAAGRRGMAPTRHPLDPDKSNRALGFPALITGTLPVAADAPPPHQAGPAESFDTEQYLRHLVRQQAANHWAHVQTHDYLLPDEPQPAEPGAEVAWPEARAGEAPAEAPDEADEALEDEEMTDLLDFLGGSGAT

SEQ ID NO: 126789 - protein, 94 aa, Glycine max
  Coding DNA Sequence Number=SeqID_10011
MPECLLIPMSFLPKSFGLGLVEFSPNFPRLAILKFFNMLKFVVNHMINDICQLFRQLRHEIVYHDVDMLFFKGGRHGNILSISGSFAMTKEIAK

SEQ ID NO: 126790 - protein, 141 aa, Glycine max
  Coding DNA Sequence Number=SeqID_10012
MGLHRKVEKSLTKLTEVVITNHKNTKVAIKSMETKIGKLAKQLQTSSIGLSTAIEENPKEEENEVEESTTLEEDIKEQANPSTQGMQSSLNPLLFDFSKLSIHKQGEDERMAKFEKHMEMLQGKKVEPPVEKLIWDVIRQV

SEQ ID NO: 126791 - protein, 316 aa, Glycine max
  Coding DNA Sequence Number=SeqID_10013
  Homolog annotation: Hit_ID=Q47522; Match level="QueryCoverage=18%, HitCoverage=77%, E-value=6e-19, Identity=74%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPHDVLGIVRRGEAHEGHHHVALGVVVGLGASLIGGAGLAADAVARHPAIFAAAGGDHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 126792 - protein, 275 aa, Glycine max
  Coding DNA Sequence Number=SeqID_10014
MASRKRKSIGARPTAQYDTRRFHSLDAWNRYTNNVLRMSILLERKVEIYHIEFDDFKTELERRNLHKRLTNLVDGTIDVALAKEFYANLYSSKDPSPKQARVRGHLVKIDADSLNTFLETPVVLEEGETLPTCSRYYRLPSDHREIEAALCIQGRGFILNAEGHPGRILRKDLTTLAQVWSVISYSNLAPTSHTSDLTVDRANLIFGLVSHMDMNIDALISGQMTSITQSNSCRLGFPALIIALCRARGVVSDSLTFERLSPAINLAYIRKNCWN

SEQ ID NO: 126793 - protein, 181 aa, Glycine max
  Coding DNA Sequence Number=SeqID_10015
MDEFMAELERRNFHKRLTSLADNSTDLALVMEFYANLYSPEGPSPKQVRIRGHLIRIDADNLNVFSETPVVLAEGESLPAYSRYCRMPTDIKEIEVALCILGRGFILNAEGHPGKILRKYLTTLAQVWSVLAYSNLALTSHTSDLTVDRARLIFGLVTEQITSMAQSNSSKLGFPALITTL

SEQ ID NO: 126794 - protein, 96 aa, Glycine max
  Coding DNA Sequence Number=SeqID_10016
MASGTACPAGGAEWPEWLAAQRAPQRLTLEGEMCWVTSVRLSSISGRSGKVEYHISEEKTHKLKPSGFGLECGVRLPYVVARGPQVYPLNLPNNWY

SEQ ID NO: 126795 - protein, 112 aa, Glycine max
  Coding DNA Sequence Number=SeqID_10017
  Gene Ontology: Mol. function=catalytic activity
  Homolog annotation: Hit_ID=Q41TG2; Match level="QueryCoverage=94%, HitCoverage=70%, E-value=4e-33, Identity=56%"; Hit description =Phenylacetic acid degradation-related protein
  Pfam annotation: Domain name=4HBT; Domain location=19-95; Score=73.8; E_value=5.6e-19; Accession=PF03061.12; Description=Thioesterase superfamily
MQGRAVVEIPFKEELTRRGNVLHGGIIMTAIDFTGGLAAFTVNDGVDQVTQELKVNFLEPMYKGPFRVEGKVLRKGSTVIVVEIEFRDAEGNLGAKALGSWYILRKKVQGAL

SEQ ID NO: 126796 - protein, 384 aa, Glycine max
  Coding DNA Sequence Number=SeqID_10018
  Gene Ontology: Mol. function=transferase activity; Biological process= biosynthetic process
  Homolog annotation: Hit_ID=Q980C8; Match level="QueryCoverage=99%, HitCoverage=93%, E-value=1e-180, Identity=78%"; Hit description=LPS biosynthesis protein, putative
  Pfam annotation: Domain name=Glycos_transf_1; Domain location=188 -362; Score=68.0; E_value=3e-17; Accession=PF00534.10; Description =Glycosyl transferases group 1
VTIRLKNHFKIIYYPTSPVLVWDKEVVKKKAKELESQGIRIAEEFYKILEEREKISKIKRFLFADKVAKEFTKDYKVDADILYQPDHTSLDIFYLARNTKYGITFHEPPFYNDSLRYLRRLMKFYGVNPYTGKGFHTRFLYNEYVKFLYKRLLKKEVSNKPTFLAGVSEAPLIESGLEGEIIKPGNAFDPFLMKYRNKGKEDYVIFWSRLNQDKGFHELPDILRIMEKKSGNRIRLVVMGKFFDKYSERRFWSKVRKYDLKVEYKGFVKREELAEIVSRAKVLIYPSHVDGFSLVVLESLALGTPVVAYGIPAIKSVYGGLESVSIVKEFDKGSMAQNALRFYKMNASKIEEIMNGNKLMEFLKLHSSWDNVAEAGLKLITNYI

SEQ ID NO: 126797 - protein, 190 aa, Glycine max
  Coding DNA Sequence Number=SeqID_10019
  Gene Ontology: Mol. function=transporter activity; Cellular component= integral to membrane; Biological process=transport
  Homolog annotation: Hit_ID=Q1T1D5; Match level="QueryCoverage=86%, HitCoverage=59%, E-value=1e-58, Identity=70%"; Hit description=Major intrinsic protein
  Pfam annotation: Domain name=MIP; Domain location=1-151; Score=3.4; E_ value=4.7e-10; Accession=PF00230.10; Description=Major intrinsic protein
MVRPREKTGTGQVHVSPWTQDKLPFYVAAQLTGAISASYTLRELLRPSDEIGGTSPAGSHIQALIMEMVSTYTMVFISMAVATDSNATGQLSGVAVGSSVCIASIVAGPISGGSMNPARTLGPAIATSYYKGLWVYFVGPITGAVLAAWSYNVIRDTEHPGFPISLSSISSKVRQSIGGTEQKSDQRCLV

SEQ ID NO: 126798 - protein, 122 aa, Glycine max
  Coding DNA Sequence Number=SeqID_10020
MPPTRHPLDPDKSNRALGFPALITGLCQSLGGDAPQVAEAPPPPHQADPAGSFGMERYLQHLGLTPFACPTPDQFRAEVAWPGDWHEAQAGVAPAEAPDDAEEARMDEEMTDLLGFLGWSGP

SEQ ID NO: 126799 - protein, 124 aa, Glycine max
  Coding DNA Sequence Number=SeqID_10021
MTPDFNQPRGGVLAGGQHTPRAATLLHVCVGETMCDTQGGVPLGLMSSGATCVQRLDGHGILQSHQVSHFATFFIDARAEISVAESHCIFEFLGARSAGVCVCREDEEAGRTGRRGHPLPPDGR

SEQ ID NO: 126800 - protein, 125 aa, Glycine max
  Coding DNA Sequence Number=SeqID_10022
  Gene Ontology: Mol. function=unspecific monooxygenase activity
  Homolog annotation: Hit_ID=O04892; Match level="QueryCoverage=67%, HitCoverage=21%, E-value=7e-16, Identity=51%"; Hit description =Cytochrome P450 like_TBP
GWKSTARRVVSGAPPAALENPEDRVPPTPGRTHNRIRSPRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 126801 - protein, 279 aa, Glycine max
  Coding DNA Sequence Number=SeqID_10023
  Homolog annotation: Hit_ID=Q9AVH2; Match level="QueryCoverage=83%, HitCoverage=100%, E-value=9e-73, Identity=54%"; Hit description =Putative senescence-associated protein
RLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 126802 - protein, 64 aa, Glycine max
  Coding DNA Sequence Number=SeqID_10024
MEKGTSLPMEKGTSLPMEKDGGYLVPGCLPILSLINYMCSSNKHLNVTNTRFLCSLHLSPLPMN

SEQ ID NO: 126803 - protein, 171 aa, Glycine max
  Coding DNA Sequence Number=SeqID_10025
MGRRPLPSSGQMKSAAARQPKGANCANTTREGGYHAATMHTGARFHPCRCKKTSADRAHQHDHSYTDMGHAHKTPSGLGEVQQGPGVSSSSYGPLSVLQGSRIAPAGHPVDPKKSNRVLGLPALITGLCQFYGVPVTPSKVIRPPTNRAFIKKYCAPRQAEGETPQQPGDG

SEQ ID NO: 126804 - protein, 951 aa, Glycine max
  Coding DNA Sequence Number=SeqID_10026
  Gene Ontology: Mol. function=nucleotide binding; Cellular component =chromosome; Biological process=chromosome organization and biogenesis
  Homolog annotation: Hit_ID=Q9SN90; Match level="QueryCoverage=99%, HitCoverage=79%, E-value=0.0, Identity=65%"; Hit description =Chromosome assembly protein homolog
  Pfam annotation: Domain name=DUF869; Domain location=244-747; Score= -341.1; E_value=0.016; Accession=PF05911.2; Description=Plant protein of unknown function (DUF869)
  Pfam annotation: Domain name=KID; Domain location=261-271; Score=2.4; E_value=1.5e+02; Accession=PF02524.5; Description=KID repeat
  Pfam annotation: Domain name=KID; Domain location=316-326; Score=6.3; E_value=22; Accession=PF02524.5; Description=KID repeat
  Pfam annotation: Domain name=KID; Domain location=337-347; Score=2.8; E_value=1.2e+02; Accession=PF02524.5; Description=KID repeat
  Pfam annotation: Domain name=KID; Domain location=351-361; Score=0.1; E_value=4.6e+02; Accession=PF02524.5; Description=KID repeat
  Pfam annotation: Domain name=KID; Domain location=389-399; Score=0.6; E_value=3.6e+02; Accession=PF02524.5; Description=KID repeat
  Pfam annotation: Domain name=KID; Domain location=691-701; Score=3.9; E_value=72; Accession=PF02524.5; Description=KID repeat
  Pfam annotation: Domain name=KID; Domain location=770-780; Score=0.3; E_value=4e+02; Accession=PF02524.5; Description=KID repeat
  Pfam annotation: Domain name=KID; Domain location=87-97; Score=3.5; E_ value=87; Accession=PF02524.5; Description=KID repeat
  Pfam annotation: Domain name=KID; Domain location=917-927; Score=4.8; E_value=45; Accession=PF02524.5; Description=KID repeat
  Pfam annotation: Domain name=SMC_hinge; Domain location=413-534; Score=111.0; E_value=3.4e-30; Accession=PF06470.4; Description=SMC proteins Flexible Hinge Domain
  Pfam module annotation: Pfam domain module=DUF869::KID::KID::KID::KID: :KID::KID::KID::KID::KID::SMC_hinge; Domain location=244-747::261 -271::316-326::337-347::351-361::389-399::691-701::770-780::87 -97::917-927::413-534
MQIVVGGRNKYLINGKLAQPSQVQNLFHSVQLNVNNPHFLIMQGRITKVLNMKPPEILSMLEEAAGTRMYETKKEAALKTLEKKQSKVDEINKLLDQEILPALEKLRKEKTQYMQWANGNAELDRLRRFCIAYEYVQAERIKDNAASEVEEVKAKIAEIDDIAKTNQGEIKEMETKIAQLTAEKEASMGGEMKSLSEKVDALSQNLVRETSVLNNKEDTLRSEEANKANLVKNIEELKHSVEEKSSAVKKAEEGAADLKNKVDELTKSLEEHDKEYQGVLAGKSSGNEEKCLEDQLRDAKVAVGSTETELKQLKAKISHCEKELKEKTNQLRSKREEANAVENELNTRQKDVENVRMELESLSYKEGEMEDLQKERMTEMDCMQKLKDEIRNLSANLANVEFTYRDPSKNFDRSKVKGVVAKLIKVKDRSTMTALEVTAAGKLYNVVVDTENTGKQLLQNGNLRRRVTIIPLNKIQSYNVSSRVQQAAVRLVGKGNAEIALSLVGYEEELQSAMEYVFGSTFVCKTIDAAKEVAFNREIHTTSVTLEGDIFQPSGLLTGGSRKGGGDLLGQLHALSEAESKLSVHQRRLSEIEAKISKLFPLQKKFIDLKAQLELKLYDLSLFQSRAEQNEHHKLGELVKKIEQELNEAKSTVKDKQLLYEDCVKTVSSLEKSIKEHDNNRESRLKGLEKKIKTIKSQMQSSLKDLKGHDSEKERFVMEMEAIIQEQASLENQLASLGTLISNLASEISFCRARLCSQPFEVQVAAARDNLDQVQSQLKSVRLKMKECDKEISAIIKDQQKLEHKISESNLERKRMENEVKRMELEQKDCSVRVDKLIEKHAWIASEKQLFGRSGTDYDFSSRDPTKAREELEKLQAEQSGLEKRVNKKVMAMFEKAEDEYNDLMSKKYIIENDKSKIKKVIEELDEKKKETLNVTWIKVNKAFVIKQSRG

SEQ ID NO: 126805 - protein, 444 aa, Glycine max
  Coding DNA Sequence Number=SeqID_10027
  Gene Ontology: Mol. function=calcium channel activity; Cellular component=membrane; Biological process=calcium ion transport
  Homolog annotation: Hit_ID=Q1RVU7; Match level="QueryCoverage=78%, HitCoverage=82%, E-value=4e-30, Identity=27%"; Hit description=IMP dehydrogenase/GMP reductase
  Pfam annotation: Domain name=Ank; Domain location=114-147; Score =21.0; E_value=0.0042; Accession=PF00023.20; Description=Ankyrin repeat
  Pfam annotation: Domain name=Ank; Domain location=148-184; Score =17.3; E_value=0.056; Accession=PF00023.20; Description=Ankyrin repeat
  Pfam annotation: Domain name=Ank; Domain location=187-222; Score =14.6; E_value=0.24; Accession=PF00023.20; Description=Ankyrin repeat
  Pfam annotation: Domain name=Ank; Domain location=45-77; Score=13.7; E_value=0.33; Accession=PF00023.20; Description=Ankyrin repeat
  Pfam annotation: Domain name=Ank; Domain location=79-112; Score=21.0; E_value=0.0044; Accession=PF00023.20; Description=Ankyrin repeat
  Pfam module annotation: Pfam domain module=Ank::Ank::Ank::Ank::Ank; Domain location=114-147::148-184::187-222::45-77::79-112
MSYADQENGSLSALYEVSLRGNVSELDTLIGRDPLILHKLSLTTFTETPLHISALLGHLDFTKSLLRHKPQLALELDHSKRTPLHLASAQGHVEIVHVLLQTYHEHACLMSDQDGRIPIHYAAMRGRTEIARQLIMAKPESLMVLDGSGKTVLHLCVEHNHLETLKTLVQVRDLSGNDFLNKTDLHHGNTILHFAVTLKQVETIRYLLSIPKIREEASIENKMGCTALDMLVDAVIMNNGMNQTHSLPSLNPNEKYWTKNFKLGKRFLQHQGERLEEMRGMLSVVATMISAMTFNAVMNPPGGVIQANGSDLRSWKNMLSNNVKDAMELHPGRAVFLTTQESDFESFVMFNSISLAASLSITLLLVSGVPLKNEVTMGILSIGTCVTLTFLMLSYFFGGFMLGFKSANHVFHFWIYLWLGLLGLIVVFSMIRVISWLVKVIKHG

SEQ ID NO: 126806 - protein, 105 aa, Glycine max
  Coding DNA Sequence Number=SeqID_10028
MLYLGRKVLNLVLEVLKVANAEWAYKIDRWENPYKAYPYVVARVVRTCDDPISDVQEKQMARRWLRVFQRLHGYGYLDKKTCYLFCFLLASYIVLTGSKSRCLSL

SEQ ID NO: 126807 - protein, 255 aa, Glycine max
  Coding DNA Sequence Number=SeqID_10029
  Homolog annotation: Hit_ID=Q1SYZ2; Match level="QueryCoverage=60%, HitCoverage=37%, E-value=3e-17, Identity=27%"; Hit description =Transposase
MVKSSQILLTIKDQDQRNVTTIEKIYNEQKNIDVNKRVQECRVDTQDVVKDIMWSHPNSIKLLNSFPIRLIFDTTYKMNKYRLLLLEIVGVNSIGMTFFVAFAYLQSERVDNFEWPLSNVKGFFMNDGVMPQLDTQTTHGLPCAYELARYCRIIGSIPLKCIHVHWKMLSISITDDTNFLSLDVGWKITLKKKVREVAFLNTTSMCPSPKKERVDEMNTVVGSLGILSVARRDPGPTTSIEKWMTIPDMGYVIAS

SEQ ID NO: 126808 - protein, 953 aa, Glycine max
  Coding DNA Sequence Number=SeqID_10030
  Gene Ontology: Mol. function=nucleic acid binding; Cellular component= nucleus; Biological process=regulation of transcription, DNA-dependent
  Homolog annotation: Hit_ID=Q6Z0U0; Match level="QueryCoverage=76%, HitCoverage=92%, E-value=0.0, Identity=47%"; Hit description =Putative SNF2 domain/helicase domain-containing protein
  Pfam annotation: Domain name=Helicase_C; Domain location=799-877; Score=63.7; E_value=5.9e-16; Accession=PF00271.21; Description =Helicase conserved C-terminal domain
  Pfam annotation: Domain name=ResIII; Domain location=420-600; Score= -14.4; E_value=0.00075; Accession=PF04851.6; Description=Type III restriction enzyme, res subunit
  Pfam annotation: Domain name=SNF2_N; Domain location=426-746; Score =12.8; E_value=8.3e-09; Accession=PF00176.13; Description=SNF2 family N-terminal domain
  Pfam module annotation: Pfam domain module=Helicase_C::ResIII::SNF2 _N; Domain location=799-877::420-600::426-746
MESSVDALASKRSRSSGFSPDPDRGKRQKLSNVVEHGNPFAVTDVLDRIEHGKYGSVTKDIEALFARRMKVLGPYLAKYPKLNQLIHAVIDRDEEILKSEDQQVTGLTHQNVIDLETPKLEVQQITGLTLQNVIDLEGENTEKDVHAAQIHGLIHIDSDEEDDGDKKSIVPYEASDEEDGRDKKIIVPYEASDEEDGRDKKIIVPYEASDEEDGRDKKIIVPYEASNEEDDRDKKSFVAFHEVVSPRLVAPSPASKTVEYHTPIPYHGETEDLKIETSISGKDNTRGDKGVYIGVQEVEDHQGDTADDDGLEDIWKEMSMAIECSKDTYVNPLPDEEVKEDEDCDHSFILKDDLGYVCRVCGIIDRGIETIFEFQYKAKRSTRTYASDSRNTKGKADAFGINVAEDDLIVTEISAHPRHMKQMKPHQVEGFNFLARNLVGDDPGGCILAHAPGSGKTFMIISFMQSFLGKYPNARPLVVLPKGILSTWKKEFQTWQVEDIPLYDFYTVKADSRSQQLEVLKQWVEHKSILFLGYKQFSSVVCDNGASSESLSCKKILLNVPSILILDEGHNPRNENTDMVQSLVEVHTRLKVVLSGTLYQNHVKEVFNILNLVRPKFLKMETSKPIVRRIRSRVHTPGVRSFYDLVENTLEKDTHFKTKVAVIQDLREMTSKVLHYYKGDFLDELPGLVDFTVVLNLSPRQKPEVEKLKRLSGNFKKSSVGSAVYLHPKLKPLAEKSEKGISDNMIDALIEKLDVRDGVKSKFFLNMLNLCESAGEKLLVFSQYLLPLKYLERLTMKWKGWSLKREIFVISGETSSEDREWSMERFNNSPDSKVFFGSIKACGEGISLVGASRIIILDVHLNPSVTRQAIGRAFRPGQKTKVFVYRLVSADSPEEEDHSTCFKKELISKMWFEWNEYCGDQAFEVEEVGVKECDDLFLESPLLGEDVIKRIRV

SEQ ID NO: 126809 - protein, 1059 aa, Glycine max
  Coding DNA Sequence Number=SeqID_10031
  Gene Ontology: Mol. function=nucleic acid binding; Cellular component= nucleus
  Homolog annotation: Hit_ID=Q10BX7; Match level="QueryCoverage=88%, HitCoverage=96%, E-value=0.0, Identity=44%"; Hit description=RNA recognition motif family protein, expressed
  Pfam annotation: Domain name=RRM_1; Domain location=112-183; Score =89.8; E_value=8.4e-24; Accession=PF00076.12; Description=RNA recognition motif. (a.k.a. RRM, R
  Pfam annotation: Domain name=RRM_1; Domain location=369-440; Score =73.1; E_value=9.1e-19; Accession=PF00076.12; Description=RNA recognition motif. (a.k.a. RRM, R
  Pfam annotation: Domain name=RRM_1; Domain location=602-678; Score =62.0; E_value=2e-15; Accession=PF00076.12; Description=RNA recognition motif. (a.k.a. RRM, R
  Pfam annotation: Domain name=RRM_1; Domain location=754-841; Score =3.9; E_value=0.062; Accession=PF00076.12; Description=RNA recognition motif. (a.k.a. RRM, R
  Pfam module annotation: Pfam domain module=RRM_1::RRM_1::RRM_1::RRM _1; Domain location=112-183::369-440::602-678::754-841
  Subcellular localization annotation: CTP_CleavageSite=20; ConfidenceScore=5.10e-01
MLRVTQQLPPTPSPTSKLTYLNKKTHKREKRKNKKAWRRKTLLTQLKKEEDTRGAQKLNPESRDTPTFSLTPFCPTSTLIVLTEPRVEILVEMGKKNKVKENGGKEHCPSTLFVSNLPYSFSNSQLEETFSQVGPVRRCFMVTQKGSAQHRGFGYVQFAVEEDANRAIELKNGTSVEGRKIVVKHAMPRPPREERQSKPNQAGKTDDLTKPKDDDEDGRSSGSEKNVSVSKEEELQVSKQKSTRKPMEIKKSALCDDVADEGGCSEKQRVARTVIFGGLINSDMAEEVHSKAKEIGTVCSIKYPLSGKDLEQHGLLQDGCTLDASAVLYTSVKSARASVATLHKKEIGGGNVWARQLGGEGSKTQKWKLIIRNLPFKAKDNEIRDMFSSAGYVWDVFIPQKPDTGLSKGFAFVKFTCKQDAEKAIQKLNGSKFAKRLIAVDWAVSKKIFSSDTNNALASEKVNIMIKKSVLSGQKNLSDEDSTDDDFELDDKRSGQGDDSDTDYSSAMEEEGTPEDNFDKEADIAKKVLNNLLTSSSKGTSANNDSMLIKENKESRSDEIVKDADEKNESGKVSGVSKPEISSRNNLSIPKRTEEDDLQGTVFICNLPFECDNEEVKQRFSGFGEVEYFVPVLHQVTKRPRGTGFLKFKTVEAANTAISTASAASGMGILLKGRPLKVLKALDKKSAHDKELEKAKNEVHDHRNLYLAKEGLILEGTTAAEGVSASDMLKRQELEKKKKTKLQSPNFHVSRTRLIIYNLPKSMNEKELKKLCIDAVISRATKQKPVIRQIKFLKNEKKGNVAQERYSRGVAFVEFSEHQHALVALRVLNNNPETFGPEHRPIVEFALDNVQTLKLRKAKLQSQLQAPQDDNNAMDNDKPGTVEGHKPVKNRKRKSQEHDKPAMESALNTNGELGVAVSNGKSPQGHKSKRQKGNNKSKKALKENPEALSMKPKNNENGQSNGGASLEGQNTATYSNRRKSGNREDWGFRKRKIQNQEQEAGQKVSKKRPKKNKDSVGKDVGDKLDMLIEQYRSKFSHKGSQENDGERKPSKQLRKWFQS

SEQ ID NO: 126810 - protein, 104 aa, Glycine max
  Coding DNA Sequence Number=SeqID_10032
MNNESVNLDFNLNVVRETENKNEGPLLNSDANNVQSKSSNSIDLNIVPMSGDGANSQQPINGEGNQSQLSNLNDLPSVEMDFDMSVDKEEDGMPDDTEDASLHG

SEQ ID NO: 126811 - protein, 107 aa, Glycine max
  Coding DNA Sequence Number=SeqID_10033
  Homolog annotation: Hit_ID=Q9SJT1; Match level="QueryCoverage=31%, HitCoverage=4%, E-value=1e-09, Identity=94%"; Hit description =Putative ubiquitin activating enzyme
  Pfam annotation: Domain name=ThiF; Domain location=12-105; Score= -51.0; E_value=0.067; Accession=PF00899.11; Description=ThiF family
MASSPPSSSAIKDAKVLMVGAGGIGCELLKTLALSGFPDIHIGKNFESLGPGVVVFVVRWSVGAYIQLASIAFMLIDVCDDGSRELIIKMADLLNAWAVLYPEQVSC

SEQ ID NO: 126812 - protein, 351 aa, Glycine max
  Coding DNA Sequence Number=SeqID_10034
  Gene Ontology: Mol. function=citrate transporter activity; Cellular component=integral to membrane; Biological process=citrate transport
  Homolog annotation: Hit_ID=Q4IV99; Match level="QueryCoverage=99%, HitCoverage=88%, E-value=1e-133, Identity=66%"; Hit description =Sodium/sulphate symporter
MGQRPLTGVSGRAAVLRGGDGVAAGSRRSDLFRFRVFRILAGAQRFRAGHRHPQHRLGGSPGQPTLAAPGRLLAAPGGRRGGDKLRAGVCHAFQHGAHYAADADRHGVGRSRRSGGGLARPHRFGAGGGVRHLPAFRQHPAGQCAQPGDERRGGKRLRQPLCLSLLPAVARPGARGCQRRAADAVHLRPVPCAAAAGGGRGGANPAQRRRMAADRAVGRHGVAVDDRQLARHRSRLDRVGGGLLVPVAAYRPLGAWRSAGRCAAGDDAGSARQTVHRVRFVGGDHRVAEFRGDSQRRAGAVYPAGAGAVRGQRLAAADGADDPGDRLCHAAAAVSGLADRGGDGDGQSAGA

SEQ ID NO: 126813 - protein, 130 aa, Glycine max
  Coding DNA Sequence Number=SeqID_10035
MTRGNPSDLQPFDPEIDRTFHRLVRHPFIPFDHPEHSITGESVHSVIGDFEHPDLEHYNFEHSDYEHSDSEHSDFAHSENMAQPPLREMVQPSATTTAACSFLPKCCWPKKTIHSSTNPTTATTPETTNS

SEQ ID NO: 126814 - protein, 85 aa, Glycine max
  Coding DNA Sequence Number=SeqID_10036
MVGAGLKKDLRVSRVVPGGSLNAFLFLLIGVISQRLAMESIDSLPIGWTVGAMIYFTGEVSAQLVELRSCNWVVAITGWMSNCPG

SEQ ID NO: 126815 - protein, 433 aa, Glycine max
  Coding DNA Sequence Number=SeqID_10037
  Gene Ontology: Mol. function=nucleic acid binding; Cellular component= nucleus
  Homolog annotation: Hit_ID=Q1SKZ7; Match level="QueryCoverage=61%, HitCoverage=26%, E-value=2e-44, Identity=42%"; Hit description=RNA -binding region RNP-1 (RNA recognition motif); Concanavalin A-like lectin/glucanase; ...
  Homolog annotation: Hit description=U2 auxiliary factor small subunit
  Pfam annotation: Domain name=zf-CCCH; Domain location=225-251; Score =27.7; E_value=4.2e-05; Accession=PF00642.15; Description=Zinc finger C-x8-C-x5-C-x3-H type (and similar)
MEEKDFIEEGKSMSRKEKRKAMKKMKRKQARKEEAERERREEEERLNNPEEQRRMQLLEQQEAERMQRDMILFREREKAWMDTVITQKQQQQQQQQQEDEDDEYEYVEEEGPPEIIWQGNEIIFKKKQLRVRVTDRDKPKPNETNQNDHQIPKHALESNLTSNPLPPESIMYYMHSSDCMCQPFIIDYHHLQQEEDNKPTSNPLPPESLTLENVAQQIPNFGTEQDKAHCPFHLKTGACRFGIRCSRVHFYPDKSSTLLIKNMYSGPGLACDQDQDEGLELSGVIQVLAYGAMLQTNGHDLQRYTDEEVERCFEEFYEDVHTEFLKFGEIVNFKVKLRQFAGGARASVIRCKSPFPAIADFVSVALFSVFCGHSHSYSNYQSVLGLQSLNLSNLKAVILPVSNHTVHRVSWGCVQLGLVQTDWIDYRSVLYFA

SEQ ID NO: 126816 - protein, 334 aa, Glycine max
  Coding DNA Sequence Number=SeqID_10038
  Gene Ontology: Mol. function=nucleic acid binding; Cellular component= nucleus; Biological process=RNA splicing
  Homolog annotation: Hit_ID=Q1SKZ7; Match level="QueryCoverage=94%, HitCoverage=60%, E-value=6e-91, Identity=44%"; Hit description=RNA -binding region RNP-1 (RNA recognition motif); Concanavalin A-like lectin/glucanase; ...
  Homolog annotation: Hit description=U2 auxiliary factor small subunit
  Pfam annotation: Domain name=zf-CCCH; Domain location=54-82; Score =30.8; E_value=4.7e-06; Accession=PF00642.15; Description=Zinc finger C-x8-C-x5-C-x3-H type (and similar)
MAVHVCKNGSFHLRGNVYVQYKSLDSALLAYNTVNGRYFAGKQVSCQFVNLTRWKVAICGEYMKSGFKTCSHGTTCNFIHCFRNPGGDYEWADSDKPPPKFWVKKMIALFGYSDDYETSMEQGNMSLSKTDSDRTCHSRRRSRSREMDQLNCGHSGRRKQRDERKHRTPNEDWNGSFKRKSRGRTPDSGAVSDREWLEKEENRETHHEYTMNSRRHEEDSDVEWVTRDNEKQHGREGRNSRKQNRDEKRHHISKSNYQGGRDASESEKDFLGRGEMETQHDYYSRKSSRYRRSGLDDDDYKYHENENDKVDGGWSRKDSYKREEHHHKKKRSKH

SEQ ID NO: 126817 - protein, 103 aa, Glycine max
  Coding DNA Sequence Number=SeqID_10039
  Gene Ontology: Mol. function=structural constituent of ribosome; Cellular component=large ribosomal subunit; Biological process =translation
  Homolog annotation: Hit_ID=Q9FLF3; Match level="QueryCoverage=81%, HitCoverage=30%, E-value=2e-33, Identity=81%"; Hit description =Genomic DNA, chromosome 5, P1 clone:MUB3
MKIGGSQVLTLAIRMVSRVTVRAKEAVEAAGGSVRRVYYNKLGLKALVKPEWFEKKGRLLPKAARPPPKQKDKVDSIGRLPAPTKPFPFLVEASKDLPVQHLS

SEQ ID NO: 126818 - protein, 90 aa, Glycine max
  Coding DNA Sequence Number=SeqID_10040
  Subcellular localization annotation: CTP_CleavageSite=44; ConfidenceScore=5.20e-01
MALRMATIPMTIISSIRAPCCGAATVRKGGQKRKGARFNPGKGRAENVARYRRSHMMMEAGSQFAASTGGIALTSDFAKTHRQIGAPARA

SEQ ID NO: 126819 - protein, 229 aa, Glycine max
  Coding DNA Sequence Number=SeqID_10041
  Gene Ontology: Mol. function=nucleoside-triphosphatase activity; Cellular component=intracellular; Biological process=transport
  Homolog annotation: Hit_ID=Q6D0J9; Match level="QueryCoverage=97%, HitCoverage=48%, E-value=1e-38, Identity=44%"; Hit description =Protein transport protein
  Pfam annotation: Domain name=GSPII_E; Domain location=78-229; Score= -96.1; E_value=0.00018; Accession=PF00437.11; Description=Type IIIV secretion system protein
MDKPDSTLQALCARYQAVILHHDATQLRVAVADAPDPLLLEALQFASQCAVEVECWPAARLEQLLHQPESRAAPREQASAESAIHALDQILRQAIQRRASDVHFEPQRHGLRVRLRIDGVLHPLPQLPDAPPAAVLARLKILGGLDIAERRLPQDGQFSLEMDDKPAAFRLSTLPVSQGEKAVVRLLQSENSAIALDKLGMPLPQLRLLKNRAGQTAGADSGHRPNRQR

SEQ ID NO: 126820 - protein, 524 aa, Glycine max
  Coding DNA Sequence Number=SeqID_10042
  Gene Ontology: Mol. function=small protein activating enzyme activity; Cellular component=nucleus; Biological process=protein modification process
  Homolog annotation: Hit_ID=Q9SJT1; Match level="QueryCoverage=96%, HitCoverage=71%, E-value=0.0, Identity=75%"; Hit description =Putative ubiquitin activating enzyme
  Pfam annotation: Domain name=ThiF; Domain location=1-116; Score=58.0; E_value=3.2e-14; Accession=PF00899.11; Description=ThiF family
  Pfam annotation: Domain name=UBACT; Domain location=304-374; Score =126.5; E_value=7.2e-35; Accession=PF02134.11; Description=Repeat in ubiquitin-activating (UBA) protein
  Pfam module annotation: Pfam domain module=ThiF::UBACT; Domain location=1-116::304-374
MDTIEVSNLNRQFLFRQFHVGQSKAKVSVFHQSDEVFNQVARDAVLKFRPHINITPYHANVKDPEFNVDFFKQFNVVLNGLDNLDARRHVNRLCLAANVPLVESGTTGFLGQVTVHVKGKTECYECQPKPAPKTYPVCTITSTPSKFVHCIVWAKDLLFAKLFGDKNQDNDLNVRSSDAASSSKNVEDVFERRKDEDIDQYGRKIFDHVFGYNIELALSNEETWKNRNRPKPIYSKDVLSDEPAQQNGNLEKKYESDELPVSAMASLGMKNPQDIWSLKENSRIFLEAFRLFFTKREKEIGNLSFDKDDQLAVEFVTAAANIRAASFGIPLQNLFEAKGIAGNIVHAVATTNAVIAGLIVIEAIKVLNNDIKNYRMTYCLEHPARNMLLMPVEPFEPNKSCYVCSETPLSLEINTNRSKLKDLVEKIVKAKLGMNLPLIMCASNLLYEAGDVEDDMVAIYEANLEKALAELPSPVTGGTMLTVEDMQQEFVCNINIKHRFLLNSIFVFCEKYSLDKKYYYARGT

SEQ ID NO: 126821 - protein, 104 aa, Glycine max
  Coding DNA Sequence Number=SeqID_10043
  Homolog annotation: Hit_ID=Q338P9; Match level="QueryCoverage=62%, HitCoverage=33%, E-value=4e-07, Identity=40%"; Hit description =Expressed protein
MADAILLGRAGEVLTAKRSKTLRDFGEDERAFILEKFRQVTSRWYQATNGGAPNEDERSHMIIVTDACLPLFASGEFPLNTHLLINYELSAKKVFLFSLFLFKF

SEQ ID NO: 126822 - protein, 154 aa, Glycine max
  Coding DNA Sequence Number=SeqID_10044
MLDKQAVVSPAKPADGPDPQVMWDDTVFGVFNEHFPLYIKHEDLSEIAHGGQCLRIPVIQLWILHLTETSMRAGNFDVYGFLEPQSIQRSGQSQFESESYMKSWMQSSKRDVYLGAYLNGAHWQIVVILPKENLVVWFCSLHDRPDNYLKGIIN

SEQ ID NO: 126823 - protein, 319 aa, Glycine max
  Coding DNA Sequence Number=SeqID_10045
  Gene Ontology: Mol. function=protein serine/threonine kinase activity; Cellular component=membrane; Biological process=protein amino acid phosphorylation
  Homolog annotation: Hit_ID=Q9T020; Match level="QueryCoverage=94%, HitCoverage=34%, E-value=1e-127, Identity=75%"; Hit description =Putative receptor-like protein kinase
  Pfam annotation: Domain name=Pkinase; Domain location=1-233; Score =27.8; E_value=3.2e-10; Accession=PF00069.15; Description=Protein kinase domain
  Pfam annotation: Domain name=Pkinase_Tyr; Domain location=1-223; Score=9.2; E_value=4.9e-13; Accession=PF07714.7; Description=Protein tyrosine kinase
  Pfam module annotation: Pfam domain module=Pkinase::Pkinase_Tyr; Domain location=1-233::1-223
MLSKLRHRHLVSLIGYCDENDEMILVYEYMPNGHFRDHLYGKNLPALSWKQRLDICIGSARGLHYLHTGTAQGIIHRDVKTTNILLDENFTAKVSDFGLSKDAPMGQGHVSTAVKGSFGYLDPEYFRRQQLTEKSDVYSFGVVLLEALCARPAINPQLPREQVNLADWAMQWKRKGLLDKIIDPLLVGCINPESMKKFAEAAEKCLADHGVDRPSMGDVLWNLEYALQLQEAFTQGKPEDESKSASAAVPTSPTPPTPSDDRPAAPAVPARPEAANNASSEVNSIDDHSGTAMFAQFSNLNGRVRVIVEASSKKLATDR

SEQ ID NO: 126824 - protein, 337 aa, Glycine max
  Coding DNA Sequence Number=SeqID_10046
  Gene Ontology: Mol. function=oxidoreductase activity; Cellular component=intracellular; Biological process=lignin catabolic process
  Homolog annotation: Hit_ID=Q2LD62; Match level="QueryCoverage=95%, HitCoverage=56%, E-value=1e-125, Identity=65%"; Hit description =Putative copper ion-binding laccase
  Pfam annotation: Domain name=Cu-oxidase; Domain location=1-73; Score=- 16.1; E_value=0.0039; Accession=PF00394.12; Description=Multicopper oxidase
  Pfam annotation: Domain name=Cu-oxidase_2; Domain location=184-322; Score=168.3; E_value=1.9e-47; Accession=PF07731.4; Description =Multicopper oxidase
  Pfam module annotation: Pfam domain module=Cu-oxidase::Cu-oxidase_2; Domain location=1-73::184-322
IANHTFTVVAMDAAYTDHYVTNIIVIAPGQTIDALFTADQPLGSYYMAASPYIVGVPVFDNTTTRGVVVYDNAPPSSSQPLMPTLPPFGDTETAHKFYSNITGKVGAPHWIPVPTTVDEHMFITIGLNLALCDPNNANNATCQGPFGHRFSSSMNNESFVLPIGRGFSMLEAFFKNVSGVYTADFPDNPPVTFDFANPSISFDPNLLFAPKSTKVKKLKFNSTVEVVFQNTAILGVQNHPMHVHGFSFHVLAQGFGNFNSTTDSTKFNLVNPQLRNTIAVPVGGWAVIRFQANNPGVWFVHCHIEDHVPWGLNMAFEVENGPTSSTSLPPPPSDLPK

SEQ ID NO: 126825 - protein, 85 aa, Glycine max
  Coding DNA Sequence Number=SeqID_10047
MAQPAIASGGKGGEKGVLPVAVARYGHPPVGTATHPTWDSPTRLARQPGSRPQDWRDTPTPFQLFLFVLAGQSCILSARAQLGHC

SEQ ID NO: 126826 - protein, 223 aa, Glycine max
  Coding DNA Sequence Number=SeqID_10048
  Gene Ontology: Mol. function=oxidoreductase activity; Cellular component=intracellular; Biological process=lignin catabolic process
  Homolog annotation: Hit_ID=Q2LD62; Match level="QueryCoverage=83%, HitCoverage=31%, E-value=8e-73, Identity=68%"; Hit description =Putative copper ion-binding laccase
  Pfam annotation: Domain name=Cu-oxidase_3; Domain location=35-151; Score=216.4; E_value=6.6e-62; Accession=PF07732.5; Description =Multicopper oxidase
  Subcellular localization annotation: CTP_CleavageSite=36; ConfidenceScore=5.02e-01
MKLFMFLLAWAFALLGSSLASAAIVEYTFKLYKKVVQTTTVNRLCNKRVIVTVNGQFPGPNINVSEGDTVVVHLLNEGPYNITIHWHGVLQLFTAWADGPEYVTQCPISPGNNYTYTFNATRQEGTLWWHAHASVLRATVHGAFIIQPRSGRFPFPKPYKQVPIILGDWYDANNVVDIETQALATGGSPNISSAFTINGLPGDLFSCSQNRMLPPCIYYSMHM

SEQ ID NO: 126827 - protein, 77 aa, Glycine max
  Coding DNA Sequence Number=SeqID_10049
MASSSSSSSHVNIKSGPIDADVLWMQPKHVSEHVWNGEEDRKLHIRRVVPTYQGEEQIPEQIFPFLLQSGFAWIIKM

SEQ ID NO: 126828 - protein, 131 aa, Glycine max
  Coding DNA Sequence Number=SeqID_10050
MTDKIKGYSLDIQLSNIHLSRHLPIQLFFFKSDGPSIYTRSLGHCGLSLQQPVIPPLLGVGSVCCFVKPTPRIALHLETRRLMPSLKSHDSTRRAGGATTQPSKAKELFHHHFGAPHESHASVSQLGNKNS

SEQ ID NO: 126829 - protein, 62 aa, Glycine max
  Coding DNA Sequence Number=SeqID_10051
MNYFYFSHSHNQNWKKGTPRKPLNKEEVRTIHERLLRANTKDYGRYDPSPSLSKPPFKLIPN

SEQ ID NO: 126830 - protein, 168 aa, Glycine max
  Coding DNA Sequence Number=SeqID_10052
MSHHSSSINGSHRSHLRPHSHRREKERKPQEANIYLPYFHGKDNVKANLDWEIRIEQQLKRKSTSKSYGSHSYPKKDQILGILGAAPSKPKDDKGKTIEKQPLKASMQEKTSFIKCFECLGRGQITSQCPTKKMMIMRGQDIYSSQDEATTSPSSSDLLSPKIIRGRQ

SEQ ID NO: 126831 - protein, 204 aa, Glycine max
  Coding DNA Sequence Number=SeqID_10053
  Gene Ontology: Mol. function=nucleic acid binding
  Homolog annotation: Hit_ID=Q9LKA4; Match level="QueryCoverage=63%, HitCoverage=40%, E-value=7e-19, Identity=44%"; Hit description =Similarity to RNA-binding protein
MAHYGYETSLHSRNEDCAHTGDGDQSIKYKETLASTNWLPRAYDQTKEEKCVRSLSAGRSDVPWGVPGSGELRHRHVDVDVLVGLGEVEKRVVKDDKGLLEIAEDGEERVEAISGGVLAKAVEEELALGDIVVRDDAHNNKDVEVAHHRVLKDVEELVRGEALDELAGFEGGELEGVRRVVVENKKASIKGKLKHNIITQYRFL

SEQ ID NO: 126832 - protein, 117 aa, Glycine max
  Coding DNA Sequence Number=SeqID_10054
MEEAEEGGTAEASIDEDYVEDKRKNMKIRGVSENVSLFDRPKKRRRKKLLMNSLSEADWLSEADWLSEPHPLSEADNLLSGWETQEEDKSEICTLSMQPARPAKTLSLFALSAPKLA

SEQ ID NO: 126833 - protein, 39 aa, Glycine max
  Coding DNA Sequence Number=SeqID_10055
MTSKVVISDVTSRHCSYWIETKGSNKNGTTSLSGITGKE

SEQ ID NO: 126834 - protein, 120 aa, Glycine max
  Coding DNA Sequence Number=SeqID_10056
MDIGLTLGTKSIENSISHSGGKSDTSSRKSFWKFSNNREVTHRNIGLYFQFNKKWLEDNHFIPILTSIWLKAPLELVGLGSSSSMDSFASWKMNGSRMEKEEREETPLQGEDESRRGSPL

SEQ ID NO: 126835 - protein, 82 aa, Glycine max
  Coding DNA Sequence Number=SeqID_10057
MDFTKPIDEVKTRSLKNIGLVDIGNDWIYNAPLVDVDEEQATEKVGKVEEKPMTTFEKSMLAKMDELMLSALLQASFMFSFE

SEQ ID NO: 126836 - protein, 58 aa, Glycine max
  Coding DNA Sequence Number=SeqID_10058
MTIDGQHKPSLLAVRPQHREEHFNRRGIFRIHLKDSIYNEAPNTFFGSFYEELMKHWA

SEQ ID NO: 126837 - protein, 90 aa, Glycine max
  Coding DNA Sequence Number=SeqID_10059
MYTSFILRDDADVRKMFNIFYNNPQLPFVELFAIICDNNNPSSNQHDLTSNLEDISDEYETCWVKNHDSDTDSSFGAEGSFPMVSYVGVQ

SEQ ID NO: 126838 - protein, 219 aa, Glycine max
  Coding DNA Sequence Number=SeqID_10060
  Homolog annotation: Hit_ID=Q1S6W0; Match level="QueryCoverage=29%, HitCoverage=14%, E-value=1e-06, Identity=43%"; Hit description =Nucleoside phosphatase GDA1/CD39
MVLNCCLQSLPELQCCSFEEPGHPQSLSETFQNLLRFLDAQPLNLLSGVQPHHGVAPFPPGHPPLGKLDELRNGAAEGVRAGVEAGGGGGGVSGGEEGTGGAEEVEDREAEGVGAGAEGEGEGGGAGVGEFWGGVDLEGGGEEVEEEGGGEEEEGEEKQEASGGVGFVVGIWIWGRRRIERDHARVQLVWCGESAMRMAFRRAERGERSFELEEQVLLD

SEQ ID NO: 126839 - protein, 91 aa, Glycine max
  Coding DNA Sequence Number=SeqID_10061
  Gene Ontology: Mol. function=hydrolase activity
  Homolog annotation: Hit_ID=Q6Z543; Match level="QueryCoverage=83%, HitCoverage=14%, E-value=9e-14, Identity=48%"; Hit description =Putative ectonucleoside triphosphate diphosphohydrolase
MVRLFIVVNWEEQGISSWVAVNYALGNLGREAQETTGIVELGGASLQVTSAKLNADLAQSLRTIRLSGVTYNLYTQSWPQLGQVLFSFSEV

SEQ ID NO: 126840 - protein, 167 aa, Glycine max
  Coding DNA Sequence Number=SeqID_10062
  Homolog annotation: Hit_ID=Q1T344; Match level="QueryCoverage=41%, HitCoverage=25%, E-value=3e-08, Identity=37%"; Hit description=RNA polymerase, RBP11-like
MRYFLALGVLSVKVKGSVFIVAVVCSTSATNEMDEDPWMYGNIMSEEVDMDYQNEEECGVNEPHVDCSDAFNISQVFDSRDNVLQSDTNTGSRGRTSFVLIGCERSGEYRCRKKEFVRRDTGTRKCGCPFKLRGKPMVGGQGWMVKLMCGIHNHELAKSLVGHPYVW

SEQ ID NO: 126841 - protein, 162 aa, Glycine max
  Coding DNA Sequence Number=SeqID_10063
  Gene Ontology: Mol. function=hydrolase activity
  Homolog annotation: Hit_ID=O80612; Match level="QueryCoverage=88%, HitCoverage=26%, E-value=7e-24, Identity=38%"; Hit description =Putative nucleoside triphosphatase
MAPRTSLFQLEAEGRHYCEDHWDALKDLHNEVDYMDLLKYCFSSAYMLALLHDVLGIAMEEKRVGFGNRKINSDVDWTLGSFITETMAEPLELEHLDTGMIVGNESVTYFSLFAFLFLFMLAAFFVLQWRKPQLKTVYDLEKGRYIVTRIPRCGRGKAKEKP

SEQ ID NO: 126842 - protein, 147 aa, Glycine max
  Coding DNA Sequence Number=SeqID_10064
  Gene Ontology: Mol. function=protein binding; Cellular component =integral to membrane; Biological process=defense response to fungus
  Homolog annotation: Hit_ID=Q1SWI6; Match level="QueryCoverage=93%, HitCoverage=61%, E-value=5e-36, Identity=54%"; Hit description =Leucine-rich repeat, plant specific
  Pfam annotation: Domain name=LRRNT_2; Domain location=1-33; Score =20.3; E_value=0.0067; Accession=PF08263.3; Description=Leucine rich repeat N-terminal domain
  Pfam annotation: Domain name=LRR_1; Domain location=113-135; Score =14.9; E_value=0.29; Accession=PF00560.23; Description=Leucine Rich Repeat
  Pfam annotation: Domain name=LRR_1; Domain location=86-111; Score =10.8; E_value=2.7; Accession=PF00560.23; Description=Leucine Rich Repeat
  Pfam module annotation: Pfam domain module=LRRNT_2::LRR_1::LRR_1; Domain location=1-33::113-135::86-111
MKFKNNLNDPSNRLWSWNHNNTNCCHWYGVLCHNLTSHLLQLHLNTSRSAFEYDYYNGFYRRFDEEAYRRWSFGGEISPCLADLKHLNYLDLSGNRFLGEGMSIPSFLGTMTSLTHLNLSHTGFMGKIPPQIGNLSNLVMGIKYVEA

SEQ ID NO: 126843 - protein, 258 aa, Glycine max
  Coding DNA Sequence Number=SeqID_10065
  Gene Ontology: Mol. function=methyltransferase activity; Cellular component=cellulose and pectin-containing cell wall
  Homolog annotation: Hit_ID=Q9SIZ3; Match level="QueryCoverage=98%, HitCoverage=44%, E-value=2e-70, Identity=49%"; Hit description =Expressed protein
  Pfam annotation: Domain name=DUF248; Domain location=1-251; Score= -44.5; E_value=4.3e-23; Accession=PF03141.7; Description=Putative methyltransferase
MVTVTKAMCWTVVAKTLDSSGIGLVIYQKPTSSSCYQERKGNTPPLCENNDRKSISSWYAKFSSCLIPLPADGEGNMQSWSMPWPQRLTSIPPSLSIESDAGEMFLKDSKHWSELVSDIYGDGLSINWSSSNYNGHECWLCRVMNVVPIDMPNTLTTIFDRGLIGMYHDWCESLNTYPWTYDLVHASFIFKHLMQRCDIVDVVVEIDRIMRPDGYLLVQDSMEIIHKLGPVLRSLHWSVTLSQNQFLVGRKSFWHPRP

SEQ ID NO: 126844 - protein, 389 aa, Glycine max
  Coding DNA Sequence Number=SeqID_10066
MVPVGLGAAGSDSAKIKEEFASVIPLLVISIVLDAVQGVMQGVADLNPKREMRGKLKRVMGVPTYAQMIQRPKPIEGKKWLMKRSLEKQERQLRWWSRENSIIVAPAPQDDASIGNGNSGSKEIQQEHFSSEISTYGIKNCNPLVWVKNDNKVGGKVWEIEKKVEQSKLRRSTRRGQARCTNEASLFQWRGYVGLEGLWKDKERDVVIINIYAPNDIEDFNCVKRAYERVGVAGEDENVAERDQFNAFIRDMELEDAPCVGRKFTWYRPNGRARSKLDRMMTTRDWFTMWPGSTQYILDRNIPDHCPIFVKNNCVDWGPKSFKVLDYWFSDKKFSKYVESWKAIRCEGWGACTKRKAKRVEKISKSVELGAFWKLGKKRITYFKPIELD

SEQ ID NO: 126845 - protein, 80 aa, Glycine max
  Coding DNA Sequence Number=SeqID_10067
MFIIKTGIWKPTKCPHCVLQPPHRGSQQNARGIANDGWFLGNHNGDHQCIGSLTVKTAMASYHRLVTACKMQELTTVFKK

SEQ ID NO: 126846 - protein, 275 aa, Glycine max
  Coding DNA Sequence Number=SeqID_10068
  Gene Ontology: Mol. function=heat shock protein binding; Cellular component=integral to membrane; Biological process=protein folding
  Homolog annotation: Hit_ID=Q9T024; Match level="QueryCoverage=90%, HitCoverage=71%, E-value=3e-96, Identity=68%"; Hit description=DnaJ -like protein
MDPTTVFGMIFGSEYFEEYIGKLALASLSSIEIEEDSQDPEVLRQRIQEKMKAWQKEREQKLSTILKDRLQPFVDDREDEFTAWAQSEARSLSKAAFGEAMLHTIGYIYTRKSARELGKDMRYMNVPFLAEWVRDKGHRIKSQVTAASGAVSLIQIQEELKKLNQGENKEESIVKAIEDKKDAMINSLWQINVIDIESTLSRVCQAVLKDPSASKDVLKSRAKALKKLGTIFQGAKSAYNRENSLRKEICHERYSYGLLTQWILNIVSYSAVNRH

SEQ ID NO: 126847 - protein, 102 aa, Glycine max
  Coding DNA Sequence Number=SeqID_10069
MTAEEIFLYKLLKVDNIGTNEARQNEENLASQCKHDTILMRKFEYTADSVVGLPLKSNISHHDLKAQFEFDEDFFTTWMSWPFVMALLAKTALMGLCLCGSS

SEQ ID NO: 126848 - protein, 439 aa, Glycine max
  Coding DNA Sequence Number=SeqID_10070
  Gene Ontology: Mol. function=peptidase activity; Cellular component =endoplasmic reticulum; Biological process=proteolysis
  Homolog annotation: Hit_ID=Q1SAR7; Match level="QueryCoverage=99%, HitCoverage=99%, E-value=1e-126, Identity=52%"; Hit description =Eukaryotic aspartyl protease, putative
  Pfam annotation: Domain name=Asp; Domain location=90-434; Score= -72.9; E_value=2.6e-09; Accession=PF00026.14; Description=Eukaryotic aspartyl protease
MAMITRYCSLALVLLWCLYNISFLKANDGGFSVEMIHRDSSRSPLYRPTETPFQRVANAVRRSINRGNHFKKAFVSTDSAESTVVASQGEYLMRYSVGSPPFQVLGIVDTGSDILWLQCEPCEDCYKQTTPIFDPSKSKTYKTLPCSSNTCESLRNTACSSDNVCEYSIDYGDGSHSDGDLSVETLTLGSTDGSSVHFPKTVIGCGHNNGGTFQEEGSGIVGLGGGPVSLISQLSSSIGGKFSYCLAPIFSESNSSSKLNFGDAAVVSGRGTVSTPLDPLNGQVFYFLTLEAFSVGDNRIEFSGSSSSGSGSGDGNIIIDSGTTLTLLPQEDYLNLESAVSDVIKLERARDPSKLLSLCYKTTSDELDLPVITAHFKGADVELNPISTFVPVEKGVVCFAFISSKIGAIFGNLAQQNLLVGYDLVKKTVSFKPTDCTKG

SEQ ID NO: 126849 - protein, 137 aa, Glycine max
  Coding DNA Sequence Number=SeqID_10071
  Gene Ontology: Mol. function=protein-tyrosine kinase activity; Cellular component=integral to membrane; Biological process=protein amino acid phosphorylation
  Homolog annotation: Hit_ID=Q84U00; Match level="QueryCoverage=77%, HitCoverage=32%, E-value=9e-46, Identity=82%"; Hit description=Ser -thr protein kinase
VPKLKRSELEAACEDFSNVIGTSSIGTVYKGTLSSGVEIAVASVAATSSKDWSKTLEAQFRNKIDTLSKVNHKNFVNLLGHCEEDEPFTRMVVFEYAPNGTLFEHLHSEYLPFRCYYYIGNKSMIEYSVSLFMVINF

SEQ ID NO: 126850 - protein, 449 aa, Glycine max
  Coding DNA Sequence Number=SeqID_10072
  Gene Ontology: Mol. function=peptidase activity; Cellular component =endoplasmic reticulum; Biological process=proteolysis
  Homolog annotation: Hit_ID=Q1SAR7; Match level="QueryCoverage=94%, HitCoverage=95%, E-value=1e-120, Identity=53%"; Hit description =Eukaryotic aspartyl protease, putative
  Pfam annotation: Domain name=Asp; Domain location=96-445; Score= -70.0; E_value=1.8e-09; Accession=PF00026.14; Description=Eukaryotic aspartyl protease
  Subcellular localization annotation: CTP_CleavageSite=80; ConfidenceScore=5.28e-01
MAAMMPRSSSSLALVLLCLYINISFSNSKVLNSGFSVEMIHRDSSRSPLYRHTETPFQRVANAMRRSINRANHFNKKSFVASTNTAESTVKASQGEYLMSYSVGTPPFEILGVVDTGSGITWMQCQRCEDCYEQTTPIFDPSKSKTYKTLPCSSNMCQSVISTPSCSSDKIGCKYTIKYGDGSHSQGDLSVETLTLGSTNGSSVQFPNTVIGCGHNNKGTFQGEGSGVVGLGGGPVSLISQLSSSIGGKFSYCLAPMFSQSNSSSKLNFGDAAVVSGLGAVSTPLVSKTGSEVFYYLTLEAFSVGDKRIEFVGGSSSSGSSNGEGNIIIDSGTTLTLLPQEDYSNLESAVADAIQANRVSDPSNFLSLCYQTTPSGQLDVPVITAHFKGADVELNPISTFVQVAEGVVCFAFHSSEVVSIFGNLAQLNLLVGYDLMEQTVSFKPTDCTQ

SEQ ID NO: 126851 - protein, 87 aa, Glycine max
  Coding DNA Sequence Number=SeqID_10073
MFQAEIARQEARLKMERDNLEKEKSVLMGTASNQDNQDGALEITICQGKKIRLCWGDKKEKYDFDFSPPGLVLSRNHLKCQAQFKYF

SEQ ID NO: 126852 - protein, 703 aa, Glycine max
  Coding DNA Sequence Number=SeqID_10074
  Gene Ontology: Mol. function=binding; Cellular component =intracellular; Biological process=metabolic process
  Homolog annotation: Hit_ID=Q8GVW4; Match level="QueryCoverage=95%, HitCoverage=97%, E-value=0.0, Identity=51%"; Hit description =Selenium-binding protein-like
  Pfam annotation: Domain name=PPR; Domain location=161-195; Score =36.6; E_value=8.5e-08; Accession=PF01535.11; Description=PPR repeat
  Pfam annotation: Domain name=PPR; Domain location=263-297; Score =40.2; E_value=7.2e-09; Accession=PF01535.11; Description=PPR repeat
  Pfam annotation: Domain name=PPR; Domain location=366-400; Score =31.5; E_value=3e-06; Accession=PF01535.11; Description=PPR repeat
  Pfam annotation: Domain name=PPR; Domain location=467-501; Score =38.5; E_value=2.3e-08; Accession=PF01535.11; Description=PPR repeat
  Pfam annotation: Domain name=PPR; Domain location=502-536; Score =14.5; E_value=0.14; Accession=PF01535.11; Description=PPR repeat
  Pfam annotation: Domain name=PPR; Domain location=538-572; Score=0.4; E_value=6.7; Accession=PF01535.11; Description=PPR repeat
  Pfam annotation: Domain name=PPR; Domain location=60-94; Score=24.3; E_value=0.00044; Accession=PF01535.11; Description=PPR repeat
  Pfam annotation: Domain name=PPR; Domain location=604-638; Score=1.0; E_value=5.7; Accession=PF01535.11; Description=PPR repeat
  Pfam annotation: Domain name=PPR; Domain location=95-129; Score=8.2; E_value=0.79; Accession=PF01535.11; Description=PPR repeat
  Pfam module annotation: Pfam domain module=PPR::PPR::PPR::PPR::PPR::PP R::PPR::PPR::PPR; Domain location=161-195::263-297::366-400::467 -501::502-536::538-572::60-94::604-638::95-129
MKRLHSLTLLGLIATHCRAIKLGSIADPYTANNLITSYAKCTELNSAHQVFDEMPHRDTVSWNAIISAFASSGDLDTTWQLLGAMRRSTHAFDSRTFGSILKGVAYVGKLKLGQQLHSVMLKVGLSENVFSGSALLDMYAKCGRVDDGYVVFQSMPERNYVSWNTLVASYSRVGDCDMAFWVLSCMELEGVEIDDGTVSPLLTLLDNAMFYKLTMQLHCKIVKHGLELFNTVCNATITAYSECCSLQDAERVFDGAVLCRDLVTWNSMLGAYLMHEKEDLAFKVFLDMQNFGFEPDAYTYTGIVGACSVQEHKTCGKCLHGLVIKRGLDNSVPVSNALISMYIRFNDRCMEDALRIFFSMDLKDCCTWNSILAGYVQVGLSEDALRLFLQMRCLVIEIDHYTFSAVIRSCSDLATLQLGQQFHVLALKVGFDTNSYVGSSLIFMYSKCGIIEDARKSFEATSKDNAIVWNSIIFGYAQHGQGNIALDLFYMMKERKVKLDHITFVAVLTACSHNGLVEEGCNFIESMESDFGIPPRQEHYACAIDLYGRAGHLKKATALVETMPFEPDAMVLKTLLGACRFCGDIELASQIAKILLELEPEEHCTYVILSEMYGRFKMWGEKASVTRMMRERGVKKVPGWSWIEVKNNVHAFNAEDHSHPQCEEIYILLQQLNEGIKLFDNFVDQMLLQSLDNLDVYDDQKFL

SEQ ID NO: 126853 - protein, 43 aa, Glycine max
  Coding DNA Sequence Number=SeqID_10075
MKYKYLDADDFHSESNKEKMRMGIPLALTDEDRMSGLNHYVIP

SEQ ID NO: 126854 - protein, 161 aa, Glycine max
  Coding DNA Sequence Number=SeqID_10076
MDTRCDMLQSIISSLAYKVASLPTFSTPTTNLDDPPSVNGVSRTSLIFLVAPDDTLHNLTPSPQAHSCHHNTPGFGSNNQFPPPPSDPLDWLFQAKQVFAFYQVPPELCLSMTMFYMRVRFRPLSYENHQAELFKFYQYSTTTEYQHHFENLSNRVFELNA

SEQ ID NO: 126855 - protein, 76 aa, Glycine max
  Coding DNA Sequence Number=SeqID_10077
  Gene Ontology: Mol. function=RNA-directed DNA polymerase activity; Biological process=RNA-dependent DNA replication
MDAQVYMILSNQRVETKVSMGYLYMVREFLEVFLEDISSLPPEREIEFSIDLVPRARHMSIAPYKMSLVELVELKK

SEQ ID NO: 126856 - protein, 145 aa, Glycine max
  Coding DNA Sequence Number=SeqID_10078
  Gene Ontology: Mol. function=GPI anchor binding; Cellular component =membrane; Biological process=cell adhesion
  Homolog annotation: Hit_ID=Q9SNC3; Match level="QueryCoverage=73%, HitCoverage=26%, E-value=1e-14, Identity=44%"; Hit description =Fasciclin-like arabinogalactan protein 4 precursor
SRKSKNTILSLFASLLASATPIAANLSDRSSLSILVVPNAYLVVDDHLSPVTLADVLRYHVLLQFLYWFDLRTLLPSGKLITMLLQPIDRATNNFGSMNLTRDSLFGVILIRSPTLYSPSNTTIISLIKKHDDAAIDHAELSSRR

SEQ ID NO: 126857 - protein, 102 aa, Glycine max
  Coding DNA Sequence Number=SeqID_10079
DVDAILNIPLVFLDSKNNRIWRWSLDGWYSVPSSYHGARDLLDMTYLKGDQSGSQCFARMLQPYGINIGLKEHSNRVTPKAYTPKSPLGPLPPDSGPTQKTF

SEQ ID NO: 126858 - protein, 857 aa, Glycine max
  Coding DNA Sequence Number=SeqID_10080
  Gene Ontology: Mol. function=nucleotidyltransferase activity; Biological process=metabolic process
  Homolog annotation: Hit_ID=Q00XF0; Match level="QueryCoverage=74%, HitCoverage=94%, E-value=1e-151, Identity=44%"; Hit description =Homology to unknown gene
  Subcellular localization annotation: CTP_CleavageSite=40; ConfidenceScore=5.86e-01
MLHSTSLLPHNNRFVFSFRSKPSFFHSHSLSFSKFLSLPSSSQSSCCHVSRISTETLEVSPPPPPDFNFRREIARLADLRDRLSACSTLNEKLRVIDADSRVKRFFRSRRGLAGVLASLQLSSDQLFLLKCVVAAGQEHVLCLGETESLESSVATSAVKSALYTLADMIENMDSFNGNGGAGFGMALGDHEIAELNNLLEILAEIERFYDCIGGIVGYQITVLELLVQKLFEMQNISWAHQRHDVKECQILGINAPNGLNLSEDTEYASQAALWGIEGLPDLGEIYPLGGSADRLGLVDPNTGECLPAAMLPYCGRTLLEGLIRDLQAREFLYFKLYGKQCITPVAIMTSSAKNNHKHVTSLCERLSWFGRGRSTFQFFEQPLVPVVGAEEGQWLVTKPFSPLSKPGGHGVIWKLAHDKGIFTWFYCQGRKGATVRQVSNVVAATDLTLLALAGIGLRQGKKLGFASCKRILGATEGVNVLMEKKSLDGNWEYGVSCIEYTEFDKFGITTGPLAPKGLQTEFPANTNILYIDLPSAELVGSSKSETSLPGMVLNTRKPIVYTDQFGRRHSVSGGRLECTMQNIADNYSNSYSSRCYNDVEDKLDTYIVYNERRRVTSSAKKKRRHGDKSLHQTPDGALLDILRNAHDLLSQCDIRLPEIEANENYVDSGPPFLILLHPALGPLWEVTKQKFYGGSISEGSELQIEVAEFFWRNVQLNGSLIIISENVMGSMKINENGESILHYGQRCGRCKLQNVKVLNKGIDWTCGENIYWKHDVQRSEVLQIILHGNAEFEATDVVLQGNHVFEVPDGYKLKITPGSPGLAIKLDPIDQDMMESGSWHWDYKIEGSHIQLELVES

SEQ ID NO: 126859 - protein, 92 aa, Glycine max
  Coding DNA Sequence Number=SeqID_10081
MLSIILNFIQEEEEEILHIYWKCFGRNDSTVDVVYAVARKRNTRQESGRFCGYAIRVTLLGYCIGHPTNCRYSPYKMDNSNIIGFPLRIDNP

SEQ ID NO: 126860 - protein, 199 aa, Glycine max
  Coding DNA Sequence Number=SeqID_10082
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=94%, HitCoverage=18%, E-value=2e-41, Identity=38%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MEECNLAKSPVEFELKLSVGLDEKPMDATLFKQMVGSLRYLCHSRLDIAYGVGLGTLDYGLLFSKANHNQGIRLIGFFDAYWSGDVEDSKITTGYVFKLLGSTICWSSKKHEDIQLDSVVQLNMDNKSAICLANNPIAHGRTKHIGTKYHYLRDQMTKGRISLAYCKSKEQEANILTKALHGEKFYKFREKLDIVNCLN

SEQ ID NO: 126861 - protein, 303 aa, Glycine max
  Coding DNA Sequence Number=SeqID_10083
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=30%, E-value=1e-75, Identity=41%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MIRSMLKLKGLSKELWEEVVTTTAYILNRSPTKKLEVIIPEEAWTGKKPRVSHFRIFGSPCWKHVPDEKRKKLDDKSTEMIMVGYHPIGAYKLYDPIEKKVTYSRDVIFYGESLYDWNKTKKVQSKGIVSKPSTRLSDFEVYTDEAITSEGELVHFALLADAKPLGYVEALKEEVWKKAMLEELATIERNDTWKLVRLPKGKKPISLKWVFKVKRKPDGTIAKHKARLVLDVKSAFLNGLLEEEAYVTQPHEFENKEGRDLVEYGVYVKEENGDIIILCLYVDDLLITSSNEVVIQTVKKQLQ

SEQ ID NO: 126862 - protein, 83 aa, Glycine max
  Coding DNA Sequence Number=SeqID_10084
MPSSSTMPLSPEPPFLCANEAVIAGLLDAESHHMPEKDYLRHCRDSSVDITTCLAAFAPGLFVVKVYWLRVIYENVTLSIILH

SEQ ID NO: 126863 - protein, 116 aa, Glycine max
  Coding DNA Sequence Number=SeqID_10085
MKLLLSAYEKWDTLYICTGFNEESPYPVVVLQTVMNLIWQKQNWMTVFASLLFQLFPSNIDEIGVCSLQERCVPVSSSLRFFIVIHLFICSPEHKFKIITGSKHNNTQGVSYHIPS

SEQ ID NO: 126864 - protein, 342 aa, Glycine max
  Coding DNA Sequence Number=SeqID_10086
  Gene Ontology: Mol. function=calcium-dependent phospholipid binding; Cellular component=plasma membrane; Biological process=cell differentiation
  Homolog annotation: Hit_ID=Q1RUA5; Match level="QueryCoverage=80%, HitCoverage=99%, E-value=4e-99, Identity=66%"; Hit description =Annexin, type V
  Pfam annotation: Domain name=Annexin; Domain location=112-177; Score =20.1; E_value=0.00059; Accession=PF00191.10; Description=Annexin
  Pfam annotation: Domain name=Annexin; Domain location=15-80; Score =81.2; E_value=3.2e-21; Accession=PF00191.10; Description=Annexin
  Pfam annotation: Domain name=Annexin; Domain location=195-259; Score =49.8; E_value=9e-12; Accession=PF00191.10; Description=Annexin
  Pfam annotation: Domain name=Annexin; Domain location=269-334; Score =82.6; E_value=1.2e-21; Accession=PF00191.10; Description=Annexin
  Pfam module annotation: Pfam domain module=Annexin::Annexin::Annexin:: Annexin; Domain location=112-177::15-80::195-259::269-334
MASLKLPEVVPSPTQDSERLRKAFQGYGTDEKAVILVLGHRNAQQRKEIRETYQQLYNESLIDRLNSELSGDFRIASKVFKLVLPNWLTTLNLLMKNAVILWSYDPPERHAGLAKDALKAKKKGTKHLQVLVEIACASTPNHLVAVRQAYCSLFDCSLEEDIIASVAPPLRKLLVSLVSSFRYDKVAVNLEVAKEEASKLHEAINCKQLEDDHIIWILSTRNFFQLRETFACYNNLYGNTLEQDIKCGNGDLESLLHMVIWCIDCPEKHFAKVVRDSIVGFGTDEDSLNRAIVTRAEIDLLKVRFEYANVYKTSLDDDVIGDTSGNYRDFLMTLLGKGSEGE

SEQ ID NO: 126865 - protein, 157 aa, Glycine max
  Coding DNA Sequence Number=SeqID_10087
  Gene Ontology: Mol. function=calcium-dependent phospholipid binding
  Homolog annotation: Hit_ID=Q1SAR1; Match level="QueryCoverage=89%, HitCoverage=42%, E-value=4e-32, Identity=59%"; Hit description =Annexin, putative
  Pfam annotation: Domain name=Annexin; Domain location=87-152; Score =65.2; E_value=2.1e-16; Accession=PF00191.10; Description=Annexin
MGVMRSMQDWQNLKLIFFMRPSKTKKGHHEEVIGGSLVQEARPNLWQLSTASKMKITFLSKLLEETSDDFYKAVNVAIHCINDHKKYYEKVLRNAIKGVGNNEDGQTRVFVTRAEKDLKDIKELYYKKNSVHLEDTMAKENSGYYKKFLLTLLGKGG

SEQ ID NO: 126866 - protein, 102 aa, Glycine max
  Coding DNA Sequence Number=SeqID_10088
  Subcellular localization annotation: CTP_CleavageSite=39; ConfidenceScore=5.19e-01
MLGILQKKTFFQWQKSVGNAKNPSLHGNFRRIFAGHESVGKMVVGNINRQIFWYFSVSNQNSHHKSAFVGHLSACHLLGPTAGLAGGAAGPDVAGEVVVVDE

SEQ ID NO: 126867 - protein, 105 aa, Glycine max
  Coding DNA Sequence Number=SeqID_10089
MAFGTMAAHTSELMLHPEVTGSPSSYMLSPLELPYATASLFFFACLVSLCVDENSFNAFSSLFFIAIVWFEIKKVWVCDIAEIGSDFVQSGAKSSLSFPTCWCSD

SEQ ID NO: 126868 - protein, 142 aa, Glycine max
  Coding DNA Sequence Number=SeqID_10090
MVGASDARQGKARRVCAELNSSGNWLDLTVHTRKEQRHVRTHVRTEFGAWGPKQDHPEPQDLLTMGRTQPIQSRHGKGEVGEEEEEEARGCGEEDEEAAAAGFGRRPNEPGPALHQDGGAHLAIEVATQCVASPFQDFQRQI

SEQ ID NO: 126869 - protein, 48 aa, Glycine max
  Coding DNA Sequence Number=SeqID_10091
MELYMQHLADQQAANHRGQVKAGPIEAPREEDKAEEDKDMIDVMDFFL

SEQ ID NO: 126870 - protein, 78 aa, Glycine max
  Coding DNA Sequence Number=SeqID_10092
MSMNLGSIMEREEKRFVYCIRCSSDENMKENEKRRILGFMGLDLDKKWARYGRNMNWERGFARGLKGCSFLILKSEFI

SEQ ID NO: 126871 - protein, 196 aa, Glycine max
  Coding DNA Sequence Number=SeqID_10093
MAGNEKDNGCGGGSDGEGLSLGNFSQGACTTFLGHTDRFELEYGSHCGNGSCNPVGGNGELPNFMLFHATRCVERQKVQILVGFPDSGYQDAVFPFHPNTTLVSEGMWDEKENRLCAVACRILNFTESLVNPYVGDCKTRLSLRFPAVLSLRNRSTVLGQIWSDKVVGESGYFSKVGFQGSSRVSKSLQRFPIQVC

SEQ ID NO: 126872 - protein, 195 aa, Glycine max
  Coding DNA Sequence Number=SeqID_10094
  Gene Ontology: Mol. function=chitin binding; Cellular component =extracellular region; Biological process=chitin metabolic process
  Homolog annotation: Hit_ID=UPI00006A17C9; Match level="QueryCoverage =77%, HitCoverage=100%, E-value=2e-11, Identity=28%"; Hit description= UPI00006A17C9 related cluster
RELHVLTFTGLHVLAFRRLHVFTFRGLHALAFRGLHALAFRGVHVLTFRGLHVITFRGLHVLAFRGLHVLAFRGLDASPSEDYMSSPLEGCMPSPSMGDTSSTSEDCMPSPFKGFLGSPLDPGGGPTVRAQPEEEAITQLLCILGQDFTRAVAKRDRAHKTPSEPEEVQQGPGVLARITGLCRFYGVITTPISPC

SEQ ID NO: 126873 - protein, 206 aa, Glycine max
  Coding DNA Sequence Number=SeqID_10095
MAYTPGEDVNNSAPILIESRQPQTDHAHVSQPMGEAHEIPYLMRLSVQTQHLLILTHGSGGRRTYPAVVCTNTTSVDSNPRVAGGHTQRFSVQTQHLLILTHGSGGKQTYPAIVRTNTTSVDPDPWVKWQVDIPNGCPYKHNFATPTYEKSGSMQRHPRVIRMHIHATPTCEKSGSIQRYLLVIRTLAFIFPWLSKFFLSSRDKPV

SEQ ID NO: 126874 - protein, 93 aa, Glycine max
  Coding DNA Sequence Number=SeqID_10096
MVLIVTIAAALISIISFMLIMASIIVAICSFNASLSALICSCTSSTSPITLALACIWLIRQVCEVLILIKPIYRLSEPSAEHTTLAAEHEEES

SEQ ID NO: 126875 - protein, 104 aa, Glycine max
  Coding DNA Sequence Number=SeqID_10097
  Homolog annotation: Hit_ID=Q1SN45; Match level="QueryCoverage=99%, HitCoverage=6%, E-value=2e-10, Identity=34%"; Hit description=AAA ATPase
MNKPEQVWEKTWHWLSDDIVYSHCRSLNTPGLHIDDSNLMNLVLLEVEQLLQANQRSLKDYPSMSYPENANLLTHADNDLILSELNFNNEELRSEFLNLFSQMT

SEQ ID NO: 126876 - protein, 188 aa, Glycine max
  Coding DNA Sequence Number=SeqID_10098
  Gene Ontology: Cellular component=integral to membrane; Biological process=peroxisome organization and biogenesis
  Homolog annotation: Hit_ID=Q8L431; Match level="QueryCoverage=98%, HitCoverage=42%, E-value=1e-54, Identity=57%"; Hit description =Proline transport protein-like
MRKALYLQYTVGVLFYYGVTVIGYWAYGTMVSAYLPENLSGPKWINVLINAIVFLQSIVSQHMFVAPIHEALDTKFLEIDKPMHSGENLKRLFLLRAFFFTGNTFVAAAFPFMSDFVNFLGSFSLVPLTFMFPSMVFIKVKGRTARIEKKAWHWFNIVFSFLLTIATTISAVRLIVNNIQKYHFFADA

SEQ ID NO: 126877 - protein, 315 aa, Glycine max
  Coding DNA Sequence Number=SeqID_10099
  Homolog annotation: Hit_ID=Q1SP03; Match level="QueryCoverage=79%, HitCoverage=50%, E-value=4e-09, Identity=23%"; Hit description=IMP dehydrogenase/GMP reductase
AIDAFLAYHHSKESPVVAILADLFDTFDRRCEKNSARIVCYLPALCVWLVSHLFQQDIRHPCPFQSYRSCVEKRRVDWDQYLAGIGGSTINWFPRWKEGKEGVLFSCGDYPNIPLIGTRGYPMRGAPTEESLSLFLVRDFGVQSFKIVQRVHKAWESPLRKDKELRGIRNGIIGGYHEWLRVHTRGLDWPSKLKIINEENFESPKEDEEVQALKSELGKARLAKEKFKLVATDIQKECAELREENAATARALEQETKRARKEEHGRDKIRGALWGSNNELKLRREERGPVTSTWHGLKGGVKLLAQDPRGVWSNT

SEQ ID NO: 126878 - protein, 258 aa, Glycine max
  Coding DNA Sequence Number=SeqID_10100
  Homolog annotation: Hit_ID=Q8UDA9; Match level="QueryCoverage=41%, HitCoverage=34%, E-value=2e-50, Identity=98%"; Hit description =Ribose-phosphate pyrophosphokinase
MGGGRLCRRGNHPHVRSSHRGRRAFPQRCGDVHPVFGPDDTVSVPGAGDKPPPSPLQRCCHLGRYDQPLAQWPPRHTYPRSGLVAENQGCSHPSPTAPGHGCGVVLVGSSRCSIAGVGASGKTVPTYPRGCPYCPRALILSTWLAPRHKAEDHAGNRLFLRGPVDCFAEQAGGAHHADIMRGLDTGGRLDAVGDDEFAQLGRGHAGHRAAGQYAMGDIGSNAGRALFQQGFSGVAERAAGIDDVVNEDAVLAGDIADD

SEQ ID NO: 126879 - protein, 75 aa, Glycine max
  Coding DNA Sequence Number=SeqID_10101
MAGRGCCHWQLRDRNPVTAHTAIRTGGIGMSRREEHVTIGAGGIGESTAIGAGGTCQHGQSHHWHLCYMFDGTDE

SEQ ID NO: 126880 - protein, 95 aa, Glycine max
  Coding DNA Sequence Number=SeqID_10102
  Gene Ontology: Mol. function=binding; Cellular component=outer membrane-bounded periplasmic space; Biological process=cell adhesion
  Homolog annotation: Hit_ID=Q2NWL3; Match level="QueryCoverage=97%, HitCoverage=32%, E-value=3e-35, Identity=77%"; Hit description=Metal ion ABC transporter periplasmic component
RYGVTFLAPVGFSTEAEASASDVAAIIKQLRAEHITTYFMENQTDPRLVKQIASETGAQPGGELYPEALSAASGPAPTYEAAFKHNVETLLHSMK

SEQ ID NO: 126881 - protein, 353 aa, Glycine max
  Coding DNA Sequence Number=SeqID_10103
  Gene Ontology: Mol. function=pepsin A activity; Biological process =proteolysis
  Homolog annotation: Hit_ID=Q9FSZ9; Match level="QueryCoverage=98%, HitCoverage=99%, E-value=2e-62, Identity=38%"; Hit description =Putative extracellular dermal glycoprotein
MNLAIDLSGNYLWYECDSHYNSSSYNPVTCVSPHCPQGSPCLGCDGSPRKPGCTNDTCGFDVVNPFSDSTFIGDMGHDFLFLPQIKLPQTFVYGCAETSRFSSIPILSGLAKGIKGILGLARTPHTLPFQISSSFNVPPKFTLCLPSSGKGKLFIGGRPSSSIISLSQTGFGGFSSTEYFIHVNSITINDKPVKFGASFLFRDENGNGGSVISTMSPYTVLHHSIYKPFVRDFVEAATAKNIKRVKSVHPFGECFDANTIKDGKAVPDIKLAMDGRFRKVSYGICAHNSLVEVRKGVLCLAFVDGGEFAVTGVVLDGHQLRDRVLEFDLSTSVLSFSSSLLLQNKTCSDHSSL

SEQ ID NO: 126882 - protein, 682 aa, Glycine max
  Coding DNA Sequence Number=SeqID_10104
  Gene Ontology: Mol. function=pepsin A activity; Biological process =proteolysis
  Homolog annotation: Hit_ID=Q9FSZ9; Match level="QueryCoverage=90%, HitCoverage=97%, E-value=5e-51, Identity=34%"; Hit description =Putative extracellular dermal glycoprotein
MATPTCVLYFCVLVFFVSPSLSASNEFPKTGYISLPINIDPTTHQHFTSIGIGTPRHNMNLAIDISGSYLWYDCGGNYNSSSYNPVLWDSPQCPGPEPFQSNCDAGFPFKPGCTNNTCNVALDNPFADFGFGGDLGHDFLFTPQIKLPQTFFSVCSESSRFPQLPILVGLPKGTKGSLGLARQSPFTLQSQISSSFNNVPPKFTLCLPSSGKKGHLFIGGRPTFSTPLSQIGFDSRYSNYDYFFHLNSIHINHKPVQFNTSGLSVDLNDNVGTKISTLHPFTVLHPQVYQPFVKAFVKAAKTKNMKRVKKVHPFGTCYDATTVGDHREAVPAIDLVLEAEELGRFGKVSYEIYGHDSLVEVKKGVLCLAFVNGGIRALDAVLLGAHQLKDRILVFDESMSGFNYNWQFRNNWTLVVPTIQIVLQEGVQCTSHGVNSLVMAKENCGSHYNSSSYNPVPWDSPQCPHPEAYLSNCDSGLPFTAHISSSFNVPPKFTLCLPSSGKKGHHLFIGGGPTLISTSLSQTGFGDGNFSNYEYAFHLNSININHKPVKFNTSDIRFLDGNGNAGAIISTIQPYTVLHRSVYQPFVKVFVKAEKAKNMKRVKKVHPFGTCYDANTIADVPAINLVLESRIGKGNYDISGHDSLVEVRKGVMCLAFADGAKQAFCGVLLGGHNSRIESWSLI

SEQ ID NO: 126883 - protein, 183 aa, Glycine max
  Coding DNA Sequence Number=SeqID_10105
  Gene Ontology: Mol. function=transcription regulator activity; Cellular component=nucleus; Biological process=regulation of transcription
  Homolog annotation: Hit_ID=Q9M8K6; Match level="QueryCoverage=85%, HitCoverage=82%, E-value=2e-44, Identity=59%"; Hit description =Putative helix-loop-helix DNA-binding protein
MFGNNFIVWLQHATKLMSDEDLGKGDQASIIGGVIEFIKELHQVLQALESQKRRKSLSPSPGPSPRTLQPMFHQLDSPSMIGTNSFKELGASCNSPVADVEVKISGSYVILKVICHRIPGQVAKIITVLESLSFEVLHLNISSMEETVLYQFVVKIELGCQLSLEELAMEVQQSFCLDAIIAL

SEQ ID NO: 126884 - protein, 153 aa, Glycine max
  Coding DNA Sequence Number=SeqID_10106
MPPTRHPLDPDKSNRALGVPVTPSKVIRPPITRAFIEKYCTPRQTQGDAPQAAHAPPPPHQADPAGSLGVERYLQHLIHECLYQLSLSQQGQGSAPFTCPTPDQFRAEVAWPEDWPKAQEEEAPAGAPSDAEEARMDEEMIDLLDFLGGSGGT

SEQ ID NO: 126885 - protein, 79 aa, Glycine max
  Coding DNA Sequence Number=SeqID_10107
MENENPQLYTVFPFCFILGLVVSLEKKYRLSNQSICFFGKCHVIFSWMKDASDFVKFYCSHEKKNGEVVNMIKKSKAKG

SEQ ID NO: 126886 - protein, 393 aa, Glycine max
  Coding DNA Sequence Number=SeqID_10108
  Homolog annotation: Hit_ID=O82271; Match level="QueryCoverage=99%, HitCoverage=100%, E-value=7e-17, Identity=24%"; Hit description =Expressed protein
MDVKGITWVGNIFQTFEDIYVDVEDTMLEETVKYIGNQMQTVGESVKKIYSDVMQDLLPPSSYDLDETSAPELPIDQYADAGFSKKSFQGSKKITVKDDTNQMTEDSRINHDVDNDVIHAEFCDSDALFISASCNSVKRNNFIAHARQYVGSTHIKSNLGGDENQQNKNMPASKTVSEITLLKTDTCSISQSCEVSRVNQNHASTVSKAASSEVTTIASVADCCNEIENASTEEIPDVLVLAESAEEKEMHIISYSSSVLLGDPYGVTMVRTFEPDNYSYHSIIASHPEQGHKTMHQDDELKLEETCVMVARDELQSVPNARGNLITSKNKKRQPFSLSKKATRRQEYEELAILHRNNEKEKGDFAENLCSTLQDDHKKLLLPDIYEPEWELL

SEQ ID NO: 126887 - protein, 80 aa, Glycine max
  Coding DNA Sequence Number=SeqID_10109
  Gene Ontology: Cellular component=membrane; Biological process =endocytosis
  Homolog annotation: Hit_ID=UPI0000D571F2; Match level="QueryCoverage =78%, HitCoverage=28%, E-value=4e-10, Identity=46%"; Hit description =PREDICTED: similar to CG9132-PB, isoform B
  Pfam annotation: Domain name=DUF1681; Domain location=1-80; Score= -53.1; E_value=1.2e-06; Accession=PF07933.4; Description=Protein of unknown function (DUF1681)
ADEWDVNKWAWEGILKVTSKGEECIIKLEDKSTGELYARAFLRNGEPHPVEPVIDSSRWFSLAVNSLSCLLSYLFSVQDA

SEQ ID NO: 126888 - protein, 528 aa, Glycine max
  Coding DNA Sequence Number=SeqID_10110
  Gene Ontology: Mol. function=RNA-directed DNA polymerase activity; Cellular component=chromatin; Biological process=chromatin assembly or disassembly
  Pfam annotation: Domain name=Chromo; Domain location=438-488; Score =20.4; E_value=0.0038; Accession=PF00385.14; Description='chromo' (CHRromatin Organisation MOdifier
  Pfam annotation: Domain name=rve; Domain location=136-292; Score =124.0; E_value=4.1e-34; Accession=PF00665.16; Description=Integrase core domain
  Pfam annotation: Domain name=zf-H2C2; Domain location=77-118; Score =7.1; E_value=0.041; Accession=PF09337.1; Description=His(2)-Cys(2) zinc finger
  Pfam module annotation: Pfam domain module=Chromo::rve::zf-H2C2; Domain location=438-488::136-292::77-118
PTEATCLTLTAPHFLFLQKLRQALLLDPQYVALLQDIRDHPTNHPDITTHQDLLFRHGRVWIPFATPFTRVLLEEFHSSPLGGHTGVTKTLHRLRQNFDWPHLKDDVRRYVAQCATCQQTKYDTKKSAGLLQPLPIPSQVWEDLSLDFVTGLPLSQGYTVILVVVDRFSKAAHFGALPTHHTAYKVAVLFLDMVCRHHGFPRSLVSDRDPIFISNFWRELFRLSGTKLRMSTAYHPQTDGQTEVLNRTLEQYLRAYVHDQPSRWYRFLSLAEWSYNTTLHSSTGMTPFEAVYGIPPPTVAHYLQGHSSNDAVDSLLTTRVQIHAQLTHRLQWAQELMKTAADRHRRDLSFEVGDWVYVRLRPYRQTSIAPKYSKLAKRFYGPFQISARIGPVAYKLALPASSRIHPVFHVSLLKLHQGPSPASPGTLPELSTDNHPILNPFAILDWKLDSSVTPPVKRVLVQWDDLPPEEASWESWDELKVLHNLADKVVFDKGGVDSNTATADQHQHMDTSRPKRECKKPAYLRDFI

SEQ ID NO: 126889 - protein, 658 aa, Glycine max
  Coding DNA Sequence Number=SeqID_10111
  Homolog annotation: Hit_ID=Q39846; Match level="QueryCoverage=99%, HitCoverage=100%, E-value=0.0, Identity=83%"; Hit description=LEA protein
  Pfam annotation: Domain name=LEA_4; Domain location=251-294; Score =5.3; E_value=0.25; Accession=PF02987.7; Description=Late embryogenesis abundant protein
  Pfam annotation: Domain name=LEA_4; Domain location=306-349; Score =13.1; E_value=0.044; Accession=PF02987.7; Description=Late embryogenesis abundant protein
  Pfam module annotation: Pfam domain module=LEA_4::LEA_4; Domain location=251-294::306-349
MASEQLARRENTTTEKEIHVEKHRVPKMATHFEHLAEQAKESDITAGKDTPQGSIEALQAGERVKDHAGKAMGDIGGRGKARETHELGAHFESLADKVTDHAAANVVGNKESQREARGGVRDVGKFEMRTEGGEKGNKDRPELKTRTREVIGRTEKERGRESGGQVVAEKGRETETARGRVGAENEGARTTAVITCTLEKGGGTQKPIREEERESESERSAWEQISNYSDQATQGVKEKYERAKQAASETLNTTTQTAQEKSAQAKNLAAQAKDATLEKGQQGYAVTKDTISSAAKTASEKTAPVAEKAKDYTLQAAEKAKSAGGTTASYVGEKAVQAKDVAVESGKSAAGYAAKVAADLRDKATAVGWAAAHFSAEKTVEGTKAAAHVVEGAAGYAGHKAAELASMSAGAVKGLAASAGETAKEYTAKKKEEAQRELEAKKPSQPQNQSFMHDSKSQHFDEEAEERPSEGIGETVRQYAQKPKPSERNPQKEGTGSIVFTAIGETVSSAGEKVKKPFKNTMGGESEGGGGKEEGKSVIGKSLTSIGEKLGDAKQREELLDNVTGNITEGGGEVLGAVGETVAEIGQNMMKPAEIVQERAHVRQAGGVLDAIGETIAEIAETTRVMVSGEDERVLRQSVVLETRVTGRAKHEEGSHGA

SEQ ID NO: 126890 - protein, 209 aa, Glycine max
  Coding DNA Sequence Number=SeqID_10112
  Gene Ontology: Mol. function=transition metal ion binding
  Homolog annotation: Hit_ID=Q013M5; Match level="QueryCoverage=69%, HitCoverage=33%, E-value=7e-17, Identity=46%"; Hit description =Homology to unknown gene
MVICQPTIGYGGNVKNHQTMLGCTFGCDPTSPVGGASFMEAGGLDAGPRLVKKLVGFGDNRTSKIAARIADEEVAHVAVGVYWFDSICEKLNCAPDFTFKGCEVWHAIFNIIFCNHADLLKEYNVELKGPFNYSARDKSGIPGDWYDDASSASTKDKKDKDGNQKQLSARLSVMLKLNEVNNSCLASWISCHGIRSLYFFIRKVVFDKE

SEQ ID NO: 126891 - protein, 548 aa, Glycine max
  Coding DNA Sequence Number=SeqID_10113
  Gene Ontology: Mol. function=hydrolase activity; Cellular component =integral to membrane; Biological process=aromatic compound metabolic process
  Homolog annotation: Hit_ID=Q5ZDY7; Match level="QueryCoverage=99%, HitCoverage=99%, E-value=1e-150, Identity=49%"; Hit description =Conserved transmembrane protein-like
  Pfam annotation: Domain name=Ferric_reduct; Domain location=163-295; Score=-19.5; E_value=0.026; Accession=PF01794.9; Description=Ferric reductase like transmembrane component
MEERENKEIKIARFSSCRGVAFEINPNRSNPFAIGSPPKQERIGTWLWLPWTRNSSFKVLPQPHTISPTRSRASSHFCDIDIDASDFEVEFIAEVQDIEKPDKANVVKVQKLLPKSDPPRRSRLSIILLDQGFTCYKGLFLVCMALNVVALALSAAGCFPYAKTRAALFSIGNILALTLCRSEAALRVIFWLTVQTLGRPCVSLRIKTATTSFLQSVGGIHSGCGVSSIAWLAYSLVLTLKNKDKTSPEIIGVAFTILSLILLSSFAAFPLIRHLHHNVFERIHRFAGWMALILLWLFILLSISYEPYSHTYDLTMSKVVKKQECWFTLAITILIIIPWLSVRKVQVNVSSASSHASIIKFEGGVEAGLLGRISPSPLSEWHAFGIISDGKKEHMMLAGAVGDFTKSLVSTPPKHLWVRTMHFAGLPYLVNLYQRVLLVATGSGICVFLSFLLQPSKADVCLIWVAKDIELNFGREIIELMNKYSKEKVIVHDTAISGRPNVAEMSVNAAIKWNVEVVIVTSNPEGSRDVLRACKRANIPAFGPIWDS

SEQ ID NO: 126892 - protein, 85 aa, Glycine max
  Coding DNA Sequence Number=SeqID_10114
GDAPQAVDAPPPPLQADPAGSFGMEWYLQHLVRQQAANHRGQVQIHECLYQLSLNQQSMDFVPFACPTPDHSTAEVAWPGDWLEA

SEQ ID NO: 126893 - protein, 395 aa, Glycine max
  Coding DNA Sequence Number=SeqID_10115
  Homolog annotation: Hit_ID=Q9FSZ9; Match level="QueryCoverage=40%, HitCoverage=71%, E-value=1e-13, Identity=43%"; Hit description =Putative extracellular dermal glycoprotein
  Subcellular localization annotation: CTP_CleavageSite=71; ConfidenceScore=5.02e-01
MLQPYEISIGLKEHSNPVTPKAYTPKSPSGPLPPDSVSGIRSGCTNAHKFTSINLVGGLPKGSKGMLGLARSELAVPTQLALLKKLPQGHEHPRDVSKHVKTTPLVVNHFDTGPLFEEVTPFEACFDSRSIGNSITGFVVPTIDLVRATRGSAMAKKNVACPAFVDRGTMATMSFFKASIVIGAHQLEENLLVFDVASSKLSFSSSLSLHNVIVTQQQQTNINIWIQAGLRESVRSQLTCGISFRRLAALTVSTGPTCLPSSAMPEHHTRQVTTDKLEEAVKTLSQDNSSLNNKIDTIHASLTAKIDALFDRFAAIAVNSPQPPPPTPVHSSSSSHRHHTKLEVPRFDGHDPLGAFQRTNGSPSHPSTWKDPRYPGISGCVATGSFRPGQRCYRP

SEQ ID NO: 126894 - protein, 59 aa, Glycine max
  Coding DNA Sequence Number=SeqID_10116
MVGAFSQNIVTLTGLPMILLSESDLTNPLCARNVITHSLCVVVFGSCDDLELVFGGADE

SEQ ID NO: 126895 - protein, 353 aa, Glycine max
  Coding DNA Sequence Number=SeqID_10117
  Gene Ontology: Mol. function=RNA-directed DNA polymerase activity; Cellular component=chromatin; Biological process=chromatin assembly or disassembly
MGLPPSCLLSCFVSGLIPELLWEVQALRPLSLPHATELARLQEDKLLDRRRGQRSSSTTLPPKTGHPQPSNSTKVPIKRLTSEELAVRREQGLCYHCEEKWSHGHRCRPRLHLFIADDDLEPPADFNTSDIPNPITADLEITPQISLNAMEGTPAPQTFRLLGQLRRHQVIILIDGGSTHNFIQSRLARFLALSTTPTTTLRVMVGNGNTLECNTQSLQGVQWLKQLGPITTDYQHLTMTFSHLGRNITLYADAPPSLSPASAHQLKRLAQTQSISALYHISALPIDTPSSTCTAKLPVPEPLPPQIVSILERFPAIFTEPSTLPPSHNIQHHIHLLPHTAPINVRPYRYPHF

SEQ ID NO: 126896 - protein, 81 aa, Glycine max
  Coding DNA Sequence Number=SeqID_10118
MTINSWGSGLDGGGRTNNSRQAIHGAPNSMAINSWGSRLDGRGCMNGIQFMGLWIRFDGGGCTNSTRQSIRGAPDSMVEDA

SEQ ID NO: 126897 - protein, 90 aa, Glycine max
  Coding DNA Sequence Number=SeqID_10119
MATRVSILIALIILSTFFMTLQASNLHGHPFIRENNIADSHHFLHKYLDDLSKHIHVQDADDAPHKDGNTHRLAPEGPDPHHNFATPPRN

SEQ ID NO: 126898 - protein, 115 aa, Glycine max
  Coding DNA Sequence Number=SeqID_10120
MKSKSKKHKLEKRNKQRWPRERNLSVRGRKDYDEQKKNLLVNGGDSSGCQECDLLMILLLMIFVATYPLVGAQKGLSDGPRVRIPSKENEWSHHQCLFKENVGKTKLEKVEGLRI

SEQ ID NO: 126899 - protein, 158 aa, Glycine max
  Coding DNA Sequence Number=SeqID_10121
ERNNGEDVVILGRVKLHADVVRDVAAVAGDGEGELHGEECQGRESEGLVAAEDAEERRGSSNVNINRVRLVFENTLNHVQCQSFVANPYLLEPKCKVTRWQCPEGVISLCSEGSGQGNVPERITEEKLKISQLMSDDRGGPVIGDKGSGALMMDEANY

SEQ ID NO: 126900 - protein, 123 aa, Glycine max
  Coding DNA Sequence Number=SeqID_10122
MPTPRDLISNYCLLRKGEEANSLSKPVRLRSSNPLSQTQSRVDSLAENSRTEPRRGNGPKPGSDMKMNAIRSGIVVLGALAFGYLSIEIGFKPYLEKAQNQNALYQSDPSQEESSSAFSERPS

SEQ ID NO: 126901 - protein, 50 aa, Glycine max
  Coding DNA Sequence Number=SeqID_10123
MGETELKTLLSLNLSQAYENKCLKWKMQLNYLKRNGEIASTIKSKIINIL

SEQ ID NO: 126902 - protein, 124 aa, Glycine max
  Coding DNA Sequence Number=SeqID_10124
MNLQCCRLVAIVLQLSRGLSFLAFLVLLIHLPRGQAFVDKDNIEMGKLSEDAVHVKHTTCKDHKRILLSQRFKPCFQKLVGLLTWIQLEEIILGHPNILHCWNFQGSTSIIDRCLRSQKIAHID

SEQ ID NO: 126903 - protein, 373 aa, Glycine max
  Coding DNA Sequence Number=SeqID_10125
  Gene Ontology: Mol. function=oxidoreductase activity; Cellular component=endoplasmic reticulum; Biological process=metabolic process
  Homolog annotation: Hit_ID=Q1S9D2; Match level="QueryCoverage=79%, HitCoverage=77%, E-value=1e-106, Identity=71%"; Hit description =Short-chain dehydrogenase/reductase SDR
  Pfam annotation: Domain name=Epimerase; Domain location=40-306; Score= -51.1; E_value=0.0082; Accession=PF01370.11; Description=NAD dependent epimerasedehydratase family
  Pfam annotation: Domain name=KR; Domain location=40-209; Score=-18.6; E_value=2.9e-06; Accession=PF08659.1; Description=KR domain
  Pfam annotation: Domain name=adh_short; Domain location=38-205; Score= 116.3; E_value=8.8e-32; Accession=PF00106.15; Description=short chain dehydrogenase
  Pfam module annotation: Pfam domain module=Epimerase::KR::adh_short; Domain location=40-306::40-209::38-205
MGDANFAFFLLFLLPAFLLALLYFLVRPRPVKIPIKNRHVFITGGSSGIGLALAHRAAAEGARVSILARSPEKLEEARNAIRLATGIEVAAFAADVRDFDAVKRAVDDAGPIDVLLLNHGVFVALELEKMELSDVKFTMDVNLMGTLNLIKAALPAMKNRNDPLPASIALVSSQAGQVGIYGYVAYSASKFGLRGLAEALQQEVIADNIHVSLIFPPDTDTPGLAEENKRKPELTKIIAASSGSMKADEVAQKALDGIKCGNFIVSCNFEGIALSLATAGLSPQRSFLMAFLEVVAAGILRIVALGMQWTWYGSIEKYHSQRKADMGNGVRLWQSILLAWTTEVAKLTHFSLGKVKIKSHDGVGHMKLVDLVT

SEQ ID NO: 126904 - protein, 402 aa, Glycine max
  Coding DNA Sequence Number=SeqID_10126
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q2RAK5; Match level="QueryCoverage=82%, HitCoverage=74%, E-value=1e-117, Identity=56%"; Hit description =Expressed protein
  Pfam annotation: Domain name=DUF231; Domain location=256-392; Score =68.6; E_value=2e-17; Accession=PF03005.6; Description=Arabidopsis proteins of unknown function
SPQQYVEAMPVLETLRRVKRLSELAGKFGFSGQSERFTWSHEKRGSVEKRVHRVEFLGEKGGGGGGCDLFEGNWVWDESYPLYQSKDCSFLDGGFRCSENGRPDLFYTKWRWQPKACNLPSRSKPKIELLNKHRFNATIMLETLRNKRLVFAGDSIGRNQWESLLCMLSSGVPNKESIYEVNGSPITKHKGFLVFRFKDYNCTVEYYRAPFLVLQSRPPPRTDRKIRTTLKLDQMDWYSLKWRDADVLVLNTGHWWNYEKTIRGGCYFQEGAEVKLEMMVEEAYKRGGDWRKGGNCNLETLPELGSSLVPNDNWSQFKIANSVLLAHTNTSEVLKFKILNVTQMTSQRKDGHSSIYYLGPNAGPAPPHRQDCSHWCLPGVPDTWNELLYALLLKHETSHTWN

SEQ ID NO: 126905 - protein, 66 aa, Glycine max
  Coding DNA Sequence Number=SeqID_10127
MEVSRGRRHLWERCPVKTQEIAPHSKLNLSKWKVVLCPLLKWSYDCIDLRGLKSLFGDILAYLTRV

SEQ ID NO: 126906 - protein, 176 aa, Glycine max
  Coding DNA Sequence Number=SeqID_10128
  Gene Ontology: Mol. function=oxidoreductase activity; Cellular component=mitochondrion
  Homolog annotation: Hit_ID=Q6KBB1; Match level="QueryCoverage=95%, HitCoverage=68%, E-value=3e-24, Identity=42%"; Hit description =Mitochondrial peroxiredoxin
  Subcellular localization annotation: CTP_CleavageSite=79; ConfidenceScore=5.39e-01
MTPGLVKRLTKSLSATLGFRSSSSVAKVTTGTDLLSIAHNVSLQKALTWDEGVASMPFSFSNHFYPFGSVTITNVLSPRCFSTRKWSYLESRYFHTPQSYHDHNAVISAAFFCNCFQWVCSEEHVPTYMDNIDKFKAKGIHAVIRVSINDPFTMNEWAEKLQGKDAVSFIHVFLPY

SEQ ID NO: 126907 - protein, 50 aa, Glycine max
  Coding DNA Sequence Number=SeqID_10129
MVLIVTIVVGGGGDVNGGVTMTIVVVLCGANKGGNNDSAISIDDVVTVTN

SEQ ID NO: 126908 - protein, 199 aa, Glycine max
  Coding DNA Sequence Number=SeqID_10130
  Gene Ontology: Mol. function=phosphoenolpyruvate carboxylase activity; Biological process=carbon utilization by fixation of carbon dioxide
  Homolog annotation: Hit_ID=Q6Q2Z8; Match level="QueryCoverage=94%, HitCoverage=19%, E-value=1e-99, Identity=99%"; Hit description =Phosphoenolpyruvate carboxylase
MAARNIEKMASIDAQLRLLAPRKVSDDDKLVEYDALLLDRFLDILQDLHGEDIRQTVQDCYELSAEYEGEHKPDKLEELGNMLTGLDAGDSIVIAKSFSHMLNLANLAEEVQIAYRRRIKLLKKGDFADENSAITESDIEETFKKLVAQLKKTPQEIFDALKNQTVDLVLTAHPTQSVRRSLLQKHGRYICYIIFSCFN

SEQ ID NO: 126909 - protein, 133 aa, Glycine max
  Coding DNA Sequence Number=SeqID_10131
  Gene Ontology: Mol. function=metal ion binding; Biological process =metal ion transport
  Homolog annotation: Hit_ID=Q5Z6Y0; Match level="QueryCoverage=99%, HitCoverage=95%, E-value=3e-18, Identity=34%"; Hit description =Copper-binding protein-like
  Pfam annotation: Domain name=HMA; Domain location=1-56; Score=46.3; E_ value=1e-10; Accession=PF00403.16; Description=Heavy-metal-associated domain
MDCPGCENKVKSALQKLKGVDDIEIDMSLQKVTVNGYADQKKVLKTVRKTGRRAELWQLPYTTDSQNQYVQQHHCNGPVNYYASQPSSSYNYYKHGYDSSDPRYYNYPSESSIFGHQTGATFSDDNPDACAIM

SEQ ID NO: 126910 - protein, 321 aa, Glycine max
  Coding DNA Sequence Number=SeqID_10132
  Gene Ontology: Mol. function=protein domain specific binding; Cellular component=germline ring canal; Biological process =intracellular signaling cascade
  Homolog annotation: Hit_ID=Q96299; Match level="QueryCoverage=81%, HitCoverage=100%, E-value=1e-113, Identity=79%"; Hit description=14 -3-3-like protein GF14 mu
  Pfam annotation: Domain name=14-3-3; Domain location=7-242; Score =509.9; E_value=2.9e-150; Accession=PF00244.10; Description=14-3-3 protein
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAAAGESTVFYYKMKGDYYRYLAEFKSGNEKKEAADQSMKAYESATAAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEDAEVSNPFYTCTLSPMDDGIFHRIRCMRLGMKHEGRLLICVLARDRDSIVSSLFPVGLPNTSR

SEQ ID NO: 126911 - protein, 315 aa, Glycine max
  Coding DNA Sequence Number=SeqID_10133
  Gene Ontology: Mol. function=metal ion binding
  Homolog annotation: Hit_ID=O23280; Match level="QueryCoverage=83%, HitCoverage=77%, E-value=1e-36, Identity=36%"; Hit description=RING -H2 finger protein RHF1a
MFLLQFQVTCCKHEYHLPCIIEWSKRSKECPICWQSLALKDPDCQELLAAVEAQKRMILRNLANSRAPLGQLNDGHDFCSDDPDYDQIMRRLDSAVKRVRYVPGQERKRSPGAGTSKVLGNSSMHVSGLQTTLTTSPSGGSSPASGVPSTVSIQPPALNTNPDSARRPNTSDMFSFPKSFKSKFSSASARYKESISKGTRDLKEKLLAHNVSVKELSKGVQREMNAGIAGVVRMIERLDLSSKRSSSPLIAVHSGATSDFPSSRKPVEENGIGGSPSKESGGAVHDVSSDVLPLVTNMQSFQTETPPFVQVTPNL

SEQ ID NO: 126912 - protein, 259 aa, Glycine max
  Coding DNA Sequence Number=SeqID_10134
  Gene Ontology: Mol. function=riboflavin kinase activity; Cellular component=cellular_component; Biological process=riboflavin biosynthetic process
  Homolog annotation: Hit_ID=Q109K4; Match level="QueryCoverage=90%, HitCoverage=59%, E-value=5e-62, Identity=51%"; Hit description=HAD -superfamily hydrolase, subfamily IA, variant 3 containing protein, expressed
  Pfam annotation: Domain name=Hydrolase; Domain location=16-202; Score= 111.9; E_value=1.9e-30; Accession=PF00702.16; Description=haloacid dehalogenase-like hydrolase
MSCCCESKGCNEGAKVLAVIFDLDGTLLNTERATRGVLNEFLARYGKELDREKEEKKRLGMTQKDSAAIIVNDYELPLTPDQFIKEITPLYRERWAKAKALPGANRLVKHLQKNGVPMGLASNSLREYVDAKISHHKGWKESFSVILGSDQVKSGKPSPYLFEEAAKKIGVDAINCLVIEDSLVGVKAANAAKMKIVAVPSRREADCHGLANVVLHSLLEFQPELWGLPPFDDWLDNTLPIDPIHLSGLYVSGCLEEAT

SEQ ID NO: 126913 - protein, 74 aa, Glycine max
  Coding DNA Sequence Number=SeqID_10135
MVVINGDYLWLILQHVYLIDANSDLKHKQKMQIHLVGYIRAWDNKEFTSTELEKLEEYKSIARASLYLPSFTCL

SEQ ID NO: 126914 - protein, 136 aa, Glycine max
  Coding DNA Sequence Number=SeqID_10136
  Gene Ontology: Mol. function=protein binding
  Homolog annotation: Hit_ID=Q2QNJ0; Match level="QueryCoverage=81%, HitCoverage=55%, E-value=1e-21, Identity=43%"; Hit description =Expressed protein
  Pfam annotation: Domain name=DUF538; Domain location=1-136; Score =122.8; E_value=9.8e-34; Accession=PF04398.3; Description=Protein of unknown function, DUF538
MAEKEGGVVKKGHEEGLKLAASLLQEFELPEGLLPLADVIEVGYVKGTGYMWIVQKKKVEHEFKLISKLVSYDTEIKGYISKKKIKKLKGVKAKELMLWPPVSEITVDDPPTGKINFKSLAGITKTFPVEAFAAGQ

SEQ ID NO: 126915 - protein, 584 aa, Glycine max
  Coding DNA Sequence Number=SeqID_10137
  Gene Ontology: Mol. function=binding; Cellular component=thylakoid; Biological process=photosynthesis
  Homolog annotation: Hit_ID=Q9SIN1; Match level="QueryCoverage=95%, HitCoverage=83%, E-value=1e-177, Identity=55%"; Hit description =Expressed protein
  Pfam annotation: Domain name=TPR_1; Domain location=112-145; Score =19.2; E_value=0.014; Accession=PF00515.18; Description =Tetratricopeptide repeat
  Pfam annotation: Domain name=TPR_1; Domain location=146-179; Score =20.4; E_value=0.0064; Accession=PF00515.18; Description =Tetratricopeptide repeat
  Pfam annotation: Domain name=TPR_1; Domain location=350-383; Score =4.0; E_value=1.8; Accession=PF00515.18; Description=Tetratricopeptide repeat
  Pfam annotation: Domain name=TPR_1; Domain location=384-417; Score =29.4; E_value=1.2e-05; Accession=PF00515.18; Description =Tetratricopeptide repeat
  Pfam annotation: Domain name=TPR_1; Domain location=418-451; Score =8.8; E_value=0.48; Accession=PF00515.18; Description=Tetratricopeptid e repeat
  Pfam annotation: Domain name=TPR_2; Domain location=112-145; Score =23.0; E_value=0.0011; Accession=PF07719.7; Description =Tetratricopeptide repeat
  Pfam annotation: Domain name=TPR_2; Domain location=146-179; Score =23.0; E_value=0.0011; Accession=PF07719.7; Description =Tetratricopeptide repeat
  Pfam annotation: Domain name=TPR_2; Domain location=304-337; Score =11.4; E_value=1.6; Accession=PF07719.7; Description=Tetratricopeptide repeat
  Pfam annotation: Domain name=TPR_2; Domain location=350-383; Score =13.3; E_value=0.88; Accession=PF07719.7; Description=Tetratricopeptid e repeat
  Pfam annotation: Domain name=TPR_2; Domain location=384-417; Score =18.1; E_value=0.033; Accession=PF07719.7; Description=Tetratricopepti de repeat
  Pfam annotation: Domain name=TPR_2; Domain location=418-451; Score =12.4; E_value=1.2; Accession=PF07719.7; Description=Tetratricopeptide repeat
  Pfam annotation: Domain name=TPR_4; Domain location=146-171; Score =15.3; E_value=0.23; Accession=PF07721.5; Description=Tetratricopeptid e repeat
  Pfam annotation: Domain name=TPR_4; Domain location=304-329; Score =7.0; E_value=5.5; Accession=PF07721.5; Description=Tetratricopeptide repeat
  Pfam annotation: Domain name=Thioredoxin; Domain location=481-581; Score=13.6; E_value=1.3e-05; Accession=PF00085.10; Description =Thioredoxin
  Pfam module annotation: Pfam domain module=TPR_1::TPR_1::TPR_1::TPR _1::TPR_1::TPR_2::TPR_2::TPR_2::TPR_2::TPR_2::TPR_2::TPR_4::TPR _4::Thioredoxin; Domain location=112-145::146-179::350-383::384 -417::418-451::112-145::...
  Pfam module annotation: Domain location=146-179::304-337::350 -383::384-417::418-451::146-171::304-329::481-581
MSNTLQQQSPESKRLDLGSNARRPCHRRSVSAGAPLIYSGGATLLPSGNICPSGKILKPGLPSRGPNRTDVLGSGTVNYGRGSIVRGGSGNIPVPAAAPPLTVKRAMSGSDPEEVKRAGNELYRGGNFVEALAMYDRAVAISPGNAACRSNRAAALTALGRLAEAARECLEAVKLNPAYARAHKRLASLYLRFGQVENSRRHLCLSGNQEDQSEEQKLVLLEKHLNRCADARKFGDWKRVLRESEAAIAVGADFSPQIVACKVEAYLKLHQLEDADSSLLNVPKLEGCPPACSQTKFFGMVGEAYVPFVCAQVEMALGRFENAVAAAEKASMLDYGNVEVGRIVNVVKMVARARSRGNELFSSGMFSEACSAYGEGLKYDNSNHVLYCNRAICWSKLGLWEQSVQDCSQALNIQPNYTKALFRRAASNTKLERWSEVVKDYQALKRELPNDNEVAESLRQAQLALEKSRQMVYGTRFGVEVEQICSLDKFKAALASAGISVVYFKEASNELCEELSPFINTLCVRYPSVKFIKVDVEECLAIAKAESIRSVPTFKIYKNGEKVKDMIRPTHQLLEDSVRKSSSL

SEQ ID NO: 126916 - protein, 55 aa, Glycine max
  Coding DNA Sequence Number=SeqID_10138
MENEENEPHIQKSGGESEDAEPIELVLFQVPECYVYIIPPRMTAASYRFAINSTL

SEQ ID NO: 126917 - protein, 247 aa, Glycine max
  Coding DNA Sequence Number=SeqID_10139
  Gene Ontology: Mol. function=transcription regulator activity; Cellular component=nucleus; Biological process=regulation of transcription
  Homolog annotation: Hit_ID=Q1SVR0; Match level="QueryCoverage=87%, HitCoverage=85%, E-value=6e-80, Identity=71%"; Hit description=Helix- loop-helix DNA-binding
  Pfam annotation: Domain name=HLH; Domain location=59-108; Score=54.8; E_value=2.9e-13; Accession=PF00010.16; Description=Helix-loop-helix DNA-binding domain
MEAFAPHRISDGFPVCCGVIGSGYGSSSSLVLDKEKGELVEAPVKLERKGVSPERSIEALKNHSEAERRRRARINAHLDTLRSVIPGAKKLDKATLLGEVIRHLKELKTNATQASEGLMIPKDSDEIRVEEQEGGLNGFPYSIKASLCCEYKPGLLTDIRQALDALHLMIIRAEIATLGGRMNSVFVIISCKEQNIEDPEYRQFLAGSVHQALRSVLDRFSVSQDMLESRKRRRISIFSSSSIGDFF

SEQ ID NO: 126918 - protein, 174 aa, Glycine max
  Coding DNA Sequence Number=SeqID_10140
  Homolog annotation: Hit_ID=Q9FT44; Match level="QueryCoverage=80%, HitCoverage=6%, E-value=5e-27, Identity=39%"; Hit description=VPS13 -like protein
  Subcellular localization annotation: CTP_CleavageSite=44; ConfidenceScore=5.31e-01
MAHVPTVDQRVGILTKAFTPSNFTTYRSKLRVVGLTGLLQFPVTGAERHGLPGVLSGVALGITGLVAKPAASILEVTGKTALIGTSVLVEADDGLKFKDEKLVACKALKEAGKPEFRGIPVDLEWIIEWEIGLENIILADCSEGVVHIVGSRPDSLLRQNQHSPKGGSSGRTRS

SEQ ID NO: 126919 - protein, 137 aa, Glycine max
  Coding DNA Sequence Number=SeqID_10141
MEEKGRMARDGSVGFALSAPLDFFVDLLLAKLELAAKWGNTRGLSCALSELSQSSIIKLLLGMRFHTLGTNSTNEASSSSISPEPTTSSPLPTSTDNLTSPKLKESSNPVISAPASLFLCHPLQNLLLYRSDLISVT

SEQ ID NO: 126920 - protein, 80 aa, Glycine max
  Coding DNA Sequence Number=SeqID_10142
  Homolog annotation: Hit_ID=Q6EPN8; Match level="QueryCoverage=46%, HitCoverage=8%, E-value=5e-08, Identity=71%"; Hit description =Putative Ste24p
MSPAVREDSFQLLTGALAEEIKARYDKAAVKVVDLILTLLQFGGYTLVQNSVDLYRSFGFDTQPVLIGLNIFQASSALDI

SEQ ID NO: 126921 - protein, 63 aa, Glycine max
  Coding DNA Sequence Number=SeqID_10143
MECENKAREDGNTKGCSGGGGGEPPTFLKGNRCIGAFSLNSPHVGYCYIFKDTHLGLLVMSLF

SEQ ID NO: 126922 - protein, 482 aa, Glycine max
  Coding DNA Sequence Number=SeqID_10144
  Homolog annotation: Hit_ID=O23305; Match level="QueryCoverage=97%, HitCoverage=98%, E-value=7e-25, Identity=25%"; Hit description=FHA domain-containing protein At4g14490
  Pfam annotation: Domain name=FHA; Domain location=33-100; Score=52.6; E_value=1.4e-12; Accession=PF00498.16; Description=FHA domain
MEEQEEEAPTLRLEILQGPRGGETLEFKPGAAVRIGRVVKGNTLPIKDLGISSKHLTISTESNKWTLRDLDSSNGTVLDGSQIPPHTPFTLQHDSIIKIGELTSIHVIFAPREQQQQQELAVLPRRNPTRRGRTEPAPTESVPPRGRGRPRGLKSKVQIQIQSVEENDASVEDAESERVGPPSRVTRKTNRGRSVVKEDWSVVVENLDAPEGKTQSVEEKNASVVEAEGEGVGPPARVTRKVNRGRSVVRVCDDDDVPVEKVEEPKSTRNLSLIVISDSSVGNSDAPLVEEPKKTRMMRNSKKVPGVTTGNVEKKTKRGVAEKRELEEEGEDLNGVKETCDGRKEGNLPNLKRRRRGATEKRELEKEGEDGNVVKEACDGREEGNLNGDDRNWHDLKGRERELEKEGVDGNSVKEACHENWPDLNKMTLGEWFDFLEVYMPKQIIDETEEMIDLMTQKAERLREYIVEMQQQNGKAKMPMEE

SEQ ID NO: 126923 - protein, 197 aa, Glycine max
  Coding DNA Sequence Number=SeqID_10145
  Gene Ontology: Mol. function=threonine-tRNA ligase activity; Cellular component=soluble fraction; Biological process=tRNA aminoacylation for protein translation
  Homolog annotation: Hit_ID=Q1B9T4; Match level="QueryCoverage=99%, HitCoverage=28%, E-value=6e-98, Identity=86%"; Hit description =Threonyl-tRNA synthetase
  Pfam annotation: Domain name=tRNA-synt_2b; Domain location=1-132; Score=79.2; E_value=1.2e-20; Accession=PF00587.15; Description=tRNA synthetase class II core domain (G, H, P, S and T)
MHIDAELNEDGTVRKPGQNYYLKPMNCPMHHLIYRARGRSYRELPLRLFEFGSVYRYEKSGVVHGLTRVRGMTQDDAHIYTTREQMHEELTSLLRFVLDLLSDYGLDDFYLELSTKDEAKFVGSDEVWEEATKTLEQVALDSGLQLVPDPGGAAFYGPKISVQAKDALGRSWQMSTIQLDFNMPERFNLEYTAADGT

SEQ ID NO: 126924 - protein, 266 aa, Glycine max
  Coding DNA Sequence Number=SeqID_10146
  Gene Ontology: Mol. function=cellulose synthase (UDP-forming) activity; Cellular component=membrane; Biological process=cellulose biosynthetic process
  Homolog annotation: Hit_ID=Q3Y6V1; Match level="QueryCoverage=97%, HitCoverage=41%, E-value=3e-47, Identity=40%"; Hit description =Cellulose synthase-like protein CslG
METLPLNTIHVQNLLVIINRLHMLLHSTALAFLFYYRLCFLFQPSETIESHSLPWLLVFASEIILSFIWILDQAYRWHPVLRSIFQEILLEDHKLPSIDVFICTADPTKEPTLDVMNTVLSAMALDYPPQKLHMYVSDEGGSPLTLHGVREASKFARSSVYMEDKQKIKEKYEAFKEEIKTFRKDRTFSRDHPSVNEVMQETIIDDADNVKMPLLVCVSREKKPSDPHHFKAGAFNVLLRASSVMSNSPYILVLDCDMFCNDPTSA

SEQ ID NO: 126925 - protein, 64 aa, Glycine max
  Coding DNA Sequence Number=SeqID_10147
MDGLMGPVISGTDLLQLKEYFGSSNEFIRSLAQNCTSDLVSGQKYALLEEPHFLASCNYEIGTK

SEQ ID NO: 126926 - protein, 59 aa, Glycine max
  Coding DNA Sequence Number=SeqID_10148
  Gene Ontology: Mol. function=ATP-dependent helicase activity
  Homolog annotation: Hit_ID=Q6ZFX9; Match level="QueryCoverage=71%, HitCoverage=10%, E-value=1e-11, Identity=74%"; Hit description=ATP -dependent DNA helicase RECG-like
MEDAITDDSSKSDAYMAPHVLAMSATPIPRTLALALYGDMTMTQRCGNELWKKFCSGKQ

SEQ ID NO: 126927 - protein, 228 aa, Glycine max
  Coding DNA Sequence Number=SeqID_10149
  Gene Ontology: Mol. function=GTPase activity; Cellular component =intracellular; Biological process=immune response
  Homolog annotation: Hit_ID=Q9FNL5; Match level="QueryCoverage=92%, HitCoverage=20%, E-value=3e-83, Identity=71%"; Hit description =Similarity to guanylate binding protein
  Pfam annotation: Domain name=GBP_C; Domain location=79-227; Score= -130.8; E_value=0.005; Accession=PF02841.5; Description=Guanylate -binding protein, C-terminal domain
MAGPITRPARLCHRIPIRDSIRALFPDRECFTLVRPLNNENDLQRLDQISMDKLRTGFREGLDALTKFVFERTRPKQVGATMMTGPVLVGITESYLKALNEGAVPTISSSWQSVEEAECHRAYDSATDVYMSSFDRSSPPEEVALREAHEQAKQKSMAAFNAIAIGVGSARKTYEALLLKFFKKAFEDYRKDAFMEADLQCSNAIQSMEKRLRAACNASDAKIDNVAK

SEQ ID NO: 126928 - protein, 93 aa, Glycine max
  Coding DNA Sequence Number=SeqID_10150
  Gene Ontology: Mol. function=serine-type endopeptidase activity; Cellular component=chloroplast; Biological process=proteolysis
  Homolog annotation: Hit_ID=P56772; Match level="QueryCoverage=79%, HitCoverage=38%, E-value=1e-33, Identity=94%"; Hit description=ATP -dependent Clp protease proteolytic subunit
  Pfam annotation: Domain name=CLP_protease; Domain location=3-93; Score=-3.9; E_value=3.5e-08; Accession=PF00574.13; Description=Clp protease
MNCRDGKAVCINTQKMLVRVMIHQPASSFYEAQTGEFILEAEELLKMRETITRVYVQRTGKPLWVISEDMERDVFMSAAEAQAHGIVDLVAVE

SEQ ID NO: 126929 - protein, 85 aa, Glycine max
  Coding DNA Sequence Number=SeqID_10151
MARGRILPRALVIGEPCLVMPCGGFGKPEMILYLMMLLGGSMISLTELSSLVLKADQAMQVSWHRHPSSEGSLVAWKPPIEGCLK

SEQ ID NO: 126930 - protein, 233 aa, Glycine max
  Coding DNA Sequence Number=SeqID_10152
  Gene Ontology: Mol. function=signal transducer activity; Cellular component=membrane; Biological process=signal transduction
  Homolog annotation: Hit_ID=Q6D124; Match level="QueryCoverage=99%, HitCoverage=44%, E-value=5e-33, Identity=37%"; Hit description =Methyl-accepting chemotaxis protein
  Pfam annotation: Domain name=HAMP; Domain location=179-233; Score =16.0; E_value=0.053; Accession=PF00672.15; Description=HAMP domain
MTLLLLAVSAMGIYAINSGNQSLDAINRIQGIELNSLYQSNADLMRARASAALAVRKIEIGLLDEGATVTKQAQADVASSQRHLTAFIDAGTVTAQGKSLADAVAAAFSAYQKGAMAPMMDALQKQYTDEYYQVLEGNLSQLAANYSKAVNDFSLYADEVSAARLAAAAHNELQMKIMIGVAVALTLLLIALAWLLLRRALLRPLDGAIQHLEQIAAGDLSQPLPAAANNEIG

SEQ ID NO: 126931 - protein, 464 aa, Glycine max
  Coding DNA Sequence Number=SeqID_10153
  Gene Ontology: Mol. function=nucleic acid binding; Biological process= DNA integration
  Homolog annotation: Hit_ID=Q0KIN0; Match level="QueryCoverage=82%, HitCoverage=27%, E-value=9e-44, Identity=28%"; Hit description =Integrase core domain containing protein
  Subcellular localization annotation: CTP_CleavageSite=66; ConfidenceScore=5.60e-01
MRRFFLARLLARAAHAPPCRHRKLPLPVPAASSSLPGSVSGFTFRFRQAIWSALECFPLLCVRVCCLALKWPPLDLFFSFSGTPTITTAKLNWKNYPSWSASVELWFLGQGHHDHLEKTLDSVSVDKRPEWEKLDYQLCAVLWQSVEPDILEILRSFKSCRSFWKKAQEIFANDIQSLFDATMKVTALKQTSHDMIAHVGKARAAVEELRKFLVADSLEEVNRKLDKFYMVLILRSLHSDFDHVRDQVLDGDRIPSMDSLITRLLCVPQLLKDENPTDGVETSAMVASRGRGSGRNSRGGRSGRGGRPHCTYCKRRSQETCYSLHGFPDKVTQVSKSEKAESRFSYEEYQEYLKLKSEKPSNQAQPSSVPCFSITCISQSIEGRNPWILDSGASDHIFCNKSSFSSFSLPKIPHLVTVANGSKEHGTGRLIGEGHESRGLYYFESSPPGSCFATSRPKLLHDRL

SEQ ID NO: 126932 - protein, 43 aa, Glycine max
  Coding DNA Sequence Number=SeqID_10154
MEMGESASLTTACGKNKATKSQANQRRNEEGAHEELPQILEMA

SEQ ID NO: 126933 - protein, 90 aa, Glycine max
  Coding DNA Sequence Number=SeqID_10155
  Homolog annotation: Hit_ID=Q9FNL5; Match level="QueryCoverage=61%, HitCoverage=5%, E-value=2e-23, Identity=96%"; Hit description =Similarity to guanylate binding protein
  Subcellular localization annotation: CTP_CleavageSite=47; ConfidenceScore=5.40e-01
MLKYFNRGRDSPAADASPPSHAPATPSSSLPSASPVTGPARPIRLVYCDEKGKFQMDPEAVATLQLVKEPIGVVSVCGRARQGKSFILNQ

SEQ ID NO: 126934 - protein, 108 aa, Glycine max
  Coding DNA Sequence Number=SeqID_10156
RTHEVPHHNLANFEPRLGYTHEGQTIGGVPLPNTLEGSQYYLQLKPLHFAVGSVPPAMTEKGKFDHIEERLKAIEGGGDYAFVDIIEWCLVPDVIIPSKFKVPNFDKY

SEQ ID NO: 126935 - protein, 105 aa, Glycine max
  Coding DNA Sequence Number=SeqID_10157
MAPDRMQLQNMCKKEHESFKGYSQRWRDMTAQLAPPMKEREMITMIVDMLSVFYYEKMVGYTPSSFAGLVFSSERIEMGLRRGKFDYSALTNEKAGADGEDEKEE

SEQ ID NO: 126936 - protein, 74 aa, Glycine max
  Coding DNA Sequence Number=SeqID_10158
MMQSYPARTLDRKLQEEWTRDAREDLRVLMNLRKCAETCGVKFQKNRKEREIYFLGKEAIDVGIARCSLAKYTK

SEQ ID NO: 126937 - protein, 181 aa, Glycine max
  Coding DNA Sequence Number=SeqID_10159
YILCGTSRGYIYLSLTENKRGYISCGSVLVEGTSTRVSKRTREVNIPKYNRERRTEEDTGRQPKNKGDEIQTQVHRATQQRQTKPLSYADAVRKKNITHQRRKDQKQHSHGYENYTSSVYLNIKTKEIKWLEDAWVGRLNNLAMFKRLVEELRWELGMDIAPKYLGDDLVLLPGLTEAEAE

SEQ ID NO: 126938 - protein, 893 aa, Glycine max
  Coding DNA Sequence Number=SeqID_10160
  Gene Ontology: Mol. function=helicase activity; Biological process =viral genome replication
  Homolog annotation: Hit_ID=Q1SN45; Match level="QueryCoverage=75%, HitCoverage=42%, E-value=1e-171, Identity=44%"; Hit description=AAA ATPase
  Pfam annotation: Domain name=DUF889; Domain location=388-640; Score =431.7; E_value=1e-126; Accession=PF05970.5; Description=Eukaryotic protein of unknown function (DUF889)
YVSAPEACWKIFAFPMHGRAPAIERLYFHLENQHLVYWKDSQDIGTVLSKSTIKESMFTTWMDSNKIYHHGQDLTYAEYVSKFVYNACKRCWKPRKQGNTIGRLIWVPPSSGELFYMRMMLSSAKGSQCYEDIRTVENVVYHTFREACFAKGFLGSDQEFVGALQEANSWGTPHFLKKLFVKLLFMNTMDRPEYVWKQSWQWMADDIVFNHKRQGYAANPHQNNLIYNELGYDRDILSAEFDKCYQSLTDEHASIFNKIMHVVATQSGGVYFLYGYGGTCKTFVWKTLSSTIRSTGGIVLTVASSGIASILLPGGRTTHSKFAIPVPATQNSTCNIHQGSDLAELLQITKLIIWDEAPMCHRYSIEALDKSLRDIMHNGNPFGGKVIVFGGDFRQILPVVPRSNRSNIVYATLNASYIWNHCQILKLTKNMRLQSNPTDHSNFDELKQFSKWLLDIGDGKLVEPNDGYGEITIPDEFLIKEFQDPIQEIVEATYLDLLHNYNNGDFLQKRAVLVSTKGVVDKINNYVLSLIPGEEKEYCSVDCVDKSDELLSPAFGVLTTEFLNSLKTSGIPNHKLRIKVGTPIILLRNLDQTDGLCNGTRLIVTRLGSSVVEAEIITGPNIGHRTYIPRMNLSPSDSPWPFKLIRRQFPFMVSFAMTINKSQGQSLAHVGLYLPTLGPRERNCNDNCERPFLSLNLLLFLAGCDASDNIVMCLCGKQLANIVLFQGTFLNRRMRYCSFLPSKMCYRLKHKFAEKKVARGVGSGCKLRNKVVALMDYNLPDLIGNGSEASWVQSTFSEEPPSLYASHSSVTSSTLGEEDSCPSPLPPDLMPSIDEKKMDQITREDYPMKVGIELQSNPTPSELFLDKSVSCIPRLSKRHYQQLDNCGFHTVGS

SEQ ID NO: 126939 - protein, 201 aa, Glycine max
  Coding DNA Sequence Number=SeqID_10161
  Homolog annotation: Hit_ID=Q1SM38; Match level="QueryCoverage=24%, HitCoverage=14%, E-value=2e-16, Identity=88%"; Hit description=Mov34- 1; Invasin/intimin cell-adhesion
MDAFALPVEGTKTRVNAQADAYEYMVDYSQTNKQGSWRMLGDGITFTLGSEVVFVDVDGLGWVGALSSCFLQFSSKKAIISMKQHTPVAAIRTMKVVGLSATFIKLKKEGKVSDLVTSIHENWFSATCINTSKPAGEGAIVIQTVAYILLAINLAYNNIIGTVPYSISNLTALTNLRECWSQSAPARTGVDFHNLSTLSTL

SEQ ID NO: 126940 - protein, 130 aa, Glycine max
  Coding DNA Sequence Number=SeqID_10162
MGAEKREGLEPEKRHANRGMILAFKRNSEALLLTPTLLFFSLSPPPLLPIKAPNFAHHFYSKLQRETIFGVVKCTSTLWDFEFQVEKCEILRVREARFGVSVNWSLKTFRKAWAEQMRKMSDKCESKSHF

SEQ ID NO: 126941 - protein, 184 aa, Glycine max
  Coding DNA Sequence Number=SeqID_10163
MITYIYAIIRALSNPTKLTRSYRNINLEQAGITPFELIEYQATDCFDFDIQQHFLDLFLEKVGSLAIVGVPLVVDMNTTAIDGEGGSAREDEKQGYLRKGIKRSFEERTTSALSTDFEFKLGVSALREVVVPVVREFQSCKRLQIRVRKRSSESKSQKGFKVREVERFWHQTIIIKDSTTSILK

SEQ ID NO: 126942 - protein, 152 aa, Glycine max
  Coding DNA Sequence Number=SeqID_10164
  Pfam annotation: Domain name=Transposase_23; Domain location=82-149; Score=-15.6; E_value=0.058; Accession=PF03017.5; Description =TNP1ENSPM transposase
MYDTLESDFKKPLYSGCKKSLALLSVVLSLINVKVRYGWSDKSFTLLLHIVQDMLLEENTMSKSYYQAKKSDGYEDPKTATSDMYGLYVDENPPRLVAFGRVYEGSTAVHNIPFGNDQVKVGVEEVRDTDVRVPIPTKDVQLVGKILNTFLA

SEQ ID NO: 126943 - protein, 381 aa, Glycine max
  Coding DNA Sequence Number=SeqID_10165
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q5DP49; Match level="QueryCoverage=41%, HitCoverage=41%, E-value=4e-57, Identity=58%"; Hit description =Isoflavone synthase 2
  Pfam annotation: Domain name=Glyco_hydro_17; Domain location=165-381; Score=71.3; E_value=3.2e-18; Accession=PF00332.9; Description =Glycosyl hydrolases family 17
MEIKITKEQIKGLVVDFFSAGTDSTAVATDWALAELINNPKVLQKAREEIYSVVGKDRLIDEADIQNLSYIRAIVRLMVGRDPKYWDKPLEFRPERFLETKGANIFNFSHLGMATLLASLIQCFDLQVVGPQGQILKGVDAKVSMEERPGLTIPMEHRSKASSNIGVNYGQLGNNLPSPHRSIELLTAMKACGIAANQSIADEWLRKNVLPYYPNTMIRYLLVGNEVLSYNSEQGHQMWRDHVPSMLRIERSLRAQNIRDIKVGTPLAMDGKFQQHKRPWQWLGLHQLVGPNADSLIFVMAKLGYPNINLVICKTGWPNSGDGEELGANASNAATYNRNLIQRMTTKPPIGTPARPRVTITTFIFSLFGENEKPGPGTERH

SEQ ID NO: 126944 - protein, 175 aa, Glycine max
  Coding DNA Sequence Number=SeqID_10166
  Gene Ontology: Mol. function=helicase activity; Biological process =protein amino acid phosphorylation
  Homolog annotation: Hit_ID=Q1SN45; Match level="QueryCoverage=84%, HitCoverage=8%, E-value=7e-29, Identity=45%"; Hit description=AAA ATPase
MADDIIFNHRKEGIRLTEKETIHLCLTEIENMLQANRRSLRYFPSMPYPIGYARNQHHNNLIHNEMTYDKEMLAEQYNTTYQLLTDEQKTIVDTIMSVVNTQSAAVYFLYGYGGTGKTFVWTTLSSGIRSNGGIVCTVASSGVASLLLPWSDHTFQICYTSPCNRKFNMQYSSRQ

SEQ ID NO: 126945 - protein, 446 aa, Glycine max
  Coding DNA Sequence Number=SeqID_10167
  Gene Ontology: Mol. function=protein dimerization activity
  Homolog annotation: Hit_ID=Q1S735; Match level="QueryCoverage=70%, HitCoverage=91%, E-value=5e-67, Identity=43%"; Hit description =Probable transposase [imported]-Arabidopsis thaliana-related
  Pfam annotation: Domain name=DUF659; Domain location=133-276; Score =135.7; E_value=1.2e-37; Accession=PF04937.6; Description=Protein of unknown function (DUF 659)
  Pfam annotation: Domain name=zf-C2HC_plant; Domain location=27-83; Score=41.3; E_value=3.3e-09; Accession=PF07567.3; Description =Protein of unknown function, DUF1544
  Pfam module annotation: Pfam domain module=DUF659::zf-C2HC_plant; Domain location=133-276::27-83
MSSTEVPSSQEASTPNTSQNVRGKIGPAWGHCKQIDEDATKVTMMCICCNKRIKGGGINMFKAHLAGQKGQVEACKKGKNTLYANDYFMPKTTPRAQPSLKSVLQNKQIVEKCDKVIAKWMIDASVPFNAINSTYYQPMIDAISSMSPSYKEVWMEIGCTLMVDGWIDCSRRTVINFLVYCPKGTIFLRYVDASYASKTVEMLFKIFKEMVLNVGAENVVHIVTDGAINYVATGRLLEKEFPKIYWSACAAHYINLILQDFGKFEEEMVRRFQRNKKKVEPYLEVLDRRWDSQLRKNLHAAGYWLNLTCRFNAEEFEKHMNTQSGILELIDRYTHGDLEFQDRLNEDMKIYKNSEGDFAKRAAIREHNTIMLVLEESPPFLTREEVEDLPNDLANMFIQSISNDIDKLNLDEYEDGDVSQPPDNTMEDVNPNENNIDEESHSFDEE

SEQ ID NO: 126946 - protein, 522 aa, Glycine max
  Coding DNA Sequence Number=SeqID_10168
  Homolog annotation: Hit_ID=Q5JMX2; Match level="QueryCoverage=98%, HitCoverage=97%, E-value=1e-120, Identity=45%"; Hit description =Putative vascular plant one zinc finger protein
MKKVPKNSCKSASHRLFKDKAKNRVDDLQLMFLDLQFARKESRTVDAVVLEEQVHQMLREWKAELNEPSPASSLQQGGSLGSFSTDICRLLQLCEEEDDASSPLAAPKPEPNDQTLQAGGKVMFQEIDIFLQRAVSAFTHCTFIQYCNTGWVSILDFILDCNKFPGLTVNQGQQQHYFPLVDECKHSTSSVQNVAANNPDGHALEYHQFDLHQDYDHGLYTGFNGTGYCEEDAIPHISSYLPSICPPPSAFLGPKCALWDCPRPAQGLDWCQDYCSSFHAALALNEGPPGMAPVLRPGGIGLKDNLLFAALSAKAQGKDVGIPECEGAATAKSPWNAPELFDLSVLEGETIREWLFFDKPRRAFESGNRKQRSLPDYSGRGWHESRKQVMNEFGGLKRSYYMDPQPLNHFEWHLYEYEISKCDACALYRLELKLVDGKKNSKTKAANDSVADLQKQMGRLSAEFPHDNKRAAKGRAKINAKVGIGGVYPASHRVTPLNGTYEYGLAAPYDYLVDNMGDYYGT

SEQ ID NO: 126947 - protein, 341 aa, Glycine max
  Coding DNA Sequence Number=SeqID_10169
  Gene Ontology: Mol. function=sequence-specific DNA binding; Cellular component=nucleus; Biological process=regulation of transcription, DNA-dependent
  Homolog annotation: Hit_ID=Q6X7J4; Match level="QueryCoverage=99%, HitCoverage=87%, E-value=2e-33, Identity=77%"; Hit description =WUSCHEL-related homeobox 9
  Pfam annotation: Domain name=Homeobox; Domain location=8-69; Score =55.8; E_value=1.4e-13; Accession=PF00046.19; Description=Homeobox domain
GEERTPEPKPRWNPKPEQIRILEAIFNSGMVNPPRDEIRKIRVQLQEYGQVGDANVFYWFQNRKSRSKHKLRHFQNSMNQNHNAEAQQQQKVDASSLSQTTPPSSSSSSSDKSSSKELAYPIGFSFGFSNVNDVAVPNSPAASVNQTYFQPHNHIDNNLLPQATEPFSFTMHNNNVQGVVDKNTITTLGFSVPQFSSNMMQSQLQCQQNVGPCTSLLLNEIMNYGTLSKKDQDEDKALKITHPQLSFPLTSTPPTTTIAPSISTVPCPITQLQGVGEVAGDRAKCTVFINGVEFEVVMGPFNVHQAFGDEAVLIHSSGNPVPTDKRGITLHPLHHGAYYYL

SEQ ID NO: 126948 - protein, 153 aa, Glycine max
  Coding DNA Sequence Number=SeqID_10170
  Gene Ontology: Mol. function=nucleotide binding; Cellular component =intracellular; Biological process=small GTPase mediated signal transduction
  Homolog annotation: Hit_ID=Q41253; Match level="QueryCoverage=99%, HitCoverage=100%, E-value=8e-64, Identity=68%"; Hit description=Rac -like GTP-binding protein RAC13
  Pfam annotation: Domain name=Miro; Domain location=8-120; Score=16.8; E_value=0.00013; Accession=PF08477.3; Description=Miro-like protein
  Pfam annotation: Domain name=Ras; Domain location=8-136; Score=157.4; E_value=3.8e-44; Accession=PF00071.12; Description=Ras family
  Pfam module annotation: Pfam domain module=Miro::Ras; Domain location= 8-120::8-136
MSTARFIKCVTVGDGAVGKTCMLISYTSNTFPTDYVPTVFDNFSANVTVDGSTVNLGLWDTAGQEDYNRLRPLSYRGADVFLLCYSLISKASYENISKKGEELKKMIGAVTYIECSSKTQQNVKTVFDAAIKVALRPPKPKKKPRKKKTCPFL

SEQ ID NO: 126949 - protein, 177 aa, Glycine max
  Coding DNA Sequence Number=SeqID_10171
  Homolog annotation: Hit_ID=O21999; Match level="QueryCoverage=37%, HitCoverage=43%, E-value=1e-22, Identity=76%"; Hit description=LacZ -alpha
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNNKLGGKRAETDSAPFVIRGQLDRVQQNAETNNGHSASCINQEEQIRQYQDDVL

SEQ ID NO: 126950 - protein, 53 aa, Glycine max
  Coding DNA Sequence Number=SeqID_10172
MVWPVAEHFPRCLGGHSATSSAVNRPCVAADLPLFYLCVVTVTFHCGGVSKEP

SEQ ID NO: 126951 - protein, 316 aa, Glycine max
  Coding DNA Sequence Number=SeqID_10173
MFVREAANSHGLRHHSCKASISELKHKLHKILKSQEIILEEKRVKDEQRMETHPSYIKKTEGIKEIKTWLERWIQEQDIMLEDKITNKQSIQEEINPHSTKHVKKTIKGSGSECCNNTEVHSWTRKHVKKTMEGIGSECCDNTEVHSWTRKGETKEDHFVCVIHQALETEQYNEVLNESKLGRLSESLKPEKELVFFEEEPKIIRGRHSIKGTGDAVLVVEESPIKVHQMSQVGNFPWARIGSLFQTPTVCLILHSPNSIQGQTTLFPVKSTCSPTHNANKGKSMSGYNVIQLTAKANEVFCQNMQIGMKMRVAVT

SEQ ID NO: 126952 - protein, 349 aa, Glycine max
  Coding DNA Sequence Number=SeqID_10174
  Homolog annotation: Hit_ID=Q0ZFU8; Match level="QueryCoverage=74%, HitCoverage=80%, E-value=3e-64, Identity=73%"; Hit description=SNI1
MENPSSSERSRAGIEDNMLAMFDASETKDAHQDALDDRIAFIDAVRASCEHGKPPTSTGKSLELIVGSYKLLVDLDKHFPRVYLSGTDDSRSSSNSPSKLVVVKEAWSPIIDFVDKATAVSEAGDKQSGGSLDPSSFQVLIEGLAEVLAETKFEAASMEIMDLDMARKKADIEGRTTRADSPRQFTFNFVSLQTPLMDIILDELAYNKDSVPVFLKMVSEPKWKLEIVVQYLWKYITKPSVRTRKSNGHTEDATFGGALKASPGAAVKLCLGDLLVMGSNPEIASLHMQGAFDRMSTSDDFLFGGSTDDDGLTGSSSKKTSSFSGFKDSDNLPNLLSFNTSLYCSVSNA

SEQ ID NO: 126953 - protein, 115 aa, Glycine max
  Coding DNA Sequence Number=SeqID_10175
MFVKFLIFFCKASICSLKSATTIVSLETEDELEIRIAARLPWWHCRMKLPENAQQLPLADMDKSSEQAARTEPQSRRRRSNSAWEEEEEEEATSSFVNPNFFGEEEATFHVRENL

SEQ ID NO: 126954 - protein, 119 aa, Glycine max
  Coding DNA Sequence Number=SeqID_10176
MASLHHPSQLSQVAWPEAQLPLVRPNEVAPPEPAPARVEPMPAEPRSLVGNPPPSLELEVVPPSPPLIIISDASSDETAAPPDSPAGETANPPDSPVGGIADLSDSSSAEVVALTDSPV

SEQ ID NO: 126955 - protein, 69 aa, Glycine max
  Coding DNA Sequence Number=SeqID_10177
AINSWGSGLGCTNSARQSIRRAPDSMVEDARTTLGNQFVGLRIRFDGGGCTNSARQSIRGALDSMVEDA

SEQ ID NO: 126956 - protein, 107 aa, Glycine max
  Coding DNA Sequence Number=SeqID_10178
MAHGCVFQERKMHGVATNVYSRKTSEKPESKIYFNRTKGHLRRWTIKRSFDFERTETLRRWTINDLLFFERRETLRHWTINDLLGWSTKAGLLLLRILNYDEEIRPT

SEQ ID NO: 126957 - protein, 884 aa, Glycine max
  Coding DNA Sequence Number=SeqID_10179
  Gene Ontology: Mol. function=ionotropic glutamate receptor activity; Cellular component=membrane; Biological process=ion transport
  Homolog annotation: Hit_ID=Q69L11; Match level="QueryCoverage=90%, HitCoverage=89%, E-value=1e-119, Identity=33%"; Hit description =Putative Avr9/Cf-9 rapidly elicited protein 141
  Pfam annotation: Domain name=ANF_receptor; Domain location=52-372; Score=81.5; E_value=2.6e-21; Accession=PF01094.18; Description =Receptor family ligand binding region
  Pfam annotation: Domain name=Lig_chan; Domain location=550-812; Score= 159.7; E_value=7.4e-45; Accession=PF00060.17; Description=Ligand -gated ion channel
  Pfam annotation: Domain name=SBP_bac_3; Domain location=447-770; Score=-22.8; E_value=1.5e-06; Accession=PF00497.10; Description =Bacterial extracellular solute-binding proteins, family 3
  Pfam module annotation: Pfam domain module=ANF_receptor::Lig _chan::SBP_bac_3; Domain location=52-372::550-812::447-770
MNFPSTIPLAFPTYLFIFFVLVNCYQGEATNGDNKVISIGAIIDVNSRVGKEQLVAMDLAAQSYNNTSKSHKMALHFQEPTKDPFRPTSLARKMIKTQKAQVIIGMHAWTEAASVAELGRKTQVPVISFAAPTITPPLLPTRLPFSVRMANDGTAYAKCVADMGDYEMLALLSETLQEVGSMIEYRLALPSPSYRTNPGEFIREELNKLIKNTQSRVFIVLQSSLEMVIHLFREAAQLGLVDGESAWIIPERITNLLDSVNKSSISYMEGALGIKTYYSEDSSEYQDFEAQFRKSFRAKYPEEDNRDPGFYALQAYDSIKIVAQAIDRMASGRKTLLTEILSSNFLGLSGEIRFEEAQLLPNPTFRIVNVDKKSYRELDFWTLKRGFITNLTTEQGSNSVSRNTESLSAVVIWPGKLNRVPKGWNLPTKQKPMQIAVPGRTSFSRFVKVDRDELTNSYKYSGFCIEIFEKVLDILGYDLPYEFHPINGTYSDLVQLVYNKTYEAVIGDTTITEARLQYVDFTVPYAESGLSMIVTEKSNESTWMFMKPFTWQMWVATGAVLTYTMVVVWYLEREPNPEFQGNWKSQVSTALMFTFSSLFFAHREKIHNDLSRVVMVSWLFLVLILNSSYTASLSSMLTIQRLQPNVTDILCLKKYNMKIGCDGDSFVRTYLEKVEQFKPENIINMDNEYSYEDAFKNNSIAAAFLELPYEKVYMSKYCKGYSASVPTTKFGGLGFMFQKGSPVARDVSKAILRLLEQGELRMLEDKWMNDAGDCSNNSPSESTESLRLGSFWVLYVISGATSTICFLLYTIQLLKTRQPTHDDAQERNGNPGDENRWKRIVIIAKQIYSRKHATVTPVPHQPQAPQLPDIITVSSPPTVAIQNS

SEQ ID NO: 126958 - protein, 654 aa, Glycine max
  Coding DNA Sequence Number=SeqID_10180
  Gene Ontology: Mol. function=fibroblast growth factor binding; Cellular component=spliceosome; Biological process=anti-apoptosis
  Homolog annotation: Hit_ID=O22957; Match level="QueryCoverage=89%, HitCoverage=84%, E-value=1e-140, Identity=60%"; Hit description =Expressed protein
  Pfam annotation: Domain name=API5; Domain location=10-650; Score =707.4; E_value=1e-209; Accession=PF05918.2; Description=Apoptosis inhibitory protein 5 (API5)
MSDPAEEAAFIEKLYEYGEQLNNAKDKSQNVQDYQGIIDAAKTSVKAKQLAAQLIPRFYKFFPDLSSPALDAHLDLVEAEELGPCGSGLCWFVRLKAKLIREVELKRVSEGYTGRKIVPFVEIKRDIGNWEVRVQAIRGLPLFCKDTPENIGKMVDILVQILGSEEFVERDAVHKALMSLLRQDVKDIVGVKGVFGNLFGALSLEVTTFQSPKPSLTALFKHIGSVEEPSTDDVIREKVINFVRDKVFPIKAELLKPQEEMERHITDLIKKSLEDVTGIEFRMFMDFLKSLSLFGEKAPAERMKELIGIIEGQADLDAQFNVSDADHIDRLISCLHMALPFVVLPGERKVDLLRSLAEFSPYTTPQDSRQMLPSIVQLLKKYMTWKKTGEEMNFTYVECLLYTFHHLAHKVPNATNSLCGYKIVTGQPSDRLGEDFSEHYNDFTESENEKTANARRRRRERSCQRKEPRSCEPVTKQELDDDGSGHAQSSNGLDLVQPPGCGWSRFPNYGLRLNNVEEFTRATIKKLTQGMDENNKSMAGAKTDEEKEKIKTKKQNATTGLRTCNNILTMTKPLHAKVPSFIGDKRINLSWKEATKAASTAPAAGAKRPANAANGSNNIASKKGRGAGGAEAGAGVVVEEEEEEGIGNFVADVM

SEQ ID NO: 126959 - protein, 84 aa, Glycine max
  Coding DNA Sequence Number=SeqID_10181
IWASWEYVSSVGGGATGDGGFYARIVDVENLVKLPAFIVDHRVVPGDMSRGSGDLGDVRRAPGSQQIKGKQDHKARRLVVAGQL

SEQ ID NO: 126960 - protein, 152 aa, Glycine max
  Coding DNA Sequence Number=SeqID_10182
MVKEECKEVSVSSKRLAKKESRFAIKTNIIETSLLRQPPHLLLCKRTLVSTDIPLELEVIPQVELLDEGLVRKSLNPCALSVPKIGIMRHQIPKIGGMMNVLSGSTLFCKITHAPNIFMTRIHRDTIEKDMFYCITFLNFLNSDQGVPTNPN

SEQ ID NO: 126961 - protein, 286 aa, Glycine max
  Coding DNA Sequence Number=SeqID_10183
  Gene Ontology: Mol. function=sequence-specific DNA binding; Cellular component=nucleus; Biological process=regulation of transcription, DNA-dependent
  Homolog annotation: Hit_ID=Q45RR3; Match level="QueryCoverage=100%, HitCoverage=91%, E-value=2e-52, Identity=45%"; Hit description=Type II homeodomain-leucine zipper protein
  Pfam annotation: Domain name=HALZ; Domain location=230-274; Score =88.5; E_value=2e-23; Accession=PF02183.8; Description=Homeobox associated leucine zipper
  Pfam annotation: Domain name=HD-ZIP_N; Domain location=21-127; Score=- 20.4; E_value=0.018; Accession=PF04618.3; Description=HD-ZIP protein N terminus
  Pfam annotation: Domain name=Homeobox; Domain location=165-219; Score= 54.9; E_value=2.6e-13; Accession=PF00046.19; Description=Homeobox domain
  Pfam module annotation: Pfam domain module=HALZ::HD-ZIP_N::Homeobox; Domain location=230-274::21-127::165-219
MELALSLGDTSKSFTFLDKAVTLPPNKDPPGFCLAPSFAEKRSDSERGTASGSSDPPVQLDLLPFSPVLRPQQHPPSHLRIPWLTQACGGAARVLDVNLFPAATAEDGDDGTSLSSSPNSAVSPFQMDFCTRNGNAAEFGSRNKREQQEAEGRASDDDENGSTRKKLRLSKEQSAFLEESFKEHTTLNPKQKLALAKQLNLRPRQVEVWFQNRRARKAINMVMDLWTKLKQTEVDCEYLKRCCETLTEENRRLQKELQELRALKSSQPFYMQLPATTLTMCPSCER

SEQ ID NO: 126962 - protein, 295 aa, Glycine max
  Coding DNA Sequence Number=SeqID_10184
  Homolog annotation: Hit_ID=Q1M8E1; Match level="QueryCoverage=21%, HitCoverage=29%, E-value=3e-07, Identity=50%"; Hit description =Putative permease component of ABC transporter
MWAIGGGQGTQWDNKKLTGQVWYQEYADYSRVVYGESHMQWQDTLLQPDVALQFIRGTSLGKALAGEVNSTSYGAQLALSFTPALNWKLDYDHIAASPNSWGNGSLVVPYAHNSSSGPYFAQPFFTSTQDLGSGNAYMTNLNYVLNEHLSLGTQYSFMDLKPSAQSASINQSEYLVYFTWAFSGVLKGLSVTDFAGVQTSPLYDSHFWQNPPDAKHLSAGERTGADVFLSAACQCAAPADRRATGYRTPARSVRRSPPPSPQCQNADNRSESPDRPGRPPRWHPPFPRRRSAPPA

SEQ ID NO: 126963 - protein, 588 aa, Glycine max
  Coding DNA Sequence Number=SeqID_10185
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q69T67; Match level="QueryCoverage=73%, HitCoverage=53%, E-value=1e-156, Identity=57%"; Hit description =Lustrin A-like
  Pfam annotation: Domain name=DUF231; Domain location=410-574; Score =254.2; E_value=2.8e-73; Accession=PF03005.6; Description=Arabidopsis proteins of unknown function
  Subcellular localization annotation: CTP_CleavageSite=11; ConfidenceScore=5.61e-01
MADSTKYIPIGGTLKSNLKTLFPIFKTRKTLTFAYAFSFTFVAFTVFLAFCPSPNTSSPFFTNIFSSTATTTSSASSYKSQLSSIFSFFFHNSTTPSSNSSSSTFNTNTTRSSNSTSQSPQTSKKTFKITPFENQTRTTPPPLTRKIPSDHVVTKEPSSANNNHTRVSDEAKAVKKTNQSSNGVVPAAAPKVSGVGSNKNLSSLVNGGGTEKDVVHSNYTASRVKDEMMESLIKCDFFDGEWVKDDSYPLYEPGSCNIVDEQFHCIQNGRPDKDFQKYKWKPKGCNLPRLDGHIMLDMLRGKRLIFVGDSINRNMWESLICILRNAVKDKSKVYEANGRVHFRGEASYSFVFKDYNFSVELFVSPFLVQEWEVQIKNGTKKETLRLDLVGKSSVQYKNADIIIFNTGHWWTHDKTSKGKDYYQEGSHVYDELNVLEAFRRAITTWSRWIDANINPSKSMVFFRGYSASHFSGGQWNSGGQCDSETVPIKNEKYLREYPPKMRVLEKVLKNMKTHVTYLNVTKMTDFRKDGHPSIYRKQNLSPEERKSPLRYQDCSHWCLPGVPDAWNEILYAELLLKEYQNQHQQKQT

SEQ ID NO: 126964 - protein, 32 aa, Glycine max
  Coding DNA Sequence Number=SeqID_10186
MAGAVRVVVIALGKNISLAFSFLHWHYDDGEH

SEQ ID NO: 126965 - protein, 308 aa, Glycine max
  Coding DNA Sequence Number=SeqID_10187
  Homolog annotation: Hit_ID=Q0WNP8; Match level="QueryCoverage=97%, HitCoverage=100%, E-value=9e-64, Identity=46%"; Hit description =Putative SF16 protein
  Pfam annotation: Domain name=IQ; Domain location=73-93; Score=24.7; E_ value=0.00034; Accession=PF00612.17; Description=IQ calmodulin -binding motif
MGSGDWFKTIISSRKSKEGTSKKVKLRFCDLESDCSFPVRDSTTKIYTRKKSNGLANGIKSKNLESDGVSVETIAATRIQTAFRAYKARKYLHRLRGFTKLKIQTQGSSVQKQAATTITYLHSWSKIQAEIRARRICMVTEDRIRRKIIHSQLKLESKIHDLEVEWCGGSETKKEILARLHHREEAAVKRERTMAYAFSHQWRANSSQGLGNYDLGKASWSWSWKDRWIATRPWESRVPSVTISPPKDQNKKPNKVKKDKNSSTSKKPISVKTPSANAKGTKSLGNAKGTTKARRRLSYPAATEKSSA

SEQ ID NO: 126966 - protein, 121 aa, Glycine max
  Coding DNA Sequence Number=SeqID_10188
  Gene Ontology: Mol. function=heat shock protein binding; Cellular component=integral to membrane; Biological process=protein folding
  Homolog annotation: Hit_ID=P93499; Match level="QueryCoverage=95%, HitCoverage=77%, E-value=5e-39, Identity=66%"; Hit description=DnaJ -like protein
  Pfam annotation: Domain name=DnaJ; Domain location=44-108; Score =75.7; E_value=1.4e-19; Accession=PF00226.21; Description=DnaJ domain
MASSSCRVKSQPIVAFATVTATVEAHSSWIEQPRPSYLNSSCSLLYGILGIPVGASNQEIKAAYRRLAKVCHPDMAAIDQKNSSADEFMKIHTTYFTFSDPNKRANYDQNLFWQQRSRDQP

SEQ ID NO: 126967 - protein, 126 aa, Glycine max
  Coding DNA Sequence Number=SeqID_10189
  Subcellular localization annotation: CTP_CleavageSite=46; ConfidenceScore=5.25e-01
MIFHHHHSPPITTTIATNVIVTHQTASTPSLLHFSEGGRQSGFTVVSKLKRGYNNLVGDMRGVIDFGCRSHKSPCTCVILLTCSCCIPPLGKWMRTPMSGVHSGCFDCVAKASRFQNSNSRGGKWI

SEQ ID NO: 126968 - protein, 302 aa, Glycine max
  Coding DNA Sequence Number=SeqID_10190
  Gene Ontology: Mol. function=transferase activity, transferring glycosyl groups; Cellular component=endoplasmic reticulum membrane; Biological process=protein amino acid C-linked glycosylation via 2' -alpha-mannosyl-L-tryptophan
  Homolog annotation: Hit_ID=Q10BB4; Match level="QueryCoverage=97%, HitCoverage=96%, E-value=2e-99, Identity=86%"; Hit description =Dolichol-phosphate mannosyltransferase, putative, expressed
  Pfam annotation: Domain name=Glycos_transf_2; Domain location=13-182; Score=139.2; E_value=1.1e-38; Accession=PF00535.16; Description =Glycosyl transferase
MDGRHQKQKNKYSIIVPTYNERLNIGLIVYLIFKHLGDADFEIIIVDDGSPDGTQDVVKQLQQVYGEDRILLRARPRKLGLGTAYIHGMKHASGNFVVIMDADLSHHPKYLPNFIRKQSETGADIVTGTRYVKGGGVHGWNLMRKLTSRGANVLAQTLLWPGVSDLTGSFRLYRKSVLEDIISCCVSKGYVFQMEMIVRASRKGYHIEEILSLICNSIYQYSVCHLCLLVNPGTKRVSKCIYTLLCAFGWPWNCFKVDSVMGDDMYMFVPITFVDRVFGSSKLGGSEIVEYLKGLAYLLVTT

SEQ ID NO: 126969 - protein, 128 aa, Glycine max
  Coding DNA Sequence Number=SeqID_10191
  Gene Ontology: Mol. function=manganese ion binding; Cellular component=mitochondrion
  Homolog annotation: Hit_ID=Q8GYB1; Match level="QueryCoverage=83%, HitCoverage=37%, E-value=4e-36, Identity=74%"; Hit description=Nudix hydrolase 15, mitochondrial precursor
MSSISFALMMLMFKLPDHLLRVVPVIGILHDKKAFKPVLNPAEVEAVFDAPLEMFLKDKNRRQDEREWMGEKYLLHFFDYGIGHKKYIIWGLTAGILIRLHQLCTNGCQLSWSRILNSSFHRMYPRIL

SEQ ID NO: 126970 - protein, 329 aa, Glycine max
  Coding DNA Sequence Number=SeqID_10192
MAEQNKESSASDPKEKKSSLDDEIGNEFLGSWKSMSMADDDAMDFSFDTVSKGKKKTFDFEKLDMNFNLDGEFDKISSFKLDMSDLDFTCPPKKNSQSKDKKGEVSGAKAGKQDGFNFSFDFNELDSFNLHSSFMKEDTTSNSSPKKKGVTTEGSDKGGKMPKTNDDEGAHASNDSTAVKSHASERLETLKVETMVGIPGNLVSKQDGSVSKISSSGNLDMPMENQTLDTNKHKSTEEIDQERDLPEKTKLTESKSEQVINMACSQSVGQSDSDQHTISDQHTNVFSSGTRVSNVSGDKQEVNDKTTYQCKKMFSSGTREINVSGDIQE

SEQ ID NO: 126971 - protein, 165 aa, Glycine max
  Coding DNA Sequence Number=SeqID_10193
  Homolog annotation: Hit_ID=Q9LRH7; Match level="QueryCoverage=30%, HitCoverage=6%, E-value=5e-17, Identity=74%"; Hit description=Mixed -amyrin synthase
MGARVTVVETSKNNDGVLTTDVDILSNNVGGEPATDVERKPNKYGCSAYLTLKWTTTTTGLRVPDVEMDPNNDGLFNIYCISFSQQIAAKMYMSMSYSYGKKFASPITPLILNVLCVLACWGEDSKGDAFKKYLARILDYLWVSEDGMTMQSFGSQTWDICLLLT

SEQ ID NO: 126972 - protein, 422 aa, Glycine max
  Coding DNA Sequence Number=SeqID_10194
  Subcellular localization annotation: CTP_CleavageSite=39; ConfidenceScore=5.34e-01
MMLMKDKKLQDMQSNMFSTPEGKRSLKQPSSTVGTKGCSLGNKKNAEMLLGPITQARENFRSNDTRLGSKLVGDSLTYSSKLTRDAAALLGSKDNLISSRNTREGNVSDATTCSGKLAGNKKSFSDEVNKGKTTFLEIGMSTKDVSMSSSQVNPSCLTEKTARITTQVSANSQPEASGKESYQKSKIASIEGNKLSSFKNCKITPALSSLKTSRNFGANRVLTTLNQKETNSLVSSGQSMDIQGITASKNDHPIDSGDNQKPSTPFLKRKTTEASEADFQSLRPLKRISQSPSKSRNSKESSEEFVGEVESMPNNLLYNHSTSGLTSPPAIKVTEVEIPDSILMEDNSNVEKAEAYMKELEDHYLYPESEGSSLAKKSVKVSYSIGFRNSNATGSHYYRPSRVSPGGPDAHHHFEAVNNTLN

SEQ ID NO: 126973 - protein, 165 aa, Glycine max
  Coding DNA Sequence Number=SeqID_10195
VVLPETFRKKGFFRKGLPELWKFFRKCASSGILPDEPLLPESSRKTFSGSLPEELFFRKTFGYFRKNTSSGNFPEKVLLELPEEPLTGSTAESILDSKSNGELGRLTSKAVRGEDGEEEEAWLVVSGRRRKLGSRCPEEDESLEDQQEWKKKRSSSGLPRRGARF

SEQ ID NO: 126974 - protein, 152 aa, Glycine max
  Coding DNA Sequence Number=SeqID_10196
  Gene Ontology: Mol. function=ribonuclease H activity; Biological process=DNA integration
  Homolog annotation: Hit_ID=Q1SYR3; Match level="QueryCoverage=50%, HitCoverage=3%, E-value=8e-24, Identity=67%"; Hit description=RNase H, putative
MKNAFDKKVCPCEFSEGDLVTKKVSYVQKDFRGKWALNYEGPFLVKKAFSGGALLLTKMDGEELPSLVNSDIVKQYYMYGFTERCLPRSLLEWGIFDINILIIQYACMFLLISALKGFIDSQESKSKVAARSIVFKPFKRVAGSHSSFSGIL

SEQ ID NO: 126975 - protein, 195 aa, Glycine max
  Coding DNA Sequence Number=SeqID_10197
  Homolog annotation: Hit_ID=Q2PMM5; Match level="QueryCoverage=100%, HitCoverage=8%, E-value=1e-100, Identity=93%"; Hit description =Protein ycf2
MSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTERSTRDQKLLKKEQKKHLVLSRRSENKEI

SEQ ID NO: 126976 - protein, 224 aa, Glycine max
  Coding DNA Sequence Number=SeqID_10198
  Gene Ontology: Mol. function=helicase activity; Biological process =viral genome replication
  Homolog annotation: Hit_ID=Q337N5; Match level="QueryCoverage=75%, HitCoverage=12%, E-value=4e-31, Identity=47%"; Hit description =Expressed protein
MMFAFTSTGIKLEKSINDKKGPPTIRIQGQPGHKIGSLLPMPRKEPKFAQLCISDIKNEVKNRINAMKQNTGIEVNIVPSLSQMLDEHNTHAKSFRMGRDRLTHNEVHDIILRLIANRQKDGCVYNVPTISEVDTLIEGDVDTCSGRDIILQNGYNTLYCFLTTKTDTDLAYFIYYITDLTYFIYYINWLEKKEESSYNQRGFAFRLQCRSNEAQTLLQSRKLF

SEQ ID NO: 126977 - protein, 64 aa, Glycine max
  Coding DNA Sequence Number=SeqID_10199
MASRDIILFGNNIVAVGTTSDNASPKEENRQEGAPAPMYPQFYAFEIFILINKKKKVVKALDLE

SEQ ID NO: 126978 - protein, 252 aa, Glycine max
  Coding DNA Sequence Number=SeqID_10200
  Pfam annotation: Domain name=Transposase_23; Domain location=92-162; Score=-17.1; E_value=0.086; Accession=PF03017.5; Description =TNP1ENSPM transposase
DVRKKAQAIQKQNTAPHVSSNTLDWLHGRPAALPPCLLKNYSSRPTNQGPARGVHHRKRDVTAHDIIQPDVVPDSIPGTCTASRASGNDPETSDLDRCGLYIEADPNCLVALGRVYEGSTIVHNTTLLPGQVKVGVEEVTDADAPVLVSTDEVSLVGQAIHTFLAWPILLVKSLSQQAVVSPAKPPQNPDPEVDDPLYLMTLTIPKLFLRPYQVTWDATMFEVFNPDFPLYIKHEDLSDILHDGQCLSISVL

SEQ ID NO: 126979 - protein, 100 aa, Glycine max
  Coding DNA Sequence Number=SeqID_10201
MTGDASKFTHISPKKSGYVTYGDNSKGRILGVGKIDILDEISESLEDMHIFMEKITKEKEMEIMKILKLMKSKQMMIFQENGELLDIILLTTSLVIYQKG

SEQ ID NO: 126980 - protein, 103 aa, Glycine max
  Coding DNA Sequence Number=SeqID_10202
MKGRRHTYGFNNNKREKAENKRIMGYPPASTPPPPPPPPPSPPPPSNASASPSAVKRTRKASRLRSLSTRPPGAERPVVHVDPATGKADGRIFRRRSLLLRRT

SEQ ID NO: 126981 - protein, 116 aa, Glycine max
  Coding DNA Sequence Number=SeqID_10203
  Homolog annotation: Hit_ID=Q00UP1; Match level="QueryCoverage=72%, HitCoverage=20%, E-value=7e-17, Identity=51%"; Hit description=[A] KOG4008 rRNA processing protein RRP7
MKHVKWKFRKTNTSANVEERKEKEALAAEGGWTVVVHHKGRKKTTDSESGIAVGSVAQAAVENKMTKKKHKEVGQDFYRFQRREAQRNEIMTLQSKFEEDKKRLQQMRAARKFRPY

SEQ ID NO: 126982 - protein, 408 aa, Glycine max
  Coding DNA Sequence Number=SeqID_10204
  Gene Ontology: Mol. function=triacylglycerol lipase activity; Cellular component=chromatin; Biological process=lipid metabolic process
  Homolog annotation: Hit_ID=O49523; Match level="QueryCoverage=96%, HitCoverage=93%, E-value=1e-110, Identity=52%"; Hit description =Lipase-like protein
  Pfam annotation: Domain name=Lipase_3; Domain location=134-296; Score= 172.1; E_value=1.4e-48; Accession=PF01764.16; Description=Lipase (class 3)
MDTIARKWRDLSGQSNWKGLLDPLDTDLRRYIIHYGQLAQAAYDAFNTEKASKCAGNSRYAMSDFFSKVGLENGNCFKYVVTKFLYATCKAGASESFILKSFNKDAWSQESNWIGYVAVATDEGKAALGRRDIVVAWRGTINAAEWVQDLHFHLDSAPLIFDDARAKVHHGFYSVYTSNKPGSEFNDTCVRHQVLEEVRRLVEEYNRKNEEISITVIGHSLGAALATINAVDIVAKGLNIPKDQPEKACSVTTFVFASPRVGNSHFAKIFTGHKHLRALRIRNETDVVPKLPLKHLFFLDGFSDVGEELVIDTTKSKYLKKEVSAHNLEVYLHGVAGTQGKNGEIFDLDESLRDIALLNKSKDALKDEYHCPVAWRVHENKGMVQQKDGTWKLMDHNKDGILFLHARL

SEQ ID NO: 126983 - protein, 339 aa, Glycine max
  Coding DNA Sequence Number=SeqID_10205
  Gene Ontology: Mol. function=triacylglycerol lipase activity; Biological process=lipid metabolic process
  Homolog annotation: Hit_ID=O49523; Match level="QueryCoverage=98%, HitCoverage=85%, E-value=4e-93, Identity=53%"; Hit description =Lipase-like protein
  Pfam annotation: Domain name=Lipase_3; Domain location=72-235; Score =187.2; E_value=3.9e-53; Accession=PF01764.16; Description=Lipase (class 3)
  Subcellular localization annotation: CTP_CleavageSite=58; ConfidenceScore=5.78e-01
MMLSTQKRHQSMPATADTLRKISFPKSSSTQLPKPATQKRFCSSPFRRTRGASNRTVATDAGKEALGRRDIVVAWRGTIQAAEWVKDFHFHLDLAPEIFGGDSSAQVHHGFYSLYTSSNPGSKFTDTSARNQVLGEVGRLVEEYTSKNEEISISVTGHSLGAALATLNAVDIAAQGLNIPKNQPQKAFPVTAFAYACPRVGDSSFEETFNGYKDLRSLRIRNVTDIVPITPFLGFSDVGEELVIDTRKSKYLKSGVSAHNLEAYLHGVAGTQGEKGGFNLEVNRDIALVNKSMDALKDEYLVPVAWRVQENKGMVQQSDGSWKIVDQVHDDMESIHSNL

SEQ ID NO: 126984 - protein, 202 aa, Glycine max
  Coding DNA Sequence Number=SeqID_10206
MATCKYLTASKAFGSGLSMYIPHMAKGQGELKLWRLSGRMHGMSANSWHPRTTFVARERPPVWKLQIPSWSSLMTKSAHGLFGHLSRGGHPVWFLLFNGHNFFSVYGGSLECLLDDSLEVPGLFSAVRPIGWCMWESLKLFGVLIVRQGLYLPQLLLMALLHLHSAILELLKSICVCHSYWWEVGAFERDLASEARLSANHG

SEQ ID NO: 126985 - protein, 231 aa, Glycine max
  Coding DNA Sequence Number=SeqID_10207
  Homolog annotation: Hit_ID=Q1SIS3; Match level="QueryCoverage=30%, HitCoverage=17%, E-value=5e-14, Identity=61%"; Hit description =Peptidase M14, carboxypeptidase A
  Subcellular localization annotation: CTP_CleavageSite=70; ConfidenceScore=5.71e-01
MGSFSSSSLFLLFFLFSSSHSKVLILKSRFWSSPLPVFLQVLPFSKRYGSGVRHREERRRGCVDGRDEVVAGLILCLIQEECEFDELSSQDRISHSKSTPNPLPPTPIVHKHTKSKKKRSNFEEDGSISCNKCRPHSCDKIFILPLDPIIMATFISIKIYVRCVSGEEKKMAIILRACKKLMSVQFSREPKKMVTGTTHMGDPKEEQLFLGERVRKGHSECAVQQRAQKSL

SEQ ID NO: 126986 - protein, 266 aa, Glycine max
  Coding DNA Sequence Number=SeqID_10208
RAYIYLGCNTENKRGYISCGSVQVECTSTWLFKENKGGYIPCGSLLVKDFTWLLKISRTGGCLGTGCRHRFDFNLVKGLVTHLVGIPYALQSFSPDACKEVMRSNYELHLIEGLVTQSDNGGLRGYLGFCRNAYQGWTLDHIRDMFVPSFDKLVGLRWGLPRMNLRFYEPLARTRDLVLCSCIRDTLKVARIGGVMSSSCKCATHCRWHILETWCRARAYVSLVVGGTYWRLSGLPSWDQAFPLGDPFWLHLGLAVRGHQVEKPVV

SEQ ID NO: 126987 - protein, 335 aa, Glycine max
  Coding DNA Sequence Number=SeqID_10209
  Gene Ontology: Mol. function=sulfotransferase activity; Cellular component=integral to membrane; Biological process=catecholamine metabolic process
  Homolog annotation: Hit_ID=Q1RZ79; Match level="QueryCoverage=98%, HitCoverage=98%, E-value=1e-120, Identity=59%"; Hit description =Sulfotransferase
  Pfam annotation: Domain name=Sulfotransfer_1; Domain location=68-332; Score=325.0; E_value=1.3e-94; Accession=PF00685.17; Description =Sulfotransferase domain
MPTEAESSVTPKYLQENELSQECKEVISTLPMERGWVASHLHQYQGFWHTTRQLQGVLSCQKHFKALDTDVLIVSTPKSGTTWLKAWTFSLLHRNQHDPNTQNQNHPLLFNNPHFLVPFLELDLYIDDNTLPDLTSLITSPRLFSTHLPYVSLPKSVQESACKIIYLCRDPKDAFISLWHFTNMLRPKSRGMNSLQEAFDKFCRGVSLYGPFWAHVLDYWQKSLSEPNKIMFMRFEEMKMKPRLVLQELATFVGCPFSKEEEEAGVVDHILKLCSFDNLSNLQVNKNGKLSSGEEHKAFFRCGQIGDCKNHLTAEMIQQLNTITQEKLAEHGLRF

SEQ ID NO: 126988 - protein, 318 aa, Glycine max
  Coding DNA Sequence Number=SeqID_10210
MPRDKQALEYGQALPNVESGNLNKCENSRRVWHMCSTLAYVSLVEWTHTGVIVNSLASALICLKFKPFNEELLTLVKRVDKAILEQFLASLEAQAILSLFSASDPLVALNGIMGDFVWRPIVKQVGPTGSVVPSSATDGLVAAKIVPSAPSSVLVKRKQDDGVGLLGCKKLRALSSLCALRQATGLTLDSGRPSSVQDAISVVAEVIAATALASSDVALSSIVVALLLSVGVATTNAPMTPPPSSSAPMGIGYKPEQKTSVGFVSAFDKNLIKSNRFQHVKDSAKVFLQQSLTILEENRQRHQEALNKVASLEAEAAK

SEQ ID NO: 126989 - protein, 140 aa, Glycine max
  Coding DNA Sequence Number=SeqID_10211
MGKLDHLEERLRAIEGGEDYSFANLEELFPIPNIITPLKFKVLNFDKYKGITCPKNHLKMYCRKMGAYAKDEELLIHSFQESLTGNTPEGGEPGSSSGTSMMKKTMTMIVDTLPVFYYGKWWATHVQSFANLVFASERID

SEQ ID NO: 126990 - protein, 40 aa, Glycine max
  Coding DNA Sequence Number=SeqID_10212
MAELRVEKLHDIFSSEAGVGMTVRAQQQRRDDVSDGGLMR

SEQ ID NO: 126991 - protein, 169 aa, Glycine max
  Coding DNA Sequence Number=SeqID_10213
MPLKNDMDVNIMLMYNDQFSFVGPIELLCTVGRTTDAILNLLERLSIPTHDAILYYNERWNMPRQNNFVGCSIDQLKDLIKQVAPKGNPPHGIHESQVVRRLFYRQPSHLEYSEKILEFKIVELKCDNDAMKVLVESNYWKQFVPIEILALFSKVVMVNEDDVVTSLRD

SEQ ID NO: 126992 - protein, 93 aa, Glycine max
  Coding DNA Sequence Number=SeqID_10214
MKQLNRKGIGKPIILLAKSSNSFRNRGGVVRDWCGVGRGGGRHRSKAIEKLVHFKGHRVHGIVKTSKGIIEVVGDHKDKREHQMLRTKHNAGN

SEQ ID NO: 126993 - protein, 32 aa, Glycine max
  Coding DNA Sequence Number=SeqID_10215
MARIVGDAEVEEEHLVSEDENELSDADLGNDE

SEQ ID NO: 126994 - protein, 112 aa, Glycine max
  Coding DNA Sequence Number=SeqID_10216
MIPASSSLLHHVFLHHIKDGRIQPPLWLPYRPGFILLKYSMHAYGRINSRKVVVSALGKVAKWCKAKEGPHGPSRFFLQKVVASGGSNLAGLGELSSPGRAGWQAPPLFCYK

SEQ ID NO: 126995 - protein, 148 aa, Glycine max
  Coding DNA Sequence Number=SeqID_10217
  Gene Ontology: Mol. function=DNA binding; Biological process=DNA integration
MPSCLCNTPSTFQSLSKVLDRCIETNPILNFEKCHCIVHEGIVVGHLVSSRGIEVDKAKIDVSIGDSSRILARLHYHCPSFSKSDEDMTKSKGKDPLEGLGGPMTRARARKAKEALQQVLSILFEYKPKFQGEKSKVVSCIMAQMEED

SEQ ID NO: 126996 - protein, 65 aa, Glycine max
  Coding DNA Sequence Number=SeqID_10218
MAHIKKFNHILTNCASSRKLRSADKEQKKNPRPKEKNDRVSICAFRTSSVFREHVWCSKRGIEGK

SEQ ID NO: 126997 - protein, 218 aa, Glycine max
  Coding DNA Sequence Number=SeqID_10219
MIQGGFPPYMLGTGRQIMFWGKTSYLRGRRNFHKRLTNLVDGSIDLALVKEFYANLYSSEGPSPKQSRVRGHLVKIDVDNLNIFLETPVVLAKALTFERLSPIINLAYIRKNCWNPEDLTVSIRGARRARARPAELHSTSTAPTLASTSSTPSIPAQIDSQRFEAMLQSIHQEQIILLQSLQVAAPPGSIPSVEHFREMVAWPGTQPFLHKEDEGPIA

SEQ ID NO: 126998 - protein, 130 aa, Glycine max
  Coding DNA Sequence Number=SeqID_10220
MAPKKLSTKRSRRDATGEGSSAASEERRVQLREDEYTDFQEEIARRRWTPLVTPMAKFDPEIVLEFYANAWPTEEGVRDMCSWVRGQWIPFDVDALSQFLGDPLVWEEGQQCEFSQRRNKVDGFDEEAIA

SEQ ID NO: 126999 - protein, 128 aa, Glycine max
  Coding DNA Sequence Number=SeqID_10221
FKVSDFDKYKGTTCPKNHLKMYNRKIGAYSENEKLLMCFFWESLIGAAVTRDLAAQVAPSIMEREMIKMIVDTLPVFYYEKMVGYMPSSFVDLVFTNERIEVGLRREKFDYPALMNRKPRANGENKKE

SEQ ID NO: 127000 - protein, 385 aa, Glycine max
  Coding DNA Sequence Number=SeqID_10222
  Gene Ontology: Mol. function=protein serine/threonine kinase activity; Cellular component=anchored to membrane; Biological process=protein amino acid phosphorylation
  Homolog annotation: Hit_ID=Q9M0X5; Match level="QueryCoverage=66%, HitCoverage=36%, E-value=4e-28, Identity=30%"; Hit description =Receptor protein kinase-like protein
  Pfam annotation: Domain name=DUF26; Domain location=170-224; Score =59.6; E_value=1.1e-14; Accession=PF01657.8; Description=Domain of unknown function DUF26
  Pfam annotation: Domain name=DUF26; Domain location=288-343; Score =46.8; E_value=7.1e-11; Accession=PF01657.8; Description=Domain of unknown function DUF26
  Pfam annotation: Domain name=DUF26; Domain location=39-92; Score =43.7; E_value=6.3e-10; Accession=PF01657.8; Description=Domain of unknown function DUF26
  Pfam module annotation: Pfam domain module=DUF26::DUF26::DUF26; Domain location=170-224::288-343::39-92
MSVFSKTINEVADEAANSTVGAKKYATKEARISGGFQSLYCEAQCTPDLSPQDCRKCLNVSIANSQQFCEGLASPVSSPSCSIRSDVYPFYRPSTALAPTGEVSTNFSSTDSQHPAYLSHNCSSNETMITTDRAFLSNLKSLLSSLSSNVTTKTGFSKTTVDGKNPSDTVSGLFMCRGNLSTILCQQCVLNATQRISSECPSSKEAIIWYNHCLLRYSNNPSSLISTVDTTPTYQNFSIVNTSNPNQLQSFFTWTMATALPEVKSVIEDSTIKNYGTKEVKLNDQQTLYTLAQCTPDLSNGACGSCLDKIFKYEIPWCCLASPEGKVLSPSCYIMFGLSPFYTDDDRVEAYRQPSPPPTTAGDVPIQAIFSCKHRLINQLSKLWY

SEQ ID NO: 127001 - protein, 94 aa, Glycine max
  Coding DNA Sequence Number=SeqID_10223
MVVQSRRRCAVTPALRNGVHFVYAAAARGGVETVGVESLGGDDGQRNVKVLAVPADGCVVSDIVVGVTEVVEVLGSFVGVYLRYDCGYEKETEY

SEQ ID NO: 127002 - protein, 122 aa, Glycine max
  Coding DNA Sequence Number=SeqID_10224
  Gene Ontology: Mol. function=nucleic acid binding; Cellular component= cytoplasm; Biological process=DNA integration
MYLYILHSKDEALDAFKVFMAEVEKQCGKQIKILRSNRGGECYGRYMENGQAPGLFAKFLQEHEIVAQYTMSGFPNQNGVEERRNQNFMEMVRSMRSNRKLPKFLWIEALKTNVYILNRVPT

SEQ ID NO: 127003 - protein, 102 aa, Glycine max
  Coding DNA Sequence Number=SeqID_10225
MLSISGTDDIGDSWGDLTLTNEVNALLKRFSQLGVGGLRTPSVSRKDANNKKRTKKIPYMNEFPNPLQQFIVKNVEVRPDGNYGYKIIAALLGQGEESWALV

SEQ ID NO: 127004 - protein, 133 aa, Glycine max
  Coding DNA Sequence Number=SeqID_10226
MRGHLMVTRTFPQQGEKEPVDARRLTSSSAPFVVLTPEVNDMRGYLLVNGTFRQPGANEPVDARRLTSSSAPFVVLTREVRTFRQPGENKPVDAQRLTSSSSPFIVLTREVKWHAGLPYGYPHLSSTRGKRAR

SEQ ID NO: 127005 - protein, 90 aa, Glycine max
  Coding DNA Sequence Number=SeqID_10227
MEEAAQSRSTDTMIDPPSSIRQHNSLEEQASQGSFDAHGRQDVLTAAIERPEHPGRGVLLELVSRSSNTLDWLQGPLARIPPWLPKTWSS

SEQ ID NO: 127006 - protein, 75 aa, Glycine max
  Coding DNA Sequence Number=SeqID_10228
MEYDSLSRCLGGEMVDTRDSKSRAKERGGDLSIEKIHRPETKRKKVKPMIRYWEQIATTISSGKSHLFLHNVFVI

SEQ ID NO: 127007 - protein, 93 aa, Glycine max; identical to SEQ ID NO: 126928
  Coding DNA Sequence Number=SeqID_10229
  Gene Ontology: Mol. function=serine-type endopeptidase activity; Cellular component=chloroplast; Biological process=proteolysis
  Homolog annotation: Hit_ID=P56772; Match level="QueryCoverage=79%, HitCoverage=38%, E-value=1e-33, Identity=94%"; Hit description=ATP -dependent Clp protease proteolytic subunit
  Pfam annotation: Domain name=CLP_protease; Domain location=3-93; Score=-3.9; E_value=3.5e-08; Accession=PF00574.13; Description=Clp protease

SEQ ID NO: 127008 - protein, 164 aa, Glycine max
  Coding DNA Sequence Number=SeqID_10230
  Homolog annotation: Hit_ID=Q14UU8; Match level="QueryCoverage=80%, HitCoverage=25%, E-value=3e-08, Identity=28%"; Hit description =Putative aluminum activated malate transporter
ANFAKWEPWHGKFGFSYPWGRYLKIGEVLRELAAFILAAGHCLEASKEPMASLRQSQWVHLETCEAVETKVVYILRELGESMKQMRKCDAKDNIWDQLKNAREDLSLIISTSKMVELEDCQVLAIASFVFLLMEVVGKVEELVKEVEELGDIAGFRTTTTSLSS

SEQ ID NO: 127009 - protein, 96 aa, Glycine max
  Coding DNA Sequence Number=SeqID_10231
MSGLIRDSPQISASPHQLDFAPYASGSYNAQWHVPKFLHDMRMLRSSRILGEMEVEEPWLGLWLPLNYRVGFVVDLGMAFVDNWVVGKEKGCLLAE

SEQ ID NO: 127010 - protein, 62 aa, Glycine max
  Coding DNA Sequence Number=SeqID_10232
MSFKESTPLCTRIGSLYGWTEGLSQTRFNSFFAGIPACLVEVSRVSTADPISLVKKSFPIFH

SEQ ID NO: 127011 - protein, 510 aa, Glycine max
  Coding DNA Sequence Number=SeqID_10233
  Gene Ontology: Mol. function=thymidylate synthase activity; Biological process=nucleotide biosynthetic process
  Homolog annotation: Hit_ID=Q8ZHV1; Match level="QueryCoverage=48%, HitCoverage=94%, E-value=1e-128, Identity=85%"; Hit description =Thymidylate synthase
  Pfam annotation: Domain name=LGT; Domain location=1-184; Score=195.3; E_value=1.5e-55; Accession=PF01790.9; Description=Prolipoprotein diacylglyceryl transferase
  Pfam annotation: Domain name=Thymidylat_synt; Domain location=167 -438; Score=478.3; E_value=9.1e-141; Accession=PF00303.9; Description= Thymidylate synthase
  Pfam module annotation: Pfam domain module=LGT::Thymidylat_synt; Domain location=1-184::167-438
MSFHGGLIGVIVVMLIFARRTKRTFFQVSDFIAPLIPFGLGAGRLGNFINGELWGRVAPDFKFAMLFPGSRSEDLALAANNPQYQELLNTYGVLPRHPSQLYELCLEGIVLFIILNLFIRKPRPMGSVSGLFLIGYGAFRIIVEFFRQPDAQLGLFEGGISMGQILSIPMILAGVIMMVWAYRRRPQQQTQKADRTGTGTLSIFGHQMRFNLQDGFPLVTTKKVHLRSIIHELLWFLKGDTNIGYLKENKVTIWDEWADENGDLGPVYGKQWRSWGNASGEEIDQISKVIEQLKRDPDSRRIIVSAWNVGELDQMALAPCHAFFQFYVANGKLSCQLYQRSCDIFLGLPFNIASYALLVHMVAQQCDLEVGDFVWTGGDTHLYSNHLEQARLQLTRETRPLPKLVIKRKPASIFDYQFDDFEIEGYDPHPAIKAPAQSAGYEQNPKRRLYAAGTAAGYGDCRHPQHRSLTGLAALATPVAAAGRKRLPRHRAAARRRVSAAVALAVPATL

SEQ ID NO: 127012 - protein, 153 aa, Glycine max
  Coding DNA Sequence Number=SeqID_10234
MIVNQQVKVPFSIGTYKDEVNFDIVPMEIIYNGLTNEITFTHLDTKFVLHPQTPSQKKEKKKKDSKALSSKANGKEKEEKNSSKKTVKKENHFATKCDIKRALLLKQSFYLLLSRETSLSTAISLEFEVIPQVKELLDEGLVRKSLTPCTLLV

SEQ ID NO: 127013 - protein, 141 aa, Glycine max
  Coding DNA Sequence Number=SeqID_10235
  Homolog annotation: Hit_ID=Q9ZP87; Match level="QueryCoverage=35%, HitCoverage=16%, E-value=4e-11, Identity=60%"; Hit description =Epoxide hydrolase
MIAAANAGYRAIAFDFRGYGLSEHPAEPQKANLLDLVDDVVGPLDSLSITKEAGRAEADFVRFDVKSVIRNIYTFFSRSEIPIIGDNQEIMDLYDPTTALPLGVEMSQAKPSFIRLELGLLPVIGFFLRLGSAYIKAWLGP

SEQ ID NO: 127014 - protein, 188 aa, Glycine max
  Coding DNA Sequence Number=SeqID_10236
MAESSRSKSNMDHIKDVIAHLSNKLEDLCQKVIWRQARIRRHYPQPISIHFTRQLPLFINQLFSYHDTPELDRLTIASFYMEGPVLAWFQWMSRNDQLSSWPGFLQELEARFAPSQYEDPTDTLFKLTQRGTITEYFSEFESLANCIVGLPPTFLLRCFVSGLAPEIRREVQALQPLTMVQATTLAHL

SEQ ID NO: 127015 - protein, 143 aa, Glycine max
  Coding DNA Sequence Number=SeqID_10237
  Gene Ontology: Mol. function=chromatin binding; Cellular component =chromatin; Biological process=chromatin assembly or disassembly
MASPMDFQGPPRVFGPHRFLPPLYQRVCNHGSPLDSSIDHSSIGLDNRSSDRLPEAERRHELCANSTTSEFLSVIHGGDRCVGYRDENSPLSVSLKKLMNQTIQTPEQQLYLVHLLGYDYTIKYRSGKSNTVADALSQAFEDS

SEQ ID NO: 127016 - protein, 135 aa, Glycine max
  Coding DNA Sequence Number=SeqID_10238
  Gene Ontology: Mol. function=RNA-directed DNA polymerase activity; Cellular component=chromatin; Biological process=RNA-dependent DNA replication
MSHFSSLVLLVKKHDGSWHFYANYRALNAITIKDRFLIPTVDELLDELGGAQWFLKLDLLQGYHQILMKEEDINKMMFRIHHGHYEFRIVPFGLCNALSSFQATMNDTFRPYLHKFVIVFFDDILIYNKTRTDHL

SEQ ID NO: 127017 - protein, 93 aa, Glycine max
  Coding DNA Sequence Number=SeqID_10239
RRHGIRRRSPAGCRGGIPRRRGLSCSSFRLLDRCGELVEGGVPPDVGLGVRGLEVNVLPADAPDDPPASTESDHVADSVPDDVDVELGRAAVR

SEQ ID NO: 127018 - protein, 224 aa, Glycine max
  Coding DNA Sequence Number=SeqID_10240
STLEDPTTRKNHADCPGHAGHVTGWNPEDLAIEYVCTDYAAHGHAYASSAPKELTAEEKQAKADDEAQQAAMLANREARRHWIHDLLPGKINQLAGVYDYMAAALLRHDDWNNDGRAPTVTMALLDIDVPDDYYKRRGAMDDLVLSKKIAPFRLMLATAFGIHELMLEQGREAVGRVRHFTQLEKWGYPLSEIDQTALAEAQEQLNAAAARLAAEAEVDEDDAA

SEQ ID NO: 127019 - protein, 56 aa, Glycine max
  Coding DNA Sequence Number=SeqID_10241
MRIASRNVVLSEQISRLVCGLDIDALPDSSVALSELSPNGELSATTTFSTSRLSLI

SEQ ID NO: 127020 - protein, 90 aa, Glycine max
  Coding DNA Sequence Number=SeqID_10242
MVAITPARFPQPPFFRGYDSNAMCAYHGGAPGHSIEHCITLKRKDFQVYAIIVNHSYNAKMDEFDVLVSLILSLTHLCLFNFHWNVSVSH

SEQ ID NO: 127021 - protein, 69 aa, Glycine max
  Coding DNA Sequence Number=SeqID_10243
MSEAAKEIADKIGSFVPHGHQEVLTAAIGRAEHPGRVRAAGIGITIKKYFGSAPRMSCNSSSLPPEDLQ

SEQ ID NO: 127022 - protein, 324 aa, Glycine max
  Coding DNA Sequence Number=SeqID_10244
  Homolog annotation: Hit_ID=Q1SKD7; Match level="QueryCoverage=72%, HitCoverage=61%, E-value=3e-22, Identity=30%"; Hit description =Ankyrin
MAPKKLSTKRSRRDATEEGSSAASEFDSHRFRSAEHQQRFEAIKGWSFHRERCVQLREDEYPDFQGEIARRHWAWLVTPMAKFDPEIVIEFYVNAWPTEEGVRDMRSWVRGHWVPFDADAINQFLGDPLILEEDQQCEFSQIRSQENGFDEEAIAQLLCIPGQDFTWTAAGRRVQIMRTSMTTLTQIWMTLLLNNVLPNDHNSDLPLPKCQLVYAILTRISVHMAQVIADATYLFAGMTPTRHPLDLEKSNRALGFPALITGLCQSYGVPITPSKVIRPPITRSFIEKYCMPRQTQGDAHQDAGAPPPPQQADSDGPLGVEWYL

SEQ ID NO: 127023 - protein, 669 aa, Glycine max
  Coding DNA Sequence Number=SeqID_10245
  Gene Ontology: Mol. function=sucrose synthase activity; Biological process=sucrose metabolic process
  Homolog annotation: Hit_ID=Q9FX32; Match level="QueryCoverage=83%, HitCoverage=61%, E-value=0.0, Identity=72%"; Hit description=Sucrose synthase, putative
  Pfam annotation: Domain name=Glycos_transf_1; Domain location=312 -502; Score=103.5; E_value=6.3e-28; Accession=PF00534.10; Description= Glycosyl transferases group 1
  Pfam annotation: Domain name=Sucrose_synth; Domain location=1-309; Score=290.2; E_value=3.9e-84; Accession=PF00862.10; Description =Sucrose synthase
  Pfam module annotation: Pfam domain module=Glycos_transf_1::Sucrose _synth; Domain location=312-502::1-309
FKEWGFDKGWGNTAGRVKETMKLLSEVLESADPVKLESLFSRLPNMFNIVILSIHGYFGQADVLGLPDTGGQVVYILDQVRALEEELLHKIELQGLDVKPQILVVTRLIPDAKGTTCNQELEPVTHTKHSNILRVPFYTDKGMLHQWDATAKILELMEDKPDLIIGNYTDGNLVSSLMASKLGVTQATIAHALEKTKYEDSDAKWMAFDEKYHFSCQFTADIISMNAADFIITSTYQEIAGSKQKPGQYETHTAFTMPGLCRAVSGINVFDPKFNIAAPGADQSVYFPSTEKEQRLIAFHPAIEELLFSKDDNEEHIGFLEDMKKPIIFSMARLDKVKNLSGLVEWYARNKRLRSLVNLVVVGGFFNPAKSKDREETEEIKKMHFLMKEYNLKGQFRWIAAQTDRYRNSELYRCISDSKGAFVQPALYEAFGLTVIEAMNCGLPTFATNQGGPAEIIVDEVSGFHIDPYNGDESSDKIADFFEKCKIDSEHWNRMSKAGLQRINECYTWKIYAKKVLNMGSIYGFWKRLNKEQKLAKERYNHMFYNLQFRNLAKQVPIPSERPQDPTQMPKPSAPAPSRRPAAKARPKKVSEHGIVGAPLTLLTAAATPKIKDHPTTSGEGVSARTATSEQSGGGGGLFGLRWLVSIISFLCAIHYLLKNLDRLFTREQ

SEQ ID NO: 127024 - protein, 236 aa, Glycine max
  Coding DNA Sequence Number=SeqID_10246
  Gene Ontology: Mol. function=sucrose synthase activity; Biological process=sucrose metabolic process
  Homolog annotation: Hit_ID=Q9FX32; Match level="QueryCoverage=98%, HitCoverage=24%, E-value=2e-79, Identity=59%"; Hit description =Sucrose synthase, putative
  Subcellular localization annotation: CTP_CleavageSite=52; ConfidenceScore=5.14e-01
MASTASNSALKRSDSITDSMPEALKQSRFHMKRCFARFVASGKRLMKQQHVMDDAEKTVEDKVERKKLLDGMLGYIFSCTQEAAVVPPYIAFAVRPNPGFWEYIKVNADDLQVEGIEAVEYLKYKEMIFDEKWANDENALELDFGAIDFSTPRMVLSSSIGNGLNFTTKILTSRLSESSQNINPLLDYLLSLNYQGENLMIKDTLNTMPKLQQALKVAEAYVSALHKDTPYQKFED

SEQ ID NO: 127025 - protein, 68 aa, Glycine max
  Coding DNA Sequence Number=SeqID_10247
MGKQAHRCTETNIIFCTFCRPDPLKSGDLRGYLRVSRTFGQLGGNEPVDTRGQTSSSAPFVVLTREVR

SEQ ID NO: 127026 - protein, 152 aa, Glycine max
  Coding DNA Sequence Number=SeqID_10248
  Gene Ontology: Mol. function=DNA binding; Cellular component =chromatin; Biological process=DNA integration
  Homolog annotation: Hit_ID=Q1S785; Match level="QueryCoverage=99%, HitCoverage=22%, E-value=2e-24, Identity=36%"; Hit description =Integrase, catalytic region
MIIEESIHVAFDETNAILPRKNILDDILESLEEMHIHGEDHKGKGEGNDEDFHIHETKTNADLPREWKTSRYHPVDKIIGDISKGARLVAKGYNQEEGIDYEETYAPIARLEVIRMLLAFASIMDFKLYQMDVKSAFLNGFIQEEVYVDQPP

SEQ ID NO: 127027 - protein, 403 aa, Glycine max
  Coding DNA Sequence Number=SeqID_10249
  Gene Ontology: Mol. function=indolepyruvate decarboxylase activity; Cellular component=cytoplasm; Biological process=branched chain family amino acid catabolic process
  Homolog annotation: Hit_ID=UPI00005F86E5; Match level="QueryCoverage =72%, HitCoverage=52%, E-value=5e-90, Identity=55%"; Hit description =COG3961: Pyruvate decarboxylase and related thiamine pyrophosphate -requiring enzymes
MQQFERRYPEIELEWMIAEDGDVIDLLQSGRAHLGMVELSAAAGDGGTGVRLGGIAALAGATIRPQYADRAAAARLAENDLGGCGMVKTDPAGPGGVLGAEAPAGRFPALSGGVARLDGARNGVEQLGNVHLRQHHFNEGQPIAVGYLAQRLAQAVRIADPQRLHRPLAGQRRRQLRPVPARDVVITLLRPVDGALDGISLIIQHEDHRFKPVAQHRTQLLHGQLRGAVANQQHCPALRFGGLHAERRRQGIADRSPERLHDQPAAARQRQRRRTKTGGALIGQHDIPGPQEILHLPPEGVLIQPFSIAFRQRRADDRRQRPTRRQRQAQAMQRLHRLAHRNAAKALPPDPGFERLNVDTFFHRQMMRETSGNGVGQTHADVDHHIGVFDKLFHRRIAGTAAV

SEQ ID NO: 127028 - protein, 97 aa, Glycine max
  Coding DNA Sequence Number=SeqID_10250
MWIMHCFNDVEKKSLDCHHQKGGECECMMILMMPKKNQTRPLQRISIFFKINSRLLQQTKPCFKIHQRSSLASKQRVSKSCKALVIDYQKGRMKKSC

SEQ ID NO: 127029 - protein, 70 aa, Glycine max
  Coding DNA Sequence Number=SeqID_10251
  Gene Ontology: Mol. function=ribonuclease H activity; Biological process=DNA integration
  Homolog annotation: Hit_ID=Q1SYR3; Match level="QueryCoverage=97%, HitCoverage=2%, E-value=7e-22, Identity=68%"; Hit description=RNase H, putative
VRTRRFSEGDLVLKKVSQALKDNRGKWAPNYDGPFVVKRAFSGGALVLTHMDGEELPSPVNSNVVKRYYT

SEQ ID NO: 127030 - protein, 90 aa, Glycine max
  Coding DNA Sequence Number=SeqID_10252
  Subcellular localization annotation: CTP_CleavageSite=62; ConfidenceScore=5.50e-01
MSTYVRLVDQTIRLPLLSASLQGLLSSSFRPGQAFSLSRFGLGRCAPATSWQKSRLMGKPPPAAMVWGVRGCCPVANSKGLKFDAELFGC

SEQ ID NO: 127031 - protein, 111 aa, Glycine max
  Coding DNA Sequence Number=SeqID_10253
  Homolog annotation: Hit_ID=Q1S9T4; Match level="QueryCoverage=95%, HitCoverage=10%, E-value=4e-07, Identity=34%"; Hit description =Integrase, catalytic region
  Subcellular localization annotation: CTP_CleavageSite=32; ConfidenceScore=5.16e-01
MKAFSSVSAYCQHLKSLLNQLKNAGFSVDNTRSMLVLEEFGLKKAAQTSSSAIVARDSNESQEMSDHSSACCTNNGGKRYSNHGNSRKNRNNTGGHDNSGVDKGGSGSKTY

SEQ ID NO: 127032 - protein, 126 aa, Glycine max
  Coding DNA Sequence Number=SeqID_10254
MDKSLKVGEDEWRERERRSTKFCASNESRCPKIQGLKNPAFLGYHMMQSYPARTLDRKLQVDWARDPREGPRVLMNVFSLAILPHIRVTTLFESVSSTPEPSSYSTPFNFPSIPIIHNPLSNSVGS

SEQ ID NO: 127033 - protein, 71 aa, Glycine max
  Coding DNA Sequence Number=SeqID_10255
  Pfam annotation: Domain name=zf-CCHC; Domain location=38-55; Score =11.0; E_value=0.015; Accession=PF00098.13; Description=Zinc knuckle
MRLRVLLDVRKSLVKSLKLKKPGGEAKDVLIKYEKLGSSCYLCGLLGHVDDSCRKILIMSIDYIWSSRMGP

SEQ ID NO: 127034 - protein, 227 aa, Glycine max
  Coding DNA Sequence Number=SeqID_10256
  Gene Ontology: Mol. function=cysteine-type endopeptidase activity; Cellular component=integral to endoplasmic reticulum membrane; Biological process=proteolysis
  Homolog annotation: Hit_ID=Q8GYI6; Match level="QueryCoverage=47%, HitCoverage=28%, E-value=8e-47, Identity=84%"; Hit description =Putative GPI-anchor transamidase
MLHSPGVLAIGSSKKGENSYSHHLDSDVGVSVVDRFTFYTLAFFERLNMYDNASLSSLFNSYNPNLLMSTAYYRMDLYQCHLEEVPVTNFFGSVMKTIHTDSAYRSRSNKKIGAAKTKMSPDESISDSDSDEEDQFNNLTAEVNLIYASFRLLLQFKLFHVKLKIMDTGFALQKYLQYSVGQLWSVILSNANTFESIDSLVCYGLLLMLPLLIFSTWLSKYDWGNIP

SEQ ID NO: 127035 - protein, 165 aa, Glycine max
  Coding DNA Sequence Number=SeqID_10257
MEHSSANIIVDSVSKNDHEAIIATDSCPKRANPLSMPINTTNINAQRTDQPSTLNQSTMTQPTIDAMNVEGNHTNELIIGDKKRHLTDGSSNMDVNETNLVQPSKNTIAPVSNSSFPYIPFLMVGPGNRIRQGLLDETRPTYIVQFSVSMKGDVVEPINPMALIG

SEQ ID NO: 127036 - protein, 101 aa, Glycine max
  Coding DNA Sequence Number=SeqID_10258
MGTIAPVEDGCFDGKVRDYGGESGRVPSSSFGEKLRHVLGIDIDSESLEIASDNAEELEVLSLCLLLCFFKLLGLALNLQDCYVGEFGKEVCESKASYFKW

SEQ ID NO: 127037 - protein, 73 aa, Glycine max
  Coding DNA Sequence Number=SeqID_10259
MIGGVCIREGNVPKTPKQCGKEGTTTEDGTTTCRHQRRALRWKAVVGSAVTRHGTTVGLRSLRECKWNTKKCR

SEQ ID NO: 127038 - protein, 134 aa, Glycine max
  Coding DNA Sequence Number=SeqID_10260
MGDLEEVQEQMKADMSTLKEQMASMMDAMLGMKQLMESNAATVAAVSSAAEVDPTLQTNAHHPIPNMVGRERSTPGHINNPHPGYNRGTYPYGLPPNYTPPAIHDDVGHVPPLILEGEPPRHLDGVHENPREHA

SEQ ID NO: 127039 - protein, 117 aa, Glycine max
  Coding DNA Sequence Number=SeqID_10261
  Gene Ontology: Mol. function=serine-type peptidase activity; Cellular component=membrane; Biological process=signal peptide processing
  Homolog annotation: Hit_ID=Q1T541; Match level="QueryCoverage=73%, HitCoverage=55%, E-value=7e-25, Identity=63%"; Hit description =Peptidase S24 and S26, C-terminal region
MDWVSKTIKPMQFRQNLTELISVGLIASFTLVMWKGLMCVTGSGTPVVVVISGSMEPGFRRLMILLQGDILFLHMSKDPIRAGDIVVYNLDKSGKIEKYLQYYMARHIDMLGLRIYF

SEQ ID NO: 127040 - protein, 105 aa, Glycine max
  Coding DNA Sequence Number=SeqID_10262
  Subcellular localization annotation: CTP_CleavageSite=99; ConfidenceScore=5.19e-01
MRMSPPPLEPHNHSQTQLKLSGQIPLQAPFSAGGLVGACMLSTTLARLAHISEFWLSARLFAQRMDSSGALSGIIPRSTNMHCSSFFQILPRTQPKECCAQQMAR

SEQ ID NO: 127041 - protein, 427 aa, Glycine max
  Coding DNA Sequence Number=SeqID_10263
  Gene Ontology: Mol. function=transferase activity; Cellular component= membrane; Biological process=hydrogen transport
  Homolog annotation: Hit_ID=Q8LAQ2; Match level="QueryCoverage=84%, HitCoverage=95%, E-value=1e-135, Identity=63%"; Hit description =Putative choline kinase
  Pfam annotation: Domain name=APH; Domain location=111-343; Score =42.1; E_value=1.9e-09; Accession=PF01636.13; Description =Phosphotransferase enzyme family
  Pfam annotation: Domain name=Choline_kinase; Domain location=134-335; Score=232.8; E_value=7.7e-67; Accession=PF01633.10; Description =Cholineethanolamine kinase
  Pfam module annotation: Pfam domain module=APH::Choline_kinase; Domain location=111-343::134-335
MTNWDRGSIVNATLRGLCVLPISVISWDNKKSTQEEEEEETETPLARFEKVKIWNPVEVAEQARHDYASQIHPSHLTIDPSLELPQMTPLVLKLCKDMFKAWSNLDDSCFVVEKISGGITNLLLKVSVKQENCIEETITVRLYGPNTEYIIDRQRELQATKYITAAGFGAKWLGIFGNGMVQSFINAHTLSPSDMREPKLAAKIAKQLQRFHHVEIPGSKEPQLWNDVWKFFEKASVLEFDDSKMQKTYETISFKEVHDEIVELKGLCDLLKSPVIFAHNDLLSGNIMMNCEEDKLYFIDYEYASYNYRGYDIGDHFAEYAGFECDYDLYPNMNEQYHFLRHYLKPERPQEVSEKDLETLYVEANTFSLASHIFWALWGLIQAKMSAIEFDYLGYFFLRYHEYKRHKEKYFLLAQSYLSGCKNEMSR

SEQ ID NO: 127042 - protein, 57 aa, Glycine max
  Coding DNA Sequence Number=SeqID_10264
GERGGRKEKRKEKETLIFTGGGKGIRERENKGAPEEGAIEGRLLSRGFAIEGDGVTG

SEQ ID NO: 127043 - protein, 57 aa, Glycine max
  Coding DNA Sequence Number=SeqID_10265
MPIWWLGATYTAKISPLRDNESTNCQKGGTLFLVFFTSIGVVKDAEMGVPCSPKLQG

SEQ ID NO: 127044 - protein, 66 aa, Glycine max
  Coding DNA Sequence Number=SeqID_10266
MEHETFLATWLAEIDFSPNGLRFSNLQPQPRLINHEKPMLCRWHKLNPLKIEGRRFALDSARDYFP

SEQ ID NO: 127045 - protein, 40 aa, Glycine max
  Coding DNA Sequence Number=SeqID_10267
EVCYGIAERLERHLSLGVVTPGSSTHEVIEECLRMVRGVS

SEQ ID NO: 127046 - protein, 130 aa, Glycine max
  Coding DNA Sequence Number=SeqID_10268
  Homolog annotation: Hit_ID=Q1STZ2; Match level="QueryCoverage=66%, HitCoverage=19%, E-value=1e-07, Identity=31%"; Hit description=IMP dehydrogenase/GMP reductase
MGSSQSPSLKKRFYQVKVKSLGVTSLKELGQLMGQLQQQALRKAYGKIWDLAMAEVSTEAIASFVQYYDQPLRCFTFGDFQLSPMVEEFEEILGCPLGGRKPYLFSGFYPSLARISKIFQISTQELDHRK

SEQ ID NO: 127047 - protein, 54 aa, Glycine max
  Coding DNA Sequence Number=SeqID_10269
MGRKIWGLSSSNRGKLWKQSYDDDSPRDDAKAQRGFSRLKNQAFKIPLKDSRIK

SEQ ID NO: 127048 - protein, 83 aa, Glycine max
  Coding DNA Sequence Number=SeqID_10270
MAILIANTSSTIHRDERLGNMHAINGFMIPTWLAHGENARCPMCAVKKTIWIFQLPTTKDETHIQRMCDGMMQMRKSATGGCT

SEQ ID NO: 127049 - protein, 222 aa, Glycine max
  Coding DNA Sequence Number=SeqID_10271
  Gene Ontology: Mol. function=transferase activity; Cellular component= integral to membrane; Biological process=polysaccharide biosynthetic process
  Homolog annotation: Hit_ID=Q46628; Match level="QueryCoverage=99%, HitCoverage=46%, E-value=8e-95, Identity=76%"; Hit description=UDP -galactose-lipid carrier transferase
  Pfam annotation: Domain name=Bac_transf; Domain location=26-222; Score=487.1; E_value=2e-143; Accession=PF02397.7; Description =Bacterial sugar transferase
MFIFSHEVMILRVSNNLAKRSSRFLKRTFDVVVASLLLLFLAPVFGLLCWMVKRDGGNAIYGHERVGQDGVKFKCLKFRSMVTNSQEVLQNLLANSAEARAEWDRDFKLKNDPRITKIGGFLRKTSLDELPQLWNVIRGEMSLVGPRPVIEAELERYAGDVDYYLMAKPGMTGLWQVSGRNDIDYDTRVYFDSWYVKNWALWTDIAILFKTAGVVLRRDGAY

SEQ ID NO: 127050 - protein, 221 aa, Glycine max
  Coding DNA Sequence Number=SeqID_10272
  Gene Ontology: Mol. function=RNA-directed DNA polymerase activity; Biological process=RNA-dependent DNA replication
  Homolog annotation: Hit_ID=Q1SDI2; Match level="QueryCoverage=81%, HitCoverage=24%, E-value=7e-18, Identity=33%"; Hit description=RNA -directed DNA polymerase
MILILLFGKEAQLEITVRFAYHTLMESMINNESIKVQGNWTTIWSLQIPPKVKLSLAQTMRMFTNKNQTSEKRSSLYKFGALKINVNAGIVIQDELRRFLKAKTITSHGNIKPKEAEVWALSQALIWMTNMELQNVTFEVDCKAVMDGFNSNQQGIPKFYFLISSCNILLYNYPNSRVSLVQRQAYQVAHSLARASWLHASNQVFKRIPNCILGLVLNETQ

SEQ ID NO: 127051 - protein, 562 aa, Glycine max
  Coding DNA Sequence Number=SeqID_10273
  Gene Ontology: Mol. function=urocanate hydratase activity; Biological process=histidine catabolic process
  Homolog annotation: Hit_ID=P53385; Match level="QueryCoverage=99%, HitCoverage=99%, E-value=0.0, Identity=85%"; Hit description =Urocanate hydratase
  Pfam annotation: Domain name=Urocanase; Domain location=3-562; Score =1418.6; E_value=0; Accession=PF01175.8; Description=Urocanase
MMSETLTQAVAREIRAPRGNELHCANWLIEAAYRMIQNNLDPDVAERPEDLVVYGGIGKAARNWACFEQILRSLRALQPEETLLIQSGKPVGVFRTHADAPRVLLANSNLVPHWATWDHFHELDKAGLMMYGQMTAGSWIYIGAQGIVQGTFETFAEAGRQHYNSDLTGRWILTAGLGGMGGAQPLAGVLAGACVLAIECQESRIDFRLRTRYLDHKAYSLDEALALIKDATEAGQAISVGLLGNAAELVPELVQRAKAGGMKPDIVTDQTSAHDPINGYLPVGWDVARWEAERVSNPKAVEKAARASMAQHVQAMLDFHHMGVPTVDYGNNIRQVALDEGVKNAFDFPGFVPAYIRPLFCEGKGPFRWVALSGDAEDIYKTDAKLKELFPDHKNLHRWLDMAQERIAFQGLPARICWLGLGERHKAALAFNEMVRNGELKAPIVIGRDHLDCGSVASPNRETEAMKDGSDAVSDWPLLNALLNTAGGATWVSLHHGGGVGMGFSQHSGVVIVCDGTAEADARLGRVLWNDPATGVMRHADAGYELAQTCAEQHGLNLPMLK

SEQ ID NO: 127052 - protein, 146 aa, Glycine max
  Coding DNA Sequence Number=SeqID_10274
  Homolog annotation: Hit_ID=UPI00005F717F; Match level="QueryCoverage =77%, HitCoverage=61%, E-value=3e-32, Identity=60%"; Hit description =COG3758: Uncharacterized protein conserved in bacteria
MQAADRLLLHAYRRAPAVAPRHDVEVLTAAANLRLYRPFAGKGPRLMGQQWLFGLFTAQQHAIAVQQSDHPIDAGEGRERPVGVDGGDAGAPLELRCARRIADNFARLPAAVAPAADRQLRVVKARVHCSARIARAKPAAAASSAA

SEQ ID NO: 127053 - protein, 402 aa, Glycine max
  Coding DNA Sequence Number=SeqID_10275
  Gene Ontology: Mol. function=hydrolase activity; Biological process =signal transduction
  Homolog annotation: Hit_ID=UPI00005F9CC4; Match level="QueryCoverage =88%, HitCoverage=78%, E-value=1e-135, Identity=64%"; Hit description= COG0402: Cytosine deaminase and related metal-dependent hydrolases
  Pfam annotation: Domain name=Amidohydro_1; Domain location=47-391; Score=6.4; E_value=2.9e-05; Accession=PF01979.10; Description =Amidohydrolase family
MAVYFAPRARLADGWQENVLIATDDQGFIRTLTADSTPGDAVRLAGPVIPAMANLHSHAFQRAMAGLAEVAGDPQDSFWTWRDLMYRMVQRLSPEQVGAIATHLYIDMLKGGYSQVAEFHYLHHDPHGQPYADDAMLHQLMQAAHTAGIGQTLLPVLYSYSGFGAQPASDGQRRFIQHTDAYLQQQQRVAQWSAQQPLINHGLCFHSLRAVSEAQMHEVLAASATHLPVHIHVAEQEKEVNDSLAWSGERPVAWLYNRFAVDARWCLIHATHLDQQEMARMADSGAIAGLCPTTEANLGDGIFPAVEYIGRGGRWGIGSDSHVSLSALEELRWLEYGQRLRDRRRNRITLTDQPSVGDLLWQQAAQGGALACGIASGCAAGQRQFRRAAQSLAICRQQPADS

SEQ ID NO: 127054 - protein, 118 aa, Glycine max
  Coding DNA Sequence Number=SeqID_10276
  Gene Ontology: Mol. function=hydrolase activity, acting on carbon -nitrogen (but not peptide) bonds, in cyclic amides; Cellular component=cytoplasm; Biological process=histidine catabolic process to glutamate and formamide
  Homolog annotation: Hit_ID=UPI00005F9CC6; Match level="QueryCoverage =94%, HitCoverage=27%, E-value=3e-40, Identity=69%"; Hit description =COG1228: Imidazolonepropionase and related amidohydrolases
MASKQIDSLWLGADVVTMRDGRYNLIEDGAVAVDNGELVWVGPRSALPDFAPRRQQQFDGGIITPGLVDCHTHLVFGGDRSQEFEQRLNGVSYAEIAAQGGGILSTVRATRADSQQQL

SEQ ID NO: 127055 - protein, 336 aa, Glycine max
  Coding DNA Sequence Number=SeqID_10277
  Gene Ontology: Mol. function=transcriptional repressor activity; Cellular component=intracellular; Biological process=negative regulation of transcription, DNA-dependent
  Homolog annotation: Hit_ID=Q9ZC75; Match level="QueryCoverage=62%, HitCoverage=82%, E-value=2e-74, Identity=65%"; Hit description=HutC protein
MAQQCGQDAAGAAGNVVAAGAAAAGAANGRGQPAARIGNDFVVAPRLATDKQARLVLIQRQMLTLAQIRQYRFNDMLTGGQRGDAHQIGVRRQAVVILAEVVRRDQRIDQTIFQLHRQLIFIVHDQRMIQRLAGGESQHRRLLRIGLHLTYLENFAAVRMAALGNFIGDVMHFQHCGVALHLRDKGPDALHAHQKPFAGEFAQRTVDGHAADAQFIDQLALRRHPLVGFPVTFPDLADDCLLNALAGGCRARIAARFTEYDQSGTALATCIDKIRHLCFTHNTYSAPGGCHRNLRSATTWQITCIDRSRLCQVRFRQFASFPVKWTSPPYAAFIRI

SEQ ID NO: 127056 - protein, 56 aa, Glycine max
  Coding DNA Sequence Number=SeqID_10278
MPALPINVWAFLELLIYFAHLCKKLKGGMNRGRMRLFQEFVDILEHSVGSFPSVAE

SEQ ID NO: 127057 - protein, 149 aa, Glycine max
  Coding DNA Sequence Number=SeqID_10279
  Subcellular localization annotation: CTP_CleavageSite=48; ConfidenceScore=5.12e-01
MYPPLFSLNNLVDVPSTRTDPQEMYPLLFSVTTTQVDVPSTYTTKDVPSNVLRQISQAVSPLKLCEWGNKRILRRLVLRNLLFMGKGRIKRILRLCRFEFFDKGEGRHKIIQAVSPSFFWKREKRDTKRIQAVSPWRILFGKGRRESKR

SEQ ID NO: 127058 - protein, 100 aa, Glycine max
  Coding DNA Sequence Number=SeqID_10280
MYFLTSAILKTLKTTLDGKRDQVAPHWIEVKIDSRIFYDNKDDGKKLKRMSSRLSQEHFKNQEKFDFKIQESSFKIQVSRIKNNQVEDSRIKKRLNQDKY

SEQ ID NO: 127059 - protein, 1314 aa, Glycine max
  Coding DNA Sequence Number=SeqID_10281
  Homolog annotation: Hit_ID=Q4KJN3; Match level="QueryCoverage=27%, HitCoverage=72%, E-value=1e-130, Identity=67%"; Hit description =Histidine ammonia-lyase
  Pfam annotation: Domain name=ABC_tran; Domain location=751-959; Score= 137.1; E_value=4.9e-38; Accession=PF00005.17; Description=ABC transporter
  Pfam annotation: Domain name=BPD_transp_1; Domain location=517-727; Score=56.7; E_value=7.7e-14; Accession=PF00528.12; Description =Binding-protein-dependent transport s
  Pfam annotation: Domain name=PAL; Domain location=943-1314; Score =206.8; E_value=5.1e-59; Accession=PF00221.9; Description =Phenylalanine and histidine ammonia-lyase
  Pfam annotation: Domain name=SBP_bac_3; Domain location=48-294; Score= 234.2; E_value=2.8e-67; Accession=PF00497.10; Description=Bacterial extracellular solute-binding proteins, family 3
  Pfam module annotation: Pfam domain module=ABC_tran::BPD_transp _1::PAL::SBP_bac_3; Domain location=751-959::517-727::943-1314::48-294
QQRQPDLLTTRRRRMTHRAPFRRFCLTTLFASLMLAGVAAEAKEWKSITIATEGSYEPWNLTLPGGKLGGFEPELMEDLCKRMSIQCKLVVQNWDGMIAGLNAGKYDVIMDAIVITPDRKKVVNFTTPYASTPATFITSKDNPLLPADKNIIKLHDDEAAINAAIAPLKAALKGKTIGIASGTVYTPFIDKYFKDVADVREYTASADAILDLQAGRIDAVFDDVTFAQSMLARKENSNLTFSGPQLGGPIWGEGEAMGVRMADNDLKAKLDAAIHAALADGTVKKLSEKCAAGTTLLLSLAALMIGAVVGSGVAAAKLSHQRWLRWLGESYSVVFRGIPELLVIYLFYFGGSGLITLVGQLFGADGFIEAPPFLIGALAIGLISGSYQGRSRSGGSHRDAALAYRPAHPRPADCALRAAGDVQRLADEPERFGAGVSDRHRRADARQPGSGRVNARLLHLLPDWRWLLSAADTAVEPCVSPRGIAPRPRMAKSHCGTALRSSSMIDFAFLADTFLKLSAALPVTLGLFISAFVCGGLLALGILALRMSRWRLLSGFARGYILVFRGSPLLIQLFLIYYGLGQFGVIRHSFVWPFLREPFICAVLALSLCTAAYTAEILRGALLAVPAGQVEAGLACGMSRWLLLRRIIAPIMLRYALPAYSTEAILLVKSTALASLVTVWDVTGVAQQIIQRTYRTMEVFVCAAAIYLILNFIIVQLYALLERLTLSATDIHKSFGAMEVLKGISLQAHQGDVISILGASGSGKSTLLRCINLLETPDAGVVSVGGETIEMKRHARGHQLAANPKQIERLRSRLGMVFQSFNLWSHMTVLQNVIEGPHYVLKRDKKSCIAQAEQLLDRVGLLNRKDFYPAQLSGGQQQRVAIARALAMDPEVMLFDEPTSALDPELVGEVLKGNIDCEGTPEAMFGASGSSRFKQFISSHQSHHAEQPVARHNAELTLSAAAWQRIARGREIVEQIVASGQIAYGINTGLGALCNITLPEDQLSQLSRNTLLSHACGVGPLLTREQTRAILCAAIANYSHGKSGVSVALVQHLLALLNQQITPQVPSQGSVGYLTHMAHIGLALIGVGDVEYQQQVMPAEQALRLAGLQPYRPGAKEGLSLVNGTPCMTGLSCLALDDAARLLDCADVTGAMSFEALRGQLAAFDAEVIALKASPGMQHSGQRLRALLSDSPLLAASCGIRTQDALSLRSMPQVHGASRDQFAHAARQVEIELNACTDNPLVLGTPDNWRVVSQANPHGESVAMAADLLAIAMAEIGSIAERRLDRLVNPLVSGLPPFLVAQPGVNSGMMIAQY

SEQ ID NO: 127060 - protein, 92 aa, Glycine max
  Coding DNA Sequence Number=SeqID_10282
MKQELKQAIKVELTQMPFIGTFIAWPRHIVKPISHEDSKNLPNKVYEPVESLSMGVGDDPLGDFIKNLSDVYPKPVEFLWDVTKFRISNVYG

SEQ ID NO: 127061 - protein, 330 aa, Glycine max
  Coding DNA Sequence Number=SeqID_10283
  Gene Ontology: Mol. function=transition metal ion binding; Cellular component=nucleus; Biological process=proteolysis
  Pfam annotation: Domain name=Transposase_21; Domain location=93-226; Score=-21.2; E_value=8.5e-13; Accession=PF02992.5; Description =Transposase family tnp2
MDRSWMKASHISDEYENGVEEFLQFVQRNAQVHKFHKVINNVSFGELEGKIWVECKSFTELLMLLKNMLLDDNTLPKNHYEGPTCGVSRYRVKDDDTSDDATANNSCTTKTIDCLYPDFAEEPKNLMLGLTSDGMNLFGNDIDVYLTPLIEDMRKLWVDRVNVYDGNPQQSFRLRAMIFCTINNFPAYGKTKDGLKCRQDLVDLVIREQLHPISQESESPIRTLFIEPFIDPRRLDDLENEVVIVLCQLEMFFPPSCFDIMRYMKVLEGYTKYQYQLEASILETYVAEKSIEFCFEYIETIKLVGLPQSRHDWARGSKGTRRYNVVTMSR

SEQ ID NO: 127062 - protein, 51 aa, Glycine max
  Coding DNA Sequence Number=SeqID_10284
MEETNILDDPTMPKMPDSCTSLVILDEFLCPITLEIMTYPIIVTSDQIVAS

SEQ ID NO: 127063 - protein, 52 aa, Glycine max
  Coding DNA Sequence Number=SeqID_10285
MVAHGGHRWSWVVEEEFLGCQNVKTWVVDLQSKFEGDPMVRESEIVVLPEQV

SEQ ID NO: 127064 - protein, 139 aa, Glycine max
  Coding DNA Sequence Number=SeqID_10286
  Homolog annotation: Hit_ID=Q1SQF7; Match level="QueryCoverage=47%, HitCoverage=29%, E-value=1e-08, Identity=46%"; Hit description =Endonuclease/exonuclease/phosphatase
MIFLCETLVNICHIKEIKNLLGFESFLVVDANSRSKGLAFLWKHPFDYTLLNYSSNFINVEVLKHGRGLAFLWKHPFDYTLLKYSSNFINVQMKNMAVVITQIGSSWGLVKQSSIVDSMIFLWKVISSPTPKVKENTMP

SEQ ID NO: 127065 - protein, 103 aa, Glycine max
  Coding DNA Sequence Number=SeqID_10287
MDYFKSHKDIVKNRSSLYKGRLLMGNAFVEHRKLHRDIDAILHRKGPVTRAMSKRFKEDWAKAAEEGHRVLMNLRLRFIKAWASPSQMNFNHLPTLEAKPILA

SEQ ID NO: 127066 - protein, 124 aa, Glycine max
  Coding DNA Sequence Number=SeqID_10288
  Gene Ontology: Mol. function=DNA binding; Cellular component =chromatin; Biological process=chromosome organization and biogenesis (sensu Eukaryota)
  Homolog annotation: Hit_ID=Q6K709; Match level="QueryCoverage=76%, HitCoverage=36%, E-value=2e-26, Identity=61%"; Hit description=DNA -binding protein-like
MRTEKTATSQERELLTSPPCAALRDVHQAPETSRNRRYSSPETALTRYGTTSWRLPSEPTLSTTWRSSLGGANAGFPFSAVAEPSSTPITDNPRHSMSSWRSTDADQEQHNDDDGGGGGDWEGG

SEQ ID NO: 127067 - protein, 140 aa, Glycine max
  Coding DNA Sequence Number=SeqID_10289
  Gene Ontology: Mol. function=hydrolase activity; Cellular component =chloroplast; Biological process=isoprenoid biosynthetic process
  Homolog annotation: Hit_ID=Q5VSC2; Match level="QueryCoverage=82%, HitCoverage=28%, E-value=2e-57, Identity=86%"; Hit description =MutT/nudix protein-like
  Pfam annotation: Domain name=NUDIX; Domain location=64-140; Score =11.2; E_value=0.01; Accession=PF00293.18; Description=NUDIX domain
  Pfam annotation: Domain name=zf-NADH-PPase; Domain location=28-61; Score=49.5; E_value=1.1e-11; Accession=PF09297.1; Description=NADH pyrophosphatase zinc ribbon domai
  Pfam module annotation: Pfam domain module=NUDIX::zf-NADH-PPase; Domain location=64-140::28-61
MTFNVTIGNSAFLFTGFGQARALLEWHKISRFCGHCGEKTVPMEAGRRKQCSNESCKQRIYPRLDPVVIMLVIDRENDRALLSKQSRFVPRMWSCLAGFIEPGESLEEAVRRETWEETGIEVGEVVYHSSQPWPGISYST

SEQ ID NO: 127068 - protein, 138 aa, Glycine max
  Coding DNA Sequence Number=SeqID_10290
  Gene Ontology: Mol. function=zinc ion binding; Cellular component =intracellular
  Homolog annotation: Hit_ID=Q1RWK5; Match level="QueryCoverage=79%, HitCoverage=77%, E-value=5e-49, Identity=70%"; Hit description=Zinc finger, RanBP2-type
  Pfam annotation: Domain name=zf-RanBP; Domain location=4-33; Score =15.0; E_value=0.015; Accession=PF00641.9; Description=Zn-finger in Ran binding protein and others
  Pfam annotation: Domain name=zf-RanBP; Domain location=48-79; Score =31.8; E_value=2.4e-06; Accession=PF00641.9; Description=Zn-finger in Ran binding protein and others
  Pfam module annotation: Pfam domain module=zf-RanBP::zf-RanBP; Domain location=4-33::48-79
MSWSGGDWMCGACQHINFKKRDACQSCAYPKFGGPDPTTYRYNSTETLAGDWYCTAMNCGAHNFASRSSCFRCGALKDGYSCRFGGNMDGSGGYGSDCNYPPGWKTGDWICTSNSISMTRLLPLFQVTQTKRGNFNRH

SEQ ID NO: 127069 - protein, 106 aa, Glycine max
  Coding DNA Sequence Number=SeqID_10291
MQVGLPPVPFESLLSWLAALQREHGIRVLALAVERAEQAPGIVQLAAVAWPLSLLPPSYCRALSTAGIIPDADGDNAGLAARHRGGLVFHAGVGCAVAGVGGDRQP

SEQ ID NO: 127070 - protein, 92 aa, Glycine max
  Coding DNA Sequence Number=SeqID_10292
MSSGFLGDFPFAIRRQPSPMACKDKNSCILPLSRDSMSIDQGYRTLPYYPETSKSNSMRRPSWLSIFIDFKASRLLLIELMVGRVEIRLKRN

SEQ ID NO: 127071 - protein, 100 aa, Glycine max
  Coding DNA Sequence Number=SeqID_10293
MKLCFYNENSKKGPQRRCCGICQSFQGLSVFLLMETTLKTLHGMQMLSETLARLAIQGNMEENLPRMHTPSAPSARPTSRLSLLALSVPNALSQNSLTRA

SEQ ID NO: 127072 - protein, 204 aa, Glycine max
  Coding DNA Sequence Number=SeqID_10294
  Gene Ontology: Mol. function=RNA-directed DNA polymerase activity; Cellular component=chromatin; Biological process=RNA-dependent DNA replication
MADSNIRKTAFRTHHGHNEFKVMSFGLYNAPSTFQATMNDTLRPFLHKFVTVFFDDILIYSPCLHSHAQHLKQVLSTFSQAQFLLRQSKCLFAQQKLHYLDHIVSTQGVAPDPDKIQAMLTWPTPSTPSALCGFLGLTSFYQHFIKSYVTLVAPLTSLLQKDNFQWYDEAQTTFKQLKRKMMEAFVLLSPDFSTPFTIETNTSS

SEQ ID NO: 127073 - protein, 89 aa, Glycine max
  Coding DNA Sequence Number=SeqID_10295
  Gene Ontology: Mol. function=protein dimerization activity
  Homolog annotation: Hit_ID=Q6Y8E6; Match level="QueryCoverage=72%, HitCoverage=9%, E-value=6e-13, Identity=49%"; Hit description=Ac -like transposase THELMA13
MAELMMEKFVKYWDEYSIVLAFSAIFDPRMKLETLGYCYEKIDPFTWEIKLEKVKSKLYMFFSQYSSKDGEGEADKDAKVERSSSKDII

SEQ ID NO: 127074 - protein, 93 aa, Glycine max
  Coding DNA Sequence Number=SeqID_10296
MDQTLLDILCIELRKQFDERKFISGFQLKSQPRSTNASSKDLSVLLTQAAIPSPFLPHRSGSKDLSVLLTQAAIEVLDIVLAPGWWIREFVSS

SEQ ID NO: 127075 - protein, 88 aa, Glycine max
  Coding DNA Sequence Number=SeqID_10297
MYRNPLPLQQRPSATIAQVVDANISIQTYTTCEKSQATMYRNPLPLQQRPSATIAQVVDANISIQTYTTCNNCMEGEGKDGCEKEGFN

SEQ ID NO: 127076 - protein, 258 aa, Glycine max
  Coding DNA Sequence Number=SeqID_10298
MEVGSNDTSAMSVIGWSERKITSSASYSLCIQVKKSSNAGLNKVMSIALVDRDNETMLLSGSSSGGSRWSGGKERASELDAKGSMSSSAIKRCNQGILGARVVFGLGMGEIGFGDDWAVTCVNDKGWRACTSRRKSGVKSKTKQLRRKDREPTILLARRSNSDVRKLFPNIHWYQHNASLSMQKEATNCETLKIHSMGSCPSNVGRPVSYGAEKKKVKLVSARKKERRERWNGPGSGEWSPRLSGQWWPAWYFALAVA

SEQ ID NO: 127077 - protein, 165 aa, Glycine max
  Coding DNA Sequence Number=SeqID_10299
  Gene Ontology: Mol. function=chromatin binding; Cellular component =chromatin; Biological process=chromatin assembly or disassembly
  Homolog annotation: Hit_ID=Q1SAV4; Match level="QueryCoverage=89%, HitCoverage=38%, E-value=2e-28, Identity=45%"; Hit description =Integrase, catalytic region
MRTTILVSLHRRLIMKTTANAHRRNVQFTVGDWVYLRLRPYRQTSLAPAYTKLAKQFYGPFQIIERMGPVTYQLQLPSSSKIHPTFHVSLLKLHQGPPPTQPTILPPSSIENHPIIEPLHIMDWKWDSSSSPPTKLILDKVGLVEWVMIAIQTYRNRKSTKAARN

SEQ ID NO: 127078 - protein, 168 aa, Glycine max
  Coding DNA Sequence Number=SeqID_10300
DVRKKAQAIQKQNTAPHILSRGGYEYLEQKLLAEKTQKKLEEAAQSGSVDGVINSSSSVRRHLKWKMARTKKTREMTIEAAKEIAEKIISHFQLTIRIIFVYFLNAMRHRDPSSPMDVRMFSPLLLDVQSTLDVFVLLKLVSPSSNTSDRFYGRPAALPRCLLKNYNS

SEQ ID NO: 127079 - protein, 410 aa, Glycine max
  Coding DNA Sequence Number=SeqID_10301
  Gene Ontology: Mol. function=transporter activity; Cellular component= integral to membrane; Biological process=transport
  Homolog annotation: Hit_ID=UPI0000685D3F; Match level="QueryCoverage =54%, HitCoverage=53%, E-value=6e-22, Identity=32%"; Hit description =Sugar efflux permease, MFS-like
  Pfam annotation: Domain name=MFS_1; Domain location=2-268; Score= -4.7; E_value=0.00052; Accession=PF07690.6; Description=Major Facilitator Superfamily
MLGLLLLAAAGSTWLIAGGLFIAGLGAGLASPALASAVSRQIDASRQTAANTLINAGTGAGIIVSVPIFMLMPGGWRAACCCFAALALISLLLARYCLPAGRADPPGSPVGWRDRLHNRALLRVIIIAFLSGVASAAWWCFGPDVLRQHSRLNEGQASMLWLVSGAAGILGALTGPLARCIGMRQVYWLAQLAMAAPLLLLAALTHFSYWLVPAAALCGAGYVTLSGILLVAGAAATPQNAASGVAAAFLTLAIGQIGGAILFAQIYSSSAAAALLLFAAIPVALLFLPAAEDAGTGVAANDRRVAVKAIAHFAYLVVIQIALGAQDIQQRAASEVIPLIEKVFADAAPANVDSGLPRLLATELILTRAFGYRPDQRMIIQAGQLTIEIAKIHRPAIAGWQRHATIAHQA

SEQ ID NO: 127080 - protein, 265 aa, Glycine max
  Coding DNA Sequence Number=SeqID_10302
  Gene Ontology: Mol. function=RNA-directed DNA polymerase activity; Biological process=RNA-dependent DNA replication
  Homolog annotation: Hit_ID=Q1SLA3; Match level="QueryCoverage=88%, HitCoverage=23%, E-value=5e-45, Identity=41%"; Hit description=RNA -directed DNA polymerase
MSNRTDVSFFSLLDLIPPGTALYASPVPTILVFFGTTPPIYLHLLLALGFYSETLMRFFFLQIDLVVGGHFTWRKNTQNGGHVRKKLDRGMLQPYNSDHNPLIVTFFKSPRTAWMSHPNYANLVSQAWNITPGDAICKLEGVKEKSIMFNWDVFGNIFKRKRQLEGRIKEVHRQLDMVITSDLIQLEINLQQDYKEVLAQKEMLWFQKSREEWIKLGNKNIKFFHTQIKRRRNQIFGLFIDGNWGTDMTLLQNEAKKFFKKLFLF

SEQ ID NO: 127081 - protein, 61 aa, Glycine max
  Coding DNA Sequence Number=SeqID_10303
MATRNKRERLLTEALNNLAQENTRPHLEGAGGVVVPWGTFRQTFLEKEEENQGRGASVTLS

SEQ ID NO: 127082 - protein, 63 aa, Glycine max
  Coding DNA Sequence Number=SeqID_10304
MTLSPMKARTLSPLKARTLSPLKARTLSPLKEANRSLMTWADHERIYMTKLPLGFEKNPKELA

SEQ ID NO: 127083 - protein, 142 aa, Glycine max
  Coding DNA Sequence Number=SeqID_10305
MGEIDEVQEWMKVNMEALKEHMTTMMEAMMSMKNIMEVNAATVAATSVAAENNNAFPPYGLPPNYTLPNVVHTPDENVNNSNPILIESQQPQSDHAHGQAVGGVPQPNTLEGPQFFPQPQPLHFVAGRVSPAIAEKGKAKGR

SEQ ID NO: 127084 - protein, 201 aa, Glycine max
  Coding DNA Sequence Number=SeqID_10306
MFLLPISLFFFLFSVFLLLLLQSLIVRLTSELHGRRRDLYMMILFFSWCFRILSSFFFSSSSFFHFPMKLACHHHRPLLCHHRPRGGLASRRHVLVAPGRHATLCGGFSYCGAICGARSSRVVSTLMPECRLGRVTLTLFQPNEHEMELLRLHQNEENDKKKKGIALKASSSIQEESDQDNDPDDDDDLSLFVKRFNKFLK

SEQ ID NO: 127085 - protein, 120 aa, Glycine max
  Coding DNA Sequence Number=SeqID_10307
  Subcellular localization annotation: CTP_CleavageSite=38; ConfidenceScore=5.17e-01
KTPSGPGGAQQGPGISSSGYGPLSILQGAHSPQQGITRARHSVDPEKSNRVLELPALITGLCQFYGVPVAPSKVIRPPTNRAFIKKYCAPRQAQGKTPQQRATDAPPPPLEFTSAHPQKG

SEQ ID NO: 127086 - protein, 118 aa, Glycine max
  Coding DNA Sequence Number=SeqID_10308
  Gene Ontology: Mol. function=RNA-directed DNA polymerase activity; Cellular component=chromatin; Biological process=RNA-dependent DNA replication
MTPEDMEKTTFVTLWGSFCYKVMSFGLKNAGATYQRAMVALFHDMMHQEIEIYVDDIIAKSETEEEHLVNLRKLFERLRKYQLREIARFIVSQKGIEVDHEKVKAILEMPEPRTERQV

SEQ ID NO: 127087 - protein, 120 aa, Glycine max
  Coding DNA Sequence Number=SeqID_10309
LLGCFLAFKVKVQPRFRNSVVLKYSDELELINVVLDLIPDSEQSLSITADHDQSMLASSEPTKFESQSVSVTGDHDPLLRIPLTPTKRVSSDELDNERKNFEISPAEVSSKKLAKHSQPE

SEQ ID NO: 127088 - protein, 257 aa, Glycine max
  Coding DNA Sequence Number=SeqID_10310
  Gene Ontology: Mol. function=nucleic acid binding
  Homolog annotation: Hit_ID=Q1T493; Match level="QueryCoverage=95%, HitCoverage=46%, E-value=6e-33, Identity=33%"; Hit description =Nucleic acid-binding, OB-fold, subgroup
  Pfam annotation: Domain name=DUF223; Domain location=51-147; Score= -10.7; E_value=0.029; Accession=PF02721.5; Description=Domain of unknown function DUF223
MTVFVWVSDYKVMPRVADKIKLIDGSREALKLSVRITDLWFIGIPGKTEQVEMVVVDSDGDEIHVVCKQDQLKSRKADLKENFTYVMHNFKVIKNDGKFKVCDHEYKLCFTGVTVVRQCDMEQLPFRKFRFVSFSSVIAGDFKIGLLVDVIGMVDEVVFRYVSSKNTRVVLNLKDLSGQVLSCTLWENYCLQFLSYLNDIEDERPIVILLTHARIKEAQGSYPASVSNSFKASKLMINDLVLEIQEFRESFRFRDRG

SEQ ID NO: 127089 - protein, 34 aa, Glycine max
  Coding DNA Sequence Number=SeqID_10311
  Homolog annotation: Hit_ID=Q8H6Q8; Match level="QueryCoverage=94%, HitCoverage=47%, E-value=2e-07, Identity=77%"; Hit description=CTV.20
MDEGAFFRLNDITFHSYCPKGPVKAVLYLSNSWI

SEQ ID NO: 127090 - protein, 34 aa, Glycine max
  Coding DNA Sequence Number=SeqID_10312
MVRSRDELTAEVNLGMEANGGQGHGRPLSLPGAR

SEQ ID NO: 127091 - protein, 38 aa, Glycine max
  Coding DNA Sequence Number=SeqID_10313
MELGGCAQTTEPSTTSCKFHDEHLVHLRRVLEAQRRES

SEQ ID NO: 127092 - protein, 272 aa, Glycine max
  Coding DNA Sequence Number=SeqID_10314
MSRNTSRDQKKVKSTKRKQDIEVDVVVCKEVIGQEMDGVRKFDKTADGYNKMQTYRGMLLDPTRRLRNRHAVGGLTTEDRMLVYLITYILTPRSSYHDQVTNDDLQIAYGKKSGIKMNWVLLIEEVMLKCRRLVDYEFLYVVLASRFIDYFKVDVSNEIMDYTKDSSDVTEKHLKKFSMRYANHEWIMARELASRNIEEMEEDDEAKAQHEPAPQWSPFESLTIQKMDVMLHLHQEHSTKFHSPLENNNSRLENIKTRLNLRNLPNSDEDDS

SEQ ID NO: 127093 - protein, 97 aa, Glycine max
  Coding DNA Sequence Number=SeqID_10315
AVHVSSIIKREASSDWEIHSSVVFQIGSFAKHDGRNQCPIFAFLLSPMRDVWHPLLHNMRSPETCRKSKGSRLTRYELNSPGRARLLQDEVTAHLGE

SEQ ID NO: 127094 - protein, 270 aa, Glycine max
  Coding DNA Sequence Number=SeqID_10316
  Gene Ontology: Mol. function=caspase activity; Biological process =proteolysis
  Homolog annotation: Hit_ID=Q9ZSP8; Match level="QueryCoverage=99%, HitCoverage=72%, E-value=7e-75, Identity=52%"; Hit description=Latex- abundant protein
  Pfam annotation: Domain name=Peptidase_C14; Domain location=88-268; Score=-53.9; E_value=0.092; Accession=PF00656.12; Description =Caspase domain
DDFRQFVDKVPRGCKITIVSDCCHSGGLIEAAKEQIGDSTNEEGQNSPSLFHFKNLFHRNMEQEEEEETIVKNRSLPLSTLTEILKQKSGKDDDIEIGKLRHTLFGEDASPKVKKYMNLVINKLQHGTSGGERGGGHTILGLVGDLAQQFFEQKLNDDDNHDEEYAKRGWSKREEHHAASIKRNILDCGILLSGCQSDQTSADFASPYGNSDAAYGAFSNVIQSIIEETDGAVTNRELVLKARMVLKSQGFDQKPGLYCSDNNVNASFLC

SEQ ID NO: 127095 - protein, 89 aa, Glycine max
  Coding DNA Sequence Number=SeqID_10317
MAVFRGGFSKKRQPFYPLAVFRGGYYLHQILLVAFCSLMGKLAKQIDLPNFPLPKLPSNVILKVCWLHHLPLAPGLFSLLHPCCWCFLC

SEQ ID NO: 127096 - protein, 329 aa, Glycine max
  Coding DNA Sequence Number=SeqID_10318
  Homolog annotation: Hit_ID=Q6CQF2; Match level="QueryCoverage=21%, HitCoverage=86%, E-value=2e-14, Identity=60%"; Hit description =Kluyveromyces lactis strain NRRL Y-1140 chromosome D of strain NRRL Y- 1140 of Kluyveromyces lactis
ICTDDRSARARALGFAATAAPSYSSGLGPCPDGRNSPAGSSYPEGNFGGNQLLDGSISPFAPIPKSGRTICTSVSLRASTRVSSGFAPLRHSSPSFGSRQVCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALKDSLFKVLFIFPSRYLFAIGLSPVFSLGRNLPPDWGCIPKQPDSPTAPRGATGSGHDGALTLSGAPFQRTWARSATEDASPDYNSDAEGDRFS

SEQ ID NO: 127097 - protein, 233 aa, Glycine max
  Coding DNA Sequence Number=SeqID_10319
  Homolog annotation: Hit_ID=Q6CQF2; Match level="QueryCoverage=17%, HitCoverage=49%, E-value=3e-09, Identity=72%"; Hit description =Kluyveromyces lactis strain NRRL Y-1140 chromosome D of strain NRRL Y- 1140 of Kluyveromyces lactis
MVAQARAVDMLVETSSSRLWMAARALGVPRHLRAPGVGLWAPHSARLETRTKESDMCASQRASKPHTCRDPKDGELCLSGAKPEETLVEARSDTDVQIVRPDLGIGAKGLIDPSRRCGCSVEPPHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKIPEPGRGG

SEQ ID NO: 127098 - protein, 320 aa, Glycine max
  Coding DNA Sequence Number=SeqID_10320
  Gene Ontology: Mol. function=two-component sensor activity; Cellular component=integral to membrane; Biological process=two-component signal transduction system (phosphorelay)
  Homolog annotation: Hit_ID=P23842; Match level="QueryCoverage=99%, HitCoverage=44%, E-value=4e-95, Identity=56%"; Hit description =Hypothetical protein yfeA
  Pfam annotation: Domain name=EAL; Domain location=180-319; Score= -25.0; E_value=6e-09; Accession=PF00563.11; Description=EAL domain
  Pfam annotation: Domain name=GGDEF; Domain location=15-162; Score= -52.5; E_value=0.0046; Accession=PF00990.12; Description=GGDEF domain
  Pfam module annotation: Pfam domain module=EAL::GGDEF; Domain location=180-319::15-162
MTDIYSRSERIKQRWRDRAEEDPLTGLPNLRALEGHLRQSPRVVISSLRIENLDFLSRHYGMMMRVECKRQIARRLQPLLDHHDKIYQLPGSELLLVIEGPEPAARLNHIVSMLNHAKFNWHNQDLDLEFGAAWGSYSGIETELHPMLGQLSWLSEQAGAVQRVLALDIAQEEVSDQTTEQVRMLTKIKQALNERSLLLYAQPIQNAEGEGYYEILTRMRCGETIITPDRFIPLIAQFNLSQRFDMLVLETLFSQIDHHPGRRFSVNLLPYTLMQKDSAAQIIALFKRYRVSPAYITIEITEEQAFSNADTSLPNIQLLS

SEQ ID NO: 127099 - protein, 151 aa, Glycine max
  Coding DNA Sequence Number=SeqID_10321
  Gene Ontology: Mol. function=DNA binding; Biological process=DNA integration
  Homolog annotation: Hit_ID=Q1SXQ3; Match level="QueryCoverage=77%, HitCoverage=20%, E-value=2e-29, Identity=42%"; Hit description =Integrase, catalytic region
MRNKARLVAKGYLQQEDAIRILLSFVALHGMILYQMDIKSMFLNGLIKEEVYVEQSPGFESSIYPHHAEFEMSMMGVLKFFLGLQIKQTNKGINIHQTKYVKKFKMDDVRPMKTSMHQTTVPGLDEDSKQRNRAILQGSLVQARYRLLKPT

SEQ ID NO: 127100 - protein, 102 aa, Glycine max
  Coding DNA Sequence Number=SeqID_10322
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=73%, HitCoverage=14%, E-value=8e-37, Identity=97%"; Hit description=NADH -plastoquinone oxidoreductase subunit 2
MGGASSSILVHGFSWLYGSSGGEIELQEIVNGLINTQMYNSPGILIALLFITVGIGFKLSPAPSHQWTPDVYEGVRCYIVGSHPSETTSIIGASVNKRITLR

SEQ ID NO: 127101 - protein, 132 aa, Glycine max
  Coding DNA Sequence Number=SeqID_10323
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q9T3G4; Match level="QueryCoverage=99%, HitCoverage=28%, E-value=2e-37, Identity=78%"; Hit description =NAD(P)H-quinone oxidoreductase chain 2, chloroplast (EC 1.6.5.-) (NAD(P)H dehydrogenase, chain 2)
  Pfam annotation: Domain name=Oxidored_q1; Domain location=1-113; Score=-73.0; E_value=0.00085; Accession=PF00361.10; Description=NADH- Ubiquinoneplastoquinone (comple
MILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSGRLISLSFNRTPYECRLYLLLSKNNQ

SEQ ID NO: 127102 - protein, 163 aa, Glycine max
  Coding DNA Sequence Number=SeqID_10324
  Subcellular localization annotation: CTP_CleavageSite=40; ConfidenceScore=5.33e-01
MTLRSLFEEPRNPGLRDLRPQLFSSPYLSSFYLSSPSNTSSSSPSGSFCFELRAFLIYVVEPASGPAPDHAKSAGCEVGLARSATFSFRRGEASTTQEPRPAHEDASADISEPSPPEPFIFEADLEPSPQPEPEPSAPVPDLPISQDPPSAPALDLNDAAQDD

SEQ ID NO: 127103 - protein, 62 aa, Glycine max
  Coding DNA Sequence Number=SeqID_10325
MLLKTWIVTSESETQHDHRFTSTPYGSHRPGHSDMNGSGMEKEEREQTPLQGEDESRRSSPP

SEQ ID NO: 127104 - protein, 214 aa, Glycine max
  Coding DNA Sequence Number=SeqID_10326
  Gene Ontology: Biological process=electron transport
  Homolog annotation: Hit_ID=Q2T0V8; Match level="QueryCoverage=59%, HitCoverage=78%, E-value=1e-20, Identity=41%"; Hit description =Uncharacterized protein conserved in bacteria
  Pfam annotation: Domain name=Oxidored_molyb; Domain location=18-137; Score=-20.3; E_value=6.8e-07; Accession=PF00174.9; Description =Oxidoreductase molybdopterin binding d
MACVALIIAQSSALSFTLEVAGKIDNVTDPVNKSYLFTDKQLLAMPVRSITTSTSWTPQRKFEGISVADILERVGAKGETLTFYALNDYYIDVPLSDVKKYNMILAYKMDGEMLKLKNFGPLFLDRDQMKLTTFKNGSRLAIPAIFAALFLVASTVTLYYYSATLSKKGLYAIAGTQENYSWSIAKFSIKLAEFDTLVEQQSHAAHVDNDNLRL

SEQ ID NO: 127105 - protein, 62 aa, Glycine max
  Coding DNA Sequence Number=SeqID_10327
MSSFALEIASGISKMFAQKKVMLSPGRHKIVILDEADRNLIRLAMPKLMEADVQFAVYTGRV

SEQ ID NO: 127106 - protein, 90 aa, Glycine max
  Coding DNA Sequence Number=SeqID_10328
MVKSFKVQVQMQFFKGDKTKSLLLNPTMTLPNIITAIQSSIADNGVTPIINVLWYRCPVYQFNGEVQYRAIQIIDEEEMRNNVRHNPHMH

SEQ ID NO: 127107 - protein, 180 aa, Glycine max
  Coding DNA Sequence Number=SeqID_10329
MGSSQKPSLKKRFYQVKIKSLEVTSLRKLGQLMGQLQRQAFRKAYGIRPPKASRKWGGRNTEKIFGAIDVFLAYHNHKESLVVAMLADLYDTFDRRCEESNARIVCCTPALYVGLVSHLFLQEGRPVYPLQGYRSCVEKGKANWDQLLASMGGRLLIGSLARRKEESRFYLHAKDVQMFP

SEQ ID NO: 127108 - protein, 136 aa, Glycine max
  Coding DNA Sequence Number=SeqID_10330
MESPTIATYPSVGGRRRAHGCVFQGRKAHGVTTNVYSGETSKKSKSVCGLRTLSVKGLGVVFTHREDISTPCVRHKGRQPLIKRETLRHWTINDLLVFERRETLRRWTINDLLGWSTKARLLLLRILNCDEEISPT

SEQ ID NO: 127109 - protein, 197 aa, Glycine max
  Coding DNA Sequence Number=SeqID_10331
  Gene Ontology: Mol. function=metalloendopeptidase activity; Cellular component=outer membrane; Biological process=cell wall catabolic process
  Homolog annotation: Hit_ID=Q1H094; Match level="QueryCoverage=57%, HitCoverage=33%, E-value=7e-24, Identity=51%"; Hit description =Peptidase M23B
  Pfam annotation: Domain name=Peptidase_M23; Domain location=52-144; Score=40.8; E_value=4.7e-09; Accession=PF01551.12; Description =Peptidase family M23
GTADPAATSSAAATSAEPGKNAVNNDIEAIADSDIQWQWPLSGKVTTGFDAQTNKGLNISGSSGQVITAAGAGKVIYSGMDVRGYGKLIIIKHNSNLLSVYAHQGNSLVKEGVFVTQGIAVHVFGSDQGPTDWLAWMAASPLNIALTVIGLVSAFAFHRYITHISTQQRRSASNLPVYAMMLLGAYFIYQLISTGHW

SEQ ID NO: 127110 - protein, 77 aa, Glycine max
  Coding DNA Sequence Number=SeqID_10332
  Subcellular localization annotation: CTP_CleavageSite=56; ConfidenceScore=5.51e-01
MDRLTTMMSALLSAQNSQAVAATVEQPLVSTTPLSTVTSPPLFLPPSCTWGMPPPVCGSPQPAVSEVPPPFAQQSAP

SEQ ID NO: 127111 - protein, 285 aa, Glycine max
  Coding DNA Sequence Number=SeqID_10333
  Homolog annotation: Hit_ID=O49929; Match level="QueryCoverage=65%, HitCoverage=87%, E-value=2e-78, Identity=75%"; Hit description=Pore protein of 24 kD
MKATLKGKYDVDKNGAAFANIAVNAGDVKFRASVTEATFINGPSFTGLALAVEKPGSFIVDYNVPKKDFRFQFMNTVRVGERPLNLTYAHSRGDNRTVLDGTFVYDSANKVSANYALDSGNCKLKYTYVHKGLTTFEPAYDVAKNTWDFAVSRRVYGGDDTLRASYQTSSRVLGVEWSRNPKHTAGFKNCGGDPILTSDRVRIVYISRMRSSHDVILGVELGPIPNSNMLSESTLMFVCKPIRPPIIRPLLDYLQMSSQIVASVNLAEEFKAPKLVAETTWNFEM

SEQ ID NO: 127112 - protein, 131 aa, Glycine max
  Coding DNA Sequence Number=SeqID_10334
  Gene Ontology: Mol. function=transferase activity; Biological process= metabolic process
  Homolog annotation: Hit_ID=Q10QG7; Match level="QueryCoverage=65%, HitCoverage=33%, E-value=8e-16, Identity=50%"; Hit description =Expressed protein
MVSFTSFTEEEKDKAISINSVQEVNEVVALHDPDHMTLKFLSHADGREAVAKAANLIFVENMKQHKLGGELDLQILLEPQLNKALQIVGSKGPEPGLLLVYGPVRSHLGFPAWRLRYTEIMLSTWNSLLMI

SEQ ID NO: 127113 - protein, 67 aa, Glycine max
  Coding DNA Sequence Number=SeqID_10335
MEKKKKISSEYKLPFTKLLVLELKTKNEVSLTSTGMPRKCDTLEVAHKDSIRSIASITMGFDSFSFF

SEQ ID NO: 127114 - protein, 617 aa, Glycine max
  Coding DNA Sequence Number=SeqID_10336
  Homolog annotation: Hit_ID=Q84UR3; Match level="QueryCoverage=40%, HitCoverage=32%, E-value=3e-76, Identity=58%"; Hit description =Proline-rich protein family-like
  Pfam annotation: Domain name=MAP7; Domain location=50-218; Score= -82.7; E_value=0.078; Accession=PF05672.2; Description=MAP7 (E-MAP -115) family
  Subcellular localization annotation: CTP_CleavageSite=57; ConfidenceScore=5.79e-01
MVAGKVRVAMGFQKSPAAAHTTPPPQKKQPPPPSPSTAKSSSHKSSFSRSFGAYFPRSSAQVQPRPPDVAELLRLVEELRESESRLKTELLEHKLLKESIAIVPVLENEITARETEIERSRRRAEEAESENERLRKELQELKVKAEEEKKENERKIKALEEEIAELKKTASFSGSSSSSNRTEALEIHEQEEATHKLVEVSFRSNLMRSLKKTASDLGSGNLKKEVSEISERPRHSRCNSEELVDCSDSVLFGSVGSRAPRVPNPPPKPTSSSSPSSPSSVSSGETERRIPPPPPPPPRKPASNAAAAPPPPPPPPPAKAVRVAPAKVRRVPEVVEFYHSLMRRDSHSRRDSGSGAEMPATANARDMIGEIENRSTHLLAIKTDVETQGDFIRYLIKEVESAAFTDIEDVVPFVKWLDDELSYLVDERAVLKHFDWPEQKADALREAAFGYCDLKKLVSEASSFRDDPRQLCGPALKKMQTLLEKLEHGIYNISRMRESATKRYKVFQIPVDWMLDSGYVSQIKLASVKLAMKYMKRVSAELETGGGGPEEEELIVQGVRFAFRVHQFAGGFDVETMRAFQELRDKARSCHVQCHSQQQKFFCRSATYDGANSASEN

SEQ ID NO: 127115 - protein, 94 aa, Glycine max
  Coding DNA Sequence Number=SeqID_10337
  Gene Ontology: Mol. function=catalytic activity; Cellular component =cytosol; Biological process=metabolic process
  Homolog annotation: Hit_ID=Q9C522; Match level="QueryCoverage=70%, HitCoverage=11%, E-value=3e-29, Identity=92%"; Hit description=ATP citrate lyase, putative; 3734-7120
MATGQLFSRTTQSLFYNYKQLYIQRMLDFDFLCGRETPSVSGIISPGSEGFQKLFFGQEEIAIPVHATCSQGEIFLYFNFFSMPIEYKVTNFSA

SEQ ID NO: 127116 - protein, 985 aa, Glycine max
  Coding DNA Sequence Number=SeqID_10338
  Gene Ontology: Mol. function=RNA-directed DNA polymerase activity; Cellular component=chromatin; Biological process=chromatin assembly or disassembly
  Pfam annotation: Domain name=RVP; Domain location=341-446; Score= -9.6; E_value=0.034; Accession=PF00077.10; Description=Retroviral aspartyl protease
  Pfam annotation: Domain name=RVP_2; Domain location=327-460; Score= -56.1; E_value=0.023; Accession=PF08284.2; Description=Retroviral aspartyl protease
  Pfam annotation: Domain name=RnaseH; Domain location=843-964; Score= -24.9; E_value=0.012; Accession=PF00075.14; Description=RNase H
  Pfam module annotation: Pfam domain module=RVP::RVP_2::RVT _1::Retrotrans_gag::RnaseH; Domain location=341-446::327-460::585 -754::108-198::843-964
MADHATRKTTTDRLEEAITRLSNSQSSLLDKHADLVDKYSELSGKVDTHHLHLRSPAREHHGTSSQFHQRNSVKLDVPRFDGRDPMGWIFKISQLFEYQNTPEEERITVASFYLDGAALSWYQWMFKNGFITSWSGFLQALESRFAPSFYDDPKGALFKLTQRGTVNEYLTEFERLANRVIGLPPPFLLSCFVSGLAQDIRREVLALQPISLPQAMALAKLQEDKIRDRRQAPPRGHNTPSPSYAPPSRKPQSTYVQRTPEEMALRREKGLCYNCEEKWSSTHRYKGRVLLFIADNPSLLPDEPNPEPPLLPEPIPACSLDLDTTSDFTSPHVSLHALSGLPSSETFRLVGIINHSSLTMLIDSGSTYNFLQPRLAQFLHLKTENTNLLHVLVGNGSVLECNQVCRDTSLLLQGHQFTVTFHLLPISGADAVLGIEWLRQFGPVITDYTAFSMKFTHMGRPIELHADISTGPKPISIPQVKRLLQTGSASALFHLKMIPDQQPDPLLHLPHPIPAVEALLTQFHKLFRQPSSLPPPRSIVHHINLLPNTTPINVRPYRYPQFQKSEIEKQVLELLESDLIQPSMSPYSSPVLLVKKKDGTWRMCVDYRALNAVTARDRFPIPTIDELLDELGGAAWFSKLDLRQGFHQILMHDPDVEKTAFRTHQGHYEYRVMPFGLCNAPSTFQAAMNTLLTPFLRKFAAVFFDDILIYSRTLASHLHHLELIFQTLLQSQYHLKKTKCLFAQKQIEYLGHVVSGQGVEPEPSKVQAMVQWPTSSSAKELRSFLGLTGFYRKFIKNYAMITAPLTSLCSKETFEWPSEAQSAFDRLKAAMTSAPVLALPDFDEPFIIETDASGAGMGAVLMQKGHPLAFFSKQFGPRMVHASTYVRELHAIVAAVRKWRQYLLGHPFTIFTDHKSLRELMSQVIQTPEQHYYLSKLLGFDYTIQYKVGSSNAVADALSRTTPSGEFLLLSVPHLDFMRDLRNTL

SEQ ID NO: 127117 - protein, 152 aa, Glycine max
  Coding DNA Sequence Number=SeqID_10339
MKQLAQCIRVNLEGHVTSIVGEKSEVWCTFSANSGGRNTSGGCDDSDNGSGGDGEGEGEGEGDDGGGDANDGDSNDVVMLTVLVVAVTKVILLVVVAIDIVGSGDCDDNNDSGNIDDDSNVDGDDDVIGDDMMVTMTKVVLMVVVLTTMMMM

SEQ ID NO: 127118 - protein, 75 aa, Glycine max
  Coding DNA Sequence Number=SeqID_10340
MNRKSTREYWSFPSHWSYMQMCYGVLFKMEKPTEDEVAMLLSHNESAPPYIEDYATKPEAQHFVEKLEVVHEDRS

SEQ ID NO: 127119 - protein, 204 aa, Glycine max
  Coding DNA Sequence Number=SeqID_10341
  Gene Ontology: Mol. function=catalytic activity; Cellular component =cytosol; Biological process=metabolic process
  Homolog annotation: Hit_ID=Q9C522; Match level="QueryCoverage=93%, HitCoverage=31%, E-value=6e-87, Identity=81%"; Hit description=ATP citrate lyase, putative; 3734-7120
GAKSGSQLESAQAKNQALRDAGAVVPTSYETFEAAIKEAFDKLVEEGNITPVKETTPPPIPEDLNSAIKSGKVRAPTHIISTISDERGEEQCYAGVSMSSIIEEGYGVGGVVSLLWFKRSLPHYCTQFIEMCIMLCADHGPCASGAHNAIVTARAGKDLISSIVSGMLTIGPRFGGAIDDAARYFKDAHDRVYDLYFSCEAGWN

SEQ ID NO: 127120 - protein, 83 aa, Glycine max
  Coding DNA Sequence Number=SeqID_10342
  Gene Ontology: Mol. function=cysteine-type endopeptidase activity; Cellular component=endoplasmic reticulum; Biological process =proteolysis
  Homolog annotation: Hit_ID=P84346; Match level="QueryCoverage=98%, HitCoverage=38%, E-value=2e-10, Identity=48%"; Hit description =Mexicain
MGAMDNMMKKTSTIYKVMVFKPKQNTLTMEKKVHVSIGMVKPVVRIRGYKIVPPRNEEQLLKAMANQPVAVGVGASGQAFRFY

SEQ ID NO: 127121 - protein, 113 aa, Glycine max
  Coding DNA Sequence Number=SeqID_10343
  Homolog annotation: Hit_ID=Q9FGZ6; Match level="QueryCoverage=32%, HitCoverage=5%, E-value=8e-10, Identity=70%"; Hit description =Protein kinase
MDIRVVEKKKEMMTVTKNAHMCQQLSFIEAHCGSTSSGISSRWFINPTAPTTCKNPRETVVHICEDGDWDFNLMSHHIWSHLLDYIRVVPPPSERRGSDSVKWQGSNDGCFSI

SEQ ID NO: 127122 - protein, 245 aa, Glycine max
  Coding DNA Sequence Number=SeqID_10344
  Gene Ontology: Mol. function=pectinesterase activity; Cellular component=cell wall; Biological process=cell wall modification
  Homolog annotation: Hit_ID=Q651B2; Match level="QueryCoverage=83%, HitCoverage=52%, E-value=3e-14, Identity=32%"; Hit description =Putative pectin methylesterase
  Pfam annotation: Domain name=Pectinesterase; Domain location=30-245; Score=-186.2; E_value=1.6e-07; Accession=PF01095.10; Description =Pectinesterase
MASPLSRLSFHASSFIVAILIFCMSHCALGIDGQTVIDSPLLTEKLGINRTEKVHIPENKPYIFMRGNGKGKTAIVWSQSSEDNVASATFKVEAHDFIAFGISFKVNSLYILKTLQPYAGKEELGTYGGCVYLAKPISGSRQSGILSLRILQYSTLSSIAKVDITTIVVTFKESGYIFVVDDKRVTIKGSVTAQNRESEGEMSGFIFIKGKVYDIGGVYLGRAKGPYSRVIFAETYLSMTIVPEG

SEQ ID NO: 127123 - protein, 163 aa, Glycine max
  Coding DNA Sequence Number=SeqID_10345
MGHRPIGMRAEGGLQSSGIIMIHSNCEVRMEGGEEGLEMMVDSKDLQQQSKALDKLTDHVEDRQLDSTRVQEAMASIAASAEADRNAMRISLAKQGNVCCVVRGAKTPNRSLATGQTKNNASGLESSSNKNLKALGEWVPVAYTLLNLSIIIHCRTLGLPHHA

SEQ ID NO: 127124 - protein, 340 aa, Glycine max
  Coding DNA Sequence Number=SeqID_10346
  Gene Ontology: Mol. function=cysteine-type endopeptidase activity; Cellular component=endoplasmic reticulum; Biological process =proteolysis
  Homolog annotation: Hit_ID=Q6F6A4; Match level="QueryCoverage=92%, HitCoverage=88%, E-value=6e-89, Identity=50%"; Hit description =Cysteine protease
  Pfam annotation: Domain name=Inhibitor_I29; Domain location=38-95; Score=85.5; E_value=1.7e-22; Accession=PF08246.2; Description =Cathepsin propeptide inhibitor domain (
  Pfam annotation: Domain name=Peptidase_C1; Domain location=129-339; Score=360.4; E_value=2.9e-105; Accession=PF00112.13; Description =Papain family cysteine protease
  Pfam module annotation: Pfam domain module=Inhibitor_I29::Peptidase _C1; Domain location=38-95::129-339
MALTLDKKSVGTFFMLFLTCICRASSRTLSESSIATQHEEWMAMHDRVYADSAEKDRRQQIFKENLEFIEKHNNEGKKRYNLSLNSFADLTNEEFVASHTGALYKPPTQLGSFKINHSLGFHKMSVGDIEASLDWRKRGAVNDIKNQGRCGSCWAFSAVAAVEGINQIKNGQLVSLSEQNLVDCASNDGCHGQYVEKAFDYIRDYGLANEEEYPYVETVGTCSGNSNPAIQIRGYQSVTPQNEEQLLTAVASQPVSVLLEAKGQGFQFYSGGVFSGECGTELNHAVTIVGYGEEAEGKYWLIRNSWGKSWGEGGYMKLMRDTGNPQGLCGINMQASYPFL

SEQ ID NO: 127125 - protein, 363 aa, Glycine max
  Coding DNA Sequence Number=SeqID_10347
  Pfam annotation: Domain name=GRP; Domain location=1-136; Score=-20.2; E_value=0.0087; Accession=PF07172.2; Description=Glycine rich protein family
MGKLRKSIGTFTVFFLLVIVIAECQKIKKHELIDGFEGDGFGGGGGGFGGGAGGGAGGGFGGGHGSGVGGGAGGGGGAGGGYGGGVGGGYGGDKGGGAGGGIEGGHGGIGGEGGGVGGGAGGGGAGGIGGGHAGGIGGGGGGGGGAGSGAAGNVGGGHGGGIGGGAGGAGGGGQAGGGHGGGIGGGAGGAGGGGQAGGGHGGGIGGGHGSGIGGGAGGGSGAGGNIGGGHGGGVGGGGVGVGGGYGGGKGGGAGGCGGINNGGMGGGHGGGVGGGSGGGAEGDTGGGAGGGGGHNGGVGGGSGGGGAGGGIGGGKGGVGGGGVGSGTGGGVGGGYGGGKGGVGGGFGVVAGGHASGSAGGDGY

SEQ ID NO: 127126 - protein, 143 aa, Glycine max
  Coding DNA Sequence Number=SeqID_10348
  Gene Ontology: Mol. function=transcription regulator activity; Cellular component=nucleus; Biological process=regulation of transcription
  Homolog annotation: Hit_ID=Q1SVR0; Match level="QueryCoverage=67%, HitCoverage=37%, E-value=2e-18, Identity=46%"; Hit description=Helix- loop-helix DNA-binding
MDKATLLAEVISQVKELKKNAMEASKGFLIPMDADEVKVEPYDDEGGDGSMSYCATICCDFRSEILSDLRQTLDSLPLHLVKAEISTLAGRMKNVFVFTLLPHWISHQEHRMQARGEDYALLKHPLPHATTDLVCADVNNLMC

SEQ ID NO: 127127 - protein, 255 aa, Glycine max
  Coding DNA Sequence Number=SeqID_10349
MEKENSDKEEYVMMLQRCVKKLHFGSREEKEVAAKVIEEGLAKQDVVKVREMTSELGVVRVLVSMAVSEVASRHRVGLKALIHLSNGTHGNKALIVEAGILSILPKKIDLEDESISEFAHLLSSLSSQGTIKRRQDSAYFVLRGMVSNLLPPSTPPTHYKAKRIISSDLIIYKKLHHAEVVSIFQNLTSMESMLINLKNLPPSMNIWKPKWHSQSPNLKDYSNAVLAELLQIKTDQENHLEKSLEKAANMDIHKF

SEQ ID NO: 127128 - protein, 48 aa, Glycine max
  Coding DNA Sequence Number=SeqID_10350
  Homolog annotation: Hit_ID=Q6EU49; Match level="QueryCoverage=96%, HitCoverage=14%, E-value=5e-07, Identity=56%"; Hit description =Putative MAP kinase
MSFTHQSNSSVFIQRCRQKYKRVDIRAVKNWTRQILSGLEYLHSHILP

SEQ ID NO: 127129 - protein, 896 aa, Glycine max
  Coding DNA Sequence Number=SeqID_10351
  Gene Ontology: Mol. function=actin binding; Cellular component =phragmoplast; Biological process=actin cytoskeleton organization and biogenesis
  Homolog annotation: Hit_ID=Q9SE97; Match level="QueryCoverage=52%, HitCoverage=42%, E-value=1e-163, Identity=63%"; Hit description =Formin-like protein AHF1
  Pfam annotation: Domain name=FH2; Domain location=421-839; Score =542.3; E_value=5e-160; Accession=PF02181.13; Description=Formin Homology 2 Domain
  Subcellular localization annotation: CTP_CleavageSite=44; ConfidenceScore=5.43e-01
MCAPFNILVLLLSLLLTSSSCSSSFSQPRRVLHQPLFPRISVPPAQAPSYLSPEPQPKQQHLQPKLPFSSISSSSPPPPQKSFFPSYHSPPLPPSPAVLATFPANISSLLLPRPISRHHRSAAALAVSLSLCSIALLAAAAAFLLHHRRRTHSSSDVNDDDDDKASRSDSLRLFPPNTAASDGAERKPRGKTSPTSELLYLGTVANSVTTTTTSTTTTATTDSSSSHHESFRPPYQKLGDSPELNPLPPLPRHKFKPWTTEEENNDKDIIEKENEEEEEEEQFFSPSGSSGGKINKQQKSSPSPSGVVASSSRVFHVDKFGSRSFTSRTPSYPRSNSLSFSRSPSLNFSPPSVKSLPPNNNPASPSFSSSSSSPREEWHVPSQRKNSPAATDLPTPPPPPPPPPPQFWEAPVDKSVTFRNESEETPKPKLKALHWDKVKASSDRVMVWDRLGPSSFQLNEDMIETLFMVNNNNNNSKEGFGVAIRDNHNPRRQVVHSASPMPLENRVLDPKKSQNIAILLRALNVTIDEVCDALREGNCDTLGTELLESLLKMAPTKDEESKLKEFQDESPFKLGPAEKFLKVVLDIPFAFKRVDAMLYIANFDSELEYLKKSFETLEVACEELRKSRMFLKILEAVLRTGNRMNVGTNRGDAHAFKLDTLLKLVDIKGTDGKTTLLHFVVWEIVRTEGSHISGSNNNHAADNDHQYTLQDEVDFKKLGLQVVSGLSGELTNVKKTAAMDSDMLSSDVAKLARGIEKIVQVVKLNEESPLKETNQKFSDAMKCFLERGEQEISTIQGQEKNALSSVKEITEYFHGNSAKEEAHPFRIFMVVRDFLSILDGVCKEIGKVNERTLVGSRQSVMPANPIMQTFFPEIIGKQPSDSSESDYPLKANLTQM

SEQ ID NO: 127130 - protein, 345 aa, Glycine max
  Coding DNA Sequence Number=SeqID_10352
  Gene Ontology: Mol. function=hydrolase activity; Cellular component =nucleus; Biological process=cell redox homeostasis
  Homolog annotation: Hit_ID=Q69MT1; Match level="QueryCoverage=93%, HitCoverage=65%, E-value=1e-108, Identity=62%"; Hit description=Acyl- CoA thioester hydrolase-like
  Pfam annotation: Domain name=4HBT; Domain location=2-82; Score=8.9; E_ value=0.038; Accession=PF03061.12; Description=Thioesterase superfamily
MGKLVEDFDALAGTVAFKQHCSNEDGTARPLLLVTASVDKMVLKKPIHIEADLTIVGAVSWVGRSSMEIQLELTQSAQGNPNISSSPALVANFTFVARDSATGKAAPINQISPESEQERLLWEEAEERNKFRKRMKQEQKHGESEDPARLKALLAEGRIFCDMPALANRDSVLMKDTCLQNSFICQPQQRNIHGRIFGGFLMRRAFELAFSTAYAFAGAAPHFLEVDHVDFFKPVDVGNFLRLKSCVLYTELDNIAEPLVNVEVVAHVTKPEHRSSEVSNRFYFTFGVDPVAIKNGLRLLHVVPATEEEARKVLERMDAENLSLVKKDGNLNVVKENKCTEKTNL

SEQ ID NO: 127131 - protein, 103 aa, Glycine max
  Coding DNA Sequence Number=SeqID_10353
MVSNIKDFAAPSWKRIVEYDREKERKLVGFSWSSMLGNMRRYNAREIPINESQFNYISELNTAFNLKPLDFKTLTYYHLIQANHLKSLTLLQHEELCLGYQGI

SEQ ID NO: 127132 - protein, 152 aa, Glycine max
  Coding DNA Sequence Number=SeqID_10354
MEDDYFNKMFNEVDMDMDKNVDDALKNEDCSNFFTTTEVFHTQDELLKWVLAVVFELSFVIIILSSPRIMDYLISSKQNPKETKGTYLEWRHTKEGGHTKSRNEEGTGGTRWREKMRRVIVVRTTTFIGGKGTVAGAIAVGGRCVVGKEVLG

SEQ ID NO: 127133 - protein, 93 aa, Glycine max
  Coding DNA Sequence Number=SeqID_10355
ALWVNVNGDNDNDVNWASGGDDDENDDSGDDNMVVMMVALVDGVYDDDCGGSLMDGSCEFATTLALNPGRESVRRLGSRVQCDCQLTITFLAP

SEQ ID NO: 127134 - protein, 46 aa, Glycine max
  Coding DNA Sequence Number=SeqID_10356
MTTNKWLNIVVDGNSALGPYWPKIVSDYLEKIVRFVSPKFHNKSSN

SEQ ID NO: 127135 - protein, 179 aa, Glycine max
  Coding DNA Sequence Number=SeqID_10357
  Gene Ontology: Mol. function=protein serine/threonine kinase activity; Biological process=protein amino acid phosphorylation
  Homolog annotation: Hit_ID=Q9XED4; Match level="QueryCoverage=71%, HitCoverage=25%, E-value=1e-26, Identity=41%"; Hit description =Receptor-like protein kinase homolog RK20-1
  Pfam annotation: Domain name=DUF26; Domain location=73-121; Score =11.3; E_value=0.00024; Accession=PF01657.8; Description=Domain of unknown function DUF26
MAAPAIVSKTLLLFLILHAILMSLATSQPNFVKHYCFDQNGQPQCPFVSNLSSNTEIDYGFYNFSNGQNSDKVNVIGMCRGDLKPEACRSCLNNSRILLTQLFQTRRRQLGVVGDLLRILGNRAAAGDSHRMYAQANKTGPSFQTVFAHVQCTPDLLELECNQCLFGNLISYIPKCRQF

SEQ ID NO: 127136 - protein, 62 aa, Glycine max
  Coding DNA Sequence Number=SeqID_10358
MARSWVVKFLHQVVILDSKLTGIFRLQKRILICAGNSDASRTVLLVAMAVLVVSVDLVLGFI

SEQ ID NO: 127137 - protein, 664 aa, Glycine max
  Coding DNA Sequence Number=SeqID_10359
  Gene Ontology: Mol. function=protein serine/threonine kinase activity; Cellular component=mitochondrion; Biological process =protein amino acid phosphorylation
  Homolog annotation: Hit_ID=Q9XED4; Match level="QueryCoverage=95%, HitCoverage=96%, E-value=0.0, Identity=54%"; Hit description =Receptor-like protein kinase homolog RK20-1
  Pfam annotation: Domain name=DUF26; Domain location=195-250; Score =57.6; E_value=4e-14; Accession=PF01657.8; Description=Domain of unknown function DUF26
  Pfam annotation: Domain name=DUF26; Domain location=82-136; Score =87.3; E_value=4.6e-23; Accession=PF01657.8; Description=Domain of unknown function DUF26
  Pfam annotation: Domain name=Pkinase; Domain location=346-616; Score =154.9; E_value=2.1e-43; Accession=PF00069.15; Description=Protein kinase domain
  Pfam annotation: Domain name=Pkinase_Tyr; Domain location=346-616; Score=118.5; E_value=1.9e-32; Accession=PF07714.7; Description =Protein tyrosine kinase
  Pfam module annotation: Pfam domain module=DUF26::DUF26::Pkinase::Pkin ase_Tyr; Domain location=195-250::82-136::346-616::346-616
MAAPAIVSKTLLLFLILHAILMSLATSQPNFVKHYCFDQNGNYTANSTFQANLNTLLSNLSSNTEIDYGFYNFSNGQNTDKVNVIGMCRGDLKPEACRSCLNNSRILLTQLCPNQKEAIGWYDQCMLRYSTRSIFGIMESDPLYNIRNNQNATNVDQYNEVVGDLLRSLGNRAAAGDSQLKYAQANKTGPSFQTIFAHVQCTPDLTDLECNQCLFGKLISYIPNCCAGKVRGRIFTPSCNLRFDTTPYFDPIPTTDVPHSSIPQAFPSPAPSAMLIKGKSNSWKTAIAIIVPIVSILILFTFMCFFLRRRKPTKYFKSESVADYEIEPTETLQLDFQTIIDATNNFADVNKLGEGGFGPVYKGRLPNGEEVAIKRLSKDSGQGDIEFKNELLLVAKLQHRNLARVLGFCLETGERILVYEFLPNRSLDYFIFDPIKRLNLDWERRYKIIQGIARGLLYLHEDSRLRIIHRDLKASNILLDDEMNPKISDFGMARLFDADQTLGNTRRVVGTYGYMAPEYAMHGHFSVKSDVFSFGVLVLEIVTGHKNGDIHKSGYVEHLISFVWTNWREGTALNIVDQTLHNNSRDEIMRCIHIGLLCVEDNVANRPTMATVVIMFNSNSLVLPIPSQPAYSTNVKGPSRSNESRNNFKQASSNEVSISDLDPR

SEQ ID NO: 127138 - protein, 76 aa, Glycine max
  Coding DNA Sequence Number=SeqID_10360
MLTSPGRVQMTTLVSACQSDLGSSNDEVSPHATGLSGHDSRIETFLRCRPEDADISGKGVDDHIGLCVSTGSLASS

SEQ ID NO: 127139 - protein, 71 aa, Glycine max
  Coding DNA Sequence Number=SeqID_10361
  Subcellular localization annotation: CTP_CleavageSite=61; ConfidenceScore=5.39e-01
MKPLPPVVTPPSVSPHSHASSSSSVKVFHKIFPYGKVILLKYLFPCEMSILGRRVELEKKRTMKVEGLDLR

SEQ ID NO: 127140 - protein, 412 aa, Glycine max
  Coding DNA Sequence Number=SeqID_10362
  Homolog annotation: Hit_ID=Q7XYY2; Match level="QueryCoverage=57%, HitCoverage=28%, E-value=2e-12, Identity=29%"; Hit description =Phytochrome and flowering time 1 protein
SKVQHINWTKNVEQFLGVLPNLPFNGDNLNQHTIVEGLAQALVMFPKDSMTKSEYLKGERHCILVATGDPVAKSMLVNLPLLHKGIFISGQFKTLDATFINVAKIFVPLRVSLSIITPNPHPLFISIFSLGNGLIEGTDLITDHGKGQLTVLLSRNFKEAQCIHSRTTLEEDPLTRLLEQEQPMPLDEILGQVFRSSTSTSREGSLPQNAWSTEVGASSFGFPNTLGNSLNQFQPPSFPILYPYDNVSDGVGPSASAGSSVDVRASAAALVAVGAASSGAIADAGVVACANVGASPYYGSYHQQFPSHHRFEMSEINPIGTSSTGANPWGSPVPMMPEYNEAFLWPEPPTNFEDYVQAWEGCLVGRIHSSISLNQAKTLRRLTSSITLTYQWPSRLEIVLFLPKTAVSYTTR

SEQ ID NO: 127141 - protein, 62 aa, Glycine max
  Coding DNA Sequence Number=SeqID_10363
MASVEFQLKLTQVYSLKHQDSLPIEANGFVAGRPRNLTRSRTQAEFIRFLPHFQSLHVQCLC

SEQ ID NO: 127142 - protein, 53 aa, Glycine max
  Coding DNA Sequence Number=SeqID_10364
MHSKGVVLACSPIDAALVATAGGDDRRFLRKIGQGDWAFELQGICMTLKLVMD

SEQ ID NO: 127143 - protein, 70 aa, Glycine max
  Coding DNA Sequence Number=SeqID_10365
MGFANSNSKRNWKLADLDEATTATTNGSIVVRGGGSEVPEVVAKDIDDDVGSNKLVMKLVKNGVQWWPHH

SEQ ID NO: 127144 - protein, 89 aa, Glycine max
  Coding DNA Sequence Number=SeqID_10366
MEHGGECDKEKEHRRHCLYEPGGIPNNNMNNTPSSLHLISLCACGGSPTPTTSSDDGKTRNRFFSSKLREIYPIDFDKFKYIRFRGIEI

SEQ ID NO: 127145 - protein, 219 aa, Glycine max
  Coding DNA Sequence Number=SeqID_10367
MPHPFLFLPWTDIDEDCHRWMVHFIHQNGMQLVWLALTPLTPLPGKSTKRSKRYNWPQLTFSCVYINSVNEQGRSLSCDDKQYREEEELRKGELEADADRMMREYRAQLDAERARKLSQGRNHSSSKSKHVKDKRDKISRKHSSRKRKHSRRSSASSSSSSSSDSSSSDEERGSRRSKSRSKRSKKEKKSKSRSKDAGSDSEDEGPVRLSRFFGNIKSE

SEQ ID NO: 127146 - protein, 53 aa, Glycine max
  Coding DNA Sequence Number=SeqID_10368
MEGTGIEIYGVGWRKRGLRNEADEKLEYVGGELDVRGVRRSNMAESGIMLMSF

SEQ ID NO: 127147 - protein, 133 aa, Glycine max
  Coding DNA Sequence Number=SeqID_10369
  Gene Ontology: Mol. function=hydrolase activity; Biological process =metabolic process
  Homolog annotation: Hit_ID=Q1SUH1; Match level="QueryCoverage=76%, HitCoverage=30%, E-value=3e-46, Identity=87%"; Hit description =Haloacid dehalogenase-like hydrolase
MVAGPVRSPPRWKTTLPRCHFNLRDDPWFAALGRSCIHFTWNGRGAIPLEGLDLRVVENVEEAEFVLAHGTEALGNADGSSCSMKLEDMERILELCAAKGIPMVVANPDYVTVEARDLRVMPGEFALSTPFSF

SEQ ID NO: 127148 - protein, 272 aa, Glycine max
  Coding DNA Sequence Number=SeqID_10370
  Gene Ontology: Mol. function=nucleic acid binding
MAPGVEILWGVWKGKRDLETPRFGELSETVQVLKLKWANLRGYGIEIYGVGWRKRGLRNEADGKLEYVGGELDVRGVRRSNMAEPFIGLDGCFLKGYFGGQLLSVVSLDRNNHIYVLAYAVGLIPALQEVLHGAPYRFCAMHLWKNFTKQWKNKELKGVVWDCAKSTTLLEFNQNLARVKALNIKAWEYLKNRPKEAWTKAYYSEWCKVDNICNNTCEVFNSKIVTYRTKPILTMLEEIRCYVMRSMSGHKLKLAARIGPLDTYCTILHNIA

SEQ ID NO: 127149 - protein, 894 aa, Glycine max
  Coding DNA Sequence Number=SeqID_10371
  Homolog annotation: Hit_ID=Q6K2T0; Match level="QueryCoverage=98%, HitCoverage=97%, E-value=1e-103, Identity=32%"; Hit description =Extra-large G-protein-like
MEDSTKLRLVRCPKCQNVLPELANYTIYQCGACNTVLRGKPKGFEGGGRLWQTSDKEQGGGDQGTPRSFLGKGVVDLSDNSDVEVRPSGGSFWEGQRRDLGKPNKGHERFLDDSRDGDEKGVLEDGFNVNKDKRGKSIGREQKEQKTHMGGDQFYGRMSNWPNGERGEMEGFWRKTHADMEGVRFPTLNYPDEGSSNSFSSFSYSYGEQWRNYKDMDGVNRVQHLEQDRAEILRKLGELSNQLNKSSEVVSNPKEKVLPEGKMVPPDLFGGPENWFPDGSSAMNRSSGQFFGPTSNKHMAGSPYFNYHQDPYAYASDHEMAMHNFHPSMHNPNYVPGYGDPSVSQMMRSSHPIPRQFLQKPMHPYFPGRYTDTVPDSYDPYAQNAMLHPPSCPCFRCYDNKIRGSVPAPPAAFVKSRFPRTPNDSMLYHHEISGAVGPHVHNARTAMSAVSLHEKQLHTRGPRDYSSEMGGFVGSRPRKVVPGTGSRQCLPIAGGSPFITCHICFELLQLPKKTLVMVKNRQLKMRCGACSTEIKFSVINKKLIISPNSEMEETTTSTRVDDTTNEVVNSCAFQACGDVNAGAANFSSDDYSGYDFHSVDRESPVLAADPILNSTKSRERQSFHSSSPCISDDENSPEVMTAPIEATKSIHQPFKASQSPSPSGSFNNAVKRLGKGNQSSCSDQETEKIEKNASRQNSLKEVLATEMDVNDYSNNGVFQDSGDASGEHDRSRSSKRGESFLANIIKKDNGKSNVTVNGHPIPDRMIKKAEKLAGPIQPGNYWYDSRAGFWGVMGGPCLGIILPFIEEFQHPMPDKCAGGNTSVYVNGRELHQKDLDLLSRRGLPRDSNRYYIVEISGRVLDEDTGEELDSLGKLAPTVEKERRGFGMKAPRTAA

SEQ ID NO: 127150 - protein, 185 aa, Glycine max
  Coding DNA Sequence Number=SeqID_10372
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q654T8; Match level="QueryCoverage=87%, HitCoverage=35%, E-value=1e-32, Identity=47%"; Hit description=Leaf senescence protein-like
MVKRVRSDSGPLSLQKHNHWCVKLGVSIFLVGLVVRLLLWDSFSFSSVVVETPPPLEEAKAESPVFASSVLQDSDDFPENDQNQTQISKNEKCDLFVGNWVQDLSGPVYTNESCRVIEPHQNCMKNGRPDSGYLYWRWSPRDCVLPKFNPRKFLKFMRNKSMSFIGDSISRNQVQSLLCILSKVL

SEQ ID NO: 127151 - protein, 65 aa, Glycine max
  Coding DNA Sequence Number=SeqID_10373
  Gene Ontology: Mol. function=protein serine/threonine kinase activity; Biological process=protein amino acid phosphorylation
  Homolog annotation: Hit_ID=Q9XED4; Match level="QueryCoverage=89%, HitCoverage=11%, E-value=6e-14, Identity=54%"; Hit description =Receptor-like protein kinase homolog RK20-1
MRPNIEQVAQHALVVPPNCVFLAAAAFVWFNISSAQPNGVYFVSVFAVREIVKTIVDSFVGSEIG

SEQ ID NO: 127152 - protein, 226 aa, Glycine max
  Coding DNA Sequence Number=SeqID_10374
  Gene Ontology: Mol. function=sequence-specific DNA binding; Cellular component=nucleus; Biological process=regulation of transcription, DNA-dependent
  Homolog annotation: Hit_ID=Q1SEL3; Match level="QueryCoverage=85%, HitCoverage=91%, E-value=4e-47, Identity=46%"; Hit description =Transcription factor, MADS-box
  Pfam annotation: Domain name=SRF-TF; Domain location=17-67; Score =72.5; E_value=1.4e-18; Accession=PF00319.9; Description=SRF-type transcription factor (DNA-binding and dimerisation domain)
MSKNKKSSLGRQKIPIEKIPKKSHLQVTFSKRRSGLFKKASELCTLCGVEIAIVVFSPADKAFSFGHPEVESLIDRYTTRNPPQESSAHHLVEAHRNANVCDLNMQLTQVFNHLEIEKKRADDLDHVRKARQRQFWWESPIDELGLNELLQLKASIEELKKNIEKHASKFMIEHSSNIPSSSILGPNNGLGPLVRYDTFENKPGAEIGIASSIPNAHYLAFRTGYL

SEQ ID NO: 127153 - protein, 509 aa, Glycine max
  Coding DNA Sequence Number=SeqID_10375
  Gene Ontology: Mol. function=extracellular matrix structural constituent; Cellular component=proteinaceous extracellular matrix; Biological process=multicellular organismal development
  Homolog annotation: Hit_ID=Q67YL8; Match level="QueryCoverage=62%, HitCoverage=53%, E-value=3e-15, Identity=24%"; Hit description=MRNA, complete cds, clone: RAFL24-22-E06
MIKRFPSRNNRSKGIKVKHNHDKKNEFAKDAKLSVSTQTDPILKLGRRDLHPGKHEEIQNEKHEEEEEDEHIEEDEETKHDHEEQQDGNKNETEEREENKHEGRLQRGEENKHGAEDQEEDVEDVGRGGGDDDIDENDQEKSEMDTIDRDDEFLDEEKEKEEVDEKENENEDEEKESLVENHNNHEAREEHYKGDDASSAVAHDTHATSTETETLSLENSDVNLEMNITKPENETTYSDESVRKQNDSDLKVSEGNVIDGISSNATAVQETGNNTLSNPVDDSSFLNKTTATDSDSHFQSSSNLTVVTTEASNNLTLAGNDTSSSSEQNKTVMLSESDQAQNSTTNTTIPGDVKDVQTEGLEQSGNRTSDENLHDTNSTISIKTENGGEDAGESSNLVASNVTENAYRNERSESDISESDKSNGNTETNENPNVDATEDEMFKGDTQTGETDETSDSSSANETMDSAEQDAIDSSDTHIHEDVAEARTDLDTLPDIRNEGDDSDETAAE

SEQ ID NO: 127154 - protein, 173 aa, Glycine max
  Coding DNA Sequence Number=SeqID_10376
  Gene Ontology: Mol. function=sequence-specific DNA binding; Cellular component=nucleus; Biological process=regulation of transcription, DNA-dependent
  Homolog annotation: Hit_ID=Q1S3Y2; Match level="QueryCoverage=93%, HitCoverage=90%, E-value=6e-41, Identity=54%"; Hit description =Transcription factor, MADS-box
  Pfam annotation: Domain name=SRF-TF; Domain location=21-71; Score =77.3; E_value=4.9e-20; Accession=PF00319.9; Description=SRF-type transcription factor (DNA-binding and dimerisation domain)
MDMFKQKEKKKNTGRKKIEIKKLDKGSNKQVTFSKRRAGLFKKASELCILCNVYVAIIVFSPADKLFCFGHPDIDSIIGRYLKGDNAEFESAKSSKGKSVSCEERNRQYEEAMKKLELEKKNLAQIEVLTKGWNRSWWDDPIDQMTDLQLEQFMVSIYELRKKLAERAGELMM

SEQ ID NO: 127155 - protein, 97 aa, Glycine max
  Coding DNA Sequence Number=SeqID_10377
  Homolog annotation: Hit_ID=Q8L7G3; Match level="QueryCoverage=95%, HitCoverage=13%, E-value=3e-07, Identity=42%"; Hit description =Putative serine/threonine kinase
  Subcellular localization annotation: CTP_CleavageSite=57; ConfidenceScore=5.14e-01
MASFMFVYLFILLTLTNFVTTIAQFDRDIPDRVCSNNLTTPNSTFQLNVKTLLSYLSSNATANKQYYNTTVGSRNHSDSTVYGMFLCWGDLPPQLCS

SEQ ID NO: 127156 - protein, 173 aa, Glycine max
  Coding DNA Sequence Number=SeqID_10378
MTDPLDESISCFLIKVDPWVLVPITFRGLYVLAIRGLHILACRGLHTLAFRGLRVLIFIPGPSPDIGRRPIVRANPEREAITHLLCIPGQDFTRVAAKRRVRIMRANMTTLTWIWMTLLFSNILPSDHCRNMPFAGVQGEAHGCTFQRRKDARSRHQRLFVENVGKTEGNRSK

SEQ ID NO: 127157 - protein, 1236 aa, Glycine max
  Coding DNA Sequence Number=SeqID_10379
  Gene Ontology: Mol. function=hydrolase activity; Cellular component =membrane
  Homolog annotation: Hit_ID=Q1SUH7; Match level="QueryCoverage=99%, HitCoverage=76%, E-value=0.0, Identity=83%"; Hit description =WW/Rsp5/WWP; Synaptojanin, N-terminal; Galactose-binding like
  Pfam annotation: Domain name=BON; Domain location=911-968; Score =12.7; E_value=0.071; Accession=PF04972.7; Description=Transport -associated domain
  Pfam annotation: Domain name=Syja_N; Domain location=81-401; Score= -63.7; E_value=2e-07; Accession=PF02383.9; Description=SacI homology domain
  Pfam annotation: Domain name=WW; Domain location=509-539; Score=54.0; E_value=4.9e-13; Accession=PF00397.16; Description=WW domain
  Pfam module annotation: Pfam domain module=BON::Syja_N::WW; Domain location=911-968::81-401::509-539
MESPGALRDTSVIVVTLDSDEVFIVASLCTRTDTQVIYVDPTTGALRHEAKLGFDLFKSQGEALDFVTNGSRFACRSRTLARAILGYAALGNVALLLVATRLVASVSNLPGGGCVYTVAESQWIRIPLQNAVAQGKGEVKNVQELTELDIDGKHYFCETRDVTRPFPSRMPVNEPDQEFVWNAWFSTPFVEIGLPRHCVTLLQGFAECRSFGSSGQLEGVVALTARRSRLHPGTRYLARGLNSCFSTGNEVECEQLVWIPKRAGQSVPLNRYVWRRGTIPIWWGAELKITAAEAEIYVSDCDPYKGSVQYYERLSKRYDARNMDIRAGENSNRKALVPIVCINLLRNGEGKSESLLVQHFEESINFIRSTGKLPNTRVHLINYDWHASVKLKGEQMTIEGLWKLLKAPTLSIGISEGDYLPSRQRINDCQGEVIYNDDFEGAFCLRTNQNGIVRFNCADSLDRTNAASFFGCLQVFTEQCRRLGISLDSDLAFGYQSMNNNYGGYTAPLPPGWEKRSDAVTGKTYYIDHNTRTTTWMHPCPDKPWKRFDMTFEEFKRSTILSPVSQLADLFLLAGDIHATLYTGSKAMHSQILSIFNEDTGGKFKQFSAAQNVKITLQRRYKNAVVDSSRQKQLEMFLGMRLFKHLPSISLQPLHVPSRPSGFVLKPIANLFPISGGEASLLSFKRKGLVWICPQPADVVEIFIYLGEPCHVCQLLLTISHGADDSTYPSTVDVRTGRHLDGLKLVLEGASIPQCASGTNLLIPLPGAINAEDMAITGANSHLHAQDASPLSLLYDFEELEGEWDFLTRVVALTFYPTVSGRKPLTLGEIEILGVSLPWSDVFTNEGPGTRLVEHVKKFEEELNPFVSDSDTNPFNSSSSEKASPPKQGGTSADHFIDLLSGEDPLPHPLAQPVTENIVYQENDPLDFLDLSVENHSAKINGKVSSEDARHAESSAEQYLKCLKTLAGPSLQRKINFIEAIKLEIERLKLNLSAAERDRALLSVGMDPATINPNTLLDEAYTGRLSKVANNLALLGEASLEDKLVGAIGLGTVDDNPIDFWNIIRIGETCSGGKCEVRAEIRKAVHSSNTMSSAGASEAVFLCSQCERKACRVCCAGRGAFLLVGYNSREVQVDFPVNRLLAQDGIICKRCCQDIVLHALILDCVRVLISFRRAERVEKAAYNALKQIIGSSWDCHLEKKQVPDSKSAGKAVQLLLNGYESLAEFPFGSFLHPMHG

SEQ ID NO: 127158 - protein, 75 aa, Glycine max
  Coding DNA Sequence Number=SeqID_10380
MVSKPILTIDVRPFRPPVIRPSLDHPQMSSPANFMLKISSPWREECVGEFALTSDMAKVVYISRGQPSPHVGFLG

SEQ ID NO: 127159 - protein, 301 aa, Glycine max
  Coding DNA Sequence Number=SeqID_10381
  Gene Ontology: Mol. function=carboxypeptidase activity
  Homolog annotation: Hit_ID=Q654T8; Match level="QueryCoverage=84%, HitCoverage=60%, E-value=2e-80, Identity=55%"; Hit description=Leaf senescence protein-like
  Pfam annotation: Domain name=DUF231; Domain location=126-298; Score =237.4; E_value=3.1e-68; Accession=PF03005.6; Description=Arabidopsis proteins of unknown function
MLIPFVDDSCCLYYTIGPQPSRLNSIYYSVFSQAALPTLDVERLVYVEPAVEIYHDKEYRSKIWKFRSHNFTLSVIWTPFLVKAAIFEDFNGVTSSEIQLYLDTLDQWTNQYKNFDYVVIGGGKWFLKTAIYHENKTVTGCHYCPGKNLTELGFDYAYRRVLQEVFKFFTKSNHKATVLFRTTTPDHFENGEWFSGGYCNRTVPFKEGQIHMIDVDSIMRGIELEEFEKAASLGSKRVNLKLLDTTLLSLLRPDGHPGPYRKFQPFAKDKNAKVQNDCLHWCLPGPIDSWNDIILQMLLNA

SEQ ID NO: 127160 - protein, 82 aa, Glycine max
  Coding DNA Sequence Number=SeqID_10382
  Gene Ontology: Biological process=metabolic process
  Homolog annotation: Hit_ID=Q93WZ8; Match level="QueryCoverage=99%, HitCoverage=2%, E-value=5e-20, Identity=68%"; Hit description=NADH glutamate synthase precursor
MDKDSCGVGFVAELSGESSRKTVSATTLAFACECEYESGACGVTDALEMLVRMTHRGACGVKPTLEMEQGSWWLYLTSFTRR

SEQ ID NO: 127161 - protein, 390 aa, Glycine max
  Coding DNA Sequence Number=SeqID_10383
  Gene Ontology: Mol. function=pyridoxal phosphate binding; Cellular component=chloroplast; Biological process=cysteine biosynthetic process from serine
  Homolog annotation: Hit_ID=Q1SUH8; Match level="QueryCoverage=100%, HitCoverage=92%, E-value=1e-146, Identity=73%"; Hit description =Pyridoxal-5-phosphate-dependent enzyme, beta subunit
  Pfam annotation: Domain name=PALP; Domain location=76-390; Score =411.7; E_value=1e-120; Accession=PF00291.15; Description=Pyridoxal -phosphate dependent enzyme
  Subcellular localization annotation: CTP_CleavageSite=55; ConfidenceScore=5.81e-01
MASASLINSLTCSSRAPTQHCSTFTRTTAATSLRQFNSHCRRPLATRISPPSTVVCKAVSVKPQTEIEGLNIAEDVTQLIGKTPMVYLNNIVKGSVANIAAKLEIMEPCCSVKDRIGFSMINDAEQRGAITPGKSILVEPTSGNTGIGLAFIAASRGYKLILTMPASMSLERRVLLKAFGAELVLTDAAKGMNGAVQKAEEILKSTPNAYMLQQFDNPSNPKVFIAYSMFKCTNPMFLGMGTLAGCIIMSSLQIHYETTGPEIWEDTRGKIDILVAGIGTGGTVSGVGQFLKQQNPKIQVIGVEPLESNILTGGKPGPHKIQGIGAGFVPRNLDQDVLDEVIAISSDEAVETAKQLALQEGLLVGISSGAAAAAALKVGKRPENAGKLIG

SEQ ID NO: 127162 - protein, 67 aa, Glycine max
  Coding DNA Sequence Number=SeqID_10384
MENKALFRLLVILLALFFVVFVAAVPATRSSMIGKIDPLVQDHLAKVPFSSQGQIFMPHICPGNSIN

SEQ ID NO: 127163 - protein, 147 aa, Glycine max
  Coding DNA Sequence Number=SeqID_10385
  Gene Ontology: Mol. function=RNA-directed DNA polymerase activity; Biological process=RNA-dependent DNA replication
MVFVGDVVSGTGQNYSLCLVGRNIDHGRWQWCFHILVLSSQGYVAGYEGRGPWTFDKHLLILSIIKEVLANRLKRVLLNCISKEQPTFIEGRSILDNVLVAIETIHHMKCKVIGNEGGFALKIHINKAFDKVDGRGVGPILPGQGKD

SEQ ID NO: 127164 - protein, 100 aa, Glycine max
  Coding DNA Sequence Number=SeqID_10386
MRKFAMKQGYMLVSKKGYMVVLPKVDDGVKAGVGASVEERVGVSLNTFVNGSDESFQGTCLKVFDTEMDLDTEDTFEEVVDDLRNVVNSRIPFDILDVII

SEQ ID NO: 127165 - protein, 197 aa, Glycine max
  Coding DNA Sequence Number=SeqID_10387
  Gene Ontology: Mol. function=monooxygenase activity; Cellular component=membrane; Biological process=electron transport
  Homolog annotation: Hit_ID=Q1SCJ4; Match level="QueryCoverage=99%, HitCoverage=36%, E-value=1e-105, Identity=91%"; Hit description=E -class P450, group I
METCTALLFLTAITAYLIWFTFISRSLKGPRVWALLGSLPGLIDNCDRMHDWICDNLRACGGTYQTCICAIPFLAKKQGLVTVTCDPRNLEHILKTRFDNYPKGPTWHAVFHDLLGDGIFNTDGDTWLFQRKTAALEFTTRTLRQAMARWVSRAINRLCLILEKAENQVEPVDLQDLMLRLTFDNICGLAFGRDPQT

SEQ ID NO: 127166 - protein, 176 aa, Glycine max
  Coding DNA Sequence Number=SeqID_10388
  Gene Ontology: Mol. function=oxidoreductase activity; Cellular component=cytosol; Biological process=metabolic process
  Homolog annotation: Hit_ID=Q6RZU3; Match level="QueryCoverage=92%, HitCoverage=51%, E-value=4e-46, Identity=60%"; Hit description =Putative short-chain hydrogenase/reductase
  Pfam annotation: Domain name=KR; Domain location=22-169; Score=-64.2; E_value=0.0012; Accession=PF08659.1; Description=KR domain
  Pfam annotation: Domain name=adh_short; Domain location=22-168; Score= 11.2; E_value=1e-06; Accession=PF00106.15; Description=short chain dehydrogenase
  Pfam module annotation: Pfam domain module=KR::adh_short; Domain location=22-169::22-168
MEPEHYFPCPSSCLTRWWSRETVAVVTGGNKGIGFALVNRLAELGVSVVLTARDRQRGEAAVENLRKQGLGDFVHFLLLDVSDPLSVLTFASSFQAKFGATLDILVNNAGVSYNELDENSVEHAESVIKTNFYGPKLLIEALLPLFRCSSSSITRVLNVSSRLGSLDLIRQYSSAT

SEQ ID NO: 127167 - protein, 225 aa, Glycine max
  Coding DNA Sequence Number=SeqID_10389
  Gene Ontology: Mol. function=acyltransferase activity; Cellular component=integral to membrane; Biological process=metabolic process
  Homolog annotation: Hit_ID=Q1SCJ7; Match level="QueryCoverage=90%, HitCoverage=40%, E-value=2e-86, Identity=79%"; Hit description =Phospholipid/glycerol acyltransferase
MATARRSFPPITECNGTTPCDSVAADLDGTLLISRSSFPYFMLVAVEAGSLLRGLLLLLSVPFIIFSYLFISESLGIQILIFISFSGLKIRDIELVSRAVLPRFYAADVRKESFEVFERCKRKVVVTANPTVMVEPFVKDFLGGDKVLGTEIEVNPKTKKATGFVKKPGVLVGKWKRLAVLKEFGDDESPDVGLGDRKTDRDFMSICKVCLLLLILITIITISTS

SEQ ID NO: 127168 - protein, 370 aa, Glycine max
  Coding DNA Sequence Number=SeqID_10390
  Gene Ontology: Mol. function=ligase activity
  Homolog annotation: Hit_ID=Q1SCK7; Match level="QueryCoverage=98%, HitCoverage=99%, E-value=1e-127, Identity=67%"; Hit description=SKP1 component
  Pfam annotation: Domain name=Skp1; Domain location=90-172; Score =42.7; E_value=1.2e-09; Accession=PF01466.9; Description=Skp1 family, dimerisation domain
  Pfam annotation: Domain name=Skp1_POZ; Domain location=15-81; Score =18.1; E_value=0.0012; Accession=PF03931.5; Description=Skp1 family, tetramerisation domain
  Pfam module annotation: Pfam domain module=Skp1::Skp1_POZ; Domain location=90-172::15-81
MSEIDLAVIKPEMMKLYVWLQTSDDSIQQVEQEIAMFCPLICQEIIQKGMGSSKSCAICLPQQVSPAMLSLILDYCRFHQVPGRSNKERKSYDEKFVRIDTERLCELTSAADSLQLKPLVDLTSRALARIIEGKTPEEIRDIFHLPDDLTEVSGACENSEEKLEPLRNITADPRIRLLNRLYAKKRKELKERERLKNVEVEEEHVDERSVDDLLSFINGNDGDPKGVKTSKNKKKNRRKKEQQKSSSLKEESELNKKEVNGHDIRHQSSEAERISETLYLPYADDDTFSPKVEFDDGDIDDEIDPALKEKIDREVEDFARRLNSDWPERMQELLSSGQERETILFTTDGFLRRHALFVHRVLLMSLMYTD

SEQ ID NO: 127169 - protein, 379 aa, Glycine max
  Coding DNA Sequence Number=SeqID_10391
  Gene Ontology: Mol. function=translation release factor activity, codon specific; Cellular component=cytoplasm; Biological process =translational termination
  Homolog annotation: Hit_ID=Q1SS34; Match level="QueryCoverage=83%, HitCoverage=87%, E-value=1e-137, Identity=73%"; Hit description =Class I peptide chain release factor; PCRF
  Pfam annotation: Domain name=PCRF; Domain location=132-243; Score =65.5; E_value=1.7e-16; Accession=PF03462.9; Description=PCRF domain
  Pfam annotation: Domain name=RF-1; Domain location=273-373; Score= -24.3; E_value=0.0049; Accession=PF00472.11; Description=Peptidyl -tRNA hydrolase domain
  Pfam module annotation: Pfam domain module=PCRF::RF-1; Domain location=132-243::273-373
  Subcellular localization annotation: CTP_CleavageSite=65; ConfidenceScore=5.27e-01
MATVGSEPACARTVHDVASSFSSKWQHSSTVKKQPRARILQCSLRIRACSSMANKKDIYKQVVLRAETFASTALEMEEATWIKQEEMVRDFDMWDDPAKSNDILVKLANSAKVVDSLKDLKYKVEEAKLINQLAEINAIDYGLYKQAYETSLDVSEIVDQYEISKLLKGPFDMAGACLVIKAGPKGIYPKLWAEQILSMYLRWAKRRGYEGRIVDKCPFKNGGINSAIIEFEFECAYGYLSGEKGVHYLIRGSPNESSQLEASSATVDVIPMFLESACDLEIDSEDLIISSPLIHGKNKRQTDHTVCIQHIPTGISVQSYGERSHFANKMKALNRLKAKLLVTTKEQGVASVEVPDLNYVLEGNIGPLIAAHINSRVMS

SEQ ID NO: 127170 - protein, 169 aa, Glycine max
  Coding DNA Sequence Number=SeqID_10392
  Gene Ontology: Mol. function=zinc ion binding
  Homolog annotation: Hit_ID=Q1SK91; Match level="QueryCoverage=67%, HitCoverage=35%, E-value=2e-20, Identity=38%"; Hit description=Zinc finger, SWIM-type
MTSRVSQLWVYDNWKESYNIHVKDLQALQLFIPGTIVRIQTIPALDKSSQPIPNKLLQKDNPYGIAWLDQIPREQRTLAWNDGKQWGHMTTNLVESLNLMLKKMRKFSITALVKITYKKLSKYFVDRGTQGDAMIASRQVYTLIAAKFIIEEETKSNTHFVQQFDRQRF

SEQ ID NO: 127171 - protein, 419 aa, Glycine max
  Coding DNA Sequence Number=SeqID_10393
  Gene Ontology: Mol. function=D-alanyl-D-alanine endopeptidase activity; Cellular component=integral to membrane; Biological process=cytochrome complex assembly
  Homolog annotation: Hit_ID=Q1SCK8; Match level="QueryCoverage=100%, HitCoverage=74%, E-value=0.0, Identity=84%"; Hit description =Protease-associated PA; Peptidase A22B, minor histocompatibility antigen H13
  Pfam annotation: Domain name=PA; Domain location=75-171; Score=52.7; E_value=1.2e-12; Accession=PF02225.12; Description=PA domain
  Pfam annotation: Domain name=Peptidase_A22B; Domain location=239-419; Score=4.3; E_value=4.5e-11; Accession=PF04258.4; Description=Signal peptide peptidase
  Pfam module annotation: Pfam domain module=PA::Peptidase_A22B; Domain location=75-171::239-419
MVSLGAIYSVIYVFLFGAVTLVLGGDIVHHDDVAPRRPGCENNFVLVKVPTWIDGVENSEYVGVGARFGPTLESKEKRANLSRVVMADPPDCCTKPKNMLTNEIILVHRGKCSFTTKANIADEAGASAILIINYRTELFKMVCEENETDVDIGIPAVMLPQDAGLTLERHIENKSNVSIQLYSPLRPLVDVAEVFLWLMAVGTILIASYWSAWSAREAAIEQEKLLKDASEDYVNTENVGSSGYVEISTVAAILFVVIASCFLVMLYKLMSFWFVEVLVVLFCIGGIEQLNLYILHVFSGSTNLFGGSVIMQNAYSFRWFQQPAQTFVKIPFFGAVSYLTVAVTPFCIVFAVVWAVYRHASFAWIGQDILGITLIITVLQIVRIPNLKVGTVLLSCAFLYDIFWVFVSKRWFHESVMIV

SEQ ID NO: 127172 - protein, 137 aa, Glycine max
  Coding DNA Sequence Number=SeqID_10394
  Gene Ontology: Mol. function=oxidoreductase activity; Biological process=metabolic process
  Homolog annotation: Hit_ID=Q6RZU3; Match level="QueryCoverage=67%, HitCoverage=29%, E-value=1e-24, Identity=55%"; Hit description =Putative short-chain hydrogenase/reductase
MKVRNGEIRAVLEREDLMEEHIDGVVGTFLRDVRNGTWKSQGWPSYWTEYAVSKLALNAYSRMLAKRYSYEGSGLSVNCFCPGFTQTAMTKGKGTHTADDAAALAATLALLPPHLLPTGKFFSLGKKATFLNPTSKL

SEQ ID NO: 127173 - protein, 877 aa, Glycine max
  Coding DNA Sequence Number=SeqID_10395
  Gene Ontology: Mol. function=ubiquitin-protein ligase activity; Cellular component=ubiquitin ligase complex; Biological process =protein amino acid phosphorylation
  Homolog annotation: Hit_ID=Q2HTK4; Match level="QueryCoverage=99%, HitCoverage=100%, E-value=0.0, Identity=65%"; Hit description =Protein kinase; U box
  Pfam annotation: Domain name=Pkinase; Domain location=519-782; Score =172.1; E_value=1.4e-48; Accession=PF00069.15; Description=Protein kinase domain
  Pfam annotation: Domain name=Pkinase_Tyr; Domain location=519-783; Score=100.1; E_value=6.7e-27; Accession=PF07714.7; Description =Protein tyrosine kinase
  Pfam annotation: Domain name=U-box; Domain location=808-877; Score =73.8; E_value=5.3e-19; Accession=PF04564.6; Description=U-box domain
  Pfam module annotation: Pfam domain module=Pkinase::Pkinase_Tyr::U -box; Domain location=519-782::519-783::808-877
  Subcellular localization annotation: CTP_CleavageSite=49; ConfidenceScore=5.19e-01
MAVVSPMPATPPQVNPVNLLRNTGVPGIMTSRREIVNEPSPSMVNETIYVAVAKDVKDSKLNLIWAIQNSGGRRICILHVHVPAPMIPLALMGAKFPASALREEGVQDYHERERLKMHKTLDAYLFICQRMGVRARKLLHIEMDCIEKGIVELISRYGIQKLVMGAASDKYHSRRMTSLRSKKAIYVCEQAPASCHIQFICNGYLIHTRDCSLNRGNVEVEFPLLQQMANSEVGHSPNLSFQSILQGQNHGIKLTNPAQELFRRVRSVNDGHMRSLESVSSSEGFLTPPSKFSKNISSIEPGLTPNLINDGSENALDLILNYPSLINKDLHHSSSPSVLDEGMDDALYYQLEQVMAEASNARRDAYQETVRRSKAEKDAIDAIHRAKATENLYKEELKLRKEQEEAVEKANEKLNNMKSQTDKVNEELRLALDQNSSLENQIASTELMVKELKQKIISALDLLQNYKDELDDLQIQRDNAVGEAEEFRSKQGEASSSAQELHCFSDFSFQEIKEATSNFNPSKKIGEGGYGSIFKGVLRHTEVAIKMLNPDSTQGPLEFQQEVEVLSKLRHPNLITLIGACAESWTLVYEYLPNGSLEDRLNRKDNTPPLSWQTRICIAAELCSALNFLHSNKPHSIAHGDLKPANILLDANLVSKLSDFGICRILSCQDSSSNSTTQFWRTVPKGTFVYVDPEFLASGELTPKSDVYSFGIILLRLMTGKPALGIIKEVQYALDAGKLKSILDPLAGEWPFMLAEELIRLALRCCEMNRKNRPELYSDVWRILEPMRASSVVTNTSQLGSQRLCQPPPYFICPIFLEVMQDPHVASDGFTYEAEAIREWLESGRDTSPRTNSKLAHRNLVPNHALRHAIQNWLQSH

SEQ ID NO: 127174 - protein, 94 aa, Glycine max
  Coding DNA Sequence Number=SeqID_10396
MAAKKPSMRLNFMDEESTNNFMSTLKQFEGTQMGADKPILRVDLHHKEGGVFPPLRLHKLEVLPDQPWHTILHMPRDILPFQPALATTREGSGK

SEQ ID NO: 127175 - protein, 83 aa, Glycine max
  Coding DNA Sequence Number=SeqID_10397
MIDVGSGFYIVKFDLSHDPEKYIASSSDGGGYSDESGYEDGGCNTREVCDLNMPSKSAPRNPSTKSSNQGKGAIHVETNQYGD

SEQ ID NO: 127176 - protein, 47 aa, Glycine max
  Coding DNA Sequence Number=SeqID_10398
MWTRNQLDVWGLAIILSKGSNLKLAISGKVGIWHRKKQCIKYCQATE

SEQ ID NO: 127177 - protein, 214 aa, Glycine max
  Coding DNA Sequence Number=SeqID_10399
MEDPLPLNDRLMIMLIDGAFHASKVAAKAVTLSIRQQFGRPWPTWGVIPKDHHDLFFQRFKEEFEARLSQARFYVVPSVGESQLTSLDPFEEQRLKSQYWVAATGPKCKGHLYGTRDIAHTYKYGNDNFMQNVQGSSSRAEDAAEINRLRSRVNQRRRCMFFNPLSFSSYLLKRGTLFINNNNLTSNIMNNRTINPSTSMTNSRTRQMINSRIR

SEQ ID NO: 127178 - protein, 44 aa, Glycine max
  Coding DNA Sequence Number=SeqID_10400
MSNSDGYSALSLQLPFILRKLGLKKGLPDLDVALSTILALSASM

SEQ ID NO: 127179 - protein, 359 aa, Glycine max
  Coding DNA Sequence Number=SeqID_10401
  Gene Ontology: Mol. function=hydrolase activity, acting on ester bonds; Cellular component=cellular_component; Biological process =lipid metabolic process
  Homolog annotation: Hit_ID=Q8L8G1; Match level="QueryCoverage=82%, HitCoverage=81%, E-value=2e-81, Identity=53%"; Hit description =Lipase SIL1
  Pfam annotation: Domain name=Lipase_GDSL; Domain location=22-337; Score=126.1; E_value=1e-34; Accession=PF00657.12; Description=GDSL -like LipaseAcylhydrolase
YGILTPTCCLGEICQPKENAALFVFGDSIFDVGNNNYINTTADNHANFFPYGETFFKYPTGRFSDGRVIPDFVAEYAKLPLIPPFLFPGNQRYIDGINFASAGAGALVETHQGLVIDLKTQLSYFKKVSKVLRQELGVAETTTLLAKAVYLINIGSNDYEVYLTEKSSVFTPEKYVDMVVGSLTAVIKEIHKAGGRKFGVLNMPAMGCVPFVKILVNAPKGSCVEEASALAKLHNSVLSVELGKLKKQLKGFKYSYVDFFNLSFDLINNPSKYGFKEGGVACCGSGPYRGNFSCGGKGAEKDYDLCENPSEYVFFDSAAWHAYKGYCGGKRAMNERLRLMKRDGKEAGFEGQNLQTQEG

SEQ ID NO: 127180 - protein, 527 aa, Glycine max
  Coding DNA Sequence Number=SeqID_10402
  Homolog annotation: Hit_ID=Q2QYH0; Match level="QueryCoverage=98%, HitCoverage=98%, E-value=2e-21, Identity=29%"; Hit description =Expressed protein
  Pfam annotation: Domain name=DUF936; Domain location=1-525; Score =519.6; E_value=3.3e-153; Accession=PF06075.3; Description=Plant protein of unknown function (DUF936)
MASLVPGVLLKLLQSMNSNVKVRGEYRSVLLQVISIVPSLSGSELWPNQGFFIKVSDSSHSTYVSLSKDDNEFILNNKLQLGQFFYVDRIEAGTPVPTLVGVRPVPGRHPFEGNPKDLMQILEQSDNDGVNGSKSMDLTEAKENPSSRQKIVIKEEKVGVASRYMQGVLNPNSRVNGADTNIGSKGNDSENGVDSKKVESSKGKQLEIKGQVLPITPTGTRLEALSPKQDIPQCNIRETVIAPSKRTSAKHSSTKQENLNMNLLSRGKDKSNNTEAIPWSALPVKLLKPGKVILRRKHLASQVVVEAQKEASAAASIVKCLSMFANICSSASSENPHATLNKFFALQQLMDQPNGTTQLKDKPIQLYKIPTPAEKHKSGKTAGVMPVKSTSKSPKPLNELSRTEKQEWAKEDGTKKINELKEVLLNETRSWFLMYLEKILDAGFSVGSQEMGKESKDNAGRQMEQANHIALTLSHLKHANEWLDKLRSSSNTESEELVETVDRLKQKVYSCLLVHIDSAALALENRA

SEQ ID NO: 127181 - protein, 305 aa, Glycine max
  Coding DNA Sequence Number=SeqID_10403
  Subcellular localization annotation: CTP_CleavageSite=54; ConfidenceScore=5.45e-01
MPIFNLKKTGGGSQLMKTQSTCLNFRNQRRRILNNLSCVQNNLLDRLQNTCPISDEQRPTNQIYMKAIQPATNDLVNVGVHMLEDDETNEIGIADTDGKIQLPLLRRPPVVLHRLLYDKDSIDSLFEWLRKDLNFTNTRNMRLQLIFERKTNGRIYNLSTISVVATLVPRDVDIVANKDIIRNSKWLANKSSPCMKDGQHSRFFPKNFQPITIVHHEGYAVYGRRGNVERIYFHLPNEQSILFEDDDDLDFVLSKPTIKESMFTARSEANEMFHDGKDITCVGFVTNFVYIVISARFQLFLGLNC

SEQ ID NO: 127182 - protein, 338 aa, Glycine max
  Coding DNA Sequence Number=SeqID_10404
  Gene Ontology: Mol. function=translation initiation factor activity; Cellular component=eukaryotic translation initiation factor 2B complex; Biological process=cellular metabolic process
  Homolog annotation: Hit_ID=Q8W4G0; Match level="QueryCoverage=100%, HitCoverage=97%, E-value=1e-117, Identity=63%"; Hit description =Putative translation initiation factor EIF-2B alpha subunit
  Pfam annotation: Domain name=IF-2B; Domain location=93-336; Score =138.7; E_value=1.5e-38; Accession=PF01008.8; Description=Initiation factor 2 subunit family
MWWRSASFIMDRQRNEEADLKGDSSNPNPNPNISAYYETRAAHHGVVTSDWLAQAQAAIGPDPVPDPNPEPEPQLRPDPDKPFSVIDEFNSWRKQPHLAEAVAAIRALAAVIRSSKATTMMQLEIELKKASDFLKSWDTTSISLTAGCDLFMRYVTRTSALEYEDFNSAKSRLIERAENLYLWHLHCDLHFNPCVHKLAEGRPDRTGLRLSNELAKLDVSVKLLIDSAVAYTMDEVDMVFVGADGVVESGGIINMMGTYQIALVAHSMNKPVYVAAESYKFARLYPLDQKDLAPALRPIDFGVPIPSKVEVERSARDYTPPQYLTLLFTDLGVLTPSV

SEQ ID NO: 127183 - protein, 152 aa, Glycine max
  Coding DNA Sequence Number=SeqID_10405
MVNGPTNLMIREKHYQASNKTVTWRSPAIKLCPTEKGIGTEDHSIHQEQGQYLHLFLSFNFILNVVKEMLLVYEDHSQGIICYQDEFGEIICEGYDEGSCFQRIPEPTNRPRDAQITTNLLLRQSWLQIVKGENSNDGLQKDLNCNGFNSFC

SEQ ID NO: 127184 - protein, 355 aa, Glycine max
  Coding DNA Sequence Number=SeqID_10406
  Gene Ontology: Mol. function=RNA binding
  Homolog annotation: Hit_ID=Q9C552; Match level="QueryCoverage=99%, HitCoverage=46%, E-value=5e-96, Identity=52%"; Hit description =Putative RNA-binding domain; 80649-84245
  Pfam annotation: Domain name=PUF; Domain location=122-157; Score=5.8; E_value=1.2; Accession=PF00806.9; Description=Pumilio-family RNA binding repeat
  Pfam annotation: Domain name=PUF; Domain location=216-248; Score =28.8; E_value=1.9e-05; Accession=PF00806.9; Description=Pumilio -family RNA binding repeat
  Pfam annotation: Domain name=PUF; Domain location=42-76; Score=7.8; E_ value=0.67; Accession=PF00806.9; Description=Pumilio-family RNA binding repeat
  Pfam module annotation: Pfam domain module=PUF::PUF::PUF; Domain location=122-157::216-248::42-76
MDRSGSHVAETSIKSLAVHLQDDDDVVRPLVEEALTMICKVVIAANSVDVMCNCYGSHVLRTLLCLCRGVPLDKSGYYLSKSTTVLADRLNSKEFSSKKYDATNFQPGFPNLLKSLVSDMLKHAKKCIKILQVDQFSSLVFQTVLRVLAGDDEELLHVIPILLGCKDKNNAEDNFIGTRVVAELKNLLKESKFSHLMEVVLEVSPEALFNELFTKVFRNSLFELSSHQHGNFVVQALISYASNQDLIFSQMELIWEELGPNLEGLFKMGRSGVVASLVAASERLHINEHKCCQVLAEAVCPVDESPKWIVPRLLFLDSCFTSEDKSNWSWQSGSKMHVMGSLILQTVFRFRSVQI

SEQ ID NO: 127185 - protein, 40 aa, Glycine max
  Coding DNA Sequence Number=SeqID_10407
MEGGHRQKNMPGNMHDHENTKQAIPPYELFLVLGQHGSHT

SEQ ID NO: 127186 - protein, 270 aa, Glycine max
  Coding DNA Sequence Number=SeqID_10408
  Homolog annotation: Hit_ID=Q75RY2; Match level="QueryCoverage=46%, HitCoverage=26%, E-value=1e-12, Identity=37%"; Hit description =Protein PAIR1
MPYGKGVIIGYVLMWYYLKMWQHPRNESIFQNKEFEEESVIQEVEFLAWSWMKNKIKGFEVHGAWLTVEDVHGGGYRKCESGLTIHESEQCNEWIASESLSASLAAISAVAFSGNFVSARIAVTFLPKLSRRGRHDERSGQLSEGLEHRIGIMETSLGRFTMILDSVQSDVMQVNKGTKEITLEVECIRQKLIAQDNSLQLMTKGQEEIKAIIEGSLKSLAEQMSHVSKKEKLREVYLAVSALPQLIEASLQNVQNDLRNITKEMQARTI

SEQ ID NO: 127187 - protein, 90 aa, Glycine max
  Coding DNA Sequence Number=SeqID_10409
MILCRHRKGEASRMWPHITHGEGEVPLWCLDMVVQGWFCGGRMAGVRSGVGVFGFRFGRGGGGGARHGGDEVRWPQGAEVVGGYDGCAWR

SEQ ID NO: 127188 - protein, 98 aa, Glycine max
  Coding DNA Sequence Number=SeqID_10410
MTTFVSACQRAHLPLVEKGVDNHKGRLPLVRITIRYPRMSSDSPSLNDKGADNHKVQKTMYALRVNGLACLWLTKGRLRVPMDSQVTIDKNNVSIGEG

SEQ ID NO: 127189 - protein, 247 aa, Glycine max
  Coding DNA Sequence Number=SeqID_10411
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=2e-29, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=34; ConfidenceScore=5.23e-01
TRPHLQRTTRPRPQRATHPCLQRATHPHLQRTTRARLQRTTRPHLQRATRPLLKKDYTSSPLEGYTPSPLERTTCPDLQKATRPHLKRTTRPHLKGLHTITFRGIHVLAFRRLHVLAFIGLHVLPFSGVHVRTFKGLHVRTFRGLHVLTLRVLHALTFRGLHVPAFRGLHVLSFRGLHVLTFRRRHDLAFTGLDALTFGVLHILAFRGLHALAFLGLHALPFRGLHALTFRGLHVPAFRGLHVLTFR

SEQ ID NO: 127190 - protein, 145 aa, Glycine max
  Coding DNA Sequence Number=SeqID_10412
MGVPYGYPYFCHPETTSWMTCGGTLWLSAPLSSRDGEPDDMQGEPDDTQRLTSSSAPLSSRDGESDDMRGDGESNDMRGYLMVIRTFCHPETASPMTCGGASEPFDTLTLTSSSAPLSFRDGESDDIRGYLMVIHTFCHQRRRVR

SEQ ID NO: 127191 - protein, 157 aa, Glycine max
  Coding DNA Sequence Number=SeqID_10413
  Gene Ontology: Mol. function=acyl-[acyl-carrier-protein] desaturase activity; Cellular component=chloroplast; Biological process=fatty acid biosynthetic process
  Homolog annotation: Hit_ID=Q42807; Match level="QueryCoverage=95%, HitCoverage=40%, E-value=3e-69, Identity=94%"; Hit description=Acyl -[acyl-carrier-protein] desaturase, chloroplast precursor
  Pfam annotation: Domain name=FA_desaturase_2; Domain location=1-143; Score=1.2; E_value=7.4e-07; Accession=PF03405.5; Description=Fatty acid desaturase
LAKEHGDIKLAQICGMIASDEKRHETAYTKIVEKLFEVDPDGTVMAFADMMRKKIAMPAHLMYDGRDDNLFDNYSAVAQRIGVYTAKDYADILEFLVGRWKVEQLTGLSESEGWRRELKQEARSRQHLNSVGFMTGKYYSKCLHQGRSMVNLPAIPF

SEQ ID NO: 127192 - protein, 260 aa, Glycine max
  Coding DNA Sequence Number=SeqID_10414
  Gene Ontology: Mol. function=RNA-directed DNA polymerase activity; Cellular component=cell wall; Biological process=RNA-dependent DNA replication
MLQEVIHHVRNSSKKDGDIVLKLDLEKAYNRIDWGCLKQALRLYGLSKKLGAMIQKEVQGARPSQARGIAKVLEEFWVMLVLKVSVVKSKTFVSRIVTFCLRRRVTHDNFGELVDRVHSKLHAWKSRLLNNPGRVTLVIAVIALLPTYGMQIQWGFIWCCHNDKGLLMVKWEIVIRPRKLGGLGVRVAHEQNIAWLGKLVWELLNPSNQLWTSVLKGKLVVWNSIMKALEFLKEGFQMKIGEGNLDFWNDSWVTKKLLAV

SEQ ID NO: 127193 - protein, 352 aa, Glycine max
  Coding DNA Sequence Number=SeqID_10415
  Gene Ontology: Mol. function=ribonuclease H activity; Biological process=RNA-dependent DNA replication
  Homolog annotation: Hit_ID=Q2HTL5; Match level="QueryCoverage=89%, HitCoverage=74%, E-value=6e-25, Identity=36%"; Hit description =Ribonuclease H
  Pfam annotation: Domain name=RnaseH; Domain location=19-148; Score= -16.3; E_value=0.0019; Accession=PF00075.14; Description=RNase H
MEVRDYDLLVQAQALRPQGDVIALNVDRSVLGNPQVARFGGLCRNHNGAFLLGFYGAVEISEVLYAEILALLKGLELCWEARYKKLVCYSDSLTMVNLVNNGVRSYHFYNNMIMKFHQLLGRDWPCSLNQTLRKGNQCANVLVKMGVASSCLLEVIYAPPLMLLEPLRADATEVVFLRFEGGRKSFWFKFLHQVGKDHMDEKSITTQEFEYGETVVPSQPANAFGNPGQAGFGGIIRDSLGNWHTELLAIYHDLKIARDKGIGRLICESDSKLALDLITGEINLFHQYFPTILLIHSLKQMDWEVTFVHVYCEGNKCADWLAKTGNSSREDFIILDHCPSFIYQALLLRNFQ

SEQ ID NO: 127194 - protein, 68 aa, Glycine max
  Coding DNA Sequence Number=SeqID_10416
MELRIELKRGKCVIFSLWKNKKEGSVSEPLMSESDEAMEALEIFRRRESNVEGERRSKCKGEKKGPAT

SEQ ID NO: 127195 - protein, 214 aa, Glycine max
  Coding DNA Sequence Number=SeqID_10417
FTCDSSQVSASPHQLDLAPYASGPYNAQWNATGPLHDKHTLRSSRILGEMEVDEPRLGLWLPLNYQVDMGASQHRTLELGDGLCGQLGGGSHSTGFSFILTLFICPSFLICPSRMTKFASFQTHIDPFTGKDQIRKALKVGVPGNSYPSKTFLEGITLNLRGVMILGTRNNSSRGIPPTACPSVAYPRQGSKLSMGIGVELLTFLLGVYATLGG

SEQ ID NO: 127196 - protein, 221 aa, Glycine max
  Coding DNA Sequence Number=SeqID_10418
EDEEVRALKLELGKARLAKEKFKSAATHIRKECTELQEENAATARALEQETKRARKKEYGREKFRGALWGSNNELKLRREEIDRSRVHGMILKEELVACARSKRSLAQHLEAMEQSMLAIIWQYKEELNQTVAHEQKLVEDLAQLYAEKEARGRVIDALHQEATMWMDRFALTLNGSQDLPRLLAKAKAMAKVCTAPEEMHGLINYCQHMIDLMAHIIRNR

SEQ ID NO: 127197 - protein, 183 aa, Glycine max
  Coding DNA Sequence Number=SeqID_10419
MASISEVMLKLQKTIEDKATTTSSGTVREAEPVLQPALNPGRDRNKAVFGRRYSPQAYPYGLPPDFTPRATPEDLSQAFTFEGQLPPYDDYPGQDDEEGDTHLGPLLHLKDPSPHELPQPNIVRHIPASPTPIKESVPFAEDKGKMEVLEERLRAVEGLDNYPFSDLADLCLVPNIVIPPKFK

SEQ ID NO: 127198 - protein, 539 aa, Glycine max
  Coding DNA Sequence Number=SeqID_10420
  Gene Ontology: Mol. function=endonuclease activity
  Homolog annotation: Hit_ID=Q109Y3; Match level="QueryCoverage=90%, HitCoverage=89%, E-value=1e-95, Identity=42%"; Hit description =NUMOD3 motif family protein, expressed
  Pfam annotation: Domain name=NUMOD3; Domain location=131-144; Score =8.8; E_value=6.7; Accession=PF07460.2; Description=NUMOD3 motif
  Pfam annotation: Domain name=NUMOD3; Domain location=219-232; Score =0.5; E_value=1.9e+02; Accession=PF07460.2; Description=NUMOD3 motif
  Pfam annotation: Domain name=NUMOD3; Domain location=99-112; Score =18.7; E_value=0.021; Accession=PF07460.2; Description=NUMOD3 motif
  Pfam module annotation: Pfam domain module=NUMOD3::NUMOD3::NUMOD3; Domain location=131-144::219-232::99-112
MGEITNAQLSFRYSLTLRSPIPMPYHAKGGPSWISFHTLKIRNLNVIKAVAATLDAKPHLDVPHPPGFLLEFSEPPDDREKLRRMRISKANKGNIPWNKGRKHTPETLQKIKERTRLAMQNPKVKMKLVNLGHAQTSETRKKIGAGVRRRWEKRRGKKMVQESCCFEWQNLIAEASRQGYVGQEELQWNSYETLDEQLKQDWLMSVEQRKQVARTPSSKRAPKSPEQRRKIAEAIAAKWADPEYRERVCSALAKYHGSEVGAERKPRRRPSDGTQPTKKKPAKKRDTDTSTHFKSDSKTCKPILLKKSKSPAYKDPLVNSKLEMIKNIRAQRASAETTQTHAIERARVLIAEAEKAAKALEVAATKSPIAQFSLIETRKLIAEAIQSLESIDTQAITDSNVPLVGLNDVNEEKGSAFEVLNQLQMAQVNGHTTLSSSDYKFTEDFGKFSLEKPVNGNPEFLLSNGCTSLPFSLNSQINESNPSNQQREAEQDQRSEYETDPSPTVMEIHSLENETMSSSPVSTKKWVRGRLVEVAEEKQ

SEQ ID NO: 127199 - protein, 279 aa, Glycine max
  Coding DNA Sequence Number=SeqID_10421
  Gene Ontology: Mol. function=zinc ion binding
  Homolog annotation: Hit_ID=Q1SR68; Match level="QueryCoverage=87%, HitCoverage=94%, E-value=3e-38, Identity=35%"; Hit description=Zinc finger, RING-type
  Pfam annotation: Domain name=zf-C3HC4; Domain location=103-144; Score= 37.5; E_value=4.5e-08; Accession=PF00097.15; Description=Zinc finger, C3HC4 type (RING finger)
  Pfam annotation: Domain name=zf-RING-like; Domain location=103-144; Score=1.1; E_value=0.1; Accession=PF08746.1; Description=RING-like domain
  Pfam module annotation: Pfam domain module=zf-C3HC4::zf-RING-like; Domain location=103-144::103-144
MGDSSAANDHLGESPAVELTGKIMIVVIIIMFFVIVIALCLHLFARNFWWRSPAPQSRSHRRRRFVFSSGPDGGSGLDPAVLSSLPVLVFEGHAQEFKDGLECAVCLSEVVEGEKARLLPKCNHGFHVACIDMWFQSHSTCPLCRNPVASSEESSESPTFPTNVLVWGNQAQISSTGGGGASLEEGSSSSSSASTCDDHGMLVIDIPSEMTSTSLSPEDDVKSPMTGRLRSLKRLLSRDKRFNPSSPTSSPDIVSNVCKYTMRVFNFSVLQRSELLQLS

SEQ ID NO: 127200 - protein, 96 aa, Glycine max
  Coding DNA Sequence Number=SeqID_10422
  Gene Ontology: Mol. function=DNA binding; Biological process=DNA integration
  Homolog annotation: Hit_ID=Q1S3I6; Match level="QueryCoverage=100%, HitCoverage=6%, E-value=5e-21, Identity=49%"; Hit description =Integrase, catalytic region
MYINKAQLAHILLERSRIQGLSKHISKLTSRRNMRQENEAFMNLDSSQMTIHFNVLCSLMKRGILCKLNCKFIIRKSAKRNKNREMKIITKILYPL

SEQ ID NO: 127201 - protein, 235 aa, Glycine max
  Coding DNA Sequence Number=SeqID_10423
  Gene Ontology: Mol. function=protein-tyrosine kinase activity; Cellular component=integral to membrane; Biological process=protein amino acid phosphorylation
  Homolog annotation: Hit_ID=Q1SUC1; Match level="QueryCoverage=91%, HitCoverage=25%, E-value=4e-82, Identity=73%"; Hit description =Protein kinase
  Pfam annotation: Domain name=Pkinase; Domain location=1-201; Score= -110.2; E_value=0.054; Accession=PF00069.15; Description=Protein kinase domain
  Pfam annotation: Domain name=Pkinase_Tyr; Domain location=3-201; Score=-124.3; E_value=7.7e-05; Accession=PF07714.7; Description =Protein tyrosine kinase
  Pfam module annotation: Pfam domain module=Pkinase::Pkinase_Tyr; Domain location=1-201::3-201
MTRLYPQFFFARYLHEVSSPSVVHKNIKSANILLDTELNPHLSDSGLASYIPNADQATQIVVNLNFPFVMDASKYEVFFVQLSQSNKILNHNVGSGYDAPEVALSGQYTLKSDVYSFGVVMLELLSGRKPFDSSRPRSEQSLVRWATPQLHDIDALAKMVDPAMKGLYPVKSLSRFADVIALCVQPEPEFRPPMSEVVQALVRLVQRANMSKRTFSSSDHGGSQRGSDEPVLRDI

SEQ ID NO: 127202 - protein, 170 aa, Glycine max
  Coding DNA Sequence Number=SeqID_10424
  Gene Ontology: Mol. function=nucleoside-triphosphatase activity; Cellular component=protein complex; Biological process=protein catabolic process
  Homolog annotation: Hit_ID=Q9SSB5; Match level="QueryCoverage=62%, HitCoverage=25%, E-value=5e-56, Identity=100%"; Hit description=26S protease regulatory subunit 7
  Pfam annotation: Domain name=AAA; Domain location=1-75; Score=-34.1; E_value=0.08; Accession=PF00004.19; Description=ATPase family associated with various cellular activities (AAA)
PDTLDPALLRPGRLDRKVEFGLPDLESRTQIFKIHTRTMNCERDIRFELLARLCPNSTGADIRSVCTEAGMYAIRARRKTVTEKDFLDAVNKVIKGYQKFSATPKYMREFDVDAFENGSTKAVGVPVGGLVAGRGMVNGGGLLFRVRCDWAESEKPKPSEYEMKRTCEII

SEQ ID NO: 127203 - protein, 273 aa, Glycine max
  Coding DNA Sequence Number=SeqID_10425
  Gene Ontology: Mol. function=protein-tyrosine kinase activity; Cellular component=integral to membrane; Biological process=protein amino acid phosphorylation
  Homolog annotation: Hit_ID=Q1SUC1; Match level="QueryCoverage=74%, HitCoverage=28%, E-value=3e-69, Identity=63%"; Hit description =Protein kinase
  Pfam annotation: Domain name=LRR_1; Domain location=100-122; Score =11.1; E_value=2.3; Accession=PF00560.23; Description=Leucine Rich Repeat
  Pfam annotation: Domain name=LRR_1; Domain location=124-146; Score =14.4; E_value=0.42; Accession=PF00560.23; Description=Leucine Rich Repeat
  Pfam annotation: Domain name=LRR_1; Domain location=148-169; Score =10.9; E_value=2.6; Accession=PF00560.23; Description=Leucine Rich Repeat
  Pfam annotation: Domain name=LRR_1; Domain location=170-192; Score =6.4; E_value=18; Accession=PF00560.23; Description=Leucine Rich Repeat
  Pfam annotation: Domain name=LRR_1; Domain location=30-52; Score=8.9; E_value=6.2; Accession=PF00560.23; Description=Leucine Rich Repeat
  Pfam annotation: Domain name=LRR_1; Domain location=54-73; Score=6.4; E_value=18; Accession=PF00560.23; Description=Leucine Rich Repeat
  Pfam annotation: Domain name=LRR_1; Domain location=76-98; Score =14.6; E_value=0.37; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=100-122::124-146::148 -169::170-192::30-52::54-73::76-98
MNSPPQLGWPPNGDDPCGQSWKGITCSGNRVTEIKLSHLGLTGSVPYGLQVLTSLNDLDMSSNRLGGSIPYQLPPYLQRLNLAYNNITGTVPYSISNLTALTDLNLGHNQLQQGLGVDFHNLSTLSTLDLSFNSLTGDLPQTMSSLSRITTMYLQNNQFTGTIDVLANLPLDNLNVENNNFTGWIPEQLKNINLQTGGNAWSSGPAPPPPPGTPPAPKSNQHHKSGGGSTTPSDTGSGSSSIEEGKKSGIGGGAIAGIVISVIVLGAIVAFFL

SEQ ID NO: 127204 - protein, 412 aa, Glycine max
  Coding DNA Sequence Number=SeqID_10426
  Homolog annotation: Hit_ID=Q10RE9; Match level="QueryCoverage=41%, HitCoverage=77%, E-value=3e-32, Identity=39%"; Hit description =Expressed protein
MAFASVIAIVAFLLLQPLSTTSDFLSPLLSPIFDDVCKEVECGKGTCKPSKNSTFLFECECHQGWKQSLSNDDDESSLKFLPCIVPNCTLDYSCSKAPAPVQEKATKSNESIFYACHWVDCGGGSCNKTSMFSYNCECDAGYYNLLNVTAFPCFRECSLGMGCSELGISMTNSSTSTPPALNDNIKNEGGIGGDTNGGNNDDMVVIVVLVVTVNGGNIGGGGGDGGDISGGSNDICGGGDEGSGNNVNSGSGGSVGGGIVGSDGSDNDGSSSDNNVGGNGDVNDNNGGNDNSIMVIPSGGGVVVVVGGDGGDIVSSDDDNDSDSDIDSGGGGSNIGGDNDDNDDGVATVEVVAVVTIRSDDDNNGDAGGGNDRHGIIVMALAVAMVATMVVMMIVVMATKNIIVKCEKCVFF

SEQ ID NO: 127205 - protein, 183 aa, Glycine max
  Coding DNA Sequence Number=SeqID_10427
  Gene Ontology: Mol. function=binding; Cellular component=membrane; Biological process=photosynthesis
  Homolog annotation: Hit_ID=Q2QMH0; Match level="QueryCoverage=86%, HitCoverage=49%, E-value=9e-65, Identity=70%"; Hit description =Tetratricopeptide repeat protein, putative, expressed
MISSVQSGKYGLEEGWKDLFSFLVETMETAVKSWHETSSVDARVYFLLDKEKTDTDKYAPVVNIDKAFESPHTHGNCFAFLRQYAEESFSKAACLVTPKNIIAYPQVWKGQGPRKWKHAQSDGFFVQFESPSLRKLWFIPSSNEKGQTLCRDPEVLDIGAHEVLPRQELQKKFKKLRTDGWLS

SEQ ID NO: 127206 - protein, 743 aa, Glycine max
  Coding DNA Sequence Number=SeqID_10428
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q9SWH0; Match level="QueryCoverage=98%, HitCoverage=80%, E-value=0.0, Identity=68%"; Hit description=Plasma membrane proton ATPase
  Pfam annotation: Domain name=E1-E2_ATPase; Domain location=1-151; Score=55.7; E_value=1.5e-13; Accession=PF00122.10; Description=E1-E2 ATPase
  Pfam annotation: Domain name=Hydrolase; Domain location=155-453; Score=69.1; E_value=1.4e-17; Accession=PF00702.16; Description =haloacid dehalogenase-like hydrolase
  Pfam module annotation: Pfam domain module=E1-E2_ATPase::Hydrolase; Domain location=1-151::155-453
MEMSWFCFMQSALTGESLPVTKRTGNEVFSGSTCKHGEIEAVVIATGVHSFFGKAAYLVDSTEVVGHFQKVLTSIGNFCICSIAIGMIFEIIIMFPVEHRSYRDGINNLLVLLIGGIPIAMPTVLSVTLAIGSHRLSQQGAITKRMTAIEEMAGMDVLCSDKTGTLTLNRLTVDRNLIEVFNRNMDKDTVVLLAARAARLENQDAIDTAVVNMLADPKEARANITEVHFLPFNPVDKRTAITYIDFDGNFHRASKGAPEQNFTLFFTLFAEYQILDLCQEKDQIAKKVHTIIDKFAERGLRSLAVAYQEIPEKSKDSPGGPWTFCGLLPLFDPPRHDSAETIRRALNLGVCVKMITGDQLAIAKETGRRLGMGTNMYPSSSLLGREKEEHEALPIDELVEMADGFAGVYPEHKYEIVKILQEKQHVVGMTGDGVNDAPALKKADIGIAVSDATDAARSAADLIYAVSITIRIVLGFALLALIWEYDFPPFMVLIIAILNDGTIMTISKDRVKPSPTPDSWKLPEIFATGIVIGTYLALVTVLFYWAIVETTFFESHFHVSSISSDSEKVSSAVYLQVSIISQALIFVTRSRGWSFLERPGVLLMCAFVIAQLVATIIAVYAYISFGKIRGIGWRWAGVIWLYSIIFYVPLDIIKFTVRYGLSGEAWKLIFERKTAFTYKKDYGKEERAAKEENGRGSSLIAEKARRRAEIARLGEIHSLRGHVQSVLRLKNFDQNLIQSAHTV

SEQ ID NO: 127207 - protein, 423 aa, Glycine max
  Coding DNA Sequence Number=SeqID_10429
  Homolog annotation: Hit_ID=Q10RF0; Match level="QueryCoverage=96%, HitCoverage=93%, E-value=2e-42, Identity=35%"; Hit description=IQ calmodulin-binding motif family protein, expressed
  Pfam annotation: Domain name=IQ; Domain location=112-132; Score=29.6; E_value=1.1e-05; Accession=PF00612.17; Description=IQ calmodulin -binding motif
  Pfam annotation: Domain name=IQ; Domain location=134-154; Score=21.1; E_value=0.004; Accession=PF00612.17; Description=IQ calmodulin -binding motif
  Pfam annotation: Domain name=IQ; Domain location=160-180; Score=3.1; E_value=19; Accession=PF00612.17; Description=IQ calmodulin-binding motif
  Pfam module annotation: Pfam domain module=IQ::IQ::IQ; Domain location=112-132::134-154::160-180
MGRTGKWLRSLLTGKRSDREKEKEKEKCGTNMCLLNGITSTTETENPTTPVSTTTTTKEKRRWSFRRSPASRELNLAESGAIASSVTVQNAENDQREHDPDSNGLSTRCSEEAAAIKIQSVFRSYLARKALYALRGLVKLQALVRGHLVRKQARETLRCIQALVIAQARARAQRARMVLEDQNLSPYRITTEENFFMLMHNEMDSGLEENAKIVEMAVCESKGNSRGRNSAANREPSDHRFSAYYSSNGSYSKEEKYNASSPAPSTLTELSPRACNGHFEECSFSTAQSSPYYYSEEVSRVDNKITKAPFAFPKPAYTEPMSYDYPLFPNYMANTESSRAKARSQSAPKSRPDSNERQPSRRRASVEGRNVPRPVRMQRSSSHVGFTAQNYQYPCSIKLDRSIVSECGSTSTVITNTNSNYFT

SEQ ID NO: 127208 - protein, 393 aa, Glycine max
  Coding DNA Sequence Number=SeqID_10430
  Gene Ontology: Mol. function=nucleic acid binding
MDARRLLNLHAGLVIGVDGCHLKNKYGGIFLAAIATDPNDQYLPLAFVGLVPTFEEMLGDNEHCFCLRHLYNTFNKRFGGGIVMGDLMMGATRATYHEAYLEKMAQLKEINEAAHKYLVDIGEQHWSKHAFKTYAKCDVLMNNLSESFNAIILLAREKPIVTMLEWIQTYCMTRFATMNETTHKVEGKIMPIAKAKEEARQGRSTQHAIAAINYKGEHAEDHVDKYYHRDTYKLCYSHSITTIDGRKKCSKTNDPDLLPPNYKRAADAISLDITRGLAKIPPFIQNQQRLVLKVREHPVKNNKVMFKLDQMEHKCKLKRTPKSLMVPLHKKSNLVSKKTGPTSASTSTDNPGIAKKVSCATTKTKKETLKKPHLSEQSAQCSNTVSGEDMDTP

SEQ ID NO: 127209 - protein, 175 aa, Glycine max
  Coding DNA Sequence Number=SeqID_10431
  Gene Ontology: Mol. function=nucleic acid binding; Cellular component= intracellular
  Homolog annotation: Hit_ID=Q1SUL6; Match level="QueryCoverage=87%, HitCoverage=89%, E-value=3e-26, Identity=47%"; Hit description=Zinc finger, C2H2-type
MANNFYNNAQFAGFYNNTDPKGCRLCNQVFTDTQALLTHVESHMAQEEDSLRRLNSSPPNVNSQMQLGSQQFPPQPAMGDGRNFQAQSQPMRMPQPISKNPIFNSSQIGSSSTPIRQMQVSPQAFPFSGSINGDGSKPYISKLEKPIKKIDFIDLVNMDGDDNLEVEAMDLDLKL

SEQ ID NO: 127210 - protein, 176 aa, Glycine max
  Coding DNA Sequence Number=SeqID_10432
  Gene Ontology: Mol. function=binding; Cellular component=membrane; Biological process=photosynthesis
  Homolog annotation: Hit_ID=Q2QMH0; Match level="QueryCoverage=87%, HitCoverage=47%, E-value=1e-54, Identity=66%"; Hit description =Tetratricopeptide repeat protein, putative, expressed
  Pfam annotation: Domain name=TPR_1; Domain location=12-45; Score =23.8; E_value=0.0006; Accession=PF00515.18; Description =Tetratricopeptide repeat
  Pfam annotation: Domain name=TPR_1; Domain location=46-79; Score =19.9; E_value=0.0091; Accession=PF00515.18; Description =Tetratricopeptide repeat
  Pfam annotation: Domain name=TPR_1; Domain location=80-113; Score =33.7; E_value=6.3e-07; Accession=PF00515.18; Description =Tetratricopeptide repeat
  Pfam annotation: Domain name=TPR_2; Domain location=12-45; Score =22.9; E_value=0.0011; Accession=PF07719.7; Description =Tetratricopeptide repeat
  Pfam annotation: Domain name=TPR_2; Domain location=46-79; Score =18.6; E_value=0.022; Accession=PF07719.7; Description=Tetratricopepti de repeat
  Pfam annotation: Domain name=TPR_2; Domain location=80-113; Score =29.4; E_value=1.2e-05; Accession=PF07719.7; Description =Tetratricopeptide repeat
  Pfam module annotation: Pfam domain module=TPR_1::TPR_1::TPR_1::TPR _2::TPR_2::TPR_2; Domain location=12-45::46-79::80-113::12-45::46 -79::80-113
MAAETKEVSGSEMSLKDQGNEFFKSGKYLKAAALYTQAIKQDPSNPTLYSNRAAALLQLDKLNKALDDAEMTIKLKPQWEKGYFRKGSILEAMKRYDDALAAFQIALQYNPQSQEVTKKIKKINQLMKDSKRAQEVENMRSNVDMAKHLDTFKTEMGEREGNKLFMERDKKEGEIQ

SEQ ID NO: 127211 - protein, 76 aa, Glycine max
  Coding DNA Sequence Number=SeqID_10433
MTQPGFGTHAYSCSPHRRGKMEIGVKRKGVVMEWGMGKWDYTLIHSSGRKPVSFGVSQANFPQPRLSNVHHPHTPI

SEQ ID NO: 127212 - protein, 282 aa, Glycine max
  Coding DNA Sequence Number=SeqID_10434
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9LW60; Match level="QueryCoverage=88%, HitCoverage=88%, E-value=3e-57, Identity=47%"; Hit description =Protein phosphatase 2C-like protein
  Pfam annotation: Domain name=PP2C; Domain location=42-274; Score =27.8; E_value=1.5e-07; Accession=PF00481.12; Description=Protein phosphatase 2C
MGMRDFHIKLKAFRVKRFFFGRRRNRWSANKPSWMIPISHGHHVVEHHVIKGGSDDSNFDSVVIQREQMDHTELWYFGIFDTVVGDEVTKYMQSHFFGKKLKECHMRRKTKETLKRAYLGVKTKIREAHKPEELETCRIGSTSVMVINGEKLVIVNMGDYRTVLCRNGVAYQTTGRYNQSSAKRHWYRRLFSVRMIACESGNTKGTKHSKGSELVVGGDRIDSDTEFLILASNGIWEVMKNQEAVNLIRHIEDPQEAAECLAKEALIRMSKSNISCLIIRFD

SEQ ID NO: 127213 - protein, 50 aa, Glycine max
  Coding DNA Sequence Number=SeqID_10435
MVVRTHSGDWAKGVVRLRIWSWERRTMLLGSWWCGKHTTGGTFRQHCGKP

SEQ ID NO: 127214 - protein, 316 aa, Glycine max
  Coding DNA Sequence Number=SeqID_10436
  Gene Ontology: Mol. function=protein serine/threonine kinase activity; Cellular component=integral to membrane; Biological process=protein amino acid phosphorylation
  Homolog annotation: Hit_ID=Q9C7S5; Match level="QueryCoverage=99%, HitCoverage=31%, E-value=1e-131, Identity=67%"; Hit description =Leucine-rich receptor-like protein kinase, putative; 84911-81624
  Pfam annotation: Domain name=Pkinase; Domain location=32-303; Score =121.8; E_value=1.9e-33; Accession=PF00069.15; Description=Protein kinase domain
  Pfam annotation: Domain name=Pkinase_Tyr; Domain location=31-303; Score=105.0; E_value=2.3e-28; Accession=PF07714.7; Description =Protein tyrosine kinase
  Pfam module annotation: Pfam domain module=Pkinase::Pkinase_Tyr; Domain location=32-303::31-303
INPGGDTDKVELESISVSSYSGVHPEVDKEASLVANIIGCGGFGLVYKATLPNGTTVAIKKLSGDLGLMEREFKAEVEALSTAQHENLVALQGYCVHEGVRLLIYTYMENGSLDYWLHEKADGPSQLDWPTRLKIAQGASCGLAYMHQICEPHIVHRDIKSSNILLDEKFEAHVADFGLARLILPYQTHVTTELVGTLGYIPPEYGQAWVATLRGDVYSFGVVMLELLSGRRPVDVSKPKMSRELVAWVQQMRSEGKQDQVFDPLLRGKGFEEEMQQVLDAACMCVNQNPFKRPSIREVVEWLKNVGSSKPQMNKD

SEQ ID NO: 127215 - protein, 676 aa, Glycine max
  Coding DNA Sequence Number=SeqID_10437
  Gene Ontology: Mol. function=protein serine/threonine kinase activity; Cellular component=integral to membrane; Biological process=protein amino acid phosphorylation
  Homolog annotation: Hit_ID=Q9C7S5; Match level="QueryCoverage=96%, HitCoverage=59%, E-value=1e-172, Identity=49%"; Hit description =Leucine-rich receptor-like protein kinase, putative; 84911-81624
  Pfam annotation: Domain name=LRRNT_2; Domain location=28-66; Score =40.8; E_value=4.6e-09; Accession=PF08263.3; Description=Leucine rich repeat N-terminal domain
  Pfam annotation: Domain name=LRR_1; Domain location=119-140; Score =14.5; E_value=0.38; Accession=PF00560.23; Description=Leucine Rich Repeat
  Pfam annotation: Domain name=LRR_1; Domain location=145-168; Score =13.8; E_value=0.61; Accession=PF00560.23; Description=Leucine Rich Repeat
  Pfam annotation: Domain name=LRR_1; Domain location=176-198; Score =12.6; E_value=1.2; Accession=PF00560.23; Description=Leucine Rich Repeat
  Pfam annotation: Domain name=LRR_1; Domain location=204-226; Score =7.6; E_value=11; Accession=PF00560.23; Description=Leucine Rich Repeat
  Pfam annotation: Domain name=LRR_1; Domain location=228-251; Score =8.2; E_value=8.2; Accession=PF00560.23; Description=Leucine Rich Repeat
  Pfam annotation: Domain name=LRR_1; Domain location=252-274; Score =5.4; E_value=27; Accession=PF00560.23; Description=Leucine Rich Repeat
  Pfam annotation: Domain name=LRR_1; Domain location=276-298; Score =17.8; E_value=0.038; Accession=PF00560.23; Description=Leucine Rich Repeat
  Pfam annotation: Domain name=LRR_1; Domain location=300-322; Score =11.2; E_value=2.3; Accession=PF00560.23; Description=Leucine Rich Repeat
  Pfam annotation: Domain name=LRR_1; Domain location=324-347; Score =9.9; E_value=4; Accession=PF00560.23; Description=Leucine Rich Repeat
  Pfam annotation: Domain name=LRR_1; Domain location=349-371; Score =14.0; E_value=0.56; Accession=PF00560.23; Description=Leucine Rich Repeat
  Pfam annotation: Domain name=LRR_1; Domain location=373-395; Score =8.8; E_value=6.4; Accession=PF00560.23; Description=Leucine Rich Repeat
  Pfam annotation: Domain name=LRR_1; Domain location=397-418; Score =5.9; E_value=22; Accession=PF00560.23; Description=Leucine Rich Repeat
  Pfam annotation: Domain name=LRR_1; Domain location=423-444; Score =2.9; E_value=82; Accession=PF00560.23; Description=Leucine Rich Repeat
  Pfam annotation: Domain name=LRR_1; Domain location=452-474; Score =11.4; E_value=2.1; Accession=PF00560.23; Description=Leucine Rich Repeat
  Pfam annotation: Domain name=LRR_1; Domain location=476-498; Score =22.4; E_value=0.0016; Accession=PF00560.23; Description=Leucine Rich Repeat
  Pfam annotation: Domain name=LRR_1; Domain location=500-522; Score =11.1; E_value=2.4; Accession=PF00560.23; Description=Leucine Rich Repeat
  Pfam annotation: Domain name=LRR_1; Domain location=585-607; Score =14.3; E_value=0.45; Accession=PF00560.23; Description=Leucine Rich Repeat
  Pfam annotation: Domain name=LRR_1; Domain location=609-631; Score =21.9; E_value=0.0023; Accession=PF00560.23; Description=Leucine Rich Repeat
  Pfam annotation: Domain name=LRR_1; Domain location=633-654; Score =0.8; E_value=2e+02; Accession=PF00560.23; Description=Leucine Rich Repeat
  Pfam annotation: Domain name=LRR_1; Domain location=70-92; Score=0.1; E_value=2.7e+02; Accession=PF00560.23; Description=Leucine Rich Repeat
  Pfam annotation: Domain name=LRR_1; Domain location=94-117; Score =15.9; E_value=0.14; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1; Domain location=...
  Pfam module annotation: Domain location=28-66::119-140::145-168::176 -198::204-226::228-251::252-274::276-298::300-322::324-347::349 -371::373-395::397-418::423-444::452-474::476-498::500-522::585 -607::609-631::633-654::70-92::94-117
  Subcellular localization annotation: CTP_CleavageSite=51; ConfidenceScore=5.09e-01
MVSKLMVFVLILFLLSGFLVLVQASSCNQLDRDSLLSFSRNISSPSPLNWSASSVDCCSWEGIVCDEDLRVIHLLLPSRALSGFLSPSLTNLTALSRLNLSHNRLSGNLPNHFFSLLNHLQILDLSFNLFSGELPPFVANISGNTIQELDMSSNLFHGTLPPSLLQHLADAGAGGSLTSFNVSNNSFTGHIPTSLCSNHSSSSSLRFLDYSSNDFIGTIQPGLGACSNLERFRAGSNSLSGPLPGDIFNAVALTEISLPLNKLNGTIGEGIVNLANLTVLELYSNNFTGPIPSDIGKLSKLERLLLHANNITGTLPTSLMDCANLVMLDVRLNLLEGDLSALNFSGLLRLTALDLGNNSFTGILPPTLYACKSLKAVRLASNHFEGQISPDILGLQSLAFLSISTNHLSNVTGALKLLMELKNLSTLMLSQNFFNEMMPDDANITNPDGFQKIQVLALGGCNFTGQIPRWLVNLKKLEVLDLSYNQISGSIPPWLNTLPELFYIDLSFNRLTGIFPTELTRLPALTSQQAYDEVERTYLELPLFANANNVSQMQYNQISNLPPAIYLGNNSLNGSIPIEIGKLKVLHQLDLSNNKFSGNIPAEISNLINLEKLYLSGNQLSGEIPVSLKSLHFLSAFSVAYNNLQGPIPTGGQFDTFSSSSFEGNLQLCGSVVQRS

SEQ ID NO: 127216 - protein, 105 aa, Glycine max
  Coding DNA Sequence Number=SeqID_10438
MVTLNQSSEPSRRTKGVGSWWLGFLGRVLGGDPDPREGQCYIEHTHKEIAWLGNDRRGKVTKFCMVGGDGMRREVRQRDAGFGPLLLEFVELICDIVVGVYTMNL

SEQ ID NO: 127217 - protein, 228 aa, Glycine max
  Coding DNA Sequence Number=SeqID_10439
  Gene Ontology: Mol. function=hydrolase activity; Biological process =metabolic process
  Homolog annotation: Hit_ID=Q9M3Z3; Match level="QueryCoverage=97%, HitCoverage=69%, E-value=1e-100, Identity=68%"; Hit description =Putative PTS protein
MGAAFAPAIASYIPWVAVLGNHDQEGSLSREGVMKYIAGMKNTLSVVNPPEVHIIDGFGNYNLEVGGVEGTDFENKSVLNLYFLDSGDYSKKAYMNGPVPQKEPAPGLAYFHIPLPKYASFDSSNFTGVKQEGISSNSVNSGFFTTLIEAGDVKAVFTGHDHVNDFCGKLTVSLEKTENGRWEDVKSIKTWKRLDDQNLTGIDGQVLWSKSFGSNRRKKQDGGSGEFA

SEQ ID NO: 127218 - protein, 229 aa, Glycine max
  Coding DNA Sequence Number=SeqID_10440
  Gene Ontology: Mol. function=3-oxoadipate CoA-transferase activity; Cellular component=mitochondrion; Biological process=metabolic process
  Homolog annotation: Hit_ID=Q1QBB0; Match level="QueryCoverage=99%, HitCoverage=99%, E-value=5e-81, Identity=65%"; Hit description=3 -oxoacid CoA-transferase, subunit A
  Pfam annotation: Domain name=CoA_trans; Domain location=6-219; Score =294.2; E_value=2.4e-85; Accession=PF01144.13; Description=Coenzyme A transferase
MIDKSVATLEDAVSIIPDGASIMIGGFGPAGQPLELIDALIGRGARELTVISNNAGNGDSGLAALLKTGCVRKMICSFPRQADSWVFDDLYRRGAIELELVPQGNLAARMQAAGSGLGGIFTPTAFGTPLAQGKETREIDGRHYVFETPLKADFALIKAHRGDRWGNLVYRKAARNFGPVMAMAAATTIAQVAELVPLGALDPENVITPGIFVQRLVAVARPATFSLSA

SEQ ID NO: 127219 - protein, 220 aa, Glycine max
  Coding DNA Sequence Number=SeqID_10441
MFVDQNNAKTATLGEVAETLQYMVSPQGRNTWTVDDLVPYVEKLTILSEEQERITKPVAHGPASECRFPPQQFDMLPSSMETRGFDRRREIVQAEDFSQQMEQCGHGMYYTPPTFSQYPSQMYQYSFEGHDTDMSASEHSYGGVAETHPHFSWPTMTPSQQHDAPMATPNAPLAPQWNVPGAIPDMGDLLGVDLRHEFSAEAEQQGRRQWARRNPDREAQ

SEQ ID NO: 127220 - protein, 109 aa, Glycine max
  Coding DNA Sequence Number=SeqID_10442
MDDFQGTLGYSGYRGSKNLGELVSDDHPEFGALIWHRELIGLTLLLLTDSETKFFGVGNLGISIRCTLEDSPIQPTTFRVKRCQGSHALGELGVVGNQNECGRAGRQAR

SEQ ID NO: 127221 - protein, 83 aa, Glycine max
  Coding DNA Sequence Number=SeqID_10443
  Homolog annotation: Hit_ID=Q946Z2; Match level="QueryCoverage=47%, HitCoverage=7%, E-value=4e-11, Identity=80%"; Hit description =Putative acyl-CoA synthetase
IYCAVIPREGSNIDDAEVLRYCKKNLASFKVPEKVLNTNSRQDHAYAFLLSCSCSLPLVLMKPSIVSLPFKLYIVAKRVHVKE

SEQ ID NO: 127222 - protein, 207 aa, Glycine max
  Coding DNA Sequence Number=SeqID_10444
  Homolog annotation: Hit_ID=UPI0000196D72; Match level="QueryCoverage =60%, HitCoverage=68%, E-value=2e-11, Identity=35%"; Hit description =RIC1 (ROP-INTERACTIVE CRIB MOTIF-CONTAINING PROTEIN 1)
  Pfam annotation: Domain name=PBD; Domain location=24-75; Score=31.0; E_value=4.1e-06; Accession=PF00786.18; Description=P21-Rho-binding domain
MPTKVKGLLKYISQIFEEKEEEFQIGLPTDVRHVAHIGSDDPSANAPSWMNDIKRGKEPPSGNPTQTVEECEKKSSSNSKRSKIRNHLIPKSRHTSIDIDPDAPKQKPIRRHNRSSDPSADSSNHESSSGGYRRRRGSNHGVESSSSQDMPPTGVKTNRRKSKASENSSVKKPSSRRSSKVDSLTDISISDFGSGSGPESGLTAIRI

SEQ ID NO: 127223 - protein, 156 aa, Glycine max
  Coding DNA Sequence Number=SeqID_10445
  Homolog annotation: Hit_ID=Q6K1Q5; Match level="QueryCoverage=56%, HitCoverage=43%, E-value=3e-37, Identity=81%"; Hit description =Glycolipid transfer protein-like
  Pfam annotation: Domain name=GLTP; Domain location=1-99; Score=-22.5; E_value=2.5e-06; Accession=PF08718.1; Description=Glycolipid transfer protein (GLTP)
MDFLVALFRNLIEHEDWPMSQACTDSYNKTLKKWHGWLASSSFTVVMKLAPDRKKFMNVIGGTGDINADIEKFCTTFSPLLQEIHKFLIINVNAKNKSIILKKSHDDDDDDDDDDAKNKSIILKKSHDDDDDDDDDDDDDDDDDDDDDDDDVLFVQ

SEQ ID NO: 127224 - protein, 84 aa, Glycine max
  Coding DNA Sequence Number=SeqID_10446
  Subcellular localization annotation: CTP_CleavageSite=13; ConfidenceScore=5.13e-01
MTTFVFALAAPLRCNKGNTPPWRRVWPLTPQGVGSRGVRPPQEIMSKKRIAAVHMALIGSQGVHVGSQGNPRRWPRYDVWRGKV

SEQ ID NO: 127225 - protein, 420 aa, Glycine max
  Coding DNA Sequence Number=SeqID_10447
  Gene Ontology: Mol. function=DNA binding; Biological process =regulation of transcription, DNA-dependent
  Homolog annotation: Hit_ID=O82799; Match level="QueryCoverage=61%, HitCoverage=71%, E-value=1e-50, Identity=46%"; Hit description =Putative RAV-like B3 domain DNA binding protein
  Pfam annotation: Domain name=B3; Domain location=87-195; Score=117.2; E_value=4.7e-32; Accession=PF02362.12; Description=B3 DNA binding domain
MELMQQVKGNYSDSREEEEEEEAAAITRESESSRLHQQDTASNFGKKLDLMDLSLGSSKEEEEEGNLQQGGGGVVHHAHQVVEKEHMFEKVATPSDVGKLNRLVIPKQHAEKYFPLDSSTNEKGLLLNFEDRNGKVWRFRYSYWNSSQSYVMTKGWSRFVKEKKLDAGDIVSFQRGLGDLYRHRLYIDWKRRPDHAHAHPPHHHDPLFLPSIRLYSLPPTMPPRYHHDHHFHHHLNYNNLFTFQQHQYQQLGAATTTHHNNYGYQNSGSGSLYYLRSSMSMGGGDQNLQGRGSNIVPMIIDSVPVNVAHHNNNRHGNGGITSGGTNCSGKRLRLFGVNMECASSAEDSKELSSGSAAHVTTAASSSSLHHQRLRVPVPVPLEDPLSSSAAAAARFGDHKGASTGTSLLFDLDPSLQYHRH

SEQ ID NO: 127226 - protein, 378 aa, Glycine max
  Coding DNA Sequence Number=SeqID_10448
  Gene Ontology: Mol. function=receptor activity; Cellular component =integral to membrane; Biological process=red or far red light signaling pathway
  Homolog annotation: Hit_ID=Q8S403; Match level="QueryCoverage=97%, HitCoverage=45%, E-value=1e-155, Identity=69%"; Hit description =Putative phosphate transporter 1
  Pfam annotation: Domain name=EXS; Domain location=169-355; Score =210.5; E_value=3.8e-60; Accession=PF03124.5; Description=EXS family
MVTTILCSVFALLSLHLFMYGCNLYMWKSTRINHNFIFEFSPSTALKHRDAFLMCTTLMTTVFGAMVIHLLLRAGGFSPGQVDAIPGIIFLFFVGLLICPFDIFYRPTRFCFIRVVRNIACSPFYKVLLVDFFMADQLTSQIPLLRHLETTGCHIFARVFKSHHPEACHSGRLYIEIPYLISFLPYWWRAMQCARRWFDDSDVNHLANMGKYVSAMVAAGARVTYSRQDNHLWFAIVLITSVVATVYQLYWDFVKDWGFFNPKSKNPLLRDDLILKNKSIYYMSMALNVVLRVAWVETIVHLKVGPVQTRLLDFLLASLEVIRRGHWNFYSNEIVNKNPCEIDNFFMNRLENEHLNNVGRYRAVKAVPLPFRDIDSDS

SEQ ID NO: 127227 - protein, 688 aa, Glycine max
  Coding DNA Sequence Number=SeqID_10449
  Homolog annotation: Hit_ID=Q6KA75; Match level="QueryCoverage=89%, HitCoverage=64%, E-value=1e-172, Identity=48%"; Hit description =Peroxisomal membrane protein-like
  Subcellular localization annotation: CTP_CleavageSite=40; ConfidenceScore=5.65e-01
MTAPPSVPAPSPPLAASLPLPFLSRKKTPTLAAPLPVPTLAAAAPAPPISPAPPLEKLNNNHPHNITTTSRLHEKLAFLEGKVKRIASDIKKTKEMLDMNNPDASKVILSDIQDKISGIEKAMVHVVSNKETKNDAVQVAAKDKSLAKGLKLNTEELEARLFPHQKLLRDRTVVKDKGSVVEEEKVLSPVDDNLVAVEFLALIDKEKEKVNAGEDVKERGGGGNVKRNNGIDVLLGADEKLEDFDDDQENKENKEETLVEEEMDEAFNFRLNGIGTNVATGGWFVNEGEAVLLAHLDGSCTYYDITNCEEKAVYMPPPEVSPNIWRDCWVVRAPGSDGCSGRFVVAASAGNTMDSGFCSWDFYTKEVCALQVDAGTASSRIALGPLPNNIRRNSTSSIVTAEATKWWYRPCGPLIVSTASSQKAVKVFDVRDGEQIMKWDVQMPVLTMDYSSPLQWRNRGKVVVAESESISLWDVNSLTPQALLSVPTGGQKVSALHVSNTDAELGGGVRKRVSSSDAEGNDGVFCTSDSINVLDFRQPSGVGLRISKHGVNVQSVFSRGDSVFLGCSSTSSTGKKQTSLLQQFSLRRQGLFTTYALPESNAHSHHAAISQVWGNSDFVMGVCGLGLFVFDTVKDDALRVLNMDYSSDQSFREVIGPDDMYCPSFDYLGSRALLISRDRPAMWRHLIV

SEQ ID NO: 127228 - protein, 66 aa, Glycine max
  Coding DNA Sequence Number=SeqID_10450
MGTNWNRCHNNFTVAYLVDKWVIAFVLRVSAEQVGVGMRASPIGHGHGLCGLWNNAIKSLDANIVS

SEQ ID NO: 127229 - protein, 417 aa, Glycine max
  Coding DNA Sequence Number=SeqID_10451
  Gene Ontology: Mol. function=ATP-dependent helicase activity; Cellular component=intracellular; Biological process=RNA processing
  Homolog annotation: Hit_ID=Q2HTA7; Match level="QueryCoverage=89%, HitCoverage=15%, E-value=1e-80, Identity=50%"; Hit description =Helicase, C-terminal; Argonaute and Dicer protein, PAZ; Type III restriction enzyme, res ...
  Homolog annotation: Hit description=subunit; Ribonuclease III, bacterial
  Pfam annotation: Domain name=DEAD; Domain location=289-410; Score= -33.8; E_value=0.004; Accession=PF00270.19; Description=DEADDEAH box helicase
  Pfam annotation: Domain name=ResIII; Domain location=285-404; Score= -34.8; E_value=0.038; Accession=PF04851.6; Description=Type III restriction enzyme, res subunit
  Pfam module annotation: Pfam domain module=DEAD::ResIII; Domain location=289-410::285-404
MEDGSRVPAGDDPSYWLDACEDISCDDFIDFDVSSIVSDQPDNPSNQDFFGGIDKILDSIKNGAGLPLNHAVEPPNNNGTAAGEVCLPSNATLEDGAPAADAFDHSGGVARSNGSSKLSNGNETGVLVNYSQERGAPPLNGGHDFDGEERCSKRAWLGGYNNERPYYCRGNYQGKERERCFNNNNRKRPRGDRDEIDRKDKDGGGRKREHYGAVARRDVRDRDCRDRETRGYWERDKSGSTDMIFRTGAWEPDHNRDDKMVIDTKLENYGKLDKKSEDAIERVPEEKARQYQLDVLEQSKRKNTIAFLETGAGKTLIAVLLIKSIQDSLQKQNKKMLAVFLVPKVPLVYQQAEVIRERTGYQVGHYCGEMGQDFWDARRWQREFDTKHYSILRIRILFSSSCLSIFSSRIELATGQV

SEQ ID NO: 127230 - protein, 582 aa, Glycine max
  Coding DNA Sequence Number=SeqID_10452
  Gene Ontology: Mol. function=protein-tyrosine kinase activity; Cellular component=integral to membrane; Biological process=protein amino acid phosphorylation
  Homolog annotation: Hit_ID=Q8S8N4; Match level="QueryCoverage=97%, HitCoverage=87%, E-value=1e-155, Identity=50%"; Hit description =Putative Ser/Thr protein kinase
  Pfam annotation: Domain name=Pkinase; Domain location=289-542; Score=- 48.0; E_value=1.1e-05; Accession=PF00069.15; Description=Protein kinase domain
  Pfam annotation: Domain name=Pkinase_Tyr; Domain location=289-541; Score=-59.3; E_value=7.9e-09; Accession=PF07714.7; Description =Protein tyrosine kinase
  Pfam module annotation: Pfam domain module=Pkinase::Pkinase_Tyr; Domain location=289-542::289-541
MRGPPCSLSILCQHFIIGSVSYTVLEFFPDGVLVDFPGSSSCRLYNDLNSFGRNFAGNNKDMFGVSVDNVIGLYDCEDSSLCKADCETIDMPGCDGKGGGSLACCYPLSDHTIWHAGDGFSVFSQFGCRGVSSWAVLRGSTWGKRGVKLEWALPRNSSSTHVCATNANMANATAVEGGVRCVCQNGYVGDGFANGTGCLQACIKDGKEAYGSDCYIKRHDQRKFVMIAGIIGPVLIVASLVVLFYLLKRPTKPGMFDTEQAYYQNITIPKACKTRLFSLHELEEATKGFEEGQKLMHDNNGTIFAGVLGDGSHIAVHKLKCEKNDLIQVLSQIEVLSSVVHRNMARILGCCIESGNTLVVYEYTSNGTLEEHLHQSKGQQLRLDWYSRLTIAAQTASVLAFLHYEKNPPILHHNLKSACIFLDDDYSVKIAGFGLINSNFYYGSNLQKNCEGFGICKNDVYDMGVLLLEIISGSNQLDSPTLALQHIRAGKFEEIMDPFLCYDEQPHYRQEQMQIIADLATRCLLFGVDGRLGMIDVVRELVHMTKESLDGGIMKGPALEETFSNSSLLQMISMSPDSMNVP

SEQ ID NO: 127231 - protein, 1093 aa, Glycine max
  Coding DNA Sequence Number=SeqID_10453
  Gene Ontology: Mol. function=ATP-dependent helicase activity; Cellular component=intracellular; Biological process=RNA processing
  Homolog annotation: Hit_ID=Q2HTA7; Match level="QueryCoverage=99%, HitCoverage=61%, E-value=0.0, Identity=78%"; Hit description =Helicase, C-terminal; Argonaute and Dicer protein, PAZ; Type III restriction enzyme, res ...
  Homolog annotation: Hit description=subunit; Ribonuclease III, bacterial
  Pfam annotation: Domain name=DUF283; Domain location=56-124; Score= -4.6; E_value=0.0071; Accession=PF03368.5; Description=Domain of unknown function
  Pfam annotation: Domain name=PAZ; Domain location=369-535; Score =138.7; E_value=1.6e-38; Accession=PF02170.12; Description=PAZ domain
  Pfam annotation: Domain name=Ribonuclease_3; Domain location=569-715; Score=145.0; E_value=1.9e-40; Accession=PF00636.16; Description =RNase3 domain
  Pfam annotation: Domain name=Ribonuclease_3; Domain location=791-904; Score=157.9; E_value=2.7e-44; Accession=PF00636.16; Description =RNase3 domain
  Pfam annotation: Domain name=dsrm; Domain location=1016-1088; Score =38.3; E_value=2.7e-08; Accession=PF00035.15; Description=Double -stranded RNA binding motif
  Pfam annotation: Domain name=dsrm; Domain location=931-991; Score =45.8; E_value=1.5e-10; Accession=PF00035.15; Description=Double -stranded RNA binding motif
  Pfam module annotation: Pfam domain module=DUF283::PAZ::Ribonuclease _3::Ribonuclease_3::dsrm::dsrm; Domain location=56-124::369-535::569 -715::791-904::1016-1088::931-991
DNLSHEAFLRNARNSEETLRKEAIERTDLSHLKDTSRLISVDTRPGTVYQVKSTGAVVSLNSAVDIQFFALNLLWRGTKNLEVPQNILASFNYHAVCLAACKKLHEMGAFTDMLLPDKGSGGEKEKDEQTDEGDPLPGTARHREFYPEGVADILKGEWILSGKDACNNSKLLHLYMYAVKCENLGHSKDPFLTQVSNFAVLFGNELDAEVLSMSMDLFIARTVTTKSSLVFRGLISITESQLASLKSFHVRLMSIVLDVDVEPSTTPWDPAKAYLFVPMVGDKSVDPTNQIDWHLVETIIGADAWKNPLQKARPDVYLGTNERTLGGDRREYGFGKLRHGMAFGQKSHPTYGIRGAVAQFDVVKASGLVPNRDAMQTQKHINMTTNGKLMMADICTNAEDLVGRIVTAAHSGKRFYVDSICYDMSAENSFPRKEGYLGPLEYSSYADYYKQKYGVNLIYKQQPLIRGRGVSYCKNLLSPRFEHSEAHEGESEEIHDKTYYVFLPPELCLVHPLPGSLVRGAQRLPSIMRRVESMLLAVQLKNMINYPVLASKILGALTAASCQETFCYERAELLGDAYLKWVVSRFLFLKYPQKHEGQLTRMRQQMVSNMVLYQYALSKGLQSYIQADRFAPSRWAAPGVLPVFDEDTKDGESSLFDQERSISKIERMDCHTNGYEDEMEDGELESDSSSYRVLSSKTLADVVEALIGVYYVEGGKNAANHLMKWIGIQIEFDPDTMECTKKPFNVPDSILRSVDFDALEGALNMKFNDRGLLVESITHASRPSSGVSCYQRLEFVGDAVLDHLITRHLFFTYTNLPPGRLTDLRAAAVNNENFARVAVKHNLHVHLRHGSSALEKQIKEFVKEVQVELSKPGFNSFGLGDCKAPKVLGDIVESIAGAIFLDSGRDTTVVWKVFQPLLHPMVTPETLPMHPVRELQERCQQQAEGLEYKASRIGNLATVEVFIDGVQVGAAQNPQKKMAQKLAARNALAALKEKEVGKTQEKNDENGKKNGNQTFTRQTLNDICLRRNWPMPFYRCVNEGGPAHAKRFTFAVRVNTTDRGWTDECVGEPMPSVKKAKDSAAVLLLELLNKLYS

SEQ ID NO: 127232 - protein, 211 aa, Glycine max
  Coding DNA Sequence Number=SeqID_10454
  Gene Ontology: Mol. function=inorganic diphosphatase activity; Cellular component=cytoplasm; Biological process=phosphate metabolic process
  Homolog annotation: Hit_ID=Q2HTA8; Match level="QueryCoverage=99%, HitCoverage=100%, E-value=1e-108, Identity=88%"; Hit description =Inorganic pyrophosphatase
  Pfam annotation: Domain name=Pyrophosphatase; Domain location=49-203; Score=303.4; E_value=4.2e-88; Accession=PF00719.9; Description =Inorganic pyrophosphatase
MSENGEEAGENRPVPRLNERILSSLSKRSVAAHPWHDLEIGPEAPQIFNCVVEITKGSKVKYELDKKTGLIKVDRVLYSSVVYPHNYGFIPRTLCEDNDPIDVLVLMQEPVLPGCFLRARAIGLMPMIDGGEKDDKIIAVCADDPEYKHFTDYRELAPHRISEIRRFFEDYKKNEHKEVAVNDFLPASVALDAIQYSMDLYAEYILHTLRR

SEQ ID NO: 127233 - protein, 719 aa, Glycine max
  Coding DNA Sequence Number=SeqID_10455
  Gene Ontology: Mol. function=DNA binding; Cellular component=nucleus; Biological process=regulation of transcription, DNA-dependent
  Homolog annotation: Hit_ID=Q0PJG5; Match level="QueryCoverage=70%, HitCoverage=100%, E-value=0.0, Identity=83%"; Hit description=MYB transcription factor MYB134
MATVTITGERQYRGHYWRPVIGDHNCDHYRRTAIATVTGDHDRRSETVTGKKEAFVKGVPIGQALDIDIPPPRPKRKPSNPYPRKTNVGAPTLHSEAKHGKSLISIASSHGKQALDLEKEPLPEHNVDLRPTTVKENKDGSCLNVFTIIQEAPCSSVSSANKNSTSISVPLRNSCALREFIPSVKEVITRDETNESFVTDELENQKLEIDDGKHTQKTNDTCEVSKLENSGASELVQTEKTDGRNCALTIDGVPGNQNYPRHVPVHVVDGNLGTSTQNLSPDMVFQDSIFQPKGGVNRQPNLVTNSATSHISECQNNAARSSIHQSFPPSPPFAQDDYHSFLHMSSTFSSLIVSTLLQNPAAHAAASFAATFWPYANAETSADSPVCTPDFPSRQIGSPPSVTAIAAATVAAATAWWAAHGLLPLCGPLHTAFACPPASATTVPSMIIDESPQKTERGEIKPQNPPLQDQIPDPEHSEAQHSAPKSPAVSSSKSEDRGDANLDTSPKATNHEMNQAISENPDSNKMKGRKPVDRSSCGSNTTSSSEETELLEKDEKEKEEPKTPDANVLDTELSNRRSRSISNLTDSWKEVSEEALFSREVLPQSFSPTHHLINKDNQIDSIKDNELNTDYKDEDLESKKCSSICDGVQKNLLFVKDNNEEEGLLTIGLGPGKLKTRRTGFKPYKRCSVEANENRIGTACIQGEEKGPKRLRLNGEAST

SEQ ID NO: 127234 - protein, 61 aa, Glycine max
  Coding DNA Sequence Number=SeqID_10456
MESSDEKVQELKSNVAKSGSLPLALPTPNPSMADSWFFVSLRHTIKSSSFIPPFAMSEYVD

SEQ ID NO: 127235 - protein, 460 aa, Glycine max
  Coding DNA Sequence Number=SeqID_10457
  Gene Ontology: Mol. function=DNA photolyase activity; Cellular component=mitochondrion; Biological process=DNA repair
  Homolog annotation: Hit_ID=Q2HTC1; Match level="QueryCoverage=92%, HitCoverage=91%, E-value=0.0, Identity=76%"; Hit description =Peptidase S8 and S53, subtilisin, kexin, sedolisin; Tetratricopeptide - like helical
  Pfam annotation: Domain name=PPR; Domain location=160-194; Score =11.3; E_value=0.34; Accession=PF01535.11; Description=PPR repeat
  Pfam annotation: Domain name=PPR; Domain location=231-265; Score =40.0; E_value=8.2e-09; Accession=PF01535.11; Description=PPR repeat
  Pfam annotation: Domain name=PPR; Domain location=266-300; Score =37.2; E_value=5.7e-08; Accession=PF01535.11; Description=PPR repeat
  Pfam annotation: Domain name=PPR; Domain location=301-335; Score =45.5; E_value=1.8e-10; Accession=PF01535.11; Description=PPR repeat
  Pfam annotation: Domain name=PPR; Domain location=336-370; Score =39.5; E_value=1.2e-08; Accession=PF01535.11; Description=PPR repeat
  Pfam annotation: Domain name=PPR; Domain location=371-405; Score =32.5; E_value=1.5e-06; Accession=PF01535.11; Description=PPR repeat
  Pfam annotation: Domain name=PPR; Domain location=406-440; Score =12.1; E_value=0.28; Accession=PF01535.11; Description=PPR repeat
  Pfam module annotation: Pfam domain module=PPR::PPR::PPR::PPR::PPR::PP R::PPR; Domain location=160-194::231-265::266-300::301-335::336 -370::371-405::406-440
MVEKNVSIFLSRKASKRRNPLLACPLSRESEEMHRAFVRSKTLISVASNRISSSGPTSLNPWQPLYLYRQKQQEASHSSSCNSGNTPFGSPTRVQKLIASQSDPLLAKEIFDLASRQPKFRHTYSSYLILLLKLGRSKHFSLLDDLLRRLKFDSHPITPTLFTYLIKVYAEADLPDKALNSFYTILHFNCKPLPKHLNRILEVLVSHRNFIRPAFYLFKDAHRYGVEPDTKSYNILMRAFCLNGDISVAYSLFNKMFKRDLVPDIESYRILMQALCRKSQVNGAVDLLEDMLNKGFVPDSLTYTTLLNSLCRKKKLREAYKLLCRMKVKGCNPDIVHYNTVILGFCREGRAHDACKVITDMRANGCLPNLVSYRTLVSGLCDMGMLDEASKYVEEMLSIDFSPHFAVVHALVKGFCNVGRVEDACGVLTKALEHGEAPHLDTWMAIMPVICEVDDDGKIS

SEQ ID NO: 127236 - protein, 197 aa, Glycine max
  Coding DNA Sequence Number=SeqID_10458
  Gene Ontology: Cellular component=cellulose and pectin-containing cell wall
  Homolog annotation: Hit_ID=Q2HTB8; Match level="QueryCoverage=93%, HitCoverage=81%, E-value=2e-70, Identity=67%"; Hit description =Harpin-induced 1
  Pfam annotation: Domain name=Hin1; Domain location=33-171; Score =165.1; E_value=1.8e-46; Accession=PF07320.4; Description=Harpin -induced protein 1 (Hin1)
MSKDKVSGDPRRAVCTGITIFLLLAGVTLLVLWLVYRPHKPRFTVIGAAVYDLNTTTPPLMSTTVQFSVLIKNPNRRVSIYYDRFSAFVSYRNQAITPQVLLPPLHQEKRSSVSVSPVMGGTALPVSVEVSDGLAVDEAYGLVGLRLIFEGRVRWKAGAIKTAHYGLYVKCDVLMGLKKGLVGQVPLLGVTPCHVHL

SEQ ID NO: 127237 - protein, 695 aa, Glycine max
  Coding DNA Sequence Number=SeqID_10459
  Gene Ontology: Mol. function=two-component response regulator activity; Cellular component=nucleus; Biological process=two -component signal transduction system (phosphorelay)
  Homolog annotation: Hit_ID=Q2HTB9; Match level="QueryCoverage=92%, HitCoverage=98%, E-value=0.0, Identity=58%"; Hit description =Response regulator receiver; CCT
  Pfam annotation: Domain name=CCT; Domain location=645-683; Score =74.0; E_value=4.6e-19; Accession=PF06203.4; Description=CCT motif
  Pfam annotation: Domain name=Response_reg; Domain location=57-173; Score=91.4; E_value=2.8e-24; Accession=PF00072.14; Description =Response regulator receiver domain
  Pfam module annotation: Pfam domain module=CCT::Response_reg; Domain location=645-683::57-173
MAENGTRLHSAVLTEWTATCLKMGLVAADKGSMQTQEEQSDNASAVQWERFLPRMVLRVLLVEADDSTRQIISALLHKCSYKVVAFCDGLKAWETLKNKPSDIDLILTEVDLPSISGFSLLTLIMEHDICKNIPVIMMSSHDSVSMVLKCMLKGAADFLIKPVRRNELRNLWQHVWRRHAISRPPQNFTLPEIEIGFAAENHAASNDSSGSVASTAKNGECSEKTSEAQSTCTSPFLEAESTYLENMQDISQLKRSSNLSNIDTVKHENSTKCERESDKHNDEAGGLRLGQGYECCETRNQDVVLKIELIKSNPEINTDIHGCSDELVDPYTGAIDLIATFKNLPKSTDEKCSFSSGNTAKFDFDTQLELSLRRRDFPGSSCKAASEERQLLNHSNASAFSRYSSSKLLQPLFPTPSTISAKLTNSSLSSHESHKFSENASTSHQYGGKNQNQEKIITPVIGQSGQVDPKLPNSQLGYFPATGVTSDHKSTGNGNVFPSMLYAESGVHPIWTPKSVCQKESSPFPTITSSQSNPQSHNSECHLWSEDSTHASDKNLNDQINLDCETHDSPDASQSAGTSFFHDTANHNSSGVYRSMGCRSDGNATSAKVAKESHGSFIDSGHCSYDGFIGTDSHRTSHREAALTKFRLKRKDRCYEKKVRYQSRKRLAEQRPRVKGQFVRQVQDDHPVADVGGGS

SEQ ID NO: 127238 - protein, 87 aa, Glycine max
  Coding DNA Sequence Number=SeqID_10460
  Subcellular localization annotation: CTP_CleavageSite=72; ConfidenceScore=5.30e-01
MDKVVSRICPLDLMMKYVQFQSLAHQWAKRASTAKHSFSALSATEESRSSSISRPRAIRETSALSVAAIFSQAQHKTGAKPESTYPH

SEQ ID NO: 127239 - protein, 539 aa, Glycine max
  Coding DNA Sequence Number=SeqID_10461
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1R2G5; Match level="QueryCoverage=55%, HitCoverage=86%, E-value=1e-112, Identity=57%"; Hit description =Hypothetical protein yjiN
MAVGEFVAPQGEQMARNYRAQQLYGGSLVSTQNGLWAKDGNDFIYIERIKGDNEIDGVSIYRFTDQRRLLSVRYAATAVWNKDRKLWELSQVDESDLKDPKQITGSQSLSGEWKTNLTPDKLGVVALDPDALSISAAVGGGDDADGAVVYLWSAEKRIDGRARGHRHQLWLPVLRAGSDLRATESGVRFTAGAGRDSAERRVLRHQFVPVAETAVDARTVSATSAPSPRAVDADKLQITANVQLNLLRHLARIPAFHRIADCFIGGERFAQPQRRQPHPLLHARIVTVEVALQPAAQVLPQLADITSLYRAVKTEAKFVALVARHFIQNRIHRVGDQLGAVFAQPFGRQYFGFDRMFAFQPAHNLQRDKLARAGFVQQTQQLLHRSVQQLLMAIVFGQAVQQQRAGLGQIDLIQCAMHRAAQKALNTLIVSKIEETAHHLQQCQQRIGIEKLLLHEAAKILADAIFVAWNDCRMARDERYRHATKQRHHRKPVGQRADHRRFGNRLQPQHPERGRQKQRHDKGRGGNQQQRQGQTLAPF

SEQ ID NO: 127240 - protein, 74 aa, Glycine max
  Coding DNA Sequence Number=SeqID_10462
MAIQFILPWLKNGTSPYVSSNHNNLNHDLKVANLIDHNIGDWKNELAKTNFNQQDAQWIKDILVLNTSNNGKLI

SEQ ID NO: 127241 - protein, 106 aa, Glycine max
  Coding DNA Sequence Number=SeqID_10463
MGHPKRIKVIPEWPTPPSIKKIRGIHDLTYFYKRCRNLPFGRRATRGSRVRLPREEGVRSRHQRLFEENVGKTETCGLRILNVKGSGVVFMHGEGISNPRIHHNGR

SEQ ID NO: 127242 - protein, 138 aa, Glycine max
  Coding DNA Sequence Number=SeqID_10464
  Gene Ontology: Mol. function=structural constituent of ribosome; Cellular component=intracellular; Biological process=translational elongation
  Homolog annotation: Hit_ID=Q307Z7; Match level="QueryCoverage=99%, HitCoverage=100%, E-value=4e-15, Identity=37%"; Hit description =Acidic ribosomal protein P1a-like
  Pfam annotation: Domain name=Ribosomal_60s; Domain location=47-137; Score=127.3; E_value=4.3e-35; Accession=PF00428.9; Description=60s Acidic ribosomal protein
MSLGETACSYAALILHEDGISVTVSFSVPLGFALTNNFLLNQLKSCAIVADKISTLLKTAKVPVDSYWPTLFAKLAEKKNLGDLIANAAGGGAPVAVAAAPVAAAAGGAAAAAPAAEEKKKEEPEEESDDDMGFGLFD

SEQ ID NO: 127243 - protein, 106 aa, Glycine max
  Coding DNA Sequence Number=SeqID_10465
MGNAWFGKKRSTKAVVHPEVVRGVTTIKVRMTKAQLMDLTQKVDMTNNYGNSELGRLIVQECSKGRFHARVVVVAAAAASAGHDSQRAHMFSRERGLTPIQENSDE

SEQ ID NO: 127244 - protein, 414 aa, Glycine max
  Coding DNA Sequence Number=SeqID_10466
  Gene Ontology: Mol. function=phospholipase A2 activity; Biological process=lipid metabolic process
  Homolog annotation: Hit_ID=Q9FZ09; Match level="QueryCoverage=99%, HitCoverage=97%, E-value=1e-159, Identity=67%"; Hit description =Patatin-like protein 1
  Pfam annotation: Domain name=Patatin; Domain location=23-229; Score =300.7; E_value=2.8e-87; Accession=PF01734.12; Description=Patatin -like phospholipase
MERTLSSLLQIQPPTYGNLVTILSIDGGGIRGIIPATILAFLEAQLQELDGEDARLADYFDVIAGTSTGGIVTAMLSAPNDNQRPLFAAKDIKPFYLEHCPKIFPQHSGLWGSVGKLLGSLGGPKYDGKYLKEVVREKLGQTRLHETLTNIVIPTFDIKTLQPIIFSSYQIKRSPCLDARLSDICISTSAAPTYLPAYHFKNQDSQGNTHEFNLIDGGVCANNPTLVAMNQVTKQIINENPDFFSIKPMEYGRFLIISLGTGTPKNEQKFNAQMAAKWGLLDWLTNSGSTPLIDVFTQSSADMVDFHLATVTQALHSENNYLRIQDDTLTGTDSSVDIATKENLEKLSQIGERLLKKPVSQINLEDGLFESVGNGETNENALKRFAKILSQERRLRESKSPHTKKVPSYFAREF

SEQ ID NO: 127245 - protein, 248 aa, Glycine max
  Coding DNA Sequence Number=SeqID_10467
  Homolog annotation: Hit_ID=Q10K64; Match level="QueryCoverage=98%, HitCoverage=91%, E-value=8e-49, Identity=37%"; Hit description =Nodulation protein, putative, expressed
METKDSPDIKSFKKFPLTLRLVILVVVVLCGIYICTIILEQKGVHTSAKLLGITVFKQPCYNHSGVEEWELPYLHYPEPKIYSRVIDESTLCREECACNPVLFFCIVSMQRSGSGCASKNECTAAVGFKLMLNQGLMEHHEEIVEYFERRRVSVIFLFRRNLLRRMISVVANSYDKDAKPLNGTHKSHVHSRVEKLKDVQEFLRVPYRDLESRQVKIHTAALSKQIENWDEVQESLAGTPYQRFLLKD

SEQ ID NO: 127246 - protein, 230 aa, Glycine max
  Coding DNA Sequence Number=SeqID_10468
  Gene Ontology: Mol. function=catalytic activity; Cellular component =endoplasmic reticulum; Biological process=electron transport
  Homolog annotation: Hit_ID=Q1T3J7; Match level="QueryCoverage=94%, HitCoverage=60%, E-value=7e-88, Identity=76%"; Hit description=FAD linked oxidase, N-terminal
  Pfam annotation: Domain name=FAD_binding_4; Domain location=59-199; Score=69.7; E_value=9.3e-18; Accession=PF01565.13; Description=FAD binding domain
MTMPISSTKNSFLILFVFMICGGVIATPPEDPIQCSSKNTDCTITNTYGVFPDRSICHAAEVIYPNTEEELISAVASASKNKRKVKAATRFSHSIPKLVCPDGEKGLLISTKNLNKVLKIDKEARTMTVQSGVSLREIISKSAEAGLALPYTPYWWGLTIGGLMGTGAHGSTLWGKGSAVHEYVLQIRIVTPAGPEDGYAKVRNLDESHQQHLNAARVSLGVLGVISQVN

SEQ ID NO: 127247 - protein, 432 aa, Glycine max
  Coding DNA Sequence Number=SeqID_10469
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=32%, E-value=1e-69, Identity=33%"; Hit description =Integrase, catalytic region
MTLVLKMKNKIGFVDCTISKPHEQHPNYSSWKRCNNLIRSWINHPISPDIATSILWPNQASEVWNALRTHFSQGDCVWILQLNNDLYSTKQGDLSVTSYFTKLRILWDKLCNFCPIPTCDATLVGSSKAVQLFKKYRDCDTVLCFLHGLNEPFAFAKSQTLMLDPLPSLDQVFSMILQQERQLHVGVLPTPTLLTAQAPPNASQGRGKAPFKFNFVKQGHARLCTHCNRTNHIIDTCFLKHGFPPGWKSKKYVHDVAIANLQPEDDSDPGGILSSLTKDQIQSLLALLPSATPTADATSSSNVVGSSNLVSSNHISTQPDTDNVSWILDTGATDNFACFLNLFASYRAIKPILVALPNGKFPSALFRGIVVLTNSLILYDVLFIEHFSVNIISITKLTKSLDCQTIFAHKLCFLQQIYGQKMIGTASTIWLF

SEQ ID NO: 127248 - protein, 387 aa, Glycine max
  Coding DNA Sequence Number=SeqID_10470
  Gene Ontology: Biological process=electron transport
  Homolog annotation: Hit_ID=Q9FM82; Match level="QueryCoverage=91%, HitCoverage=61%, E-value=1e-138, Identity=64%"; Hit description =Arabidopsis thaliana genomic DNA, chromosome 5, P1 clone:MCD7
MKEISDQCKEFHTQSPRVVSVTLNLEPLFKRSLTYLIKDDSDLGDELASFGRKHEFADVTWYPSQQKAVYRIDDRVSVNTSGNGLYDFFPFRPTLSAALTVVRATEELQEATRDANGKCVGAKLITATLSGIGYGLTDNGIFLGYPIVGFSNRMQASGTCLDSRNDGLFTACPWDSRIKGEFFHQTAFSIPLSVVKNFIEDVQKLVELEPKSLCGLETANGILMRYVTASSAYLGKSEDAVDFDITYYRSKDPLAPRLFQDILEEIEQIGLFKYGGLPHWGKNRNLAFLGAIKKYHNADKFLKVKEEYDPQGLFSSLWTDQMLGLKEGVTTFKDGCALEGMCICSQDSHCAPKKGYFCRPGRIYTEARVCTRDVKKSKEADDVKDEL

SEQ ID NO: 127249 - protein, 377 aa, Glycine max
  Coding DNA Sequence Number=SeqID_10471
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=29%, E-value=1e-117, Identity=51%"; Hit description =Integrase, catalytic region
MDKEIEALQNNNTWILTELPLDKKLVGCKWIYKIKRKSDGSNERFKARLVAKGYTQLEGVDYNETFSLVVKLTSVWLVLALAATKHWHLHQLDVNNVFLHGDLIEDVYMKVPPGFTTANYELVCKFQKSLYGLKQANRQWNAKLTAALISLGLHQSSSDYSLFVKNQNSHISILLVYVDDVVLTGNHLEEINYVKSFLDQQFRIKDLGELKFFLGLEVARSKSGIVLSQRKYALELITDVGLLGCKPILVPMLIYLTKTRPDLCFAVQKLSQSSDFKLRDSSDLDRAACPETRKSITDFSIFFGSSIVSWKSKKQPTISRSSSEAEYWPLTITACELQWLSYLLIDMHQETSLSIILYCDNQSTIKIARNPMFHEPA

SEQ ID NO: 127250 - protein, 77 aa, Glycine max
  Coding DNA Sequence Number=SeqID_10472
MVDKESKYAACDILVGPESIGEKAGTMELETEIVYEVETGIEPESAEIVSERTGAELGVELFDSVGLVGKEDKSEPV

SEQ ID NO: 127251 - protein, 106 aa, Glycine max
  Coding DNA Sequence Number=SeqID_10473
MMAHQNPPYLAFCTPGQNETKNKIQEYQRETNKNIHIFLNEHQGIKGMVPRSTSLLAREVSSSKPKASVLTLPILEFKEGKRSEVMQERVPFLQKCEYDLVMEKML

SEQ ID NO: 127252 - protein, 108 aa, Glycine max
  Coding DNA Sequence Number=SeqID_10474
MEPKLLLKLDYGVRRWFPNVAQGVDYFIEYLQFTVTSLVEFEEAPEYVEYFIWRVQPTPPYYRYVKLVYVIEILFSLYYLDLSEYVLGPPYASMDFEHTVTVTSQQNF

SEQ ID NO: 127253 - protein, 173 aa, Glycine max
  Coding DNA Sequence Number=SeqID_10475
MEIGIRRMVVSFLFRSMQVTCKGIRSLMEQIHYNLFHSKCRMPMQFINLKMLQLMLEVSYPNFFREPLFFGMRPPFHHFKMFNTHCHGIRKVLGHFGKKTTKNTKVGVNLSNTTGALRKIIQNILKGVNLSIMGCIQESSSRSLWAETTSILLKNGIRGFRKISENLGLAYFT

SEQ ID NO: 127254 - protein, 114 aa, Glycine max
  Coding DNA Sequence Number=SeqID_10476
MEEQKLRFLLKSKALNVMLYALSEKEYTKFINKNFSRTKDPRERSLLLLAVKITKRHHHLENKSQRSLKLLKLITPLMRNLRKILMKKNLPSSHERFARCGKTKVALLEIEEAT

SEQ ID NO: 127255 - protein, 646 aa, Glycine max
  Coding DNA Sequence Number=SeqID_10477
MPSFSILTVVFEGVYFESGGDRLLFLLGNTDLPISKPHVENRDITNSHWSGYSHQPHLLQDDQILLVLRYTQTFNLTSRAIKGEIRSISKHGSLKYFDIVYISSQLSRYSEYQFSLELMPRSCKDKHLCQDWKQYDALTFSGYEFCKTIQSISEPFNVVPNYKFTDRYAYQSKLRPLQPRKEFGFANWRLNREDFRLVLVFPTSIPEDTARERTGLSNLTLLAEGTWDSSSGKLCMIEFSGDVDSVLEECNYHISLYFPREYSIKQRSLMLGSISSIANETNMFFPLQINYAPHPVLLHLSLDPCGSYLSYNYTMIQIATSIRRRNQPSKFRLLKQSSLLKYPALEDEQDVLAAQLHFLSTNLSFDAYAICKHCSDKHNSRVFIHMDVFSLGPLFGPYVPGLRKDDEAKKPAGTENSLIPKFSISHCILYSMKDLPMVSNVSTNVEHGLDCLVDVKVQDTEILVESPHGLHDNKHMLNPLEIITRLLVLIALLITIRLYNKVHIVGCLVLTSLLAIEPSLRNNLRSLGLIDFLLLPGVFIRQAHTLCAQDLFLVPQALQKSVWQSKVKPLRKMYYVGLTLLRLILFSYDYMRDPILDPYSDNGEFNTMRSIFYPIYGITGAAVPIIMVLVATVVHIQQSSNIHKSF

SEQ ID NO: 127256 - protein, 294 aa, Glycine max
  Coding DNA Sequence Number=SeqID_10478
  Gene Ontology: Cellular component=integral to membrane
  Homolog annotation: Hit_ID=Q6MLK6; Match level="QueryCoverage=94%, HitCoverage=90%, E-value=2e-80, Identity=53%"; Hit description =Hypothetical transmembrane ptotein yneE
  Pfam annotation: Domain name=UPF0187; Domain location=1-288; Score =434.5; E_value=1.5e-127; Accession=PF05249.2; Description =Uncharacterised protein family (UPF0187)
MLFVWHGSVLPALLPRLGLLLILSLLVTYFHGIIFSFKVPLNPAPLTLFGFVLALFLGFRNNASYDRFWEGRKLWGALLNTSRALTRQAITLKNIKEDQDSVHNFVQLLGAFVFALKHQLRGTDAYEDLKSRLNEDQLKLVAASKYKPAVIMRLLAEWVQKLKDEGGMDSIQQARFDENFDKLSDILGGCERIISTPIPYSYRVLLHRTVYIYCFLLPFGLVDSLGWFTPLIVVFVAYTFVAFEAIADEIEEPFGTDANDLALNSMCIMIDETIHEMVGEHIAVSRKNTQNIID

SEQ ID NO: 127257 - protein, 462 aa, Glycine max
  Coding DNA Sequence Number=SeqID_10479
  Gene Ontology: Mol. function=DNA binding; Biological process =regulation of transcription
  Homolog annotation: Hit_ID=Q9ZQ85; Match level="QueryCoverage=99%, HitCoverage=100%, E-value=1e-91, Identity=47%"; Hit description =Expressed protein
  Pfam annotation: Domain name=Myb_DNA-binding; Domain location=254 -305; Score=35.4; E_value=2e-07; Accession=PF00249.21; Description =Myb-like DNA-binding domain
MSSQVELSMDYKPYSYSTLLKSYADETETDQTHKLEEFLSRLEEERVKIDAFKRELPLCMQLLTNAVEASRQQLQAFRSNQGTRPVREEFMPIKHPNSQESTEKTSNISDKANWMTSAQLWSQASEGTKPQSTITSPKNGADMGFSVSPNPALDNKHRNGGAFLPFSKERNSCQGLRDLPEVALASSEKEMEKKCELESEKCSKRENSGKGSGSCEGVVDQGKSASVASEAQTTNTTITTTTNNTTGQTHRKARRCWSPDLHRRFVNALQMLGGSQVATPKQIRELMKVDGLTNDEVKSHLQKYRLHTRRPSPSLQTGAPTPQLVVFGGIWVPPEYARAAAHSGGPTLCGPHPTSHVPPPHYCAPTPMPQEFYNSAPSLSLPSPAHENILHHHHFHMYKTAPQTRSSPVSDVRSGGDRSETIEDGKSESGSWKAENGEKKGLAALRDQEGDESTGSEITLKF

SEQ ID NO: 127258 - protein, 63 aa, Glycine max
  Coding DNA Sequence Number=SeqID_10480
MKADMEVSYPNFVRGPFLDDMQLLFGPCPSGTFWKLGCLRRKQLGGKLLHVFEKWFPGLPRLP

SEQ ID NO: 127259 - protein, 121 aa, Glycine max
  Coding DNA Sequence Number=SeqID_10481
MAACILGIFHKEMVGTEVLYCKPQGIQVEAYPYVVTRVVCAFDDLVFDIHEEQMARSFDGCLSVPETKATRKGQNGHFLEFSDLNSPRSASGSPGPWESFSLKQLARLGKPIPSSLSNWLA

SEQ ID NO: 127260 - protein, 60 aa, Glycine max
  Coding DNA Sequence Number=SeqID_10482
  Subcellular localization annotation: CTP_CleavageSite=45; ConfidenceScore=5.07e-01
MDFMRKKKGPYHTKNNPNNNKKRRKKLSFAQGRPKLKLPREEFPRNQVVQTTHDYYPLIP

SEQ ID NO: 127261 - protein, 42 aa, Glycine max
  Coding DNA Sequence Number=SeqID_10483
MDVLCLVGTSVKPTKHRGRARKASIAARPTKPSTFGRGRPRN

SEQ ID NO: 127262 - protein, 254 aa, Glycine max
  Coding DNA Sequence Number=SeqID_10484
  Gene Ontology: Mol. function=protein serine/threonine kinase activity; Cellular component=cytoplasm; Biological process=protein amino acid phosphorylation
  Homolog annotation: Hit_ID=Q6ZLP5; Match level="QueryCoverage=98%, HitCoverage=56%, E-value=3e-87, Identity=62%"; Hit description =Putative CBL-interacting protein kinase 23
  Pfam annotation: Domain name=Pkinase; Domain location=16-253; Score =202.8; E_value=8.1e-58; Accession=PF00069.15; Description=Protein kinase domain
  Pfam annotation: Domain name=Pkinase_Tyr; Domain location=16-253; Score=-10.9; E_value=8.4e-12; Accession=PF07714.7; Description =Protein tyrosine kinase
  Pfam module annotation: Pfam domain module=Pkinase::Pkinase_Tyr; Domain location=16-253::16-253
MSSMKVAKGRILVGKYELGKTIGEGSFAKVKFARNVQNGNYVAIKILDRKHVLRLNMMEQLMKEISTMKLINHPNVVRILETLLKREWAHIFLMAANGRLKEDEARNYFQQLINAVDYCHSRGVYHRDLKPENLLDSNGVLKVSDFGLSTYSQKEDELLHTACGTPNYVAPEVPTLGPSLDMVLNDRGYVGSTSDIWSCGVILFVLMAGYLPFDEPTHMALYKKIGRAEFSCPSWFSPQAKKLLKHILDPNPLT

SEQ ID NO: 127263 - protein, 563 aa, Glycine max
  Coding DNA Sequence Number=SeqID_10485
  Gene Ontology: Mol. function=kinase activity; Cellular component =cytoplasm; Biological process=regulation of transcription, DNA -dependent
  Homolog annotation: Hit_ID=Q45GG2; Match level="QueryCoverage=91%, HitCoverage=90%, E-value=1e-101, Identity=43%"; Hit description =Expressed protein
  Pfam annotation: Domain name=DUF547; Domain location=349-485; Score =255.0; E_value=1.5e-73; Accession=PF04784.5; Description=Protein of unknown function, DUF547
MNTSVRPRLLHRKKAPTLLSHEKAEMRGSSRGGENNAAKGGKASSKDRKLALQQDVDRLKKKLSREENIHRALERAFNRPLGALPRLPPYLPPYTLGLLAEVAVLEEEIVRLEEQVVHFRQDLYQEAVYMSSSKMKLEQSAGVNNANPTSSPKLGKLKSLSQSMDDTATSETRPTTTLPKDRHGKENQSCTSSSKSSKQSICKGQTTKSPIKKLPIDNKSLQKRRDPPKKQQELRLKDQPIAEVRNLRENPQGDECPNIISENILKCLSNIILRMSAAKNLDSTADVPPFRTPKSKNCVEGSEFWDPYSICLEFGKRDSGPFKQLRSIEAKSFDPKRTAKSLFLLHRLKLLLRKLACVNIENLNHQEKLAFWINIYNSCMMNAYLEKGIPESPEMVVALMHKATINVGGHLLSATTIEHCILRLPYHWKFTLSKGGKNHETYGLELSEPLVTFALSCGTWSSPAVRIYRASQVENELEMAKKEYLQAAVGISISKFLIPKLLDWYLLDFAKDLESLLDWICLQLPSDVGKEAIKFLEKRKTEPLSQYVQIMPYEFNFRYLLCT

SEQ ID NO: 127264 - protein, 296 aa, Glycine max
  Coding DNA Sequence Number=SeqID_10486
  Gene Ontology: Mol. function=uroporphyrinogen-III synthase activity; Biological process=tetrapyrrole biosynthetic process
  Homolog annotation: Hit_ID=Q8LBE8; Match level="QueryCoverage=83%, HitCoverage=74%, E-value=3e-56, Identity=49%"; Hit description =Uroporphyrinogen III synthase
  Pfam annotation: Domain name=HEM4; Domain location=63-296; Score= -48.6; E_value=0.1; Accession=PF02602.6; Description=Uroporphyrinogen- III synthase HemD
  Subcellular localization annotation: CTP_CleavageSite=56; ConfidenceScore=5.93e-01
MAHFSLSPLSCAPSPLPPRRRIFLSPPRAAASSATDVVSTSTSTSSSASNFAPKVVVTRERGKNAKLIAALAKHEINCLELPLIEHMQGPDLDRLPSVLGDNAFDWVVITSPEAGSVFLEAWRASPGAAVKLCLGDLLVMGSNPETASLHMQGASGMPHVKIGVVGAGTASIFKEALQSSNRSLDIAFVPSKATGKVLATELPKIGSKCTVLYPASAKASNEIAIPRLEWAICGLYLSDRLTAAPNSNLFVRAWKNLLSDSEWNNSVACIGETTATMARSLGFTNVYFPTQPGIEG

SEQ ID NO: 127265 - protein, 244 aa, Glycine max
  Coding DNA Sequence Number=SeqID_10487
  Gene Ontology: Mol. function=zinc ion binding; Cellular component =endoplasmic reticulum; Biological process=metabolic process
  Homolog annotation: Hit_ID=Q1SHH2; Match level="QueryCoverage=84%, HitCoverage=87%, E-value=3e-71, Identity=55%"; Hit description=Zinc finger, DHHC-type
  Pfam annotation: Domain name=zf-DHHC; Domain location=125-189; Score =116.3; E_value=8.9e-32; Accession=PF01529.11; Description=DHHC zinc finger domain
MRGEKEGVVAWDIWKRLFPARRSRSGWLPNIRMGNNINLFKLCSGLRVLGYLMILLFGAIVALTYYAVVFITWGPLLFFSSPLRIPSFFILLLFHTLLLLLTWSYLMVLLNDPGPVPLNWIHLGSDSDPTSSPSYCSRCQNGKPPRCHHCSICQRCVLKMDHHCIWVVNCVGARNYKYFLLFLIVCLDAVLNLAFALSLLCFVVMHASLLLSNTTSVEVHEKKKGVRWMYDLGWKRNFEQKLGK

SEQ ID NO: 127266 - protein, 497 aa, Glycine max
  Coding DNA Sequence Number=SeqID_10488
  Gene Ontology: Cellular component=intracellular; Biological process =signal transduction
  Homolog annotation: Hit_ID=O82459; Match level="QueryCoverage=83%, HitCoverage=96%, E-value=0.0, Identity=83%"; Hit description=Rac GTPase activating protein 2
  Pfam annotation: Domain name=Chromadorea_ALT; Domain location=1-122; Score=-45.7; E_value=0.032; Accession=PF05535.2; Description =Chromadorea ALT protein
  Pfam annotation: Domain name=PBD; Domain location=118-164; Score =48.5; E_value=2.2e-11; Accession=PF00786.18; Description=P21-Rho -binding domain
  Pfam annotation: Domain name=RhoGAP; Domain location=181-318; Score =105.1; E_value=2.1e-28; Accession=PF00620.17; Description=RhoGAP domain
  Pfam module annotation: Pfam domain module=Chromadorea_ALT::PBD::RhoGA P; Domain location=1-122::118-164::181-318
MTRLFRSKSCGLVEFNAAPPSPLFHDVKSEDEYNEEEEEEEEEEEEEEEELDSDDDDEDADEDDDVSSNHVSTPFMNPGSKGHGCQSNQFAILDILVAALKKSLVTCSVEREDVSSLDISWPTEVRHVSHVTFDRFNGFLGLPSELEPEVSKRVPSASAKVFGVSAKSMQCSYDERGNSVPTILLMMQKRLYSEGGLKAEGIFRINADNSQEEFVRDQLNRGLVPLGIDVHCLSGLIKAWFRELPTGVLDSLTPEQVMHCNTEEDCTNLMKLLPSTEAALLDWAINLMADVVEHEQFNKMNARNIAMVFAPNMTQMADPLTALIHAVQVMNFLKTLILKTLRERDKSIAKARQLSSLLDSPSCKGDSHPMEVNNKEESCDEETCTPKPPMKSKFSRTSTLGRIEWCIEEKLWRSEEKGNGVVGEFESVLGSSSPSRYENGPLENRYRGIYDSEHWVKLRNGVRRLCRHPVFQLSKPTKKRASLGVVNTREGGGEALA

SEQ ID NO: 127267 - protein, 202 aa, Glycine max
  Coding DNA Sequence Number=SeqID_10489
  Homolog annotation: Hit_ID=Q1SHH7; Match level="QueryCoverage=36%, HitCoverage=71%, E-value=4e-33, Identity=85%"; Hit description=Auxin responsive SAUR protein
MEGLFPINDPTNVPKVLDMARDGYGSFVIETVLFLCVLEKLHEEWVFEIHEWHHEPFLLFSLPHFYCQTPFGHSPLVKTLLRPTSTHHCKLNSLVNLWGYRRISQRLWSVSHGLDTQQIGRVTHSEHKHLTEGYIIPQSVSLAFPLSWTPHRSIFLTILINGSFVDPTENTKSGLESDATLTFLVSLYARTIKDTCALIGPS

SEQ ID NO: 127268 - protein, 34 aa, Glycine max
  Coding DNA Sequence Number=SeqID_10490
MASNPKPLTFEEVANHNNKKDCWIIINGKFLGLP

SEQ ID NO: 127269 - protein, 117 aa, Glycine max
  Coding DNA Sequence Number=SeqID_10491
  Subcellular localization annotation: CTP_CleavageSite=56; ConfidenceScore=5.17e-01
MTSFQFEVILILETLSAYPSSSWSLTLHRRSTGQPLLPSFHRGVILPPPSTLPIPVSFLPSACNLALGLSQPHLLRCSSPMPNLSFLPLVVALCCHYLVRLTLNSSATLSRIARKST

SEQ ID NO: 127270 - protein, 101 aa, Glycine max
  Coding DNA Sequence Number=SeqID_10492
  Homolog annotation: Hit_ID=P92964; Match level="QueryCoverage=32%, HitCoverage=12%, E-value=7e-07, Identity=78%"; Hit description =Arginine/serine-rich-splicing factor RSP31
MININDQDELDAEDAIRALDNFQFGNEKRRLSVEWARFETQEDAIKALECTHMRSVMNDKVAVRYWTEWCLRDDDEKGGSPRGGVEYGRHCSRSPMRRSRT

SEQ ID NO: 127271 - protein, 236 aa, Glycine max
  Coding DNA Sequence Number=SeqID_10493
  Gene Ontology: Mol. function=nucleotide binding; Cellular component =membrane; Biological process=small GTPase mediated signal transduction
  Homolog annotation: Hit_ID=Q40192; Match level="QueryCoverage=99%, HitCoverage=98%, E-value=1e-106, Identity=84%"; Hit description =RAB11B
  Pfam annotation: Domain name=Arf; Domain location=11-185; Score= -43.5; E_value=2e-06; Accession=PF00025.11; Description=ADP -ribosylation factor family
  Pfam annotation: Domain name=Miro; Domain location=26-140; Score =66.3; E_value=9.9e-17; Accession=PF08477.3; Description=Miro-like protein
  Pfam annotation: Domain name=Ras; Domain location=26-187; Score =303.8; E_value=3.1e-88; Accession=PF00071.12; Description=Ras family
  Pfam module annotation: Pfam domain module=Arf::Miro::Ras; Domain location=11-185::26-140::26-187
MNQEMNGVEAERVKVNVHDKIDYVFKVVVIGDSAVGKTQILSRFAKNEFCFDSKSTIGVEFQTRTVTINGKVIKAQIWDTAGQERYRAVTSAYYRGALGAMLVYDISKRQSFDHVARWVDELRAHADSSIVIMLIGNKGDLVDQRVVHAEDAVEFAEDQGLFFSETSALSGENVESAFFKLLEEIHRVISKRSLECGNGKANADNNLATLKGSKIDVISGAELEITDMKKLSSCSC

SEQ ID NO: 127272 - protein, 151 aa, Glycine max
  Coding DNA Sequence Number=SeqID_10494
MKGERRRNEEEGVPQWSEQIADIKFRVAHQLQAQLPRQLGSSSFGRIDGDSLGSRVLHVATLPMLARSFMSFTKAWNMGYRSVECESDSLVSLNLIVQEGVGHHPMAAIIINLIQSFKTRQCQLSFNHVYREASICANSLARHDSFKIDKC

SEQ ID NO: 127273 - protein, 147 aa, Glycine max
  Coding DNA Sequence Number=SeqID_10495
MGVIKYLTMDELKILSIPSEMLKLFNHSIFPTRDIDKVRAPPMNIHNIQRINVGIVKYMTMDELKPLSIPSEMLKFFNHSSFPRKGHPTRSLHPSTTYTTSNFSTQGTSDKVTAPPHEHTHAHLNAFPTSSTFHFNIILNINIISSQ

SEQ ID NO: 127274 - protein, 117 aa, Glycine max
  Coding DNA Sequence Number=SeqID_10496
MECTFPLGTGPRPLTLVGAGAQVVTPLKILNQAILGGKAVSNVKCGSNDFQDYFDDAKESRVKQVPKNQESKSFKNQVSNIQDSKNNQVSKNQDSRIIKIQEQSRSRFKNQEKTQSR

SEQ ID NO: 127275 - protein, 161 aa, Glycine max
  Coding DNA Sequence Number=SeqID_10497
  Gene Ontology: Mol. function=DNA binding; Biological process=DNA integration
  Homolog annotation: Hit_ID=Q1SKC8; Match level="QueryCoverage=54%, HitCoverage=21%, E-value=1e-24, Identity=61%"; Hit description =Integrase, catalytic region
MKVYHDQKLIQKNFQPGQQVLLFNSRLRLFPSKLKSKWYGPFIIKEVGPSGVVELVDLASSDPERSWIVNGQRLKIYTGGHIERLTSGVDSDTLTYKFLSLDAPPPPPVVPPLAASTSYGPSSSSQLEQLLPMLQSLHHGQYLLMEACLRSFRGGWIFELQ

SEQ ID NO: 127276 - protein, 87 aa, Glycine max
  Coding DNA Sequence Number=SeqID_10498
  Gene Ontology: Cellular component=intracellular; Biological process =intracellular protein transport
  Homolog annotation: Hit_ID=Q1S1S0; Match level="QueryCoverage=61%, HitCoverage=13%, E-value=5e-20, Identity=88%"; Hit description=GAT; ENTH/VHS
MAVFFGSLKVPMNLLMINYPDKHISYSAVVFCSIIQKASNALEVLKEVLDAIDAQHPQAARDEFTIDLVEQCSFQKQRVMHLVMDSR

SEQ ID NO: 127277 - protein, 178 aa, Glycine max
  Coding DNA Sequence Number=SeqID_10499
  Gene Ontology: Cellular component=integral to membrane
  Homolog annotation: Hit_ID=Q94DE5; Match level="QueryCoverage=75%, HitCoverage=38%, E-value=8e-34, Identity=45%"; Hit description =Putative betaine/proline transporter
MKLYEFVVIFGYFMLILAQMPHINLMSLIPNRLFGIFNAIPIVANTYGCGIVPEIEATLAPPVEGKMLKGLCVCYVVVALSFFSVAISGYWAFGYQAAGLIFSNFVDDYSKPLAPKWLIYLPNICTIAQLLANGVVIAILDKIKNDKSQNKELLGSSPNEDDDDWDGEDPEEGIIYVE

SEQ ID NO: 127278 - protein, 149 aa, Glycine max
  Coding DNA Sequence Number=SeqID_10500
MTLLLSNIQPSDRSANLPLRKGSAHKTPSGLEGAQHGPGVSSSNYGALSDLQGHPVDPKKSNRVLGFPALITGLYHFYGVPVTHGKVIRSPTNQAFIKKYCAPRQAQSETQQQPGDGQQQATDAPLPPSEPLSSSTKRLEYFLRHMADQ

SEQ ID NO: 127279 - protein, 201 aa, Glycine max
  Coding DNA Sequence Number=SeqID_10501
MTGEKTALSLPLRFQQEEDEPAGDRADDRGPPAIAPRRYADAASGLTVTVPSPLRVGRAPARGRFDALIEISSPDGFPPRAQDAKYLCRVGFVAAPPLARGAKAPAAPTWQAQLKAAERRQRQRRASIELYDHYTLAGSAGIDYVAAPGAGPGHADTLEYYAELPLPQGRVRMACATQRDAMPAAMTMFRQVRDGIRIAPR

SEQ ID NO: 127280 - protein, 281 aa, Glycine max
  Coding DNA Sequence Number=SeqID_10502
  Gene Ontology: Mol. function=nucleic acid binding; Cellular component= intracellular; Biological process=regulation of transcription
  Homolog annotation: Hit_ID=Q39262; Match level="QueryCoverage=75%, HitCoverage=85%, E-value=6e-32, Identity=41%"; Hit description=Zinc finger protein 3
  Pfam annotation: Domain name=zf-C2H2; Domain location=96-118; Score =20.4; E_value=0.0063; Accession=PF00096.16; Description=Zinc finger, C2H2 type
METLSHEPLLYDNSAGETPPSPSTPLQNSREKKQLSVKEEEEEEKEAKADTLLDLNAPGGDSAIGCSPVLNLITCLDTDLSSTTSENQHGSEPRVFSCNYCQRKFYSSQALGGHQNAHKRERSIAKRGHQRSGSRLMASATTALGIPFLHNHLHHHYATMASLPLHGASSNNKPLGIQAHSIIHKPSSSNYSHFSFNGFGTTFGHRGWSRPLIDQQPGIGKLTMESFHKTSRGNVGKFDVVKTTRLNSATNEEISGYMVSGISLLKTNQEEMKHLDLSLKL

SEQ ID NO: 127281 - protein, 136 aa, Glycine max
  Coding DNA Sequence Number=SeqID_10503
  Gene Ontology: Mol. function=nucleic acid binding; Cellular component= SWI/SNF complex; Biological process=negative regulation of transcription from RNA polymerase II promoter
  Homolog annotation: Hit_ID=Q9S775; Match level="QueryCoverage=61%, HitCoverage=6%, E-value=5e-40, Identity=91%"; Hit description=CHD3 -type chromatin remodeling factor PICKLE
  Pfam annotation: Domain name=Helicase_C; Domain location=28-97; Score= 3.8; E_value=0.007; Accession=PF00271.21; Description=Helicase conserved C-terminal domain
MMVKLKEQGHRVLIYSQFQHMLDLLEDYCTYKNWQYERIDGKVGGAERQVRIDRFNAKNSSRFCFLLSTRAGGLGINLATADTLECSAKHTQLVLYKYTSVTCKSGTKKKSTMSTPSLLPTKYRVDTTKVKKQCSS

SEQ ID NO: 127282 - protein, 568 aa, Glycine max
  Coding DNA Sequence Number=SeqID_10504
  Gene Ontology: Mol. function=nucleic acid binding; Cellular component= chromatin; Biological process=chromatin assembly or disassembly
  Homolog annotation: Hit_ID=Q9S775; Match level="QueryCoverage=75%, HitCoverage=30%, E-value=2e-97, Identity=46%"; Hit description=CHD3 -type chromatin remodeling factor PICKLE
  Pfam annotation: Domain name=DUF1086; Domain location=220-347; Score =159.5; E_value=8.4e-45; Accession=PF06461.2; Description=Domain of Unknown Function (DUF1086)
  Pfam annotation: Domain name=DUF1087; Domain location=142-208; Score =54.2; E_value=4.2e-13; Accession=PF06465.4; Description=Domain of Unknown Function (DUF1087)
  Pfam module annotation: Pfam domain module=DUF1086::DUF1087; Domain location=220-347::142-208
MVDSGGVGVILRNDVGLLGDGVLCEKRVGFVVFVGLHFLNLDVGPGLHGDGSDEVDMDAEMLARALKAHEGTVGDRGPHRSCSPPSTAGHGAAVPLPQDLEEGVGEIKVLQSDTSFFEIKEKIVTEVLAVLDEGVANFEYVDEAEAAAEEAAQKRAMETLNSSERTHYWEELLRDKYQEHKVEEFNALGKGKRNRKLMVSVEEDDLAGLEDVSSDGEDDNYEAELTDGDSNSTGTTTARRPYKKKARTDSTEPHPLMEGEGKAFRVLGFNQNQRAAFVQILMSYGTLFLSHIAEDITDSATFADGVPKEGLRIQDVLVRIAVLLLIRDKVKYASQHPQTPLFSDDILLRYPGLKGAKIWKEEHDLVLLRAVLKHGYGRWQAIVDDKDLKIQEVICQELNLPFINLPVPGHVSSQAQNGANLTNAEVPNSQSKENGGSDIATDGAQGSGDARNQAQLYQDSSILYHFRDMQRRQVEFIKKRVLLLEKGLNAEYQKEYFITKELIRKHEQGRHALLGDPKSNEATNEELKSETKATNFPSDKLGDSDTKMIDQLPQVETIDNRSYLVCIR

SEQ ID NO: 127283 - protein, 519 aa, Glycine max
  Coding DNA Sequence Number=SeqID_10505
  Gene Ontology: Mol. function=nucleic acid binding; Cellular component= chromatin; Biological process=chromatin assembly or disassembly
  Homolog annotation: Hit_ID=Q9S775; Match level="QueryCoverage=96%, HitCoverage=34%, E-value=0.0, Identity=71%"; Hit description=CHD3 -type chromatin remodeling factor PICKLE
  Pfam annotation: Domain name=Chromo; Domain location=120-170; Score =57.8; E_value=3.5e-14; Accession=PF00385.14; Description='chromo' (CHRromatin Organisation MOdifier
  Pfam annotation: Domain name=Chromo; Domain location=28-101; Score =42.7; E_value=1.3e-09; Accession=PF00385.14; Description='chromo' (CHRromatin Organisation MOdifier
  Pfam annotation: Domain name=DEAD; Domain location=251-422; Score= -38.1; E_value=0.0092; Accession=PF00270.19; Description=DEADDEAH box helicase
  Pfam annotation: Domain name=ResIII; Domain location=211-416; Score= -6.2; E_value=0.00015; Accession=PF04851.6; Description=Type III restriction enzyme, res subunit
  Pfam annotation: Domain name=SNF2_N; Domain location=217-519; Score =304.4; E_value=2e-88; Accession=PF00176.13; Description=SNF2 family N-terminal domain
  Pfam module annotation: Pfam domain module=Chromo::Chromo::DEAD::ResII I::SNF2_N; Domain location=120-170::28-101::251-422::211-416::217-519
MKILCLLPPLKGPLPDNWRCPECVSPLNDIDKILDCEMRPTTAADNEATKLGSKQIFVKQYLVKWKGLSYLHCTWVPEKEFLKAFKTHPRLKTKVNNFHQKMASVNTSDEDFVAIRPEWTTVDRILACRGDDDEREYLVKWKELPYDECYWEFESDISAFQPEIERFNRLRSRSSKFSSSKQKNSVKDDAELKKQQKEFQHYEQSPEFLSGGTLHPYQLEGLNFLRFSWSKQTHVILADEMGLANVALGFFLILPLTNNTFGLGKTIQSIAFLASLFKEGVSPHLVVAPLSTLRNWEREFATWAPQMNVLMYVGSAQARNVIREYEFYFPKKLKKIKKKKSGHLISESKQDRIKFDVLLTSYEMINFDTTSLKPIKWECMIVDEGHRLKNKDSKLFSSLKQYSSKHRVLLTGTPLQNNLDELFMLMHFLDAGKFGSLEEFQEEFKDINQEEQISRLHKMLAPHLLRRVKKDVMKELPPKKELILRIELSSKQKEYYKAILTRNYQILTRRGGAQARLML

SEQ ID NO: 127284 - protein, 669 aa, Glycine max
  Coding DNA Sequence Number=SeqID_10506
  Gene Ontology: Mol. function=protein dimerization activity; Cellular component=nucleus; Biological process=regulation of transcription, DNA-dependent
  Homolog annotation: Hit_ID=Q9C5W9; Match level="QueryCoverage=95%, HitCoverage=91%, E-value=1e-171, Identity=52%"; Hit description =Auxin response factor 18
  Pfam annotation: Domain name=AUX_IAA; Domain location=504-654; Score=- 84.9; E_value=0.0022; Accession=PF02309.7; Description=AUXIAA family
  Pfam annotation: Domain name=Auxin_resp; Domain location=240-326; Score=150.3; E_value=5.1e-42; Accession=PF06507.4; Description=Auxin response factor
  Pfam annotation: Domain name=B3; Domain location=113-218; Score =112.4; E_value=1.3e-30; Accession=PF02362.12; Description=B3 DNA binding domain
  Pfam module annotation: Pfam domain module=AUX_IAA::Auxin_resp::B3; Domain location=504-654::240-326::113-218
MAGVGDGDLYTQLWKLCAGPLVDVPRQGERVFYFPQGHMEQLQASTNQGLNQEIPHFNLPPKILCRVVHIQLLAEQETDEVYARITLLPESNQEEPTSPDPSPPETQKQVFHTFSKILTASDTSTHGGFSVLRRHATECLPQLDMTQTTPSQELVAEDLHGFEWKFKHIFRGQPRRHLLTTGWSTFVTSKKLVAGDAFVFLRGENGELRVGVRRVARQQSPMPSSVISSQSMHLGVLATASHAFLTSTMFVVYYKPSMPFHTFRTSQFIIGVNKYLEAENNKFSVGMRFKMRFEVEDSPERRFSGTIVGVGDVSPGWWNSQWRSLKVQWDEPAIIPRPERVSSWEIEPFAASTALNVTQQLVKSKRSRTEVSSSEIAPNSPALAFWYRGPQDPTALGSSTEVQSNENPVVWSTRQKEINGNPMNSSSKVRVEGMRPSSPHSKPNLFMDPKNCKAVPAQSTVSSRPKDDLAHDPMECAKRSSQNPMNCWIFGVNLTNNITKNVTLPDKEQLGCPAIIPSGPKDSIPVAACETEAGQNPYYSLSNKEHKQNISDGSPSASQRHTRTRTKVQMQGIAVGRAVDLTVLKDYDDLIDELEKMFDIKGELQMQTKWAITFTDDGNDMMLVGDDPWPEFCTVVKRIFICSREDVKKMKSKHSSSSSVGEETLLSQD

SEQ ID NO: 127285 - protein, 205 aa, Glycine max
  Coding DNA Sequence Number=SeqID_10507
  Gene Ontology: Biological process=regulation of transcription
MGLEAEREEQRSIARLPLFSIQSPERSGMATPPLHTLASVPFRWEQVPGKPRPCSALVSFSNPKCLELPPRLFTPSPATVFKVSSNRFRSPSFRMSANCYGSDTKVLGAMVLTKANDYAWFGSWRKKAFKLNKREVTGASHVFPSSTDTDIPNMKQRSANSRIWFARTLREGNKSGDWLAKFGANFIEFLHTWSSCPAALGHSFS

SEQ ID NO: 127286 - protein, 55 aa, Glycine max
  Coding DNA Sequence Number=SeqID_10508
MYNASYAFNYQESIPKVDTITVQTEDEPTIHIEHFFDIASLESMGLNLNETMLCC

SEQ ID NO: 127287 - protein, 84 aa, Glycine max
  Coding DNA Sequence Number=SeqID_10509
MKRRKKVESRQLVKKDVANVQQVLVDLEKSSTKENEQERSLYTPPTSTIQKDVPQINYIARGAIIEGNIQELLNQAVQKQKEET

SEQ ID NO: 127288 - protein, 155 aa, Glycine max
  Coding DNA Sequence Number=SeqID_10510
MSYQAGLSEKGCAKRQHHFVLKSLEVRLAQVVALSLNHSLCVLSVPYKFQFLKSRGRGTWVATLAPKPLNSFTPEYFCFCFVLIDPLHPSCFSALQIQFRSPLGEMWLKRVVKTPKYLMGFAMNMLSVPAALSQFIATVKNFQISDDCAKRTMSR

SEQ ID NO: 127289 - protein, 171 aa, Glycine max
  Coding DNA Sequence Number=SeqID_10511
  Gene Ontology: Mol. function=transferase activity, transferring nitrogenous groups; Cellular component=intracellular; Biological process=regulation of transcription, DNA-dependent
  Homolog annotation: Hit_ID=Q2L0R7; Match level="QueryCoverage=72%, HitCoverage=35%, E-value=3e-25, Identity=40%"; Hit description=GntR -family transcriptional regulator
  Subcellular localization annotation: CTP_CleavageSite=55; ConfidenceScore=5.65e-01
MRTARSAHRGRYLPGRRRPYPASVPATVRRRRGPRGCRRRRGSSSVRPGPAAGPRAGSRPPCPARTARCPAAAGCSCSGPRPPAGPGRAAAAGGRPGAARRHPPPRAPAGQSAGTAGRRPRGRGGPRCDWGVSGGGRRQVASSATSYPQCSRSTPGRCAQASRSSALLQQG

SEQ ID NO: 127290 - protein, 202 aa, Glycine max
  Coding DNA Sequence Number=SeqID_10512
MRLRAHEQFQKRDSGRGTRLPPLAILLSCHNRPFSRKDLYWNILVQSGARLVILVLRHLCVPFDACGLCRQVRGCEHATATGHTTQPRDISYLGQQRADIGGYSVARFDSPLFHWYIQRNPHARFSSLFQVIEVSSSAEDPEELPPEPVVDALDLPEDDEDPLLDVDFPEDIMSVSEADSTKESGPGGTANSGDSSSKQMAP

SEQ ID NO: 127291 - protein, 48 aa, Glycine max
  Coding DNA Sequence Number=SeqID_10513
MDINPAYNCLLGCPWIHLVGVIPSKLHQKLKYIVEGHLDIVSGKEDIL

SEQ ID NO: 127292 - protein, 161 aa, Glycine max
  Coding DNA Sequence Number=SeqID_10514
MSHPIRALCPDVLQHKGDQSGSRYFARMLQSCGIGTGLKEHSNRVTPKTYTWKSPSGPLPPDSGLTPKIIFCMQTLLMNYTIPTISHSCEKGRYNKQKGAEIKKKENQKKPKSSKALSAGRAQRARRQGVKCTTCAERDVALSTRLRAQRDCEDPSPSLHL

SEQ ID NO: 127293 - protein, 807 aa, Glycine max
  Coding DNA Sequence Number=SeqID_10515
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=95%, HitCoverage=63%, E-value=1e-152, Identity=43%"; Hit description =Tyrosine protein kinase, active site
  Pfam annotation: Domain name=LRRNT_2; Domain location=33-72; Score =49.9; E_value=8.8e-12; Accession=PF08263.3; Description=Leucine rich repeat N-terminal domain
  Pfam annotation: Domain name=LRR_1; Domain location=101-123; Score =13.9; E_value=0.6; Accession=PF00560.23; Description=Leucine Rich Repeat
  Pfam annotation: Domain name=LRR_1; Domain location=125-147; Score =14.0; E_value=0.54; Accession=PF00560.23; Description=Leucine Rich Repeat
  Pfam annotation: Domain name=LRR_1; Domain location=149-171; Score =15.0; E_value=0.28; Accession=PF00560.23; Description=Leucine Rich Repeat
  Pfam annotation: Domain name=LRR_1; Domain location=173-195; Score =13.3; E_value=0.86; Accession=PF00560.23; Description=Leucine Rich Repeat
  Pfam annotation: Domain name=LRR_1; Domain location=197-219; Score =12.9; E_value=1.1; Accession=PF00560.23; Description=Leucine Rich Repeat
  Pfam annotation: Domain name=LRR_1; Domain location=221-243; Score =6.4; E_value=18; Accession=PF00560.23; Description=Leucine Rich Repeat
  Pfam annotation: Domain name=LRR_1; Domain location=244-266; Score =15.5; E_value=0.19; Accession=PF00560.23; Description=Leucine Rich Repeat
  Pfam annotation: Domain name=LRR_1; Domain location=268-290; Score =6.9; E_value=15; Accession=PF00560.23; Description=Leucine Rich Repeat
  Pfam annotation: Domain name=LRR_1; Domain location=292-314; Score =14.8; E_value=0.32; Accession=PF00560.23; Description=Leucine Rich Repeat
  Pfam annotation: Domain name=LRR_1; Domain location=316-338; Score =6.8; E_value=15; Accession=PF00560.23; Description=Leucine Rich Repeat
  Pfam annotation: Domain name=LRR_1; Domain location=340-362; Score =7.6; E_value=11; Accession=PF00560.23; Description=Leucine Rich Repeat
  Pfam annotation: Domain name=LRR_1; Domain location=364-386; Score =12.6; E_value=1.3; Accession=PF00560.23; Description=Leucine Rich Repeat
  Pfam annotation: Domain name=LRR_1; Domain location=388-410; Score =21.5; E_value=0.0029; Accession=PF00560.23; Description=Leucine Rich Repeat
  Pfam annotation: Domain name=LRR_1; Domain location=412-434; Score =15.7; E_value=0.17; Accession=PF00560.23; Description=Leucine Rich Repeat
  Pfam annotation: Domain name=LRR_1; Domain location=436-458; Score =11.4; E_value=2.1; Accession=PF00560.23; Description=Leucine Rich Repeat
  Pfam annotation: Domain name=LRR_1; Domain location=460-482; Score =15.7; E_value=0.17; Accession=PF00560.23; Description=Leucine Rich Repeat
  Pfam annotation: Domain name=LRR_1; Domain location=484-506; Score =11.4; E_value=2.1; Accession=PF00560.23; Description=Leucine Rich Repeat
  Pfam annotation: Domain name=LRR_1; Domain location=508-530; Score =12.0; E_value=1.6; Accession=PF00560.23; Description=Leucine Rich Repeat
  Pfam annotation: Domain name=LRR_1; Domain location=532-554; Score =2.8; E_value=84; Accession=PF00560.23; Description=Leucine Rich Repeat
  Pfam annotation: Domain name=LRR_1; Domain location=556-575; Score =7.0; E_value=14; Accession=PF00560.23; Description=Leucine Rich Repeat
  Pfam annotation: Domain name=LRR_1; Domain location=580-602; Score =9.3; E_value=5.1; Accession=PF00560.23; Description=Leucine Rich Repeat
  Pfam annotation: Domain name=LRR_1; Domain location=604-626; Score =11.7; E_value=1.9; Accession=PF00560.23; Description=Leucine Rich Repeat
  Pfam annotation: Domain name=LRR_1; Domain location=628-650; Score =9.6; E_value=4.5; Accession=PF00560.23; Description=Leucine Rich Repeat
  Pfam annotation: Domain name=LRR_1; Domain location=652-674; Score =15.4; E_value=0.21; Accession=PF00560.23; Description=Leucine Rich Repeat
  Pfam annotation: Domain name=LRR_1; Domain location=676-698; Score =18.5; E_value=0.024; Accession=PF00560.23; Description=Leucine Rich Repeat
  Pfam annotation: Domain name=LRR_1; Domain location=699-721; Score =7.5; E_value=11; Accession=PF00560.23; Description=Leucine Rich Repeat
  Pfam annotation: Domain name=LRR_1; Domain location=723-745; Score =15.2; E_value=0.25; Accession=PF00560.23; Description=Leucine Rich Repeat
  Pfam annotation: Domain name=LRR_1; Domain location=747-769; Score =12.1; E_value=1.6; Accession=PF00560.23; Description=Leucine Rich Repeat
  Pfam annotation: Domain name=LRR_1; Domain location=76-99; Score=1.8; E_value=1.3e+02; Accession=PF00560.23; Description=Leucine Rich Repeat
  Pfam annotation: Domain name=LRR_1; Domain location=771-793; Score =11.6; E_value=1.9; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1; Domain location=33-72::101-123::125-147::149 -171::173-195::197-219::221-243::244-266::268-290::292-314::316 -338::340-362::364-386::...
  Pfam module annotation: Domain location=388-410::412-434::436 -458::460-482::484-506::508-530::532-554::556-575::580-602::604 -626::628-650::652-674::676-698::699-721::723-745::747-769::76 -99::771-793
MVFIFPTLLSMKLQPLLLLLVMYFCAFAASSEIASEANALLKWKSSLDNQSHASLSSWSGNNPCNWFGIACDEFNSVSNINLSNVGLRGTLQNLNFSLLPNILTLNMSHNSLNGTIPPQIGSLSNLNTLDLSTNNLFGSIPNTIGNLSKLLFLNLSDNDLSGTIPSEIVHLVGLHTLRIGDNNFTGSLPQEIGRLMNLRILDIPRSNISGTIPISIEKLSILSHLDVESNNLSGNIPLRIWHMNLKHLSFAGNNFNGSIPKEIVNLRSIETLWLWKSGLSGSIPKEIWMLRNLTWLDMSQSSFSGSIPRDIGKLRNLKILRMWESGLSGSMPEEIWTLRNLEQLDIRMCNLIGSFPISIGALVNLTLIRLHYNKLFGHIPHEIGKLVNLQVLDLGNNNLSGFIPPEIGNLSKLSELSINSNELTGPIPVSIGNLVNLDFMNLHENKLSGSIPFTIGNLSKLSELSINSNELTGPIPVSIGNLVNLDFMNLHENKLSGSIPFTIGNLSKLSVLSIHLNELTGSIPSTIGNLSNVRGLYFIGNELGGKIPIEISMLTALESLQLADNNFIGHLPQNICIGGTLKNFSARNNNFIGPIPVSLKNCSSLIRVRLQGNQLTGDITDAFGVLPNLDYIELSDNNFYGQLSSNWGKFGSLTSLMISNNNLSGVIPPELAGATKLQRLHLSSNHLSGNIPHDLCNLPLFDLSLDNNNLTGNVPKEIASMQKLQILKLGSNKLSGLIPKQLGNLLNLLNMSLSQNNFQGNIPSELGKLKFLTSLDLGGNSLRGTIPSMFGELKSLETLNLSHNNLS

SEQ ID NO: 127294 - protein, 43 aa, Glycine max
  Coding DNA Sequence Number=SeqID_10516
MCFSEENPSRGAAVTLPRHFREQIHEDFPSFFTVIRSFCGLQS

SEQ ID NO: 127295 - protein, 119 aa, Glycine max
  Coding DNA Sequence Number=SeqID_10517
SDSSITSGSLRFLQFFSSNCSDRVLKRQSDKEGIEASTRTVLFHENPTVNETGIVVLLRPFWVSAGKEKATMQRYFSQLKHDIKIPNGENARNRVTNVVLKFHDDPTVNEFEIVVFLRQ

SEQ ID NO: 127296 - protein, 63 aa, Glycine max
  Coding DNA Sequence Number=SeqID_10518
MAYQLATSRKITVSLRKKWYIDSGCSKHMTGDASNFTHISPKKSGHALSIACLALVNYVTKAI

SEQ ID NO: 127297 - protein, 82 aa, Glycine max
  Coding DNA Sequence Number=SeqID_10519
MTMTIMTTKVVTCDNGHGGGGDDNNYHGSGGNNDLDSGIDGHDCDDHRCNILGKKVCQAHPLNQVSRELLSNATNLDSLDSL

SEQ ID NO: 127298 - protein, 53 aa, Glycine max
  Coding DNA Sequence Number=SeqID_10520
MTMTIMTTKVVTCDNGHGGGGDDNNYHGSGGNNDLDSGIDGHDCDDHRHIQLV

SEQ ID NO: 127299 - protein, 103 aa, Glycine max
  Coding DNA Sequence Number=SeqID_10521
  Gene Ontology: Mol. function=DNA binding; Biological process=DNA integration
  Homolog annotation: Hit_ID=Q1SIT1; Match level="QueryCoverage=92%, HitCoverage=26%, E-value=4e-20, Identity=55%"; Hit description =Integrase, catalytic region
MAQVGEKMKLQLSELDEIRLEAYEISNFYREKPKKFHDSLIAKRDFGVGQKVLLYNSRLGLMSAKWRSKGMGPFVVTNVFPYGTIEFKSESTDTSFKVMGNCF

SEQ ID NO: 127300 - protein, 61 aa, Glycine max
  Coding DNA Sequence Number=SeqID_10522
MVGYFGIPVRDVDKNNNVDIVVTVVEGVDAVNPEIVFATRRSSPRRLILLMMVVGSRRPEI

SEQ ID NO: 127301 - protein, 174 aa, Glycine max
  Coding DNA Sequence Number=SeqID_10523
  Gene Ontology: Mol. function=enzyme inhibitor activity
  Homolog annotation: Hit_ID=Q1S1D0; Match level="QueryCoverage=97%, HitCoverage=97%, E-value=4e-22, Identity=36%"; Hit description =Pectinesterase inhibitor
  Pfam annotation: Domain name=PMEI; Domain location=24-169; Score =35.9; E_value=1.4e-07; Accession=PF04043.6; Description=Plant invertasepectin methylesterase inhibitor
MNSLTLFLSFCLILITNSPSLTNANGSDLISQICKASVNQKECTDILTAYPRIMHANNFFELAEAILQLSLYKAIEGQKFLRTLMKSENVPAIAQCANSDYESVITAYKSALSKLKDDPKTAKHYARDAGNGPVSCETALAATTVYFNFEISNLNIQMGSLSYIATLAIDKLII

SEQ ID NO: 127302 - protein, 123 aa, Glycine max
  Coding DNA Sequence Number=SeqID_10524
MVVGNATIEKPRKEWDDDERRKVQYNLKAKNIITSASSMDEYFRVSNLTAIAKSRDITNMSLATLFGKLQEHEMELMRLHQHEENDKKRNGIALKASSSSIQEENDKEDLTEIEEDDDFRFFV

SEQ ID NO: 127303 - protein, 240 aa, Glycine max
  Coding DNA Sequence Number=SeqID_10525
  Homolog annotation: Hit_ID=Q9AVH2; Match level="QueryCoverage=19%, HitCoverage=16%, E-value=9e-20, Identity=97%"; Hit description =Putative senescence-associated protein
MAMPEGCGEGVFLANLPGDAFSLWGNFFEAKKQMMADAKVGGAGLWPRAKLRIGWPPPPPRDQFCCQEINNKTCAPLAKSPPYKWSITPSPGKTQGHTHTHTHTLTQAQGGGGAGREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 127304 - protein, 468 aa, Glycine max
  Coding DNA Sequence Number=SeqID_10526
  Homolog annotation: Hit_ID=P06864; Match level="QueryCoverage=45%, HitCoverage=20%, E-value=3e-69, Identity=58%"; Hit description =Evolved beta-galactosidase subunit alpha
GNPRTPQLKFGVIACPLIGSAARRARQNDVGKRQQQHQRRGHRGHRPQQFCAAVGDVGREGEQEDADDRRGQRGKHVVIAQERVRSVGDDARQQRGINAGLGVAVERDELGDDQAKGNEAKLADGVSVRRSHRDSPNGVGDFAVSLVVFEDRHVAFADPASLAFAAEKLAVGFVLIGRYRRQRPFVGDLDGLFPLKVIVHIEVAAVALQPTVLAAGADAQPIRQRVADRMAHVRADAIDIGDRLHAAQPLLAARETVAERRQIDPVGIQHFGAPGVGAEAEDLVVQVQRQAVARCQLVDVLGLVQHLGAVGPQAEIDRPPRLDEDPLARRVLQTQPAHVLPIAVVLRERIVFEQRVGALPVVANQVGPAAVTVVLARPAAVVFHLLEAAADAEIEADFRDNLAEIAVRLTGQIQADVALRGDAPAVGAAHAEVEHRRRDQAMYLDQQILALPLPIEAAEVLLHDGEVM

SEQ ID NO: 127305 - protein, 45 aa, Glycine max
  Coding DNA Sequence Number=SeqID_10527
MEVEEPWQGLLLPLHYQEWQSQHGFHHHSHPLHLPQFSHSSKHDD

SEQ ID NO: 127306 - protein, 230 aa, Glycine max
  Coding DNA Sequence Number=SeqID_10528
  Gene Ontology: Mol. function=ATP binding; Cellular component=outer membrane; Biological process=cell adhesion
  Homolog annotation: Hit_ID=Q1MHZ0; Match level="QueryCoverage=73%, HitCoverage=14%, E-value=4e-15, Identity=30%"; Hit description =Putative adhesin autotransporter precursor
  Pfam annotation: Domain name=Autotransporter; Domain location=1-228; Score=71.9; E_value=2e-18; Accession=PF03797.9; Description =Autotransporter beta-domain
MFIRYLGSDLQYRSNRGLDAWGYDFDLNYSAVQLGGNLLRADGAENSVRGGVAYTRGNTRIRPHAADGYSSTSFDSDTLSLYGTWLSSSGWYVDGSLSWSGYRGETDIARQKAVAKPKGHGWTASVESGYPLMLAGDVRLEPQAQVSWLRMNMDSFTDADGARVSFNDYDQTIGRLGARVARSWQDSSQNQYTPYLRADYYRGWGGTAQARVGTSDSDLSQSFSSGKFGQ

SEQ ID NO: 127307 - protein, 316 aa, Glycine max
  Coding DNA Sequence Number=SeqID_10529
  Gene Ontology: Mol. function=nucleic acid binding; Cellular component= intracellular; Biological process=chromatin modification
MVSLEHRCDDRIHKIQTIKMMEGILICVAPHCLKSFLKKADFESHIQDSHGSLLRPNADKEDGNESEAQSVRQSTASDSTARGPQRPVFSPGSNSQQHDLEDKSRRQTHLESNQSHHIMGFHLQNFDMQHPPQDPSQFADRQQEVGPEAPFLGYPAMHPAKTSNVPLLVTSNPMPDPPMTFGYPPYPNERAQPFYGAPYDMPRQDSGSDVGGDQSSLLGFPQGVPNGPNFPGNYPQPWNSGMGGVPFEQAQGGMVVDPREGKGILAPQPMPLPPPPPPPSHMSYGKQNYYSGELGHDGQSYGGWQHDTRDSFGSQG

SEQ ID NO: 127308 - protein, 67 aa, Glycine max
  Coding DNA Sequence Number=SeqID_10530
  Subcellular localization annotation: CTP_CleavageSite=51; ConfidenceScore=5.38e-01
MIPDDDSSLFHRSLLTLFLIAPPSPSSPSPFAKPPTRVLLGAPSIIAGAPSTNHEKTEIPLTDQVDP

SEQ ID NO: 127309 - protein, 90 aa, Glycine max
  Coding DNA Sequence Number=SeqID_10531
  Subcellular localization annotation: CTP_CleavageSite=32; ConfidenceScore=5.34e-01
MTIFQPRISAPSGARPLKVVRVWWKTRSSGPRFSPGSQERSSITIVCAKSIMLCACIHIRENCGVQIEISAILDSTGSLVEFACEVEITE

SEQ ID NO: 127310 - protein, 89 aa, Glycine max
  Coding DNA Sequence Number=SeqID_10532
MRYVKDIHSASGSGIRECPTLFPRYTCNNEDLEIYAKLIMHAPMWTLKHQVCGHVTLRCPFINLCIHPSPFRHSEKLPQLSPFRIRNSL

SEQ ID NO: 127311 - protein, 584 aa, Glycine max
  Coding DNA Sequence Number=SeqID_10533
  Gene Ontology: Mol. function=acetyl-CoA carboxylase activity; Cellular component=acetyl-CoA carboxylase complex; Biological process=fatty acid biosynthetic process
  Homolog annotation: Hit_ID=Q9LLR0; Match level="QueryCoverage=60%, HitCoverage=49%, E-value=1e-172, Identity=89%"; Hit description =Carboxyl transferase alpha subunit
PEACAAILWKTAKASPKAAEKLKITATELCKLQIADGVIPEPLGGAHADPEWTSQQIKKAIKETMDELTKMNTEELLKHRMLKFRKIGGFQEGIPIDPKRKANMKKRDLSIAKIPDAELEVEVEKLKQQVLEAKESSPVPPKLDLDEMLKQLAREVGLEYSEAVKATGLTDSLLKLREEVSKANADSQIVDPLLKDKIEKLRVEFEQQLRAAPNYGRLQNKFKYLSELCKVKLLSDANKDNQAVTFKQELEKKVDNALSDPKIRETFEALKAEIKGAGASSASDLDDELKKKIVGFMIELKEVKEVKEVIENQIESLVNSSDDIKSKILQLKLELPKAGETPDSESNNRIGRLFVIENFQCLVKMDEDQWMYDNIMSEKVYMNKQNEDEVGVNEEHVDCFDAFNTFQVFATRDDVLHWARSVAYEIGFVAVIMRSGQYRSTKKDFVKIDADNRKCGCSFKLREKPVVGGQGLSEFEVSITEEMETISKRFEELDANSKCAQKKPMTKHQRSTKRDPSYWEYVDALNFVQNSNSLVKRNTSSSDQAIPRRTMPILDFIRAFMIPLKTLSMSKLTVTVDIVQLLSY

SEQ ID NO: 127312 - protein, 160 aa, Glycine max
  Coding DNA Sequence Number=SeqID_10534
  Homolog annotation: Hit_ID=Q1T1F7; Match level="QueryCoverage=71%, HitCoverage=24%, E-value=8e-07, Identity=32%"; Hit description=IMP dehydrogenase/GMP reductase
MSDGVCWMSHGGHRAVREFELISCFFEHIRWGPVVVIHRPKKVVMHFRYVHTTPPHSLDSRLRLEDIDNGWMHFSKYLAPVGQICVVPEQCALDYIDWFYMISHPFMRPAQPGDLVRHPPIMQMTRMWNQIFLSTWWRQQLWREHMHMHLLMWSSLNMKW

SEQ ID NO: 127313 - protein, 369 aa, Glycine max
  Coding DNA Sequence Number=SeqID_10535
  Gene Ontology: Mol. function=DNA binding; Cellular component=beta -galactosidase complex; Biological process=DNA integration
  Homolog annotation: Hit_ID=Q1SS89; Match level="QueryCoverage=85%, HitCoverage=44%, E-value=1e-132, Identity=65%"; Hit description =Integrase, catalytic region
MKNAFLHGDVEEDVYMDIPLGYMPSSRTKVHRQGKVTTLNVYVDDMIITGDDTEEISRLQEQLVAEFEMKNLGGLKYILGIEVTRSQRGIFLSQRKYVLDLLTEVGLLDYKLADTPIIQNHKLSQYTNQVPADKGRYQKLVGKLIYLLHTHPDIAYAVSMNNHLSVEGYTDADSTRNVLDRKSTSGYFTFVGGNLVTWRSKKQKVVALSSAEAEFRGMGKGLCELLWLKRLPMEIGFGPSMEMNLFCDDKATIDISQNPIHHDRTKHMEVDSHFIKQNLEEKIIRFSFVKSEDQLVDILTKAVSSKNFRELLDKLADIEGRNITFEDLKKPPPGYPRNYNIFLKAFEAMEMANTGFKDQFLLEEEEEGN

SEQ ID NO: 127314 - protein, 156 aa, Glycine max
  Coding DNA Sequence Number=SeqID_10536
  Gene Ontology: Mol. function=transferase activity, transferring glycosyl groups; Biological process=metabolic process
  Homolog annotation: Hit_ID=Q43716; Match level="QueryCoverage=94%, HitCoverage=34%, E-value=1e-41, Identity=52%"; Hit description =Anthocyanidin 3-O-glucosyltransferase
MNTYIHTFILVMNFPSNLFAKAELERALPKRFLERVKNRGVAHTGWFQQHLVLKHSSVECHIGHGGFNSVIEALASDCELVLLPFKAGIEVNYRSEDVDFKKEDILKAVKTIMVEDDKELGKQIKENHMKWKEFLSNKGIQNKFITGLVAQLKAMA

SEQ ID NO: 127315 - protein, 84 aa, Glycine max
  Coding DNA Sequence Number=SeqID_10537
  Gene Ontology: Mol. function=protein tyrosine/serine/threonine phosphatase activity; Biological process=protein amino acid dephosphorylation
  Homolog annotation: Hit_ID=Q9LFA7; Match level="QueryCoverage=72%, HitCoverage=10%, E-value=7e-22, Identity=74%"; Hit description=MRNA capping enzyme-like protein
MSMSVTQAIKIFSDVRPPGIYKPEYIDALYAFYHEKKPEMIVCPPTPKWKRTPELVDLNGEAMPDDDDDDGVPGSPLHVWIILK

SEQ ID NO: 127316 - protein, 200 aa, Glycine max
  Coding DNA Sequence Number=SeqID_10538
MRAALGSPRFLFMYRCLFEVLRLILSFTVIQCDLFEHLNVAISQLHPNSSTMMNLMEKIGWVSLNNMSNKLFKPIDPRGEGGQGHLGATGLIGRAGHSISSLGERPLCYLGWYYGGQPIIEVGPVVIGTTEIASNTRSSVLAKRNEQDVPLAPPAIVVDVVATLVGLGSSSSMDSFASWKMNGSGMEKGRERGDATSRRR

SEQ ID NO: 127317 - protein, 135 aa, Glycine max
  Coding DNA Sequence Number=SeqID_10539
  Gene Ontology: Mol. function=sequence-specific DNA binding; Cellular component=nucleus; Biological process=regulation of transcription, DNA-dependent
  Homolog annotation: Hit_ID=Q8LC79; Match level="QueryCoverage=95%, HitCoverage=53%, E-value=7e-17, Identity=39%"; Hit description=GATA transcription factor 19
  Subcellular localization annotation: CTP_CleavageSite=5; ConfidenceScore=5.17e-01
MGPCTCGMFHSQITSSFAMFFSMPNHKPPPYNDSDNIYDYSSFAPSSSSSVDCTLSLGTPSTYFSEDEEKRSRHERCFVSNFCRDLLQSKHNNPQSHSKSSQTTNTTDPLLVRRCANCDTTSTPLERNGPRGPKD

SEQ ID NO: 127318 - protein, 81 aa, Glycine max
  Coding DNA Sequence Number=SeqID_10540
MGSKNQRNDEKRGVIGGGWVGGSGGTDSGWLGVVGSGSELIGRGRLRVAACACGWYVGCLKCFVVRLSNRWWWWWWCSNSS

SEQ ID NO: 127319 - protein, 48 aa, Glycine max
  Coding DNA Sequence Number=SeqID_10541
MEISKVRGKEPWSWTPNVNFSRPVDWRSWGQPIPCAQESLQLKRPSVP

SEQ ID NO: 127320 - protein, 34 aa, Glycine max
  Coding DNA Sequence Number=SeqID_10542
MAMVVPSSLHFQPKLIKLALEHLDVEEGLGASTD

SEQ ID NO: 127321 - protein, 669 aa, Glycine max
  Coding DNA Sequence Number=SeqID_10543
  Gene Ontology: Mol. function=signal transducer activity; Cellular component=membrane; Biological process=response to light stimulus
  Homolog annotation: Hit_ID=Q75H87; Match level="QueryCoverage=99%, HitCoverage=95%, E-value=1e-111, Identity=38%"; Hit description =Putative NPH3 family protein
  Pfam annotation: Domain name=NPH3; Domain location=216-531; Score =361.0; E_value=1.9e-105; Accession=PF03000.5; Description=NPH3 family
MKFMKLGSRSDTFYTAESTIDDVSALGETISSEVSSDLIIQVKGTRYLLHKFPLLSKCLRLQRLCSESSDSPQHQIVQLPDFPGGVEAFELCAKFCYGITITLSAYNIVAARSAAEYLQMTEDVEKGNLIYKLDVFFNSCILNGWKDSIVTLQTTKALPLWSEDLTVSSRCIEAIASKALSHPSKVSLSHSHSRRLRNDVSSYNETESLRHKSTSKGWWAEDLADLSIDLYWRTMMAIKSGGKTPSNLIGDALKIYASRWLPNIRKNVHNVKRETESDSDSDSASEVNSKHRLLLESIVSLLPAEKGAVSCSFLFKLLKAANILNASASSKVELATRVGLQLEEATVNDLLIRSVSKSTNDMMYEVDLVMTILEQFMLQGQSPPTSPPRSRLAVERRRSRSAENINFEFQESRRSSSASHSSKLKVAKLVDRYLQEVARDVNLALSKFIAIAETIPDFARHDHDDLYRAIDIYLKNYCILYMLEINNGQHRGVPGGTLVEHVSVAHPELSKSERKRLCRILDCKKLSMEACMHAAQNELLPLRVVVQVLFFEQARAAAAGGKVSDMPSNIKALLTAHGIDPSKHTAPLSTTTSIHADDNWSVSGFKSPKSTTRNPTLRMKLAEDDLDENVVPRDEIGRTSKFKGLGLPTQPKRMFSKLWATNRSATEKN

SEQ ID NO: 127322 - protein, 61 aa, Glycine max
  Coding DNA Sequence Number=SeqID_10544
MVVVATTVGTTTIKVVVVDDGEAKVVAVDDSSGSDDNYGCGSSSDQGGGSDNQHYYKMGLL

SEQ ID NO: 127323 - protein, 44 aa, Glycine max
  Coding DNA Sequence Number=SeqID_10545
  Gene Ontology: Mol. function=methyltransferase activity; Biological process=metabolic process
  Homolog annotation: Hit_ID=Q5Z7K6; Match level="QueryCoverage=87%, HitCoverage=10%, E-value=2e-10, Identity=71%"; Hit description =Putative coclaurine N-methyltransferase
MVIQYLIWDAVGDHWPCTLPRSTLTAGLQGSASPQLKRLIGEKC

SEQ ID NO: 127324 - protein, 72 aa, Glycine max
  Coding DNA Sequence Number=SeqID_10546
MGYEAEMHNIRVAIAINNHDINMVMDSLHSFFLHVTTEATGPYHCPSHEKYAPYVAWLAGFGDNVNADQGGV

SEQ ID NO: 127325 - protein, 103 aa, Glycine max
  Coding DNA Sequence Number=SeqID_10547
  Subcellular localization annotation: CTP_CleavageSite=42; ConfidenceScore=5.02e-01
MKVAQQLFCYMSSGGNPTGSAWRSLRPKSWAEYVVLLTSMKRCNINENSFILWHQRLGHISIERIKRLMTAEWRRRKGDWRRHFKEKMSQEQAHHHRKPWIRA

SEQ ID NO: 127326 - protein, 67 aa, Glycine max
  Coding DNA Sequence Number=SeqID_10548
MDKSLKVGEDEWREKERRGTKFMSQMRDTITFGANQHPCTKSPSISDDDDGEEHDNDKEEHSSQPKK

SEQ ID NO: 127327 - protein, 160 aa, Glycine max
  Coding DNA Sequence Number=SeqID_10549
  Gene Ontology: Mol. function=RNA-directed DNA polymerase activity; Biological process=RNA-dependent DNA replication
MTNLSAICPFLPFTFFFVKWTHSKAIVALYVIILFGTKAQWISSTVGGKICFILLAIVFMRILKIKLQIRLIGLNSLGWDGFFYLGDQSNKSLFEMCGILPIIQNSKKKTRDILSNDMYYYKVRLSTSVIRAILHRFSTVVVVNAVKRGSLFYDGRKRPS

SEQ ID NO: 127328 - protein, 75 aa, Glycine max
  Coding DNA Sequence Number=SeqID_10550
MGAQFHMECPKATCLNGMNKHRPQFGTYPLTITSKSFLTTNISCAHAPITFSSIPLQSCHIEDKGNNYRFEQGQG

SEQ ID NO: 127329 - protein, 118 aa, Glycine max
  Coding DNA Sequence Number=SeqID_10551
MVPKCQNLIWKACHQILPAKQSLVKKGINVDPLCPWCMMEEESIEHEEEHIGLFANGASVKASLGDGKWLGIKQKTQEWKTEANHQVWRPPPSSQIKFNLDASIKARIGTCFGRISRQ

SEQ ID NO: 127330 - protein, 98 aa, Glycine max
  Coding DNA Sequence Number=SeqID_10552
MTVDPPSPIARHVKWKMTRTKQYRFVPDGRADILNTVLGRLEHPGHDSHNNVLKPVGPVERCNTVAGDDPLGELMKILFMDDWSTSLGHGLVYSFLEP

SEQ ID NO: 127331 - protein, 127 aa, Glycine max
  Coding DNA Sequence Number=SeqID_10553
MGETHEVPRDHTLANFEPHLRYATEGKTFGGVPLPNTLGGPQYRPQPQLQPLHFAMGRLPPAMVESEKFDHIKERLRAIEGSRDCPFVDMAKLCLVPDVIIPPKFKVSDFDKYKGTTCPKNHLKMYC

SEQ ID NO: 127332 - protein, 62 aa, Glycine max
  Coding DNA Sequence Number=SeqID_10554
  Gene Ontology: Mol. function=RNA-directed DNA polymerase activity; Biological process=RNA-dependent DNA replication
MVALFHDMVHKEIERGIKVDLDKVKAILEMPEPRTEKQVRGFLGRLNYIARFDAILPRNGIG

SEQ ID NO: 127333 - protein, 127 aa, Glycine max
  Coding DNA Sequence Number=SeqID_10555
  Gene Ontology: Mol. function=hydrolase activity; Cellular component =cytoplasm
  Homolog annotation: Hit_ID=Q9LUH1; Match level="QueryCoverage=53%, HitCoverage=29%, E-value=4e-18, Identity=57%"; Hit description =Similarity to endo-1
MNGTRELIDKVATKNGCYCVCPDFFNGDPFDPKNENMPLPVWLKDHEPEKGIETTKPVIEALKREGASTIGAAAHLRYNLTESILTFTLQFTEYASDDKSCCEKVGLGSPRKVTRSGWLVCFLNCPF

SEQ ID NO: 127334 - protein, 155 aa, Glycine max
  Coding DNA Sequence Number=SeqID_10556
MCKRERESFKEYAQRWRDLAAQVAPPMMEREIITMIIDSLPMFYYEKMVGYMPSTFADLISPLPNTPPTKNAQSTTKTSPTSPTKYIPYTTQTECKPKPQYKHQPKEEHPRDKTRGVHPNPNVVCQLATILAQQPNGHSEPKKGLSTSISLMIQS

SEQ ID NO: 127335 - protein, 109 aa, Glycine max
  Coding DNA Sequence Number=SeqID_10557
MRLQRVTTNVDSVVAMPREVPMPSMTELQCHERLQIRVPKRSSKSGQNESGSDESERIQTFSKVEPHKPLNFNIFSDTLSSLLQMVHFTTHILRWLFGTVLECDAVANL

SEQ ID NO: 127336 - protein, 249 aa, Glycine max
  Coding DNA Sequence Number=SeqID_10558
  Subcellular localization annotation: CTP_CleavageSite=74; ConfidenceScore=5.65e-01
MATRTLLKLKPNLKLPLRFFRNPTLALTRPVVPLTRPVFPLARPESPSLALFKPFTVQFPGMIARQMATARSPRGASKRNEEKEEDGGDDDDDGGADFDDEDGFDLDEEFDGSDESDGFDDEEEEEKPKGKKKRCTLSPPSHGSASTTPGPPAPVSAATEAACGVDRRRRSGGEVTDLACEDKERIKEEEDEKEFASKRRHSKSPHRVMNSERICGNGEVGFMEEKKLQAAGGGGRESDEREGSDGTTL

SEQ ID NO: 127337 - protein, 60 aa, Glycine max
  Coding DNA Sequence Number=SeqID_10559
  Gene Ontology: Mol. function=nucleoside-triphosphatase activity; Cellular component=intracellular; Biological process=regulation of transcription, DNA-dependent
  Homolog annotation: Hit_ID=Q9FNQ1; Match level="QueryCoverage=88%, HitCoverage=2%, E-value=2e-19, Identity=88%"; Hit description=RNA helicase
MIVTPPEKWDAITRKSSDMSLSMVVKLLIIDEVHLLNDDKGPVIEALVARTLRQTLAYDS

SEQ ID NO: 127338 - protein, 202 aa, Glycine max
  Coding DNA Sequence Number=SeqID_10560
  Subcellular localization annotation: CTP_CleavageSite=76; ConfidenceScore=5.20e-01
MSSLLHPNKNKHVKLSNLCSNSHIMDHNHHNNNRVPRIHAFLSPTPPSPPMLSFIAALSITTLIFMCLYVLSPIVSVAILLALYITTLFLCRFMQDRRELRERTSFHAQTPQNNQRVVRVFNKLFWVVEEKRGGKRQQVKKLLGCVLCFGSQAMASSCSCPIASFSLVALPSTTSSRLQLLLLHETHLAIPANPFTVHNSVR

SEQ ID NO: 127339 - protein, 117 aa, Glycine max
  Coding DNA Sequence Number=SeqID_10561
  Gene Ontology: Mol. function=oxidoreductase activity, acting on single donors with incorporation of molecular oxygen, incorporation of two atoms of oxygen; Cellular component=plastoglobule; Biological process=abscisic ...
  Gene Ontology: Biological process=acid biosynthetic process
  Homolog annotation: Hit_ID=Q8LP14; Match level="QueryCoverage=98%, HitCoverage=20%, E-value=9e-46, Identity=73%"; Hit description=Nine -cis-epoxycarotenoid dioxygenase4
  Subcellular localization annotation: CTP_CleavageSite=69; ConfidenceScore=5.51e-01
MENDTSFPLIPNVFSGFNSLVASAACGSLSVARVLTGQFNPTNGIGLANTSLAFFGNRLFALAESDLPYAVNVTPDGDIDRLGRHDFDEKLTFSMTAHPKIDLDTVECFAFRYGPVP

SEQ ID NO: 127340 - protein, 86 aa, Glycine max
  Coding DNA Sequence Number=SeqID_10562
MPEESEEVQALKAELEKTRVAKEKLKVAVTRVRKECYELKDINMIADEALEQEMKKVNLAANHGQMLEDEQAKVSALWVEREAREG

SEQ ID NO: 127341 - protein, 73 aa, Glycine max
  Coding DNA Sequence Number=SeqID_10563
  Gene Ontology: Mol. function=isomerase activity; Biological process =metabolic process
  Homolog annotation: Hit_ID=Q1SD05; Match level="QueryCoverage=56%, HitCoverage=11%, E-value=4e-10, Identity=73%"; Hit description=Enoyl- CoA hydratase/isomerase
MNVSSACSSSMDKIVRLWHLSSKSCLKVFSHGDYGIYLGLIGKRISTPSGAIYVGLETHYVPSGKLSLFKDAL

SEQ ID NO: 127342 - protein, 93 aa, Glycine max
  Coding DNA Sequence Number=SeqID_10564
  Pfam annotation: Domain name=Curlin_rpt; Domain location=43-76; Score= 13.5; E_value=0.06; Accession=PF07012.3; Description=Curlin associated repeat
MVSNRRGQGGRGNQGGRAGRGGHPQCSYSKTAKESLTSSTISGHNSTAYISQSGNNQSPWIIDSGASNHIAATGIGHVSSTSSLSLNSVLLIP

SEQ ID NO: 127343 - protein, 288 aa, Glycine max
  Coding DNA Sequence Number=SeqID_10565
  Gene Ontology: Mol. function=protein tyrosine/serine/threonine phosphatase activity; Cellular component=nucleus; Biological process= protein amino acid dephosphorylation
  Homolog annotation: Hit_ID=Q8GSD7; Match level="QueryCoverage=88%, HitCoverage=38%, E-value=5e-93, Identity=64%"; Hit description=MRNA capping enzyme-like protein
  Pfam annotation: Domain name=mRNA_cap_C; Domain location=137-234; Score=122.2; E_value=1.5e-33; Accession=PF03919.6; Description=mRNA capping enzyme, C-terminal domain
  Pfam annotation: Domain name=mRNA_cap_enzyme; Domain location=1-134; Score=151.6; E_value=2.1e-42; Accession=PF01331.10; Description=mRNA capping enzyme, catalytic domain
  Pfam module annotation: Pfam domain module=mRNA_cap_C::mRNA_cap _enzyme; Domain location=137-234::1-134
MAEKTHHFTLLDGEMIIDTLPDSKKQERRYLIYDLMAVNGVSVIERPFYERWKMLEKEVIEPRNQERFQSRNPYYRYDMEPFRVRRKDFWLLSTVTKLLSEFIPKLSHDADGLIFQGWDDPYIPRTHEGLLKWKYADLNSVDFLFEVIDNDCQLLFLYERGKKKLMEGYRVAFEEGSNPLHYSGKIIECSWDSDRQEWIFKRIRTDKSTPNDFNTYRKVMRSIRDNITEDILLNEISEIIRLPMYADRIRIDSKANHHTNMSRRRCKQDQMYLLMSARGHHPKVPHIM

SEQ ID NO: 127344 - protein, 86 aa, Glycine max
  Coding DNA Sequence Number=SeqID_10566
MTNDDVLGDEIPNDQQDAFRQFCFQTLKLGVGQVNMDQVTQQLEAILQTANQSTLQQEMRGEYQGGMMENRGPSHTIEKTQVAPCS

SEQ ID NO: 127345 - protein, 106 aa, Glycine max
  Coding DNA Sequence Number=SeqID_10567
MTLILVVGFGRIALVEKSWQFMRPNGNVFMGRRQKQLKRKKMGDAGRRRHCAALLLCLVTGACGVEATKCDSNVSVSKVKKGGVIEEYQQYEESGDAKLGLRWMNP

SEQ ID NO: 127346 - protein, 208 aa, Glycine max
  Coding DNA Sequence Number=SeqID_10568
  Homolog annotation: Hit_ID=Q1SAW1; Match level="QueryCoverage=24%, HitCoverage=28%, E-value=9e-07, Identity=56%"; Hit description =Probable GDSL-motif lipase/hydrolase [imported]-Arabidopsis thaliana- related
MECFILKAVIERLHLLNLVFEDFPNGLKQKRENQVTVKPCLVIKVSGIGVLTKSASDGISPSPPEVQIPSDHTSPLPDTLNSQDSSSFGGTCSKNEKSGVAPDQYVGCNNNDASWCSEEVSESKAEQLYLSESGSVSEITTDGNLSSLPSEEDMFKQHFGSLSNTHKVKSSNSLVRRFSAGYIVQWDCKKLFSSPVRNKGATHTVSEE

SEQ ID NO: 127347 - protein, 65 aa, Glycine max
  Coding DNA Sequence Number=SeqID_10569
MNHKGIRSFVFNDYNQEVMPTSCNEPKSVINQEANHASCNEPKERWSLVFSVQPRRPSLENSHQE

SEQ ID NO: 127348 - protein, 65 aa, Glycine max
  Coding DNA Sequence Number=SeqID_10570
MANSFGDVRGSGGVNNGDVDSTNDNNGDHGFIVLVVVVIVLVVVHGGTNSDVDGISVYDDDNNNN

SEQ ID NO: 127349 - protein, 439 aa, Glycine max
  Coding DNA Sequence Number=SeqID_10571
  Gene Ontology: Mol. function=RNA-directed DNA polymerase activity; Cellular component=chromatin; Biological process=chromatin assembly or disassembly
  Pfam annotation: Domain name=Chromo; Domain location=376-424; Score =15.5; E_value=0.014; Accession=PF00385.14; Description='chromo' (CHRromatin Organisation MOdifier
  Pfam annotation: Domain name=rve; Domain location=151-264; Score =16.1; E_value=0.00027; Accession=PF00665.16; Description=Integrase core domain
  Pfam annotation: Domain name=zf-H2C2; Domain location=92-133; Score =24.5; E_value=0.0002; Accession=PF09337.1; Description=His(2)-Cys(2) zinc finger
  Pfam module annotation: Pfam domain module=Chromo::rve::zf-H2C2; Domain location=376-424::151-264::92-133
MASILARPFFCHLNGPSQPEGIDTGKANVATDALSRIPEVTSGKLLAFTIPHLVFMEDLKNELHRHPAYLELRYSITDTLDTYSNFSLTEFHSTPIGGHMGIAKTLARVSQNFTWPGIKDDVRNFILHCLHCQQTKYDHQKSPGLLCPLPVPMRPWEDLSLDFIGGLPSFRGYSVILVVVDRLSKGIHLGILPPNHTASTVAHLFLDIVSDGQTEVLNKVIEQYLRSFVHQQPSSWGKFILWAEWSYNTSIHSATGMTPYEITFGKLPLSIPHYLPDTKRQEMQFKVGDMVLVKLRPWRQTTVTGVVQSKLGKRYYGPFCVLEKIGPVACRLELPSDSRIHPVFHCSLLKPFHSNHAIPTPVDGLPNTSIDNEPIITPLVILATKWASTDNGPELLALVQWRGLLPEDTSWESWTQLKEEYHLEDKVLLDVAGDVMKQP

SEQ ID NO: 127350 - protein, 741 aa, Glycine max
  Coding DNA Sequence Number=SeqID_10572
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=91%, HitCoverage=52%, E-value=1e-116, Identity=40%"; Hit description =Chromo
MADNTRSKSNLDCMEEAIAKLASTQLHVTSKLDEIIHRLTTLESSHQASSSSLPSSANQHSPTASITHLPRMKLDVPRFDGSDPSGWCFKITQFFEYHSMPEANDCSSPRSSLKARLSLGFSGSPGTVNFPLGPSSCARLRPDLPLLNMRILSLFFYLSQFEHLAIRIVGLPPSFLLSCFVSGLAPNVRREVQALQPLTLTQAAGLARLQEEKLITPRCPPIGRPLTLPTAPLSPPSPTSLLPSPTKLTKSPPPVVHRLSPKEITLRREKGLCFNYDEKFSRGHKCSSRFFLLVAEDDRPGTLATDPSFEPIAMPQPQPESPDPPQAQISFYALSGHLAPETLRLLGCVAHHSITILIDGLRRIIQNNGASAFFHIRILDPDLPSNQPNTTSHPELTQILTKYSSLFQTPTTLPPSRNTNHAIHLLPNSNPINVRPYRYPYFQKQEIETQVASMLQNGIIRPNTSPFSSPVLLVKKRDGTWRFCVDYRALNAITVKDHFTIPTIDELLNELGGARWFSKLDLLQGYHQILMKPEDVDKTAFRTHHGHYEFLVMPFGLCNVPSSFQATMNNAFSPYLRKFIFFDDILIYSSSLSEHMNHLEHAFEVLLAGGFFLKLSKCSFAQNQIEYLGHIVSHADVHLVPAKIEAIRDYPTPYSIIALRTFLGLSGFYQRFIQGYALIVAPLTKLLAKDQFQWTPTAQQAFDKLKTALCSAPILGLPDFSQPFTVETNTSRVGMGAVLSQ

SEQ ID NO: 127351 - protein, 70 aa, Glycine max
  Coding DNA Sequence Number=SeqID_10573
HEHEIYPKAHENPRVLSCISGPIYLESSIQCPCGVGIRTRWRDYRHGGMVDYQHVIPAHADVARRKNVMS

SEQ ID NO: 127352 - protein, 67 aa, Glycine max
  Coding DNA Sequence Number=SeqID_10574
MDSTLLLSATRISLTTHKLPAQRWFPIEWLVLCSVIDKGGFMDLDHEDVMIIVPPIFAPKDVPENLV

SEQ ID NO: 127353 - protein, 77 aa, Glycine max
  Coding DNA Sequence Number=SeqID_10575
MYCYHFTLPTQRRGMTNDNDDNNDFSGRGNGDNDGQNDNDDHDGVVMFIMHKCPLYINKWGRRSDTTTIGVKPTRYD

SEQ ID NO: 127354 - protein, 134 aa, Glycine max
  Coding DNA Sequence Number=SeqID_10576
  Homolog annotation: Hit_ID=Q1RV13; Match level="QueryCoverage=68%, HitCoverage=25%, E-value=8e-08, Identity=34%"; Hit description=IMP dehydrogenase/GMP reductase
MAKILGGLMRSGIFSRYRVGNEQVEVAFLQFANGTLFFVEANINNVMETKAMLGCYEFIFDLKVNFYKSCLAGMRKCLIVLGMRLPFLDLVIPIRGNTRNEDSLWLRDLTRICGEGTKHPWFEEVGIVEARYTG

SEQ ID NO: 127355 - protein, 100 aa, Glycine max
  Coding DNA Sequence Number=SeqID_10577
  Gene Ontology: Mol. function=O-methyltransferase activity; Biological process=lignin biosynthetic process
  Homolog annotation: Hit_ID=Q9SCP7; Match level="QueryCoverage=85%, HitCoverage=25%, E-value=9e-16, Identity=57%"; Hit description =Caffeic acid O-methyltransferase-like protein
MEKEESTEQRKQAKLAIMELANMISAPMALNIVVRLNVTNVLWQGDTNNPFSAAEILPASFPTAATMPSRTSNGFSACWLVTTSSTSTSLQKLSPFYIFF

SEQ ID NO: 127356 - protein, 150 aa, Glycine max
  Coding DNA Sequence Number=SeqID_10578
NLTNLKEEKPILIFIEKSGPNLGPWAQKSTLREDCITPIGRFLEYRINRLSKIGGHLPPSLATIPCENPIFLWNLAEPINFLVKKRISSWAKHASIAKRSFNALSATEESGRALISRPHAKREINALSATVVFSQAQRMTGAKLKSTYSC

SEQ ID NO: 127357 - protein, 144 aa, Glycine max
  Coding DNA Sequence Number=SeqID_10579
  Subcellular localization annotation: CTP_CleavageSite=59; ConfidenceScore=5.45e-01
MCISGTSYRRGTWSSLKECSMNFTESSSGASGTRYSQNSRRSKLTWLLSRSSIPTSTTQRMELQNIAREDYPTYSQYLHIYPDHQAIAAKLCTPGGGFVLNANGAPWKLLQKDLARLAQTWSILSYFNLAPSSHTSDLNVDRAR

SEQ ID NO: 127358 - protein, 239 aa, Glycine max
  Coding DNA Sequence Number=SeqID_10580
MVPLVLNFEALFAKNHDKKSILLGNEWLEVNEIAVRIIVMAAFLLQLHLLQLTWSTRKADTKQKDLWIAEKKVLHVIFTLYAVGILIALLVHQNNTLHGDVVYSSSLSQQHSFWEHLKSCSGLVLDDFLLPQILLNIFMNSKGNALSCSFYFGTSLVRLIPHAYDLFEALAYVDGSCLYADEIADYYSTAWDIIIPLVSLMFASIIHFQQRFGGCSILSWRIKTKGVEEYEKVPMVTEA

SEQ ID NO: 127359 - protein, 81 aa, Glycine max
  Coding DNA Sequence Number=SeqID_10581
MLVPQRQASVQVVEYESQQRKKKLACLKDIMVRYEKERLKAKKDVENSKNMKKEGPTQDALSAQHVLSAKTHVGAKREESR

SEQ ID NO: 127360 - protein, 403 aa, Glycine max
  Coding DNA Sequence Number=SeqID_10582
  Gene Ontology: Mol. function=nucleic acid binding; Cellular component= chromatin; Biological process=DNA integration
  Homolog annotation: Hit_ID=Q1S7C5; Match level="QueryCoverage=95%, HitCoverage=33%, E-value=1e-142, Identity=61%"; Hit description =Integrase, catalytic region
MKEEYQALMRNQTWTLVKPSESRKPIGCKWVFRVKENSDGSLNKYKARLVAKGFHQQTRSDFTKTFSPVVKPVTVRIVLTLAVTHKWTIQQIDVNNAFLNGTLEEEVFMQQPPGFESSDKSLVCKLNKAIYGLKQAPRAWFDKLKNALIQQGFLASKCDPSLFLLHHGKLQIIMLVYVDDIIITGNSTSFITALIKHLNDVFCLKQLGKLDYFLRIEVTHLPNGSLLLSQSKYITDLLAKVNMTSANDPDDKRSTSGACVFLGPNLVSWWSKKQQLVAQSSAEAEYRSMAHLAAELLWVQTLLRELHCPFQTPKVLCDNLSTVTLAHNPVLHNRTKHMELDIFFVREKVLNKSLVVAHVPAQDQWADALTKPLSANKFLPLCSKLRVFDKHSLLGLPSASKGE

SEQ ID NO: 127361 - protein, 424 aa, Glycine max
  Coding DNA Sequence Number=SeqID_10583
MVPNSNPNESKFKDFPHGQFQVGYYLGGDKIVGADTFQKLRQKQVTLRIKSVYETDVSGLLKVGATLLIRSASSYYRVGNFTRGKRLKNRKRFPSSIMFSLDGFWAESSGRLCMVGTGSGYSMQLLEVVLKLYNVVNSSNTISTLVIGSLESLSSKNELSYFEPILLFIFPKMDYEYSLDTMETKNEYSDEGEVVPGLSINPSYWGDANQLPYIVSLKELVCLDVKQRVIELIGFRNSGDRWSFNPNTTLVGEGWWDEEKNQLSIVGCHFLGMEDSMASVHVGYFKRVVLRKFGGQRVQISGTQYEYSQLDKVRKMCLRQEPLKNKEIRYPDVYSSDMRFDIYTLPPISPNSNSTSLFKVIVMFQFPPLDAKNNGGYIKGSIESMREKSNPLYFKQLDVISAAFYTAEASQILKKIDMEVIVIL

SEQ ID NO: 127362 - protein, 550 aa, Glycine max
  Coding DNA Sequence Number=SeqID_10584
  Gene Ontology: Mol. function=nucleic acid binding; Biological process= DNA integration
  Homolog annotation: Hit_ID=Q1T4S3; Match level="QueryCoverage=86%, HitCoverage=34%, E-value=4e-61, Identity=49%"; Hit description=Zinc finger, CCHC-type
MDSLFPSSQVKLPHLISVKLDDKNFKQWKQQIDGVIRGHRLQRFVTVPVIPPPPSSGSDSSLHDANSSESLVSIGDLVPLRNLIEIVLDALPEEYDSIVAAVNSKEEVGSLDELESSLLAHESRLEKHRKAVLTEPVMVNLTQASKPSSSATSDQSSAGTDAFPQGTSHVTANAENHGYGSRGGRSNHGGGRFGHGGGRFGKTQCQICHKSGHDASICYYRYSNSAAAMYQPQRAPFNPFLMPSRPMYQPPFSYAAPRAASPRAPQPQVRPIMLLLIQVFMGNGQGLSIHSIGSMPFPLPNYPHMSLTLQNLLLVPHITKNLMSVSKFAQDNKASSEVLLRGLVRADGLYKFLIPASQISKSPPSLNSCIAESSNKCSSSSLCSSVANENDSYNCISLCTTDLFMNKDNSMCSNFPSLNATTYDSLSSQHVNNSLSIATNKYVLWHSRLGHPHHHALTEVFKLCHLPVPSKPPAELCSACCLGKSHRLPTSLSATVYSQPFELVVCDLWGPAPMQSLGGYSYFLTCVDAFSRFVWVFPLRLKSDTLPQFM

SEQ ID NO: 127363 - protein, 436 aa, Glycine max
  Coding DNA Sequence Number=SeqID_10585
  Gene Ontology: Mol. function=protein-tyrosine kinase activity; Cellular component=integral to membrane; Biological process=protein amino acid phosphorylation
  Homolog annotation: Hit_ID=Q1SML3; Match level="QueryCoverage=100%, HitCoverage=42%, E-value=1e-157, Identity=64%"; Hit description =Tyrosine protein kinase, active site
  Pfam annotation: Domain name=LRR_1; Domain location=21-43; Score =11.6; E_value=1.9; Accession=PF00560.23; Description=Leucine Rich Repeat
  Pfam annotation: Domain name=LRR_1; Domain location=45-66; Score =18.1; E_value=0.033; Accession=PF00560.23; Description=Leucine Rich Repeat
  Pfam annotation: Domain name=LRR_1; Domain location=68-89; Score =13.2; E_value=0.93; Accession=PF00560.23; Description=Leucine Rich Repeat
  Pfam annotation: Domain name=Pkinase; Domain location=162-436; Score =138.0; E_value=2.5e-38; Accession=PF00069.15; Description=Protein kinase domain
  Pfam annotation: Domain name=Pkinase_Tyr; Domain location=162-436; Score=72.2; E_value=1.7e-18; Accession=PF07714.7; Description =Protein tyrosine kinase
  Pfam module annotation: Pfam domain module=LRR_1::LRR_1::LRR _1::Pkinase::Pkinase_Tyr; Domain location=21-43::45-66::68-89::162 -436::162-436
MSLSQNNFQGNIPSELGKLKFLTSLDLGGNSLRGTIPSMFGELKSLETLNLSHNNLSGNLSSFDDMTSLTSIDISYNRFEGPLPNILAFHNAKIEALRNNKGLCGNVTGLEPCSTSISYHLCQTSTKKEDQATNIQTPNIFAIWNFDGKMVFENIIEATEDFDDKHLIGVGGQGCVYKAVLPTGQVVAVKKLHSVPNGEMLNLKAFTCEIQALTEIRHRNIVKLYGFCSHSQFSFLVCEFLENGSVEKTLKDDGQAMAFDWYKRVNVVKDVANALCYMHHECSPRIVHRDISSKNVLLDSEYVAHVSDFGTAKFLNPDSSNWTSFVGTFGYAAPELAYTMEVNEKCDVYSFGVLAREILIGKHPGDVISSLLGSSPSTLVASRLDHMALMDKLDQRLPHPTKPIGKEVASIAKIAMACLTESPRSRPTMEQVANEL

SEQ ID NO: 127364 - protein, 98 aa, Glycine max
  Coding DNA Sequence Number=SeqID_10586
MGSKAPRKISYNHIKIKEIKIGHFSLRRHYFTNSNGEDVKNRVLNLVFMLHDDLVVNKSGIIVFPGQESKGGGNEEEVADAETRLGEDNHDVDGEAVH

SEQ ID NO: 127365 - protein, 96 aa, Glycine max
  Coding DNA Sequence Number=SeqID_10587
MVGAFSQNKVTLTGLPMILPSESDLTYQYVICLVMYSWAPDEIFHSYVEFGTNRRGRVDSTPSFNPKNGPAPTFQAHNRPGTCYKPRIYLANVFNT

SEQ ID NO: 127366 - protein, 105 aa, Glycine max
  Coding DNA Sequence Number=SeqID_10588
  Gene Ontology: Mol. function=nucleic acid binding
  Homolog annotation: Hit_ID=Q1SKJ3; Match level="QueryCoverage=96%, HitCoverage=11%, E-value=2e-10, Identity=33%"; Hit description=Zinc finger, CCHC-type; Endonuclease/exonuclease/phosphatase
MDSYLIQLESIEDYKHAVFEGPWKIADHYLLVQKWRLGCFMEADLENRVVVRVCMPNLPIELSNEEFLTRVGNIVGVMLKIDSVTSLHLSGKFACFCVELDLEKP

SEQ ID NO: 127367 - protein, 390 aa, Glycine max
  Coding DNA Sequence Number=SeqID_10589
  Gene Ontology: Mol. function=RNA-directed DNA polymerase activity; Cellular component=extracellular region; Biological process=RNA -dependent DNA replication
MGGYKAPGLDGLQAMCFQSWWHLVGEDPIEGATRLKDFCPIGLCNVSYKQSMDNIVIAQEIFYSMKNKKGKKGWMAIKVDLEKAYDGLQWEFLRETLSDIGCPHNYLQMVLDAFISKKRVHQGDPIFPYHFVLCLEYLIHLINLAVDNKTWKPIQLNKGAPLIPHLAFADDILLFAEASVDQIDVIKIVLNLFCESSGDKVSDQKSYILFSNNVNWQTKHDIVTRSGFHCTNDLGKYLGSIAFEFVEGQYDVHGRATVRILGKSILWLGVLLGAPDNIAVLCDIWSFERVWGVVKNVGIHYFKGTKELLPRECMEERSSAVEINNCGRTFFPALLRKNFFRESARKNLLPNAWKKVPPQLLCSVVEEGSSVHSRDRAYPYRRPRILCLRE

SEQ ID NO: 127368 - protein, 428 aa, Glycine max
  Coding DNA Sequence Number=SeqID_10590
MDEKRKKKLVEAAQCRSTNTVIDPPSPIRRHVKWKMTHTKKTRQMTSEARKEIAEKIDLLEEQASQGSFVAHGRQDVLTVSLGRPEHPGRVRAAGAGVTIKQYFGPSPRTSHMSSSMAPEDIQSQGLALPPEPKVGPSAACVRTKESCVDPSGNDPNIGDSDKCGLYVKENPPGLVALGRLYKGSTTVHNISLLHDQVKVGVEKVRHTDAPILVPTEEEAVGSAKPTDRPKHDVDDPIYLMRLTIPQLFLKPLQVMWDATVFGVFNENFPLYIKHEDLSEIAHGAGNVDVYGFLEPQSIQRSGQSQFESESYIKNWMQNSKRDVYLRANLNGPDNYLKRIINSVLKELDNTTQSKSNVTARWIVVKGQMRLLKRRQIFFKRSHKKNKRKVDGEGHEGTMWKALVLMTNGSKILWRDPTCLYNGGPRFI

SEQ ID NO: 127369 - protein, 62 aa, Glycine max
  Coding DNA Sequence Number=SeqID_10591
MANSSVVIPLLELKSVNPSSNTSNPAEKYIQVLWSPCKELFKPADKYNQKLSLSNGPKEKEA

SEQ ID NO: 127370 - protein, 264 aa, Glycine max
  Coding DNA Sequence Number=SeqID_10592
  Homolog annotation: Hit_ID=Q8S8F8; Match level="QueryCoverage=98%, HitCoverage=89%, E-value=1e-56, Identity=44%"; Hit description =Expressed protein
  Pfam annotation: Domain name=GRAM; Domain location=154-224; Score =22.0; E_value=0.0013; Accession=PF02893.10; Description=GRAM domain
  Subcellular localization annotation: CTP_CleavageSite=11; ConfidenceScore=5.28e-01
MEQPPKPETVTESHVPNGFSTTTTTVPNGSGSESQAPKEHTASSSSSTKKSVHWSPELVTESTFTSSPCESRSNPYFSSSSSFSQPPPTFMETVVTVRNVLGRWGRKAAEATKKAESLAGNTWQHLKTSPSFAEAAMGRIAQGTKVLAEGGYEKIFLNTFETVPEERLLNSYACYLSTSAGPVMGVLYVSTAKIAYSSDNPISYKNDNQTEWSYYKIIFSSPNKKLSNTPLKLEHTNHMHQAFYYGTEIQGPRRDFVRISRADN

SEQ ID NO: 127371 - protein, 86 aa, Glycine max
  Coding DNA Sequence Number=SeqID_10593
MNKSLKVGEDEWREREKGEHKFQREKKENERASAKHNTPGLSARKTLEEDELYKFAKCTTSSHQAHHFSSSAKRERCAKPKITNVR

SEQ ID NO: 127372 - protein, 282 aa, Glycine max
  Coding DNA Sequence Number=SeqID_10594
  Homolog annotation: Hit_ID=Q1SMF0; Match level="QueryCoverage=66%, HitCoverage=35%, E-value=1e-26, Identity=36%"; Hit description =Tetratricopeptide-like helical
  Pfam annotation: Domain name=FAR1; Domain location=49-208; Score= -64.6; E_value=0.061; Accession=PF03101.5; Description=FAR1 family
MSEEVDMNEENKEEPSVNEELNECPLKTRHVWIALLVFATCDDVLHWTRSVAYEIGFVVLITRLDTDTGIRGRTSFVLIGCERSDQYKAKKKDLEKTITGSRKCGCPFKLRVKPVVEGKGWMVKLMSGSHNHELVKSLVGYPYVGRLTKDEKIIIADITKSMVKPRNILLTLKEHDVNSYTTIRKVYNARNVYRSSIRGNNTKMQQLMKLLEWDQYIHWHRLKDEDVIVPTKQTSEGCCRDLSSGGGAKKALGWDKGVSSVEGKCMELPQTFIRKMLEKPQR

SEQ ID NO: 127373 - protein, 125 aa, Glycine max
  Coding DNA Sequence Number=SeqID_10595
  Subcellular localization annotation: CTP_CleavageSite=84; ConfidenceScore=5.15e-01
MTVSWAKRASTAKRKFSVLSATKESGRTSISGSCAKHEISALSAVVVFHQAQRMTDAKLKPTYSRYAQRLGLRVYLKSVLCRIRVHTFTETFAEDSRAHHSAYFGNRALEAARGAAFAKIPRFCN

SEQ ID NO: 127374 - protein, 433 aa, Glycine max
  Coding DNA Sequence Number=SeqID_10596
  Gene Ontology: Mol. function=RNA-directed DNA polymerase activity; Biological process=RNA-dependent DNA replication
  Homolog annotation: Hit_ID=Q1SYR3; Match level="QueryCoverage=99%, HitCoverage=19%, E-value=2e-97, Identity=43%"; Hit description=RNase H, putative
MEELQERFDGMQREVEALRGRDLFGKDACELCLVPNVTIPHKFKVPDFDKYKGNSCPRSHLVMYARKMSMYTDNHKLLIHFFQDSLTGAALKWYMNLDSASIRTFNDLGEAFIRQYKYNLDMAPDRDQLRAMTQKEKETFKEYGQRWREVAAQIVPPLEEREMTKIFLKTLSQFYYEKMVASAPTDFTEMVNMGVRLEEVPHAASNAKKFGGHFAKKKDQEVGMVAHGKPQQNFTPYRQVANVASAIPNPSYHQQRPHYPYPYPPHPYPPQQYPPQQYPPQQYPPQQYHQPPYPQKQQNRPQTPQQPYHSQNRQKTTFDPIPMKYADLLPALLAKNLVQVRTPPRTPDVLPPWFRHDLTCAFHQGAPGHDVENCYVLKNEVQKLVRANLLSFKDQNPNVQANPLPNHGPAVNMIQDCDEDGVILNVQHVRTPL

SEQ ID NO: 127375 - protein, 247 aa, Glycine max
  Coding DNA Sequence Number=SeqID_10597
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=1e-31, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
ALHALILRGLHDLTFTGLHALALRGLHTLPFTGLHALAFRELHILTFRGPHVLTFRGLHVHALRGLHILAFRGLHALAFRGLHVLTFRGLDVFHFRGPHILPFRGLHVLTIRGLHVVAFIGLHVHPLRGLQVLTFRGIHVLAFIRLQVLPLRGLYALTFRGLHVLALRRLHVLRFRGLHVLAFRGLHVLPFRGLHVLTFRGLPVLALRGLLVLPFRGLHALAFEGLHAFTFRGVHVLQFRGLRILAL

SEQ ID NO: 127376 - protein, 82 aa, Glycine max
  Coding DNA Sequence Number=SeqID_10598
MDKSLKEEEEDEWRERKRRSTKFCASNEVKKRPSHEVLKATVEHSSSAGLSAHPPLSATLARQKNLAEHQYQGRALSARSVH

SEQ ID NO: 127377 - protein, 213 aa, Glycine max
  Coding DNA Sequence Number=SeqID_10599
  Gene Ontology: Mol. function=nucleic acid binding; Cellular component= nucleus; Biological process=DNA integration
MWKHAMNEEMQSMSVNGVWELVELPENYKAIGCKWVFKTKKEWIAEASFMLGIEIHRDRSRHTLGLSQKGYIDSVLERFNMQNCKPRDVLVIKGDKFNKDQCPKIEIKPTEMNDRRFGSALGSLMYAQVCTRSDIAFIVGVLGRYWSNPMNDHLIAAKKVKRYLQKTKEYMLVYKRVENLEVVGYTNSNLGGCPDDRRSTSGYIFIMVGGAIS

SEQ ID NO: 127378 - protein, 248 aa, Glycine max
  Coding DNA Sequence Number=SeqID_10600
  Gene Ontology: Mol. function=nucleic acid binding; Cellular component= chromatin; Biological process=DNA integration
  Pfam annotation: Domain name=zf-CCHC; Domain location=184-201; Score =8.2; E_value=0.044; Accession=PF00098.13; Description=Zinc knuckle
MASCDGGDQPGRWSRRQQAMTMHDNDGLKLIAIKRTVSKDLLSGQPKKAIVKEFLNALGKKYQVFDNVEFRCLMKQLTNMRHDNVRVLPTDFTQIKIAYNTIGKKWTVNNLIAKCVVEEEKLKKDKSDIALLSIHNKPIFGKRHWKNTKRASNASHRYQGLGKPSKDKHQDVGGPRPAIFNKGIWCFWCKEKGHKKSNCGKFKAWLENKQKSRGNNSTFVCLESDQVDVPIDSWWIDSGSTTHIVVSF

SEQ ID NO: 127379 - protein, 159 aa, Glycine max
  Coding DNA Sequence Number=SeqID_10601
  Subcellular localization annotation: CTP_CleavageSite=56; ConfidenceScore=5.59e-01
MYNRKISSNKFNLWFSNGFGLMDNKNMFSSRFNNSSTSFLAGTGSGSTSRKEEAPRCDVRKSCLKYLLDDQVISCTISWKNASRIIPFPRMVGLSSMLRLVFRVQGLPLSMGGFALLFQCLEVGFLQEVGSLLHSGSRDLGDYLGIGECLVFGGEEGLG

SEQ ID NO: 127380 - protein, 698 aa, Glycine max
  Coding DNA Sequence Number=SeqID_10602
  Gene Ontology: Mol. function=nucleotide binding; Biological process =catabolic process
  Homolog annotation: Hit_ID=Q1EP28; Match level="QueryCoverage=99%, HitCoverage=85%, E-value=0.0, Identity=70%"; Hit description=Dynamin family protein
  Pfam annotation: Domain name=Dynamin_N; Domain location=8-129; Score =24.0; E_value=1.7e-07; Accession=PF00350.13; Description=Dynamin family
MEEDSEEYGSPVVLSSAIADIIKSRTEALLKKTKTAVSPKPIVMRAEYAHCPNLTIIDTPGFVLKAKKGEPDNTPDEILSMVKSLASPPHRILLFLQQSSVEWCSSLWLDSIREIDPTFRRTVIVVSKFDNRLKEFSDRWEVDRYLSASGYLGDNTHPFFVALPKDRGNVSNDEFRRQISQVDSEVLHHLQEGVKGGFDEEKFKSYIGFGRLRDYLESELQKKYKEAAPATLALLEQRCSELTSELARMDSKIQATSDVSHLRKSAMLHAASISNHVGALIDGAADPSPELWGKTTVEERSRSGIGVWPGVTADVNPPNATLRLYGGAAFERVMHEFRCAAYSIECPSVSREKVANILLAHAGRGGGRGITEAAAEIARAAAKSWLAPLLDTACDRLSFVLGSLFDLALERNCSHDSECGIKGDDMDGYVGFHAALRCAYNRFIGDLAKKCKQLVRHHLDSVTSPYSQVCYFNDFQPCSGPNALSYSKVLELSDTSSASRDVRRDQENIPPEKNAQETTPGKTGETRDVLRESHITIPETPSPDQPGDAAFGVVKKEPGICNDMGPRKRASRMGGNSKNSDNVRLQNGVILFGNGERSGSPYSDICVSAAQHFARIRGVLVERGVTSTLNSGFLTPCRDRLFVALGLDLFAVNDEKFMDMFVAPGAIDVLESERESLSKRQKILQSCLNEFKNVARAL

SEQ ID NO: 127381 - protein, 97 aa, Glycine max
  Coding DNA Sequence Number=SeqID_10603
MPMITIEANATYHFLFKHIPQHDINHIISYYAYFGSVQLDNLLQFLQQFFEHDANGRPTRPTFCWDTTIEVHEDVRDFNDDEDLMSSEIPFYQDICS

SEQ ID NO: 127382 - protein, 55 aa, Glycine max
  Coding DNA Sequence Number=SeqID_10604
MSSQSTRSAGEMMEDVIHGHNSTVLGSTFSCRSKLHDDESSMNQVVLMRTKGSKE

SEQ ID NO: 127383 - protein, 95 aa, Glycine max
  Coding DNA Sequence Number=SeqID_10605
MASDVCKVHMEERLFLHHVALAVAANPHKHPPRMLHDLPLKLVVARVSPSFLKRHKQQHTDPEHGSKLENFKITCSRKFNNKHRIQELERPPYLS

SEQ ID NO: 127384 - protein, 140 aa, Glycine max
  Coding DNA Sequence Number=SeqID_10606
MARTKNQLYKETSPCKKIKQLKEVASSKQAPKAKPQQPWMVHEPSNDNERFFNKYFKDRSQAFAVNPLSRISMLMPSFKMISKKRSPRSEEIFSIATKMSFHLGLLALITALCVRKGMDIVEDWAQSYVDLQPTSDANYI

SEQ ID NO: 127385 - protein, 71 aa, Glycine max
  Coding DNA Sequence Number=SeqID_10607
MQGELAWASTTAPGNIKTRGGGVSLHPKLPSLIQKCNTHWIFRFSPLGHHFCAFASIFSVFGNSIQTTCEN

SEQ ID NO: 127386 - protein, 178 aa, Glycine max
  Coding DNA Sequence Number=SeqID_10608
MGKAEEVQEKMKADMEAMKEQMATMMEAMMSMKKIMEANAVIVAATSAVAKVNPMLPSSLKQMNHPNLNMGKQLVVYPLKTLWRALSFAPQPQPLHFAVGRAPPAMAEKGKADHLKERLRAIEGGEDYAFANLEELFLIPKHGHSQVQGAGLWQVQGDYSLQEPSKDVLSEDGGIRKR

SEQ ID NO: 127387 - protein, 63 aa, Glycine max
  Coding DNA Sequence Number=SeqID_10609
  Subcellular localization annotation: CTP_CleavageSite=67; ConfidenceScore=5.26e-01
MAFLGETSSQTIVNSRLAFTFPNGSIIHNKCGVYFQSSTSVPMRVPNMCDFATLKSRIHNTLQ

SEQ ID NO: 127388 - protein, 68 aa, Glycine max
  Coding DNA Sequence Number=SeqID_10610
MAEVFVSKTRKNVFHVIRWKNLLLQVLPWNHTEDVLPQECTEEPPSIVITLTTEEPSFVHSGRRTSSA

SEQ ID NO: 127389 - protein, 63 aa, Glycine max
  Coding DNA Sequence Number=SeqID_10611
MDEDQWAYDNMMSEEVDMDFKDEQHCGVNEGHVDCSYAFNTSQVITLPMVFLTRYEESIKARP

SEQ ID NO: 127390 - protein, 84 aa, Glycine max
  Coding DNA Sequence Number=SeqID_10612
MGMRGCISYNPVLAIRQLGYPMRGAPLEDELTPVISRDFNKTNIETVQKVRKAWEVLRTAKREEVEAPEEDKEVQALRAELEQA

SEQ ID NO: 127391 - protein, 90 aa, Glycine max
  Coding DNA Sequence Number=SeqID_10613
MVQLLAELLLQSSLVMELGVRSSGLGRTIVGVLGEEEQDRGENVLEEALANVIRRRRHQVEVVVPATAPFQKSEEESKRENQRATIRESD

SEQ ID NO: 127392 - protein, 45 aa, Glycine max
  Coding DNA Sequence Number=SeqID_10614
MLSPLKPNSSFLDSPLSYSHFAVVWRQAVVARGGHRWSWVEKERF

SEQ ID NO: 127393 - protein, 111 aa, Glycine max
  Coding DNA Sequence Number=SeqID_10615
MTNMRKTLMKMRSPSCPERLEKYGETKVALDGKIPHEGLQKLAKRFQKLSKDHLKLEKTLQDQTRHMTSKCRDRPKKGTTNIFMAKTKACIKIWVPKKKIIPIVDVPDNKK

SEQ ID NO: 127394 - protein, 121 aa, Glycine max
  Coding DNA Sequence Number=SeqID_10616
MDLFRSWRGSIAMPIGWTFQKSGADIEEEEPTDLRSNPLQGGRDDAILSRKGLVTRAMSNRLQEDWDRATKEGPRVLMNLRLSSSFFRNLLKELLKELLKEVFSKKLLKEVFSRKLLKEAT

SEQ ID NO: 127395 - protein, 119 aa, Glycine max
  Coding DNA Sequence Number=SeqID_10617
MWEVVGLNMWEVAGLWSLIKPKFYQAKRKTKESGKHYSKHLNLSHYAIPPQMDLCLEDLSTAKRISDSLCTLAMDKTTKEVLEHQCINYARFKKSRSKGSKSICLAPCYKMGTRVKHLK

SEQ ID NO: 127396 - protein, 92 aa, Glycine max
  Coding DNA Sequence Number=SeqID_10618
MLSFSQMQSQFQSQMQSLGLALPPELEVGPSAARVSTKESCVDPSRNNPDTGDSEKYGLYIKENLPHLVALGRLYEGSTTVHNIPLRHDQVK

SEQ ID NO: 127397 - protein, 131 aa, Glycine max
  Coding DNA Sequence Number=SeqID_10619
MGFCQSYRVPVPPARSCHRDIGIAPTRHPVDPEKSNRALRFPTLVTGLCQSYRVPVPPARSCHHDIGIVPVRHPVDPKKSNRVLGFPALITGLCQFYGVPVAPSKVIRPPINRTFIEKYCTPGQAQSEASQ

SEQ ID NO: 127398 - protein, 85 aa, Glycine max
  Coding DNA Sequence Number=SeqID_10620
AANHGGQVQTHKCLYQLSLSLQSQGFAPFACPTPDQFRAEVAWPGDWSEAQAGEAPTEAPGDADEARMDEEMTDLLDFLGGSGAT

SEQ ID NO: 127399 - protein, 120 aa, Glycine max
  Coding DNA Sequence Number=SeqID_10621
MTEGCGEGFCLANLPGDAFSLWGNFFEAKKQMMADAKVGGAGLWPRAKAPSGWPPLQREKSFVARILPTLACAPLAKSVPRWVDHHVITWQDTRGGRIKATRAESQWIVAARPLCHLQYP

SEQ ID NO: 127400 - protein, 117 aa, Glycine max
  Coding DNA Sequence Number=SeqID_10622
MNEVLSELRGVHTYVGEHFDSLDGRIEGIDTRITQLEEDEFNCHHKKGGDCRSKDFDFDVLMMPYDHALLKFNSRCIIKKISSDLGSEFQVETTRGLAKEYELKCFFQEIYSLVIDY

SEQ ID NO: 127401 - protein, 78 aa, Glycine max
  Coding DNA Sequence Number=SeqID_10623
MSKVGRFEGLGMEGRRKEEEAAQGFLKNVVFIDQDALWRQPIGNRLHEDCNRLQAICSSVIDYSIHVIDYQNKTIAFS

SEQ ID NO: 127402 - protein, 185 aa, Glycine max
  Coding DNA Sequence Number=SeqID_10624
  Homolog annotation: Hit_ID=Q0ZCD0; Match level="QueryCoverage=65%, HitCoverage=10%, E-value=7e-07, Identity=30%"; Hit description =Integrase
MASNSQQFSAKNDVIVLRGVHEVATDSSSSTENKNLEGKLDALVNLVTQLAMNQKSTHVARVGGLCSSTDHHIDLCPSLQQSGVNEQPEAYDANIYNRPPQQQNQQQHNNYDLSSNKYNPGWRNHPNLRWTSPPQQQQHVPSFQNVAGPSKSYVPPPMQQQQQQSQQRQPATEAPPQPFLEELVR

SEQ ID NO: 127403 - protein, 69 aa, Glycine max
  Coding DNA Sequence Number=SeqID_10625
MEFPIVATYPSTGGRGERPKVLLPMKKMRKSHHQRLFEENIRKTKKKGSTRVLPLLLCILRCDEEFKPT

SEQ ID NO: 127404 - protein, 57 aa, Glycine max
  Coding DNA Sequence Number=SeqID_10626
PFHPGLFVGDAGGFQSPTREPLNVGGLVPPHCSLKSVVSDDACPGACFVQRDATTLS

SEQ ID NO: 127405 - protein, 404 aa, Glycine max
  Coding DNA Sequence Number=SeqID_10627
  Gene Ontology: Mol. function=transporter activity; Cellular component= integral to membrane; Biological process=transport
  Homolog annotation: Hit_ID=Q398S2; Match level="QueryCoverage=99%, HitCoverage=99%, E-value=7e-89, Identity=53%"; Hit description=Major facilitator superfamily (MFS_1) transporter
  Pfam annotation: Domain name=MFS_1; Domain location=39-370; Score =15.4; E_value=6.3e-05; Accession=PF07690.6; Description=Major Facilitator Superfamily
  Pfam annotation: Domain name=PRA1; Domain location=196-342; Score= -38.6; E_value=0.0065; Accession=PF03208.9; Description=PRA1 family protein
  Pfam annotation: Domain name=Sugar_tr; Domain location=24-404; Score=- 96.8; E_value=0.00077; Accession=PF00083.14; Description=Sugar (and other) transporter
  Pfam module annotation: Pfam domain module=MFS_1::PRA1::Sugar_tr; Domain location=39-370::196-342::24-404
MANTDSTLPHAARAAAGKTHTGRLAAASSIGTALEWYDFTVYNIMAALVFNHVFFPSFDPLVGTILAFSTYAVGYVSRPVGGFIFAISGMSPGARRLDHHAGDHGRDHGADGHAARLCAVGHLESDSAGGAALCAGHRAGRRMGRRGVALHGARRSHGEQFQEWGWRIPFLLSLLLVMFGLWLRRGVEETPTFVAMQQAEKTSHTPLKEVFLRYPRELLIAGGSRIGSDVLYALVVVFTLTYVTTVLQLPRPLALMATMVGAIGNALTVPLFGALSDRLGRRPVYIAGALLAIVWSFVFFVLLDSTQPWLIVLAVVIGLLIHAMMYGPQAAFVTEQFPSHVRYAGSSLAYTLAGIIGGGFAPLIITSLYKELGSTLWVSLYVTLALTITLFALWKAKETAHQSL

SEQ ID NO: 127406 - protein, 319 aa, Glycine max
  Coding DNA Sequence Number=SeqID_10628
  Gene Ontology: Mol. function=signal transducer activity; Cellular component=membrane; Biological process=regulation of transcription, DNA-dependent
  Homolog annotation: Hit_ID=UPI00005F9389; Match level="QueryCoverage =94%, HitCoverage=40%, E-value=5e-93, Identity=57%"; Hit description =COG2200: FOG: EAL domain
  Pfam annotation: Domain name=EAL; Domain location=61-298; Score =343.3; E_value=4e-100; Accession=PF00563.11; Description=EAL domain
MAWWHGSAAMSLCLGIALAPQDADNASDLLRFADIALYKAKNSGRNQWIFFDRDMEEKIVQRREMEHELRAALQENQLRLVYQTRYDLIAQRISAVEALVRWQHPRLGLLMPDQFIPLAEETGLISALSDWVLLNACEDIARYRPEMAVSVNISASELQDSALAERITRVLQLSGLPSQRLEIEVTENALLSDPDKTLAVMQAVKALGVRFLIDDFGTGYASLCYLRAFPFDGIKIDKSFIFPLADSPQARQVVENMIGLGKAYSLSVTAEGVETPVQMSQLQELACDAIQGYYIGRPLPLPQISTEPPQSEPALHMNI

SEQ ID NO: 127407 - protein, 231 aa, Glycine max
  Coding DNA Sequence Number=SeqID_10629
  Gene Ontology: Mol. function=two-component sensor activity; Cellular component=membrane; Biological process=two-component signal transduction system (phosphorelay)
  Homolog annotation: Hit_ID=Q3Q8J9; Match level="QueryCoverage=97%, HitCoverage=78%, E-value=9e-59, Identity=52%"; Hit description=PAS
  Pfam annotation: Domain name=MCPsignal; Domain location=48-230; Score= 9.1; E_value=4e-08; Accession=PF00015.11; Description=Methyl -accepting chemotaxis protein (MCP) signaling domain
NPDFWRKIGNGQHFVGRFERKTASGERIWLEASYNPVFDGDGKVYKVIKIASDITARVEAAKRVADIALTTSEQTSQITDNANEVLDETVRNSGLVAQQVNAAAEIGAQLTASARSISDVVETINLIASQTNILALNAAIESARAGEAGRGFSVVAGEVRRLAASTASATKQISVVVEQNADLIQQMYQQLDEVRQFVVTEQEKISVLSRSLREINSGVHEFVNVIHRLDV

SEQ ID NO: 127408 - protein, 171 aa, Glycine max
  Coding DNA Sequence Number=SeqID_10630
  Gene Ontology: Mol. function=signal transducer activity; Biological process=regulation of transcription, DNA-dependent
  Homolog annotation: Hit_ID=UPI00005FA610; Match level="QueryCoverage =97%, HitCoverage=19%, E-value=6e-27, Identity=39%"; Hit description =COG2200: FOG: EAL domain
  Pfam annotation: Domain name=CHASE4; Domain location=39-171; Score =45.3; E_value=2e-10; Accession=PF05228.3; Description=CHASE4 domain
MLLMVLLIFLSFMVALVTLCFIASDLNQQEARQNRLLLEKALQTRQEVMQFHLSDNAEWGEAYQNLHRTLNTDWAWTRQNLGESLFQTFAYEGVFVIAPRGDTVYSVIDGQLQQRDFTGWLGRQQLPALRQQLQHNDGKALSRFVVVNQQLVLLCAAWITTGGDNSVPQVP

SEQ ID NO: 127409 - protein, 269 aa, Glycine max
  Coding DNA Sequence Number=SeqID_10631
  Gene Ontology: Mol. function=transferase activity, transferring groups other than amino-acyl groups
  Homolog annotation: Hit_ID=Q35DW4; Match level="QueryCoverage=85%, HitCoverage=51%, E-value=5e-23, Identity=29%"; Hit description =Similar to acyltransferases
  Pfam annotation: Domain name=Acyl_transf_3; Domain location=2-254; Score=-71.9; E_value=0.04; Accession=PF01757.12; Description =Acyltransferase family
MLIASLLLYLAGGFFPEWSLMTPESRNLLPGLIFINPETLTQLTGIEFRSMAGSFWSLYVEALFYLIIGAVYFTLGRKYCLPALIVPMLLLSASSILKSLGHPLLIDVISKFGFIHYAWFMVGCLVYERLHGRDKRYHYALTALALLINFSYYVKNSGVVAVIPLLLVMLFFIASFYSRQIERWLSLRFFTAIGFVSYALYLIHENLMIAILIKLNGYIKNEAVMTMLPVVVASVLYYVAWLISKYAEPALRNALKWKRQPAPQAGSGL

SEQ ID NO: 127410 - protein, 162 aa, Glycine max
  Coding DNA Sequence Number=SeqID_10632
MLMCNEQYSCVGPIELLCTIIRTPDAILNLLQSTITPTHDAIMYYNGKWNIPRQGEFLGYSFTGTNPIRFGIPSGCGMEKLKDLIKQVTPTGVPPNGIHGSQLVRRLFFRQPGHSKYSENLIEYDITELKNDEDVLKVLAQSNYWKRFCTIEILAIFSKPVI

SEQ ID NO: 127411 - protein, 75 aa, Glycine max
  Coding DNA Sequence Number=SeqID_10633
MHPYKWQSGSSKSKGRDKLKRQRMAKWEAMEKENEEMERKRKEEEFIHEREWEERMNYRGWNGRRGLTRLEWFLS

SEQ ID NO: 127412 - protein, 168 aa, Glycine max
  Coding DNA Sequence Number=SeqID_10634
  Gene Ontology: Mol. function=glutathione transferase activity; Biological process=auxin mediated signaling pathway
  Homolog annotation: Hit_ID=Q9FQF0; Match level="QueryCoverage=68%, HitCoverage=67%, E-value=4e-43, Identity=61%"; Hit description =Glutathione S-transferase GST 8
  Pfam annotation: Domain name=GST_C; Domain location=31-141; Score =13.8; E_value=0.009; Accession=PF00043.15; Description=Glutathione S- transferase, C-terminal domain
MGSNNRGNSKEFLELIKSIGESQSTAEEDCIVLCEIKTLKRCINDVDTSKRKIETRSSTWKNNPILPSDPYQRALAHFWSKFIDDKDKKFFGGEEIGLVDIVVVYTAFWVPVVQEIAGLELFTSEKFPKLHNWSQEFLNHPIVKESLPPRDLVFTFFKGLYESLFGSK

SEQ ID NO: 127413 - protein, 133 aa, Glycine max
  Coding DNA Sequence Number=SeqID_10635
  Gene Ontology: Mol. function=oxidoreductase activity, acting on single donors with incorporation of molecular oxygen, incorporation of two atoms of oxygen; Biological process=electron transport
  Homolog annotation: Hit_ID=Q2DFW9; Match level="QueryCoverage=99%, HitCoverage=38%, E-value=8e-21, Identity=42%"; Hit description =Dioxygenases related to 2-nitropropane dioxygenase-like
  Subcellular localization annotation: CTP_CleavageSite=32; ConfidenceScore=5.08e-01
MDGAGIATMMKLGASGVQLGTAFVLCPESAASAAYRRALLAAGERGTVMTAAISGRQARCVRNAFCELCHDVTPEEIPDYPLTYALGKALAAAAAAHGEDGFGAQWAGQGVARVRALPAAQLVETLIAEWQQA

SEQ ID NO: 127414 - protein, 259 aa, Glycine max
  Coding DNA Sequence Number=SeqID_10636
  Gene Ontology: Mol. function=transporter activity; Cellular component= integral to membrane; Biological process=transport
  Homolog annotation: Hit_ID=Q1BJ60; Match level="QueryCoverage=41%, HitCoverage=24%, E-value=3e-39, Identity=66%"; Hit description=Major facilitator superfamily MFS_1
KAQHVEHFRTADERGAHRDNAPGHHDARNPDFGANLLHREVAWHLKQKIANKKQAACQAKHRFAQPEIFIHLQGRHADVAAIDNGDQIADDQKRQNAPDDAFYGLLLNIGHSGRAGYLHGKIPAFIPSGDSGITLQHLAVYPRRHSAGVVDGLYYPFYMEWTRHAYMREALGIDIEEEFSQGKIYMVLEYTLRFRKSLVKGDKVEVTCALEQNEKRNRVNFVQQIKVDGVVYAEATFVATCLANGRPSMPEAVTRALGL

SEQ ID NO: 127415 - protein, 122 aa, Glycine max
  Coding DNA Sequence Number=SeqID_10637
  Gene Ontology: Mol. function=nucleic acid binding; Biological process= DNA integration
MPLYAKFLKDTLTKKNRYILSDRIVMEGNCSVVIQCILPIKHKDPGVVTISCSLRLGEIEIMPTCLTLQLADRSITRPYGVIEDVLVKVKHLIFPSDFVVMDIEEDVDIPLILGHPFISTAS

SEQ ID NO: 127416 - protein, 159 aa, Glycine max
  Coding DNA Sequence Number=SeqID_10638
MGGIHEIPHHNLANFEPCLEHATEGQAVGGVPLPNTLEGPQFRPQPQPLHFAVGRGPPAMAEKGKLDQIEERLRVVERGEDYALADMEDLCLVPDVVIPLKFKVPDFDKYKGTTCPKNHLKAYYRKIGAYAKDEKLLMHFFQESLTRATVTLYTNLEPS

SEQ ID NO: 127417 - protein, 67 aa, Glycine max
  Coding DNA Sequence Number=SeqID_10639
ATIGTSKPYTGAMRGTVHEPQVNIGADQKFTPVDVFKLEKKGGDKPWDFNGLIKHQTALLPSLQNGQ

SEQ ID NO: 127418 - protein, 57 aa, Glycine max
  Coding DNA Sequence Number=SeqID_10640
MDEFDILVSLILSQTHLCLFNFHRNVSVVKTKMDASEPYTGGMRGIVHEPQLNLGAD

SEQ ID NO: 127419 - protein, 67 aa, Glycine max
  Coding DNA Sequence Number=SeqID_10641
MYSNEIGLIKKLMPLCEVQHTLHEGNQCADVLAKLGANSLSPLDALHDPPVAGRCTEGCLPKAVIHF

SEQ ID NO: 127420 - protein, 76 aa, Glycine max
  Coding DNA Sequence Number=SeqID_10642
MAQEEGTSTDQILEPSLAPVLEETQPSTPVTEPEQPIHDSSPLEENEHVIGSMTENVSQFVRLIVKECINRIPVKV

SEQ ID NO: 127421 - protein, 417 aa, Glycine max
  Coding DNA Sequence Number=SeqID_10643
  Gene Ontology: Mol. function=nucleoside-triphosphatase activity; Cellular component=membrane; Biological process=peptide transport
  Homolog annotation: Hit_ID=Q8U7K4; Match level="QueryCoverage=99%, HitCoverage=98%, E-value=0.0, Identity=68%"; Hit description=ABC transporter, nucleotide binding/ATPase protein
  Pfam annotation: Domain name=ABC_tran; Domain location=171-342; Score= 138.6; E_value=1.7e-38; Accession=PF00005.17; Description=ABC transporter
  Pfam annotation: Domain name=oligo_HPY; Domain location=345-401; Score=35.0; E_value=1.1e-07; Accession=PF08352.2; Description =Oligopeptidedipeptide transporter, C-
  Pfam annotation: Domain name=oligo_HPY; Domain location=68-125; Score= 28.7; E_value=5.6e-07; Accession=PF08352.2; Description =Oligopeptidedipeptide transporter, C-
  Pfam module annotation: Pfam domain module=ABC_tran::oligo_HPY::oligo_ HPY; Domain location=171-342::345-401::68-125
MALASNRKLLIADEPTTALDVTIQGQILDLIKTLQEEEGMSVLFITHDMGVVAEVSDRTIVMFRGDVVETGATDDIFHRGRHPYTRALLSAVPKLGSMKERLLPARFPIIDIKTGESQPVADVKDTVSGGRTPILSVKDLTTRFDIRSGLFGRKSGAVHAVEKVSFDLAEGETLSLVGESGCGKSTTGRSITRLIEPTSGDVMLDGYEVLKLDKTTLRTMRRSVQMIFQDPFASLDPRMSVGTAIMEPFIEHRLGTKQQAREKPADLLEKRQRIAIARSLMLDPKVIVADEAVSALDVSIKAQVCNLLLDLQQNLNLAFLFISHDMAVVERVSHRVAVMYLGEIVEIGPRAAVFDNPQHPYTKKLMSAVPVPDPARRQIKRNMATDEIRSPIRPVDYVPPQRLYREVSAGHLVQEAA

SEQ ID NO: 127422 - protein, 187 aa, Glycine max
  Coding DNA Sequence Number=SeqID_10644
  Homolog annotation: Hit_ID=Q8TGM6; Match level="QueryCoverage=45%, HitCoverage=68%, E-value=7e-15, Identity=52%"; Hit description =Protein TAR1
PTPGARRCRGTPRARAAIHNRDDDVSTSISTARAWATIAIRVGQCPESIGGPALTSFSSFPRGTCSLSVSRQYLALDGIYRPIGAAFPNNPTRRQRLVVRQGPGTTGLSPLSGAPFQGTWARSATEDASPDYNSDAEGDRFSWWAFPGLVGSVRARKGSSMGPELTGSHVIGLERGSSTILSRRSRP

SEQ ID NO: 127423 - protein, 463 aa, Glycine max
  Coding DNA Sequence Number=SeqID_10645
  Gene Ontology: Mol. function=endonuclease activity; Biological process=DNA-protein covalent cross-linking
  Homolog annotation: Hit_ID=Q6K1F3; Match level="QueryCoverage=96%, HitCoverage=62%, E-value=1e-169, Identity=67%"; Hit description=Gp36
  Pfam annotation: Domain name=Phage_GPA; Domain location=47-234; Score= 471.7; E_value=9e-139; Accession=PF05840.4; Description=Bacteriophage replication gene A protein (GPA)
MELEDEEGNRISLIEKYDGSVANPAIRRCELMTRIRGFENICNEMGYIGEFYTLTAPARYHATIKTGYRNRKWNGASPADTQRYLCSLWQKIRAKLHREEIRIFGIRVAEPHHDATPHWHMLMFMRPEQVERVREIMRDYACQEDSGELTTDKARKARFHAEAIDPEKGSATGYVAKYISKNIDGYALDGETDDESGKELKETAPAVSAWAARWHIRQFQFVGGAPVTVYRELRRMADSETAHGLSVEFAAAHDAADAGDWAGYVNAQGGPFVRRDELAVRTWYQASEEVNEYGEETVRIKGVFATEVGEDTPILTRLAQWKIVPKRAVDFAFDLQDAHASSRSSVNNCTGGLRSEDSNPPESFDKIDPDGMSRKVRRRLLAQIRAQQPQKLHKKLRRSDKIEAACDNLISQVRDLSGETISRGLAVRLIGGTQTEIAGRMFRSSAYGDLLRPHRGTDPSGIL

SEQ ID NO: 127424 - protein, 132 aa, Glycine max
  Coding DNA Sequence Number=SeqID_10646
  Gene Ontology: Mol. function=DNA binding; Biological process=DNA integration
  Homolog annotation: Hit_ID=Q1RVN6; Match level="QueryCoverage=84%, HitCoverage=16%, E-value=4e-09, Identity=33%"; Hit description =Integrase, catalytic region
MDMMERDLPKKGSTNTFMDNTKGPKKIWVPKKNIILAANVLDNRKQTPIMEKSVCSNAYRGGIVTFRGNQRERITGVGIKPNLLSIIQLCNSGYGVSFNKDKCVLLCHDVSPLFSSKRKGNLYKIRLGGTLR

SEQ ID NO: 127425 - protein, 97 aa, Glycine max
  Coding DNA Sequence Number=SeqID_10647
MVAITLAKVHQPPFLRQYDSNTTCACHGEAPGRSIEHCRALKRKVQDVSNDSSGFSTFTGIWVQAIGLFAQATCALEFGLPRPFNQRLLVLHVGGAA

SEQ ID NO: 127426 - protein, 92 aa, Glycine max
  Coding DNA Sequence Number=SeqID_10648
MKNATSESQILQPQLHSGICNDPGNIFRKLIKRCTKKYLSRRDKIILVVTPEAASSLLLLFHALLIAPSCGMRMDDEKFYQKSGSLLTVLAC

SEQ ID NO: 127427 - protein, 139 aa, Glycine max
  Coding DNA Sequence Number=SeqID_10649
PGGGPTLRIQSEEELGLVHDHPNTDLDDIATQQHPPQRSQFQPPPPKCQLVYAILTQFYAVPVTSTKLIWPPLNKAFIEKYCMPRQAQQQGQAQQQQASADAPPPPLGVQTGAEPAGTTGDGDGAQDDDDMADVMDFIL

SEQ ID NO: 127428 - protein, 64 aa, Glycine max
  Coding DNA Sequence Number=SeqID_10650
EMAPRKLASKRSRKDKATEGTSSAPEYDSHRFRSAVHQQRFEAIKGWSFLRERRIQLKTLKKRY

SEQ ID NO: 127429 - protein, 117 aa, Glycine max
  Coding DNA Sequence Number=SeqID_10651
  Homolog annotation: Hit_ID=Q1SP02; Match level="QueryCoverage=70%, HitCoverage=18%, E-value=4e-09, Identity=41%"; Hit description=IMP dehydrogenase/GMP reductase
  Pfam annotation: Domain name=DUF1723; Domain location=43-92; Score =49.9; E_value=8.5e-12; Accession=PF08330.1; Description=Protein of unknown function (DUF1723)
ERPELKLSSHGRKVDKFDRPAPEIEGLVAATRLSSLIACSLDTSDRGLVSTFVERWHKGTSSFLLPVGEVTITLDDVASLLHLPIIGTFHSFEAFHVDEVMDLLVDLLEVSLEEARA

SEQ ID NO: 127430 - protein, 86 aa, Glycine max
  Coding DNA Sequence Number=SeqID_10652
  Subcellular localization annotation: CTP_CleavageSite=43; ConfidenceScore=5.32e-01
PSLSLTLPFSSSSFSIEAPHKASTFGHHFCPKSRKESIFGVVKCVATSGTSKIQLGRIDGDPVLRETRIWATWEYVSSVGGGQQGM

SEQ ID NO: 127431 - protein, 141 aa, Glycine max
  Coding DNA Sequence Number=SeqID_10653
  Subcellular localization annotation: CTP_CleavageSite=21; ConfidenceScore=5.09e-01
MWKFFIVLHRSSSFFGLQTLEASKPVDMRRLTSSSAPLSSRDGKSDDMRRYLLVIHTFCQLEASEPVDTHRLTSSSAPLLSKDDKSDDMQRYLMVIRTFCQLEASEPVDMQRLTSSSAPLSSRDDKFDDMRRYLLVIHTFC

SEQ ID NO: 127432 - protein, 219 aa, Glycine max
  Coding DNA Sequence Number=SeqID_10654
  Gene Ontology: Mol. function=sugar porter activity; Cellular component=integral to membrane; Biological process=carbohydrate transport
  Homolog annotation: Hit_ID=Q2HSP6; Match level="QueryCoverage=95%, HitCoverage=64%, E-value=5e-36, Identity=64%"; Hit description=Sugar transporter superfamily; Major facilitator superfamily MFS_1
MEGGVPEADGSAFKECISLSKNNPYVLRLAFSAGIGGLLFDYDTGVISGSLLYIREDFKDVDRKTWLQIYPEGEVEAEIQNLRESTEMEIKEVEAGGKVSLVKMLKITSVRRGLYAGMGIAIFQQFVGINTVMYYSPTIAQLSGFASNQVAMLLSLITAGVNAFGSILSIYLVDKTGRKKLALISLVGVLASLVLLTVVFRHSEISSSLQLPTTINGIS

SEQ ID NO: 127433 - protein, 736 aa, Glycine max
  Coding DNA Sequence Number=SeqID_10655
  Gene Ontology: Mol. function=protein dimerization activity; Cellular component=nucleus; Biological process=transposition, DNA-mediated
  Homolog annotation: Hit_ID=Q1S5E6; Match level="QueryCoverage=77%, HitCoverage=76%, E-value=1e-109, Identity=39%"; Hit description=HAT family dimerisation domain, putative
  Pfam annotation: Domain name=hATC; Domain location=596-678; Score =115.9; E_value=1.2e-31; Accession=PF05699.5; Description=hAT family dimerisation domain
  Subcellular localization annotation: CTP_CleavageSite=45; ConfidenceScore=5.07e-01
MADSSGSMGASCPTAPIRGQRTPPESESPADSNTQSSSEGSQEVRSKIKRSHELVDQFNQEKFNSAITRMIIVDMLPFEFVENPGFREFSALLAAPVESFGEFFSALLTIPTESPVVASLQELGNNLTYDELVEFHQEFCTQALAKMIIIDELPFKFVENKGFGEFVTAFQPQFKIPSQITIVEDCMNLHRVAKAKLKFNLSQNKQMMSLTTDTWTSIHNKNYLCVTAHCIDERWELIKMILSFVLIPDHKGDTIGKALEKCLKEWEITKICTITVHNADTENLASSYLIQNMCGWNGTTLLNGEHVHLRCCTHILNSIVSDGLQEMDCCIARIRAACKYVRSFSSRYACFKRCANLANINCDQMIVLDEPTKWNSTYLMLVVAEKFEKAFNLLEFEDDSYVKSLDNEGGPPSADDWNRARVFIKVLKVFYEATLSFSGYLNVSSNSFLRMWVKIQNALRSWMENDDFGLQQMATTMKLKFDKYWDIDGNINNLLFVAIFLDPRFKFKYLEFCFGRMYGPEKCKDMLKKLEDFIKELFTQYSSSHPIIPDICESSGLSFDVTSQTIVSNDDGGNMDMDEEYGITVKKMLDELEKNELERYMKDHVEVNYDGFDILRWWKGKSTKYYVLAHMARDILAIPVSSVSFEDAFSTGDHVLDRYHSCLDPTTVEALICSKSWLSHNLRKNWDSHQTFDVVQAERDMLEDSDLEEYDATTLEALVCLNSWLSDDIGKNGDSH

SEQ ID NO: 127434 - protein, 173 aa, Glycine max
  Coding DNA Sequence Number=SeqID_10656
MEGYISVDSGVFSSLEQEQDPYEQYHVSNYQQVDDKKCINPKMGGEMVQEINKYTITENNTVPECVIEVVVQNELPKEISEGYSNNVKRPLLPLEVHDSDRACKEKHVPARFKCDRPHRIKRVNDESMKRRRSATTKIEAEVDEENEFNSMTNEELNRRVEEFIQKCRLDFRQ

SEQ ID NO: 127435 - protein, 72 aa, Glycine max
  Coding DNA Sequence Number=SeqID_10657
MSTHRRSSYREQHQQEGWKEGVISSSRNAIFGIDNVHYMVRVGVSKLNMKLVSATPGSKEKERGRGRGSAVR

SEQ ID NO: 127436 - protein, 511 aa, Glycine max
  Coding DNA Sequence Number=SeqID_10658
  Gene Ontology: Mol. function=protein binding; Cellular component =anchored to membrane; Biological process=protein amino acid phosphorylation
  Homolog annotation: Hit_ID=Q1SBD8; Match level="QueryCoverage=71%, HitCoverage=77%, E-value=2e-49, Identity=34%"; Hit description =Unnamed protein product; contains similarity to elicitor-inducible receptor EIR gene_id:T5M7.12
  Pfam annotation: Domain name=LRR_1; Domain location=114-139; Score =1.4; E_value=1.5e+02; Accession=PF00560.23; Description=Leucine Rich Repeat
  Pfam annotation: Domain name=LRR_1; Domain location=141-164; Score =9.1; E_value=5.7; Accession=PF00560.23; Description=Leucine Rich Repeat
  Pfam annotation: Domain name=LRR_1; Domain location=166-188; Score =16.1; E_value=0.12; Accession=PF00560.23; Description=Leucine Rich Repeat
  Pfam annotation: Domain name=LRR_1; Domain location=190-212; Score =19.8; E_value=0.0097; Accession=PF00560.23; Description=Leucine Rich Repeat
  Pfam annotation: Domain name=LRR_1; Domain location=214-236; Score =11.3; E_value=2.2; Accession=PF00560.23; Description=Leucine Rich Repeat
  Pfam annotation: Domain name=LRR_1; Domain location=238-260; Score =9.9; E_value=4.1; Accession=PF00560.23; Description=Leucine Rich Repeat
  Pfam annotation: Domain name=LRR_1; Domain location=262-284; Score =13.6; E_value=0.74; Accession=PF00560.23; Description=Leucine Rich Repeat
  Pfam annotation: Domain name=LRR_1; Domain location=286-308; Score =6.6; E_value=17; Accession=PF00560.23; Description=Leucine Rich Repeat
  Pfam annotation: Domain name=LRR_1; Domain location=310-332; Score =17.9; E_value=0.038; Accession=PF00560.23; Description=Leucine Rich Repeat
  Pfam annotation: Domain name=LRR_1; Domain location=334-356; Score =13.8; E_value=0.61; Accession=PF00560.23; Description=Leucine Rich Repeat
  Pfam annotation: Domain name=LRR_1; Domain location=358-383; Score =12.3; E_value=1.4; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =114-139::141-164::166-188::190-212::214-236::238-260::262-284::286 -308::310-332::334-356::358-383
MASMSLILLWFLFFASEMMSMGNSLHKGHMVMEEEELLGLFEVMDALLEDPYWAQAHPKPCTDTPWPGVECELGSNNQQIFHVTKIHIGPDIVFPFSPCKPSAYLSHSLLKLKYIKTLSIFNCFVASPVTLPKTLFGPFSSLEHLALENNPSLYGEIPTSLGGVAGLRVLSLSQNSLQGNIPSQIGGLVSLEQLDLSYNNLSGQIPKEIGGLKSMTILDLSCNAVEGFLPCSLGKLQLLQKMDLHSNRLSENIPPDIGNLKRLVLLDLSHNFIVGPISETFSSLDLLEYLLIDDNPIKGGIPQFIGKLKKLKSLSLSGCGLTGSIPYSFSSLKNLTALSLGNNSLIGQVPPNLGSLPSLDQLNISHNKLSGVLELPGDFIQKLGKRLDLRGNSELCINDQSKKKNLSSYLEIPSCLNTRQRNDDNYFAGGPLQDLSGLKPSWYDSNPTFSKSRRQECRFCDINESMLHCCNTLVTGTMKKDSHLSTCFDVLGETENLMRNSQSFYLQLAKF

SEQ ID NO: 127437 - protein, 803 aa, Glycine max
  Coding DNA Sequence Number=SeqID_10659
  Gene Ontology: Mol. function=catalytic activity; Cellular component =membrane; Biological process=metabolic process
  Homolog annotation: Hit_ID=O05174; Match level="QueryCoverage=64%, HitCoverage=99%, E-value=0.0, Identity=74%"; Hit description=RpfB protein
RHHGGDLVDLTHRCPCVRNASAFLDHLFDCGNAFAHRHHDVDQAHLLQLAGGVEVAFQHDLLGLARADPLAQEGVGAHAREQVEQHLGQAHQHAFLGDDGMAAECGLEAATQCIALDQGDAVGTGAQAGMEGMHAAHAALGIVEQAGAVAFADQAAEQFEVAPQGVRGAEAVAQVALVVDDVIDQARGEARPARLVDQVGVHVDPVDIPLGLLGDTQGRVLRGAGDDGAYCGHGSSPCDRPANRRADGEEKTPPSPAGSLYCPVARKPLLGGRITQLATENLADIGLRQLFSEFYDSGVLVTGQVCPRMFLDHFRGQVRVLLHDHDLDHFAGLLVRDTDGGDFQHARHHRDDVFDLIRPAVGVDGGGGFFRPLPVALHYLRALDAQLAHFAQRQDIAVVVLDAGIGGRDRQADGAVVLGQGERVDTGCRRGFGQAVGFDQGHAGDLLPAFGHGTLHRHATAQGELDRREVDLVEARGVEQAVEQRVDAGDGSEAGALELLDEALHVARVGDQVVAATELHEDQTVRGQREDVVQRQGGDDHFLARLDARGGQPRRRLLHVGDQVAVGQHRTLGHAGGAAGVLQEGDVVVVDLDRRKRVAAAQLERLLEADGALDVVVGHHLLDVLQHEVDDRALGAEQVAQAGGDHVPDRRVGDDLLDGVAEVVDHHQRTDAGINQLVLEFARGVQRVDVDHGQSGAQHAEGGHRVLQAVGHHQGDAVTLLELELTQQVGGELGDQRIRLTIGEDLAEAGVGGTVAEFRDGSVEDRGDRMEFVDVDFGGNAFRIALQPGTIQTHIPPPGIVMF

SEQ ID NO: 127438 - protein, 170 aa, Glycine max
  Coding DNA Sequence Number=SeqID_10660
  Gene Ontology: Mol. function=4 iron, 4 sulfur cluster binding; Cellular component=mitochondrion; Biological process=metabolic process
  Homolog annotation: Hit_ID=O50579; Match level="QueryCoverage=99%, HitCoverage=18%, E-value=6e-78, Identity=85%"; Hit description =Aconitase
  Pfam annotation: Domain name=Aconitase_C; Domain location=1-108; Score=127.6; E_value=3.6e-35; Accession=PF00694.9; Description =Aconitase C-terminal domain
MVRGTFANIRIKNLMFGGEEGGNTLYYPAGGGQPEKLAIYDAAMKYKADKVPLVVLAGKEYGTGSSRDWAAKGTLLLGVKAVIAESFERIHRSNLVGMGVLPLQFRNGENAQSLGLDGSEVIDITGLQDGASKRATVTATKADGTKKTFEVSVMLLTPKEVEYFRHGGLL

SEQ ID NO: 127439 - protein, 219 aa, Glycine max
  Coding DNA Sequence Number=SeqID_10661
  Gene Ontology: Mol. function=(S)-2-hydroxy-acid oxidase activity; Cellular component=peroxisome; Biological process=electron transport
  Homolog annotation: Hit_ID=Q84LB8; Match level="QueryCoverage=80%, HitCoverage=48%, E-value=2e-74, Identity=78%"; Hit description =Glycolate oxidase
  Pfam annotation: Domain name=FMN_dh; Domain location=11-219; Score =168.0; E_value=2.4e-47; Accession=PF01070.8; Description=FMN -dependent dehydrogenase
MFANCNEYVLYSRILLNAPTLTSFNYCGGELATARAASAAGTIMVFKDRNVVAQLVRRAERAGFKAIALTVDSPILGRREADIKNRFTLPPNLVLKNLEGLDLGKLDKTSDSSLASYVAEQIDQSLNWKDIKWLQSITSLPIVVKGVLTAEDTRIAIQAGAAGIIVSNHGARQLDYVPATIMALEEVVKAAQGKIPVFLDGGIRRGTDVFKALALGAAG

SEQ ID NO: 127440 - protein, 85 aa, Glycine max
  Coding DNA Sequence Number=SeqID_10662
MRRKSRRRTKATPQGEPPALWMALGSDPGMGKLIWVAVESQKPQMSAVATIKSQISEKLKPEAALVPEEAMKLGGRVKSQECAVK

SEQ ID NO: 127441 - protein, 181 aa, Glycine max
  Coding DNA Sequence Number=SeqID_10663
  Gene Ontology: Mol. function=(S)-2-hydroxy-acid oxidase activity; Cellular component=peroxisome; Biological process=oxidative photosynthetic carbon pathway
  Homolog annotation: Hit_ID=P05414; Match level="QueryCoverage=92%, HitCoverage=56%, E-value=4e-44, Identity=51%"; Hit description =Peroxisomal (S)-2-hydroxy-acid oxidase
  Pfam annotation: Domain name=FMN_dh; Domain location=1-181; Score= -44.3; E_value=2.2e-11; Accession=PF01070.8; Description=FMN -dependent dehydrogenase
MAHPEGMPSDFLVLKDKNVVAQLVRRAERAGFQAIALTVDSPVLGRREADIKNRFTLPPNMVFKNFERLDLGKLDKTCDSVVTTYVAVLFDRSLNWKDCFLNHEANSIYYANNVARIAIQAGAAGIIVSNQGARQLDYVPATIMALEEIGRPVMFSLAADGKAGVRKVLRMLVDELEVTIN

SEQ ID NO: 127442 - protein, 144 aa, Glycine max
  Coding DNA Sequence Number=SeqID_10664
  Gene Ontology: Mol. function=oxidoreductase activity; Cellular component=peroxisome; Biological process=electron transport
  Homolog annotation: Hit_ID=Q39640; Match level="QueryCoverage=64%, HitCoverage=25%, E-value=2e-37, Identity=80%"; Hit description =Glycolate oxidase
  Pfam annotation: Domain name=FMN_dh; Domain location=14-143; Score= -171.3; E_value=0.0001; Accession=PF01070.8; Description=FMN -dependent dehydrogenase
MDMITNVTEYEAVAKENLPKMVYDFYASGAEDQWTLKENRNAFSRILFRLRILVDLSKIDLTTTVLGFKISMPIMIAPTAKQKMAHPEASRGVSKDAKGFFKNLGACTVSMAELGAILTALELPWQRGASYDFVGIKFPRRVSL

SEQ ID NO: 127443 - protein, 303 aa, Glycine max
  Coding DNA Sequence Number=SeqID_10665
  Gene Ontology: Mol. function=diacylglycerol kinase activity; Cellular component=intracellular; Biological process=protein kinase C activation
  Homolog annotation: Hit_ID=Q2HS18; Match level="QueryCoverage=99%, HitCoverage=76%, E-value=3e-65, Identity=32%"; Hit description =Tetratricopeptide-like helical
  Pfam annotation: Domain name=PPR; Domain location=125-159; Score =28.6; E_value=2.3e-05; Accession=PF01535.11; Description=PPR repeat
  Pfam annotation: Domain name=PPR; Domain location=160-194; Score =10.4; E_value=0.43; Accession=PF01535.11; Description=PPR repeat
  Pfam annotation: Domain name=PPR; Domain location=196-230; Score =10.3; E_value=0.45; Accession=PF01535.11; Description=PPR repeat
  Pfam annotation: Domain name=PPR; Domain location=24-58; Score=26.2; E_value=0.00011; Accession=PF01535.11; Description=PPR repeat
  Pfam annotation: Domain name=PPR; Domain location=59-93; Score=9.7; E_ value=0.52; Accession=PF01535.11; Description=PPR repeat
  Pfam module annotation: Pfam domain module=PPR::PPR::PPR::PPR::PPR; Domain location=125-159::160-194::196-230::24-58::59-93
MYAECYAVMSARMVFDEMTDRDVVSWSSLIAAYVASNSPLDAFYVFREMGMENEQPNSVTLVSLLSACTKTLNLRVGESIHSYVTSNGIEMDVALGTALFEMYAKCGEIDKALLVFNSMGDKNLQSCTIMISALADHGREKDVISLFTQMEDGGLRLDSLSFAVILSACSHMGLVDEGKMYFDRMVRVYGIKPSVEHYGCMVDLLGRAGFIQEAYDIIKGMPMEPNDVILRSFLGACRNHGWVPSLDDDFLSELESELGANYVLTANVFSTCASWKDANDLRVAMKLKGLKKVPGCSWVEVQN

SEQ ID NO: 127444 - protein, 44 aa, Glycine max
  Coding DNA Sequence Number=SeqID_10666
  Gene Ontology: Mol. function=oxidoreductase activity; Cellular component=peroxisome; Biological process=electron transport
  Homolog annotation: Hit_ID=Q9LRS0; Match level="QueryCoverage=97%, HitCoverage=11%, E-value=6e-13, Identity=81%"; Hit description =Probable peroxisomal (S)-2-hydroxy-acid oxidase 1
MAIALTVDTPVLGRREADIKNRFTLPPNMVFKNFERLDLGKLDK

SEQ ID NO: 127445 - protein, 115 aa, Glycine max
  Coding DNA Sequence Number=SeqID_10667
ESHPQRHPVGPEKSNRALGFPALGSRLQDTQWTRRSPTGSWSCQALITGLCQFYGVPVTSSKGIRPPTNRAFIKKYCVSRQAQGETPQQPGDGWQQATDAPPSPLEFTLAHPQKG

SEQ ID NO: 127446 - protein, 45 aa, Glycine max
  Coding DNA Sequence Number=SeqID_10668
MKAKVHNGSLGLLPSVAPRYRVQFYLNAYGTLLIKPNDSGFSGQD

SEQ ID NO: 127447 - protein, 110 aa, Glycine max
  Coding DNA Sequence Number=SeqID_10669
  Gene Ontology: Mol. function=oxidoreductase activity; Cellular component=peroxisome; Biological process=electron transport
  Homolog annotation: Hit_ID=Q19U05; Match level="QueryCoverage=99%, HitCoverage=72%, E-value=2e-31, Identity=56%"; Hit description =Glycolate oxidase
  Pfam annotation: Domain name=FMN_dh; Domain location=1-110; Score= -212.6; E_value=0.015; Accession=PF01070.8; Description=FMN-dependent dehydrogenase
DIKWLLTITSSPILLKGVLTVEDTNSIYYANNVARVAIQAGAAEIIVSNQGARQLDYAPATIMALEEIGRPVMFSLAADGEAGVRKVLQMLVDELEVTMALSGCHSLKEI

SEQ ID NO: 127448 - protein, 368 aa, Glycine max
  Coding DNA Sequence Number=SeqID_10670
  Gene Ontology: Mol. function=oxidoreductase activity; Cellular component=peroxisome; Biological process=electron transport
  Homolog annotation: Hit_ID=Q39640; Match level="QueryCoverage=98%, HitCoverage=99%, E-value=1e-170, Identity=82%"; Hit description =Glycolate oxidase
  Pfam annotation: Domain name=FMN_dh; Domain location=14-357; Score =721.8; E_value=4.7e-214; Accession=PF01070.8; Description=FMN -dependent dehydrogenase
  Pfam annotation: Domain name=Glu_synthase; Domain location=6-345; Score=-212.6; E_value=0.0065; Accession=PF01645.7; Description =Conserved region in glutamate synthase
  Pfam annotation: Domain name=IMPDH; Domain location=45-367; Score= -229.1; E_value=0.012; Accession=PF00478.15; Description=IMP dehydrogenase  GMP reductase domain
  Pfam module annotation: Pfam domain module=FMN_dh::Glu_synthase::IMPDH ; Domain location=14-357::6-345::45-367
MDMITNVNEYEAIAKEKLPKMVYDYYASGAEDQWTLKENQNAFSRILFRPRILVDVSKIDLTATVLGFKISMPIMIAPTAMQKMAHPEGELATARAASAAGTIMTLSSWATSSVEEVASTGPDIRFFQLYVFKDRNVAAQLVRRAERAGFKAIALTVDTPILGRREADIKNRFTLPSHLVLKNFEGLDLRKLDKTSDSNVASYVAGPFDQSFNWKDIQWLQTITSLPILLKGVLTAEDTRIAVQAGVAGIIVSNHGARQLDYVPATIMALEEVVKAAQGRIPVFLDGGIRRGTDVFKALALGAAGVFIGRPVLFSLAADGEAGVRKVLQMLRDEFELTMALSGCRSLKEITRDHVVTEWDRPRFAPKL

SEQ ID NO: 127449 - protein, 72 aa, Glycine max
  Coding DNA Sequence Number=SeqID_10671
MRKNCNLELRLFPPSLSDLRPMMEAEVSERPQQQVAHHQQQQQPQPQHPLTIFYDGKISVSDVTELQTPGKK

SEQ ID NO: 127450 - protein, 48 aa, Glycine max
  Coding DNA Sequence Number=SeqID_10672
  Homolog annotation: Hit_ID=Q9C757; Match level="QueryCoverage=83%, HitCoverage=7%, E-value=1e-11, Identity=73%"; Hit description =Probable inositol transporter 2
MNVYAVPIASVTDKKDRETMRLETQIAVDAIPPHTPLNLKGCEFSTSL

SEQ ID NO: 127451 - protein, 542 aa, Glycine max
  Coding DNA Sequence Number=SeqID_10673
  Gene Ontology: Mol. function=oxidoreductase activity, acting on single donors with incorporation of molecular oxygen, incorporation of two atoms of oxygen; Cellular component=chloroplast; Biological process=abscisic ...
  Gene Ontology: Biological process=acid biosynthetic process
  Homolog annotation: Hit_ID=Q3KRR4; Match level="QueryCoverage=94%, HitCoverage=94%, E-value=0.0, Identity=79%"; Hit description=9-cis -epoxycarotenoid dioxygenase 2
  Pfam annotation: Domain name=RPE65; Domain location=102-541; Score =584.3; E_value=1.1e-172; Accession=PF03055.6; Description=Retinal pigment epithelial membrane protein
  Subcellular localization annotation: CTP_CleavageSite=48; ConfidenceScore=5.65e-01
MAALNSSTCAKPQFPHPLSSSFSSSSSLTRDLGFPTRFQKKPIRKVVDCALHSPPVIHFPNQPYNKPEITKEPTTSTAERPQWNPFQKAAAKALDMFESALLSRELNQPFPKTTDPRVQIAGNFAPVPEHPVEHSLPVIGTIPDAINGVYLRNGANPLFKPKAGHHLFDGDGMVHAVKFNDGTASYACRFTETQRLMQERKLGKPVFPKAIGELHGHSGIARLMLFYARGLCGIVDHRRGAGAANAGLVFFNGKLLAMSEDDFPYELRITASGDLETIGRYSFHGQLNSSMIAHPKVDPVSGELFTLSYDVTSKILKYFHFSPEDERKSPDIEIPLDAPTMTHDFAITENFVVIPDQQVVFKLGEMIKGGSPVIYDGEKKSRFGILPKYASDASSIVWVDSPDTFFFHFWNAWEERDKDEVVAEHEKREGEEEGAGGGNEPGGRDGEQEKVGEKNTVRIFVHSGTVAEGVGGGEGGPGEWGSEEARVRREKDEGYVMAFVHDEMTWQSELQILNALDLKLEATVMLPSRVPYGFHGTFVEAH

SEQ ID NO: 127452 - protein, 52 aa, Glycine max
  Coding DNA Sequence Number=SeqID_10674
GKGGFELLQTYRPTKTLTQSYTAALRRDQIRSILRSKRFKTTGSIQSTMRLR

SEQ ID NO: 127453 - protein, 143 aa, Glycine max
  Coding DNA Sequence Number=SeqID_10675
  Homolog annotation: Hit_ID=Q1WD20; Match level="QueryCoverage=70%, HitCoverage=59%, E-value=2e-08, Identity=40%"; Hit description =Polymorphic epithelial mucin
LEHDSTQRLTSYPAPFVNRDPEHDSMQRLTSSSAPFVNRDPEHDSTQRLTSSSAPFVNRGPSPLTHPEHDSMQRLTSSSAPFVVLTRANKLIDAKRLTSSPAPSVVLTREVRWQAKIPDGHPRLSSTEGNEFDGMRMMLVVQC

SEQ ID NO: 127454 - protein, 140 aa, Glycine max
  Coding DNA Sequence Number=SeqID_10676
MPINNGPRAKLGYDTYQVMQHEFNINPWLYALDFVRSQGQLNANDIPHGTPLGSIDYTFDRIPLTDLKCLTKTFTPGYGVNRFLLSVPGPPPDIEGRPTVLAQPEREAIAQLLCIPGQDFTRAAVKRRVRIMRANMTTLT

SEQ ID NO: 127455 - protein, 120 aa, Glycine max
  Coding DNA Sequence Number=SeqID_10677
  Homolog annotation: Hit_ID=P55826; Match level="QueryCoverage=39%, HitCoverage=8%, E-value=8e-18, Identity=87%"; Hit description =Protoporphyrinogen oxidase, chloroplast precursor
MSKSSGSKIAKFWHDNPLYALSKIYYPPIAAVSISYPKEAIRSECLMDGELKGFGQLHPCNQGVETLAEWRRKRERRRHFKEKISLEEAHHHRRPWIRAWRKKEMNEGRGREEHEILCSK

SEQ ID NO: 127456 - protein, 183 aa, Glycine max
  Coding DNA Sequence Number=SeqID_10678
MGKLDHLEERLRAIEGGKDYAFANLEELFLVPNIITPPKFKVLDFDKYKGTTCPKNHLKMYCRKMGAYAKDEELLIHFFQESLIGVAVTWYANLEPSRVHSWKDLVVAFVRQCQYNVSGRRKLQNMCKNGAQIFQRIRPKVEGPGSSSGTSMTEKKMMTMIVDTLPVFYYEKWWVTHLQALLI

SEQ ID NO: 127457 - protein, 332 aa, Glycine max
  Coding DNA Sequence Number=SeqID_10679
  Gene Ontology: Mol. function=transferase activity, transferring hexosyl groups; Cellular component=chloroplast thylakoid membrane; Biological process=metabolic process
  Homolog annotation: Hit_ID=Q6Z8Z5; Match level="QueryCoverage=81%, HitCoverage=69%, E-value=4e-88, Identity=41%"; Hit description =Putative pentatricopeptide (PPR) repeat-containing protein
  Pfam annotation: Domain name=PPR; Domain location=108-142; Score =15.8; E_value=0.1; Accession=PF01535.11; Description=PPR repeat
  Pfam annotation: Domain name=PPR; Domain location=143-177; Score=6.4; E_value=1.3; Accession=PF01535.11; Description=PPR repeat
  Pfam annotation: Domain name=PPR; Domain location=210-244; Score=8.8; E_value=0.67; Accession=PF01535.11; Description=PPR repeat
  Pfam annotation: Domain name=PPR; Domain location=38-72; Score=33.9; E_value=5.6e-07; Accession=PF01535.11; Description=PPR repeat
  Pfam annotation: Domain name=PPR; Domain location=4-37; Score=22.3; E_ value=0.0018; Accession=PF01535.11; Description=PPR repeat
  Pfam annotation: Domain name=PPR; Domain location=73-107; Score=18.4; E_value=0.027; Accession=PF01535.11; Description=PPR repeat
  Pfam module annotation: Pfam domain module=PPR::PPR::PPR::PPR::PPR::PP R; Domain location=108-142::143-177::210-244::38-72::4-37::73-107
MEPSAYNLMIGYLCEHGRTGKAETFFRQLMKKGVQDSVSFNNLICGHSKEGNPDSAFEIIKIMGRRGVARDADSYRLLIESYLRKGEPADAKTALDGMLESGHLPESSLYRSVMESLFDDGRVQTASRVMKSMVEKGVKENMDLVSKVLEALLMRGHVEEALGRIHLLMLNGCEPDFDHLLSVLCEKEKTIAALKLLDFVLERDCIIDFSIYDKVLDALLAAGKTLNAYSILCKILEKGGSTDWSSRDELIKSLNQEGNTKQADVLSRMIKGTDGGPPKRGGKRKTTCLLVILTEILRSATSQNQLCPWRARWDSFFSPAFYSYWTSVLQVL

SEQ ID NO: 127458 - protein, 60 aa, Glycine max
  Coding DNA Sequence Number=SeqID_10680
  Homolog annotation: Hit_ID=Q1RW53; Match level="QueryCoverage=90%, HitCoverage=14%, E-value=4e-11, Identity=52%"; Hit description =Cyclin-like F-box; F-box protein interaction domain
MWAMKEYKVQSSWTKSIVISVDGFAIRSFFPVCSTKSGDIVGTNVIPGLMKLSEQVEEDD

SEQ ID NO: 127459 - protein, 468 aa, Glycine max
  Coding DNA Sequence Number=SeqID_10681
  Gene Ontology: Biological process=regulation of transcription
  Homolog annotation: Hit_ID=Q70MT1; Match level="QueryCoverage=79%, HitCoverage=85%, E-value=6e-48, Identity=39%"; Hit description =Putative transcription factor
  Pfam annotation: Domain name=TCP; Domain location=36-267; Score =165.4; E_value=1.5e-46; Accession=PF03634.4; Description=TCP family transcription factor
MEEEDEILQARACKLPRRRGSDGESTNSRFHSSSWHHHNSSRIIRVSRASGGKDRHSKVMTSKGLRDRRVRLSVNTAIQFYDLQDRLGYDQPSKAVEWLIKSASDAISELPSLNNFPDTPQSDDHEKRENTADVAVGVVDGENGNGQNLSLAKSACSSNSETSKGSGLSLSRSDIRVKARERARERTTKEKEKEKEKNDESHRHHHNVVVVPHHNHNVNLVSQTASFTELLTGSDPNKGCDEANNNMMFNKAAGRLQWCSSTTPMDYFLGLSSSRTTTHNHNHLHHHQYSSSSSSGFSLAQIQLGHSLPEAMNHVSAFNNNVSGDNHNHSSSDPHLQQQHLSLIPDHLMSAVVTSSAASSHHHHHHQPSGNDYNLNSTMSSGLAGYNRGTLQSNSPSLLPHSQRFSPIDGSTVPFFIGAASSAAAVAAPAMENNNNNNHHQHQFSSVFDGSRLQLYYGHSDQKGKAKN

SEQ ID NO: 127460 - protein, 378 aa, Glycine max
  Coding DNA Sequence Number=SeqID_10682
  Gene Ontology: Mol. function=pyridoxal phosphate binding; Cellular component=cytosol; Biological process=ornithine metabolic process
  Homolog annotation: Hit_ID=Q38IW9; Match level="QueryCoverage=92%, HitCoverage=68%, E-value=1e-175, Identity=87%"; Hit description =Ornithine aminotransferase
  Pfam annotation: Domain name=Aminotran_3; Domain location=54-377; Score=315.8; E_value=7.5e-92; Accession=PF00202.11; Description =Aminotransferase class-III
MAATRPVQCLLRRVCRGSRTIGVATEVNASSSSQKIIDKEYEHSAHNYHPLPIVFAQAKGTSVWDPEGNKYLDFLSGYSAVNQGHCHPKILKALQEQAERLTVSSRAFYNDRFPDFAEYVTNMFGYDMVLPMNTGAEGVETALKLARKWGYEKKRIPKDEAIIVSCCGCFHGRTLGVISLSCDNEATRGFGPLLPGNLKVDFGDAEALEQIFKEKGEHIAAFILEPVQGEAGVIFPPDGYLKAVRDLCSKYNVLMIADEIQTGLARTGKMLACEWEEVRPDVLIHFQNNDINITCHHRVNKIYRQLLDNVNCHCTLQILGKALGGGVIPVSAVLADKDVMLCIQPGQHGSTFLPTVVKLLGYDGHLFSSLKPFISQIM

SEQ ID NO: 127461 - protein, 172 aa, Glycine max
  Coding DNA Sequence Number=SeqID_10683
  Gene Ontology: Mol. function=RNA binding
  Homolog annotation: Hit_ID=Q9FNK3; Match level="QueryCoverage=81%, HitCoverage=23%, E-value=4e-20, Identity=45%"; Hit description =Arabidopsis thaliana genomic DNA, chromosome 5, P1 clone:MCL19
  Pfam annotation: Domain name=KH_1; Domain location=58-124; Score =69.7; E_value=9.2e-18; Accession=PF00013.19; Description=KH domain
MRIDAHLGSQHLYLLAAFRKETRGKMKQRSPSDLKSMAVEAVLLMQGKINDEDDTTVSIRLLVPSKVIGCIIGKSGSIINEIRKRTKADVRISKGDKPKCADANDELVEVGGSVDCVRDALIQIILRLRDDVLRERDTGHNPSIGAESLYPGSAGLSLPSMMHSVPPVAAPM

SEQ ID NO: 127462 - protein, 43 aa, Glycine max
  Coding DNA Sequence Number=SeqID_10684
GWPTAGNKRIATTSRVHLNSSTKRLERCLQPVADQQATKPKAK

SEQ ID NO: 127463 - protein, 204 aa, Glycine max
  Coding DNA Sequence Number=SeqID_10685
  Gene Ontology: Mol. function=chitin binding; Cellular component =extracellular region; Biological process=chitin metabolic process
  Homolog annotation: Hit_ID=UPI000066154C; Match level="QueryCoverage =94%, HitCoverage=100%, E-value=2e-09, Identity=30%"; Hit description= Homolog of Homo sapiens "Keratin-associated protein 10-1
MQLARQVDGIDKLDLIRVDPWVLVPITFRGLHVLANRGLHAFTFRGLHVLALRGLHALTLGTSYPHRQRTTRPHHQRAARPHLERTTCPRLERATHPHLGGLHVLTIRGLHALTSRGLHVLALRGLHALTLGLHVLTIRGLHALTSRGLHVLVLRGLHVLTLGTSYPHRQRATRPHLERTTRPRQQRAARPHLQRTTPPRLERA

SEQ ID NO: 127464 - protein, 152 aa, Glycine max
  Coding DNA Sequence Number=SeqID_10686
MSSGPMNKSVICSQGRRVDVGLPCTAIEEKETSIYPSQLHPNAWGFILAFKRLCHRHKTILKAYEESYSNFKEIYFWLRHSKDCRDDLFIVDDNEETFMGKSKDKPMSIATLFVANGSNKKKSSNKIGLSDKGKGSIMETHSKAIHDMPPLP

SEQ ID NO: 127465 - protein, 75 aa, Glycine max
  Coding DNA Sequence Number=SeqID_10687
MLLLGNSVFGLMETANVDTPDDMMADGFMNAPEANFDGRVAEASNANADLFEEPVSRFYMYWNKFVCLLNKYFYF

SEQ ID NO: 127466 - protein, 64 aa, Glycine max
  Coding DNA Sequence Number=SeqID_10688
MSDKPERCGLRILSVKGSGVVFMHGEGVSLASTYSSIVIRKSDLRSSSRTERWLSCFYPLQDIF

SEQ ID NO: 127467 - protein, 78 aa, Glycine max
  Coding DNA Sequence Number=SeqID_10689
  Gene Ontology: Mol. function=transmembrane receptor activity; Cellular component=membrane; Biological process=apoptosis
  Homolog annotation: Hit_ID=Q1T2S3; Match level="QueryCoverage=83%, HitCoverage=4%, E-value=2e-13, Identity=56%"; Hit description=TIR; Disease resistance protein; KRAB box; Calcium-binding EF-hand; Tumor Necrosis Factor
MGSDKIEGIMLDPPQRAVVDWSGFAFEKMEWLRILIVRNTSFSYEPKHLPNHLRVLDWEEYDGNKFVCPRFKSSYNQF

SEQ ID NO: 127468 - protein, 103 aa, Glycine max
  Coding DNA Sequence Number=SeqID_10690
  Homolog annotation: Hit_ID=Q5W7C9; Match level="QueryCoverage=55%, HitCoverage=21%, E-value=2e-20, Identity=79%"; Hit description =Unknow protein
MGGLYFWERTPVEYEAPGYKLCLGMEENSESALSTNKEAISNATRNLMESSILAQDERWRHALHMQVGREVVFPVADGWKRLLIPRRLRSKRRNPPEEGLASD

SEQ ID NO: 127469 - protein, 319 aa, Glycine max
  Coding DNA Sequence Number=SeqID_10691
  Homolog annotation: Hit_ID=Q5W7C9; Match level="QueryCoverage=31%, HitCoverage=56%, E-value=4e-14, Identity=42%"; Hit description =Unknow protein
LALPEKEVIQPHLPVRLPCYDFTPVTSPAFGIPLLAVKVTTSGMASSHSVTGGELQPTIRTEDGFLELAHPRGIAILCPVHCSTHAPPVSAFPKAPLSFKRIRGMSSPGGILNALATALHGSIRTAPMSAQQSAFAVGVLSDLYAFHRSTGNPSAPTVLQLDALRPIIPDNACILCLTAAAGTELADAYSPDTVIASSPGKEVHDPPSVADHPLGPATDHRLGKLLPHQLANQTRAPPRADSSFCSSAYGVLAAVSSCCSPPKGRIELSMRFLVALLIASLFVDKADSEFSSIPRHNLYPGASYSTGVRSQKYSPPIPR

SEQ ID NO: 127470 - protein, 74 aa, Glycine max
  Coding DNA Sequence Number=SeqID_10692
MDAEFPKRCLPRSLLEWENNVVVWFYSLHDKPDNYSKGIINSALKGFNDIQGSKSKATAKWIIVKRKLLNKWPQ

SEQ ID NO: 127471 - protein, 108 aa, Glycine max
  Coding DNA Sequence Number=SeqID_10693
MTSLSNVSTSIGSIYNNVQVPYLKEKIMMFRHDSKRSLNSQISKNYKSKTSNQAWEILQQEFKGDSKAEEEVETLVEMEEAPMEGKEAMKDQIDGVEFAKGALMKRKI

SEQ ID NO: 127472 - protein, 78 aa, Glycine max
  Coding DNA Sequence Number=SeqID_10694
  Homolog annotation: Hit_ID=UPI00006A2901; Match level="QueryCoverage =40%, HitCoverage=20%, E-value=2e-10, Identity=96%"; Hit description =UPI00006A2901 related cluster
  Subcellular localization annotation: CTP_CleavageSite=11; ConfidenceScore=5.38e-01
PNPSAVRWTARAASAARAVRRVPVGGRIGNGPFGASSPGVEQSTQNCALNVKVKKFNQARVNGGSNYDSLKVAKCLVI

SEQ ID NO: 127473 - protein, 74 aa, Glycine max
  Coding DNA Sequence Number=SeqID_10695
  Subcellular localization annotation: CTP_CleavageSite=51; ConfidenceScore=5.56e-01
MSSAGSTAKPTWVQKEGQCPASDSRNNRIPLVRTSSELTVRRPGKRPRRARSQSVPRPARDEPLSPRKQLEQST

SEQ ID NO: 127474 - protein, 37 aa, Glycine max
  Coding DNA Sequence Number=SeqID_10696
MDMSRGYAHDRRIVVPCPALDKREALLGGDGQMPNLP

SEQ ID NO: 127475 - protein, 199 aa, Glycine max
  Coding DNA Sequence Number=SeqID_10697
MTTMMEAMMSMRKIMEVNTTIVVAASNATEVDPTHPSGLNPVNHSISDMVGQGGKALGSIGGPHFMQSQQLQSGHAQVPQPMGEAHEVPRDHTLADFEPHLRYATEGQAFDGIPLPNTLGGPQYRPQIQPLHFALERLPPAMVETEKLDHIEERLRAIEGGGDYAFVDMAELCPTPLSLRSSRCWILISTRGLLAPRIT

SEQ ID NO: 127476 - protein, 107 aa, Glycine max
  Coding DNA Sequence Number=SeqID_10698
  Gene Ontology: Mol. function=metal ion binding; Cellular component =cytosol; Biological process=ubiquitin cycle
  Homolog annotation: Hit_ID=Q6H890; Match level="QueryCoverage=78%, HitCoverage=26%, E-value=2e-27, Identity=67%"; Hit description=BRAP2- like protein
  Pfam annotation: Domain name=zf-UBP; Domain location=6-69; Score =44.6; E_value=3.3e-10; Accession=PF02148.9; Description=Zn-finger in ubiquitin-hydrolases and other protein
MTNANCLQESLHSVLNGNLRYKGGHAIIHWKETQHCYSLEVETKRAWDYVGDNYVHRLIQSKTDGKLVELNTQCAHADNGCGSCSSEDNAMNEAILNSKLEAVMLQD

SEQ ID NO: 127477 - protein, 58 aa, Glycine max
  Coding DNA Sequence Number=SeqID_10699
  Homolog annotation: Hit_ID=Q9SUI2; Match level="QueryCoverage=86%, HitCoverage=6%, E-value=3e-07, Identity=56%"; Hit description =Phosphatidylinositol-4-phosphate 5-kinase 7 (EC 2.7.1.68) (AtPIP5K7) ...
  Homolog annotation: Hit description=(1-phosphatidylinositol-4 -phosphate kinase 7) (PtdIns(4)P-5-kinase 7)
MGQISLDCKFLDSQHKIDYSLLLGLHFRAPENLKAFVEHHESVQRQESLPSGDGKYLH

SEQ ID NO: 127478 - protein, 90 aa, Glycine max
  Coding DNA Sequence Number=SeqID_10700
MATEIPFVGFHDGVVVEITLGFARDLLWVSRADGENKVANDKWELRDGVDAMAVDEDEGGDGGGNDGGDDGVGLLVHVDFPMLAASNLAR

SEQ ID NO: 127479 - protein, 476 aa, Glycine max
  Coding DNA Sequence Number=SeqID_10701
  Gene Ontology: Mol. function=acyltransferase activity; Cellular component=nucleus; Biological process=regulation of transcription, DNA-dependent
  Homolog annotation: Hit_ID=Q1SCF6; Match level="QueryCoverage=60%, HitCoverage=85%, E-value=6e-90, Identity=54%"; Hit description =Anthocyanin acyltransferase-like protein-related
  Pfam annotation: Domain name=Transferase; Domain location=4-473; Score=70.9; E_value=3.9e-18; Accession=PF02458.6; Description =Transferase family
MASHNIKIHDHLRVSPPSATEISLSLTFFDLFWLRFHPVERIFFYTLPTPHSNPSIFYSKLVPKLKTSLSRTLQHFPPLAGNVVWPDNTPNPTVQYTPGDSVSLVVAESEADFNHVLDNSPHEASELRCLVPHLDSSDSHASVVSFQITLFPNRGFSIGISTHHAVLDGKSSTIFVKAWASLCKTYNDDESSESSSPSLAPELKPFFDRTAIKDPSEIGLNFTVNWTEILTKFFPNENSDGRCLKLLPFPPRLEDHVRASFALTGADLEKLRKRVLSKWDIVDRGAESEPPRLSSFVLTCAYALACIAKAIHGVEKEKEKFAFAFTVDCRARLEPPIHDNYFGNCVWGHVVDAEPLDFIKEEAFAIVAKSIHSKIKMILDEGIFHGMESAFSRYESLGKDGVEIMGIAGSNRFGVYGTDFGWGKPAKVEIASVDRALTIGFAESKDGNDGVQVGLVLKKHVMDLFCTLFRQGMLDD

SEQ ID NO: 127480 - protein, 1001 aa, Glycine max
  Coding DNA Sequence Number=SeqID_10702
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=69%, E-value=0.0, Identity=41%"; Hit description =Integrase, catalytic region
  Pfam annotation: Domain name=rve; Domain location=584-744; Score =150.3; E_value=4.9e-42; Accession=PF00665.16; Description=Integrase core domain
  Pfam annotation: Domain name=zf-CCHC; Domain location=246-263; Score =12.4; E_value=0.009; Accession=PF00098.13; Description=Zinc knuckle
  Pfam annotation: Domain name=zf-CCHC; Domain location=281-298; Score =12.0; E_value=0.01; Accession=PF00098.13; Description=Zinc knuckle
  Pfam module annotation: Pfam domain module=RVT_2::Retrotrans _gag::rve::zf-CCHC::zf-CCHC; Domain location=946-1001::77-192::584 -744::246-263::281-298
MNESSVSNMESYLYLHPSENPAIALVSPVLDSTNYHSWSRSMVTALSAKNKVEFIDGSAPEPLKTDRMHGAWRRCNNMVVSWIVHSVATSIRQSILWMDKAEEIWRDLKSRYSQGDLLRISDLQQEASTMKQGTLTVTEYFTRLRVIWDEIENFRPDPICSCNIRCSCNAFTIIAQRKLEDRAMQFLRGLNEQYGNIRSHVLLMDPIPAISKIFSYVAQQERQLLGNVGPGIHFEPKEISINAAKNVCDFCGRVGHLESTCYKKHGMPSNHDTRNKNSGRKACTHCGKMGHTVDVCYRKHGYPPGYTPGYKPYGGRTTVNNLVAVENKANEDQAQHHEAHDSVRFSPEQYKALLALIQEPSAGNTAISQSKQMASISSCINTPTNPGMSLSLRTPCVSWILDSGATDHATYSLRNLHSYKQIDPITVKLPNGQCVCATHSGIVKLSSNIILQDVLYIPSFTFNIISISKLVSSVNCELIFSSTSCVLQEANNHMRIGIVEAKHGLYHLIPAQLTTKTVNSTITHPRCNVIPIDLWHFRLGHPSTERIQCMKAYYPLLRNNKDFVCNTCHHAKQKKLPFSLSHSHASHIFDLLHMDIWGPCSKPSMHGHKYFLTIVDDCSRFTWVHLMKSKAETRQIIMNFITFIETQYDGKVKIIKSDNGIEFSMHHYYASKGIIHQTTCIETPEQNGIVERKHQHLLNVTRALLFQASLPPSFWCYALPHATYLINCIPTPFLHNVSPYEKLHKHPCDISNLRVFGCLCYINTLKANRQKLDARAHPCIFIGFKMHTKGYLVYDLHSNDVSISRNITFYEDHFPYLSETQPTHLEYPAPSPESFSDKNGDPQTESLSSQPMISIPPSNEPEHNHPPSHLRRSTRTKNAPTYLQDYHREFASSTPSTSTAVRYPLSSVLSYSRLSPAHRNFVMNISSVTEPTSYADASRHDCWIKAMEAELRALQSNQTWRLTPLPSHKTAIGCRWVYKIKYRADGSIERHKARLVAKGYT

SEQ ID NO: 127481 - protein, 425 aa, Glycine max
  Coding DNA Sequence Number=SeqID_10703
  Gene Ontology: Mol. function=protein-tyrosine kinase activity; Cellular component=integral to membrane; Biological process=protein amino acid phosphorylation
  Homolog annotation: Hit_ID=Q1SSH9; Match level="QueryCoverage=75%, HitCoverage=39%, E-value=2e-56, Identity=43%"; Hit description =Tyrosine protein kinase, active site
  Pfam annotation: Domain name=LRR_1; Domain location=117-139; Score =18.5; E_value=0.024; Accession=PF00560.23; Description=Leucine Rich Repeat
  Pfam annotation: Domain name=LRR_1; Domain location=141-163; Score =15.3; E_value=0.22; Accession=PF00560.23; Description=Leucine Rich Repeat
  Pfam annotation: Domain name=LRR_1; Domain location=165-187; Score =14.3; E_value=0.45; Accession=PF00560.23; Description=Leucine Rich Repeat
  Pfam annotation: Domain name=LRR_1; Domain location=189-211; Score =16.3; E_value=0.11; Accession=PF00560.23; Description=Leucine Rich Repeat
  Pfam annotation: Domain name=LRR_1; Domain location=213-235; Score =11.5; E_value=2; Accession=PF00560.23; Description=Leucine Rich Repeat
  Pfam annotation: Domain name=LRR_1; Domain location=248-270; Score =16.6; E_value=0.092; Accession=PF00560.23; Description=Leucine Rich Repeat
  Pfam annotation: Domain name=LRR_1; Domain location=272-294; Score =14.2; E_value=0.49; Accession=PF00560.23; Description=Leucine Rich Repeat
  Pfam annotation: Domain name=LRR_1; Domain location=296-318; Score =19.2; E_value=0.014; Accession=PF00560.23; Description=Leucine Rich Repeat
  Pfam annotation: Domain name=LRR_1; Domain location=346-368; Score =15.0; E_value=0.26; Accession=PF00560.23; Description=Leucine Rich Repeat
  Pfam annotation: Domain name=LRR_1; Domain location=370-391; Score =16.4; E_value=0.11; Accession=PF00560.23; Description=Leucine Rich Repeat
  Pfam annotation: Domain name=LRR_1; Domain location=93-115; Score =9.2; E_value=5.5; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =117-139::141-163::165-187::189-211::213-235::248-270::272-294::296 -318::346-368::370-391::93-115
MATILVPVPVRVLISFLEQNSLNLVENRELVRSYQFTLGATPVPAPAPSQFLSEAYAILNCGWWNQSHSNPGDICSWEAGIQFATLNLSALKNLERLEVSYRGLRGTIPPEIGNLSKLTHLDLSNNYLDGEIPPSLGNLTQLESLIISNNKIQGFIPRELLSLKNLRVLYLSINKIQSSIPSELVSLKNLTVLYLSSNRLNGTLPISLVKFTKLEWLDISQNLLSGSLKSLLVGSHAQLVTAIKLNHHLTYLDMSYNSLDDEIPPLLGNLTHLKSLIISNNKIKGSIPRELLFLKNLTSLDLSKNRISGTLPISLSKLTKLQNRDISNNLLVGSLKLLSAGSHHSQLTTIYLSHNIISDEIPPKLGYFPSLKSLDLSYNNLTGMVPLFLNNVSYYMDISYNNLKGPVPEAFPPTLLIGNKGVCSD

SEQ ID NO: 127482 - protein, 208 aa, Glycine max
  Coding DNA Sequence Number=SeqID_10704
  Gene Ontology: Mol. function=acyltransferase activity
  Homolog annotation: Hit_ID=Q1SCF6; Match level="QueryCoverage=85%, HitCoverage=54%, E-value=3e-64, Identity=63%"; Hit description =Anthocyanin acyltransferase-like protein-related
  Subcellular localization annotation: CTP_CleavageSite=19; ConfidenceScore=5.15e-01
MASQSHNIKIHDHFSVSPPSATATSLSLKFFDLFWLRFHPVERIFFYTLPTPQSDPSIFYSKIVPKLKTSLSHTLQHFPPLAGNVVWPHDSPNPIGQYTPGDAVSVLVAESEADFNHVLDNSPHEASESRCLVPHLDSSDSHASIVSLQITLFPNKGFSIGISTHHSVLDGKSSTLFIKAWSSLCKTNDDESSESSSPSLAPELVLFL

SEQ ID NO: 127483 - protein, 479 aa, Glycine max
  Coding DNA Sequence Number=SeqID_10705
  Gene Ontology: Mol. function=acyltransferase activity; Cellular component=nucleus; Biological process=regulation of transcription, DNA-dependent
  Homolog annotation: Hit_ID=Q9LJB4; Match level="QueryCoverage=99%, HitCoverage=99%, E-value=1e-85, Identity=40%"; Hit description =Anthocyanin 5-aromatic acyltransferase-like protein
  Pfam annotation: Domain name=Transferase; Domain location=6-475; Score=78.8; E_value=1.7e-20; Accession=PF02458.6; Description =Transferase family
MASSDKSIKIHEHCLVPPPSAAATPFSVPLTFFDLHWLRFHPVERIFFYSLPLPHSDHSSFFDKVVPKLKTSLSHTLQHFLPLAGNIVWPSDSPKPIIQFNPGDGVSLVLAQCDDALFNHMLDNSPRGATESHTLVPHLESSDSLASVMSLQITLFPNKGFCIAISSHHAVLDGKSSTMFIKAWAYACKSGEEESPPSLVPEYLEPLFDRDIIKDPTGLESVFINNWTQIASQMNPSHTSNGRSLKTVPQPIKENSVRATFELARGDLEKIKKRVLSKWELVEELAEPVLASSKPTTLSTFVTTLAYVSVCIAKAIHEAQNVQKFVLGFTVDYRARLEPPIPENYFGNCVASHMVDTQPHDFIKDDGVAIVAKRIWSKIKTLDKGALNGLDTIFSRFMTMRSEGTMAIGVAGSNRFGVYETDFGWGRPSKVEITSIDRGLNIGLAESKDGRGGVEVGLALNKHVMDLFHTIFHAGLSFD

SEQ ID NO: 127484 - protein, 37 aa, Glycine max
  Coding DNA Sequence Number=SeqID_10706
MASIDRTGALCLSDSKNGDGVEVNKYSHKYSDFMKHY

SEQ ID NO: 127485 - protein, 188 aa, Glycine max
  Coding DNA Sequence Number=SeqID_10707
  Gene Ontology: Mol. function=acyltransferase activity
  Homolog annotation: Hit_ID=Q9LJB4; Match level="QueryCoverage=96%, HitCoverage=47%, E-value=3e-22, Identity=32%"; Hit description =Anthocyanin 5-aromatic acyltransferase-like protein
LEDHVRATFALTRADLEKLRKRVLSKWDIVETGEESEPPRLSSFVLTCAYAVVCIAKAIHGVKKEKEKFSFGFTVDCRARLEPPIPDNYFGNCVWGRLVDADPLDFIKEEAFVIIAKSIDRSNRFGVYGSDFGWGKPAKVEITSVDRALTIGLAESKDGNGGVEVGLVLNKHVMDLFATLFRHGVSDE

SEQ ID NO: 127486 - protein, 221 aa, Glycine max
  Coding DNA Sequence Number=SeqID_10708
  Gene Ontology: Mol. function=acyltransferase activity
  Homolog annotation: Hit_ID=Q9LRQ8; Match level="QueryCoverage=95%, HitCoverage=46%, E-value=3e-26, Identity=35%"; Hit description =Anthocyanin 5-aromatic acyltransferase/benzoyltransferase-like protein
MVCDLKPPEDATRGSFQLSRSDVEKLKQSVVFKKKGSTNLHLSTFVLSLACAWVCRVRAEEITNKSVALALTVDCRGRLEPPLPSTYFGNCVGFRLPIAETRDLLGEEGLVVAVEAVSDALETLKDGAVSGAENWSSWLLYGVGAEADVKTIGVAGSPRFEVYGSDFGWGRPKKVEMVSIEKTAVFGLSDSRNGDGIEIGFVSKKKTMETFASLFVNGLQS

SEQ ID NO: 127487 - protein, 450 aa, Glycine max
  Coding DNA Sequence Number=SeqID_10709
  Gene Ontology: Mol. function=acyltransferase activity; Cellular component=nucleus; Biological process=regulation of transcription, DNA-dependent
  Homolog annotation: Hit_ID=Q9FID1; Match level="QueryCoverage=99%, HitCoverage=100%, E-value=1e-85, Identity=39%"; Hit description =Anthocyanin acyltransferase-like protein
  Pfam annotation: Domain name=Transferase; Domain location=3-444; Score=74.9; E_value=2.6e-19; Accession=PF02458.6; Description =Transferase family
MNKVVEVLSVAPILESEELPTQTSLPLTFFDILWLRLPPVQRIFFYEFPHPTHLFFDTLLPKLKHSLSLALAHFYPLAGHLIWPLHSAKPIINYNTGDTLSLIVAESEADFNHLAGTDLYEAKEIHNLLPHLTISHEKATLLALQVTLFPNSGFSIGITSHHAVLDGRTSTSFMKSWAYLCRESQSPTSLPPELCPFFDREVVKDPNELEAKYVSDWLKHGGPNNRSLMVWDLPVPEEATRGLFQLPRSAIEKIKQIVVMSKKKGNNNTNLHLSTFVLSIAYALVCRVRAEEVKSKRVVLGVSVDCRRWLEPPLPPTYFGNCVGGRVVIVETRGLLGDEGVLVAVEALSEALETLKDGVLNGAENWSSMLFDGLATDDKTIGAAGSPRFEVYSSDFGWGRPKKVEMVSIDRTAAFSLSESKNGDGIEIGFVSKKTTMETFASLFVNGLQS

SEQ ID NO: 127488 - protein, 101 aa, Glycine max
  Coding DNA Sequence Number=SeqID_10710
  Gene Ontology: Mol. function=transferase activity
  Homolog annotation: Hit_ID=Q8GZM6; Match level="QueryCoverage=73%, HitCoverage=16%, E-value=1e-14, Identity=53%"; Hit description =Putative malonyl CoA:anthocyanidin 3-O-glucoside-6''-O- malonyltransferase
MVEISVRFSYYERNGVTIVVIDDGVLGVKWPGEVSSKRKKVAKCMRKRVFEFGKNGTKEEWGWMRELVQEDALNRWCQFIEKTSARVNTKAKLFPLNVHVR

SEQ ID NO: 127489 - protein, 63 aa, Glycine max
  Coding DNA Sequence Number=SeqID_10711
MEAKRNLNGEGDSESEQDLVTRIKSFKTRYNDKNLHVMCWNMKTWSRKFHDVEVQRPECAVLG

SEQ ID NO: 127490 - protein, 974 aa, Glycine max
  Coding DNA Sequence Number=SeqID_10712
  Gene Ontology: Cellular component=cytosol
  Homolog annotation: Hit_ID=Q10JI7; Match level="QueryCoverage=98%, HitCoverage=97%, E-value=6e-51, Identity=24%"; Hit description =Expressed protein
MSGKALKSLKDENPDLQKQIGCITGFFQLFDRHRFLTGQRSATYVQHRPTSGGSSNEIQELNGTMQKAKAKNLKSAREKQQFSTESSITSLSSSSCSSSMSSHEFNKTIQIQSPSRNQTRIPENTNSKAAKKQPHKPHQQSLHFHHIVNDSMHKEARRLSVKTGAKEEKKGQTNALKHIDSPRPLRSHKSVNGGETVANEPLHSLAKSKKKPWDSPRLSYDETFKSATKHKELPRLSLDSREGSNRGFNEGNKSQNQLKGSPRWYGRTSSTMINQLKEPETSKRSSSVVAKLMGLEALPECTQTCGSPKGTSSSSTKKNELLSRSCTSDEDKQRQRFTLPHSKKADSITNMMPYSRFAIESTPWRQPDTIQSSQLQASKGSESDIKASKSSLTVYGEIEKRVAELEFKKSGKDLRALKQILEAMQRHKYSVDIARDQASNSPSNNRNNTNLNESSKIQSPRVRQKDTASVTAEMSNSTQGSKLPIVIMKPAKVTRKPNNLSSTELSIHGKSGLSKCSPSNPTNGRLVDKQIARGISSTTKNIKDPFGQEVCSSDKNNMRTSKLMQSMKVSQDSNGECTTNYGYINVTGSPRPQKKFGLERCSRPTSPSSDSRINRREHNRQPVELSSPSSTPRHKFSTLQQRNERFSEISCHWRDFKHHVNIISDFDDKSSSASHSDIEVIRIDQSGKIISSSIQLSGMSQNNAFEELRKAETMITAEQPSPVSVLDAAFYKDDPPSPVKNKSDISKNLGEALSTDEDSEESSVDLLQEIDWIDEKLFNFNNNRDPDHKYIAQILLASGLLSGHSYSQIFHSPGHLINPKLFFALEQMKRKRPLNIEGSAKKIPRNINPEQMQRKLIFDVVNDILVQKLILDSSSALWCQPNELAGTTLKGKQLLDELCTEIDQLQPQNRNVSLVHEEENLKHHQAIWTNCCNEMPNIVLDVERLIFKDLITEVVRGEVANHPGTHCRQLVFYK

SEQ ID NO: 127491 - protein, 207 aa, Glycine max
  Coding DNA Sequence Number=SeqID_10713
MADGFDEEAIAQLLCTPGHDFARTTAGRRVRIMRSSMTTLTQMWMTLLLSNVLPRDHNSDLPLPKCQLVYAILTRMSIHVAQLIADAIYLFAVVRSSGHPQQSDPTTDHPSLHEKYCTPRQAQGDVPQGASAPPPPRQADLAEPLGVERYLQHLVRQQAANHRGQFAAEVAWPGDWPDAQAGEEPAGSPGRMDEPRMDEDMTNLFDF

SEQ ID NO: 127492 - protein, 123 aa, Glycine max
  Coding DNA Sequence Number=SeqID_10714
MLNPTQFQVKEENVQVVDDSLSEANPLSEWHLLSEAYNSLSGLRNPKRGSVRDVLAHTTSLAKPKFTYFHLASLRKLKGPRAFKTLKLAEIKHRVRERAPEEAEKIERKQLRELRLEGVKSRV

SEQ ID NO: 127493 - protein, 94 aa, Glycine max
  Coding DNA Sequence Number=SeqID_10715
MVLRSNSLTRAKRKNGAKRDIESLNRLRKGPEVWIAESTRTEQGAKFSSFWEIREFWSDCEIPRGGGDIPTPYVKGASLPWKDKTLSWEFLLCS

SEQ ID NO: 127494 - protein, 43 aa, Glycine max
  Coding DNA Sequence Number=SeqID_10716
MCKGTNYVEPKKIWVPKPQIVFVVDILEKMKDGFGIKDLGMST

SEQ ID NO: 127495 - protein, 52 aa, Glycine max
  Coding DNA Sequence Number=SeqID_10717
MTSGNLSKSTEATRLSELVLNPRLREREKTYKAEIKQKQIARWVIGCRFHVT

SEQ ID NO: 127496 - protein, 193 aa, Glycine max
  Coding DNA Sequence Number=SeqID_10718
  Gene Ontology: Mol. function=serine-type peptidase activity; Cellular component=integral to membrane; Biological process=proteolysis
  Homolog annotation: Hit_ID=Q2R135; Match level="QueryCoverage=76%, HitCoverage=68%, E-value=8e-30, Identity=44%"; Hit description =Signal peptidase I family protein, expressed
  Pfam annotation: Domain name=Peptidase_S24; Domain location=52-125; Score=29.2; E_value=1.4e-05; Accession=PF00717.13; Description =Peptidase family S24
MDNSLELIKMKTAVMILRNLEALEHIIKAGWRISKFFCFVHVTQTYLIAPAVIYGPSMLPTIDLKTAVFLMEKISPWFGKVACGDIVVLRNPQDPRRFMTKRVVGLEGDSITYISNPETYELEGDSFTHISSLDNSDKSKTILVPKGAVWVEGDNKYNSNYSRKFGPVPYDLIDGKMFWRITPLKKFGPFWNK

SEQ ID NO: 127497 - protein, 78 aa, Glycine max
  Coding DNA Sequence Number=SeqID_10719
MGEHHLVTGSNAAQMGAPMGAPAPAAYGEVFRDYRPSFIGSFSFNLAIETTFDKGWRKLSIEYDSVLAIQAFKLVKET

SEQ ID NO: 127498 - protein, 299 aa, Glycine max
  Coding DNA Sequence Number=SeqID_10720
  Gene Ontology: Mol. function=binding; Cellular component=nucleus; Biological process=regulation of transcription, DNA-dependent
  Homolog annotation: Hit_ID=Q1RVV4; Match level="QueryCoverage=99%, HitCoverage=87%, E-value=1e-110, Identity=69%"; Hit description=IMP dehydrogenase/GMP reductase
  Pfam annotation: Domain name=Arm; Domain location=168-209; Score =18.0; E_value=0.034; Accession=PF00514.13; Description=Armadillobeta- catenin-like repeat
  Pfam annotation: Domain name=Arm; Domain location=210-254; Score =18.7; E_value=0.021; Accession=PF00514.13; Description=Armadillobeta- catenin-like repeat
  Pfam annotation: Domain name=Arm; Domain location=37-77; Score=29.5; E_value=1.2e-05; Accession=PF00514.13; Description=Armadillobeta -catenin-like repeat
  Pfam module annotation: Pfam domain module=Arm::Arm::Arm; Domain location=168-209::210-254::37-77
MDPNPRTIRSLVSKLSSVSEAARIDALSQLRLMSKQSPETRPIIAQAGAIPYIAETLYSSSHPSQEDAATTLLNLSITLKEPLMSTRGVLDAIAHVISHHHTTSSPPAVQSAAATIHSLLSSVDSYRPVVGSKREIVYSLIDILRCHLSSPPRTIKDSLKALFAIALHPINRSTMINLGAVPALFSLVLKDGRVGIVEDATAVIAQVAGCEDAVDAFRKASGGVGVLADLLDLATAASMRTKENAVSALLNLVRCGGDKVAADVRDVVASGALDGIADVRDGGSVKGKNKAAELMKLLL

SEQ ID NO: 127499 - protein, 96 aa, Glycine max
  Coding DNA Sequence Number=SeqID_10721
MMPQTKLRMIQKDYLLWRSNSTSYVDVMVRKILPSSLMLGKAISLQFSTSSEFVYHARVGAEKAAKSDERLIYEASLQVNMGLRFLQDVACVGNLK

SEQ ID NO: 127500 - protein, 83 aa, Glycine max
  Coding DNA Sequence Number=SeqID_10722
VDATYETWKEVPAAQKDLIWEDIQKKAQAIQKQNTALHVLSRGGYEYLEQKLMAEKTKKKLEKLLSSEALRASLTLHLPSDDT

SEQ ID NO: 127501 - protein, 625 aa, Glycine max
  Coding DNA Sequence Number=SeqID_10723
  Gene Ontology: Mol. function=arylesterase activity; Cellular component=membrane; Biological process=electron transport
  Homolog annotation: Hit_ID=Q1GXJ6; Match level="QueryCoverage=35%, HitCoverage=44%, E-value=5e-95, Identity=72%"; Hit description =Threonine dehydratase, biosynthetic
  Pfam annotation: Domain name=Cytochrom_D1; Domain location=238-589; Score=-142.0; E_value=0.0092; Accession=PF02239.7; Description =Cytochrome D1 heme domain
  Pfam annotation: Domain name=SGL; Domain location=266-524; Score= -100.8; E_value=0.0062; Accession=PF08450.2; Description=SMP -30GluconolaconaseLRE-like region
  Pfam annotation: Domain name=Thr_dehydrat_C; Domain location=136-225; Score=113.4; E_value=6.7e-31; Accession=PF00585.9; Description=C -terminal regulatory domain of Threonine dehydratase
  Pfam annotation: Domain name=Thr_dehydrat_C; Domain location=42-131; Score=131.0; E_value=3.2e-36; Accession=PF00585.9; Description=C -terminal regulatory domain of Threonine dehydratase
  Pfam module annotation: Pfam domain module=Cytochrom_D1::SGL::Thr _dehydrat_C::Thr_dehydrat_C; Domain location=238-589::266-524::136 -225::42-131
RWCLALAGLKAYSEKYQLQGKTMIAVASGANMNFDRLRFIAERAELGEHREAVFAVTIPEAPGAFKAFCRLLGNRSITEFNYRFSDAKEAHIFVGVAVHNPAEAAEIAGKLQQAGLPTLNLSDNEMAKLHLRHLVGGHAPQAQNEVVYRFEFPEKPGALMNFLESMGHNWNISLFHYRNHGADFGRVLVGMQVPPEDKVAFAQFLQQLGYPCWDESQNPAYRLRFGRNVAWNARIKGLAPRRTRMSFLLLALVATVAACNKQEEPAAEAAAPATESAAGAVAYVSTQDAGVNVIDLATMQVTKQFDVKAQGPRGLAVTDDGKQLVVATRENGSVSVIDTATGEVVKQIEVGKNPEFVRVSGNYAFVSSEPSAKAGPPPKPGAKPEEDDDDDDEEKIPAKIAVIDLSKGEKIREITGGPETEGLEFSADGKQLVITNEADNTVTVHNIETGELVKTIPTHEYGDRPRGIKVSPDGNTYLATLEFGNKFMVMDKDFNVVRTVDTAETPYGISYDSKGERIFVATNKAKLLQVFDAKSFEKIKEVPTGNRCWHFSFTPDNKNVLLACGKSDAVFVIDADKLEVTNQVEVKNMPWGVVTFPKAMGSLESFAGGHAGKSVSQVESLSVLA

SEQ ID NO: 127502 - protein, 119 aa, Glycine max
  Coding DNA Sequence Number=SeqID_10724
MRVRLSSVIRYTSVVEGEGHEDDVDEEALPVVVAVEGNRGGGMDEEGVCAEERDKVEIVRVKVRKEKVNVMKQRMELTVVSAIISIVRGTVQPKAAIVLALGKELEAADRASCSKFLHL

SEQ ID NO: 127503 - protein, 327 aa, Glycine max
  Coding DNA Sequence Number=SeqID_10725
  Gene Ontology: Mol. function=transferase activity, transferring phosphorus-containing groups; Cellular component=membrane; Biological process=two-component signal transduction system (phosphorelay)
  Homolog annotation: Hit_ID=Q00WL2; Match level="QueryCoverage=57%, HitCoverage=59%, E-value=9e-42, Identity=43%"; Hit description =Homology to unknown gene
  Subcellular localization annotation: CTP_CleavageSite=65; ConfidenceScore=5.41e-01
MEMTMSAATCSNMTRFSGILRTTCVSSSPKRKHAKGILRNFTICASPFISSVDPIIVNSPSFQVLASNLSLADVPQRSEEWFALRKDKLTTSTFGTALGFWKGSRRPELWQEKVFASEAQIMGANNAMAWGTLKEAVAVEQYKKITGNEVSSMGFAVHSKQSCDWLGASPDGVLGCPPQLGILEVKCPYNKGKPEAGLPWSKMPFYYMPQVQGQMEIMDCEWVDLYCWTPNGSTIFRVLREREYWNLIHDMLREFWWENVVPAREALLLGREEEVKSYKPASTHQKTGVAIAKNGFGALATAFGALLYSKLTAFVQCSSKLTGILHS

SEQ ID NO: 127504 - protein, 451 aa, Glycine max
  Coding DNA Sequence Number=SeqID_10726
  Gene Ontology: Mol. function=zinc ion binding
  Homolog annotation: Hit_ID=Q8L720; Match level="QueryCoverage=95%, HitCoverage=99%, E-value=1e-106, Identity=46%"; Hit description =Expressed protein
MALNFSHRPIFSEDNLVSPMRMGIPEKSVVENCFDYGRDRSGGGASHDDILDLLPSDPFGMDISTTVTAITGWLEDLEIVDYGGYRRDELGASDGNYQLFAGLNFIWNNAMRFHASCVEEKRGFGESCSVRNDGAAAASNNFGFGSVNNYDEVSGLPATSGSGDVVRRGGGGGGGDELAPHPALSFSLGYLGLSDLLVVERVCKSLHSTVRGDPLLWRSIHVDQPLNERITDDVLLQLTNRAQGHLQCLSLVECTRITDDGLKRILEGNPKLTKLSVPGCTRLSIEGIVTILKAYNSMDTQGVKHLHIGGLYGVTQKHFEELRFLLGADSPLLPHSHKSHYYRRGNLYLSCDDDQAIDIEVCPRCQNLRLVYDCPAESCQGVEHTTQVCRACTLCIPRCSQCGRCINDSEYEETFCLELLCSSCSKQLVKCSERGDRKIGSDKSVVIHEQN

SEQ ID NO: 127505 - protein, 65 aa, Glycine max
  Coding DNA Sequence Number=SeqID_10727
LFSLLSIGKPPRWLVFAYRPLPHSLLVICHIGNWKGGLMSYLEEFESRSKGSTTLRAIGLRSTPN

SEQ ID NO: 127506 - protein, 155 aa, Glycine max
  Coding DNA Sequence Number=SeqID_10728
  Gene Ontology: Mol. function=inositol oxygenase activity; Cellular component=inclusion body; Biological process=L-ascorbic acid biosynthetic process
  Homolog annotation: Hit_ID=O82200; Match level="QueryCoverage=77%, HitCoverage=48%, E-value=1e-34, Identity=52%"; Hit description =Inositol oxygenase 2
  Pfam annotation: Domain name=DUF706; Domain location=60-155; Score= -39.8; E_value=1.7e-12; Accession=PF05153.6; Description=Family of unknown function (DUF706)
MFSLIEQPQPSRTQAEENNEHSQKITLGLVLDGDFPLLKPPSSHDGLIVPDINSNGRSFSERHKSVKEFYRQQHIGQTYEFAKKMTEEYGKLNRVEMSIRECSEAARKDYPNEDWLHLTALIHDLGKVLLLPSFGGLPQWTVVGESCPLINPIRD

SEQ ID NO: 127507 - protein, 129 aa, Glycine max
  Coding DNA Sequence Number=SeqID_10729
  Homolog annotation: Hit_ID=Q5ZDK4; Match level="QueryCoverage=30%, HitCoverage=14%, E-value=9e-09, Identity=77%"; Hit description=50S ribosomal protein L22-like
  Subcellular localization annotation: CTP_CleavageSite=34; ConfidenceScore=5.13e-01
MVQSWSRQHKSWSGKRQIRKLSPKKVNLVAALVRGMLVKDASMQLESTIKRAAKTVYQVKEFHRRDGFEVASADKMAKSCMVYFEMHLSLRKKVITKAFNGTIIVVEDDKGPERGMPSFNSELPNSNSW

SEQ ID NO: 127508 - protein, 927 aa, Glycine max
  Coding DNA Sequence Number=SeqID_10730
  Gene Ontology: Mol. function=ATPase activity, coupled to transmembrane movement of substances; Cellular component=integral to membrane; Biological process=transport
  Homolog annotation: Hit_ID=Q7FMW1; Match level="QueryCoverage=93%, HitCoverage=93%, E-value=0.0, Identity=47%"; Hit description=MRP -like ABC transporter
  Pfam annotation: Domain name=ABC_membrane; Domain location=215-484; Score=72.7; E_value=1.2e-18; Accession=PF00664.13; Description=ABC transporter transmembrane region
  Pfam annotation: Domain name=ABC_tran; Domain location=561-733; Score= 137.6; E_value=3.4e-38; Accession=PF00005.17; Description=ABC transporter
  Pfam module annotation: Pfam domain module=ABC_membrane::ABC_tran; Domain location=215-484::561-733
MAVLDALLGTVNVAFLYAILIWLLVDSLRQSTRNNHARVVLHYFKRGGPMVFAVFTVLSCAVISVMNIALAFYQYSSRRIIGFNSVSLVLTWVLATIVSFYSMRTKVRENKRFRENSDLEQEQMLLQKEEESSMEEEDEQAFTNASMWSKLAFRWLNPIFKTGRIQKLELGHIPPVPPSETAENASSVLEESLRKQKLKGGSLTKAIAYSIWKSLALNAVLAGVNTGASYIGPLLITNFVNFLLGDNGDSSIQYGLVLAFIFFLAKTAESLSQRQWYFGAQRIGIRVRAALTSLIYSKSLLMKCAGPTQGKIINLINVDVERIGDFCWYIHGVWLLPVQVILALVILYINLGGTPSFAAFGVTILVMVCNTPLANKQEGLHSKIMEAKDSRIKVTSETMKNIRILKLHSWETSFLQKLLQLRETERRWLQKYLYTCSAVATLFWTSPTLVSVVTFGACILVKTELTTATVLSALATFRILQEPIYNLPELISMIIQTKVSVDRIQEFIKEDDQNQFINRHSSKISAVAIEIKPGEYVWETNDQTHKNPTIQITGKLVIKKGQKVAICGSVGSGKSSLICCLLGEIPLVSGAVTKVYGTRSYVPQSPWIQSGTVRENILFGKQMKKDFYEDVLDGCALHQDINMWGDGDLNPVEERGINLSGGQKQRIQLARAVYNDSDIYFLDDPFSAVDAHTGTHLFKKCLMKLLYDKTVVYATHQLEFLEAADLILVMKDGKIVESGSYKDLIACPNSELVQQMAAYQETLHQINPCQEDDSASCRPCQKNQIEVAEENIQEIMEDWGRSKEEEAETGRVKWSVYSTFVISAYKGVLVPVILLCQILFQVMQMGSNYWISWATEQKGRVNNKQLMGTFALLSFGGTIFILGRTVLMAAVAVETAQRLFLGMITSVFRAPVSFFDTTPSSRIMSRL

SEQ ID NO: 127509 - protein, 400 aa, Glycine max
  Coding DNA Sequence Number=SeqID_10731
  Gene Ontology: Mol. function=ATPase activity, coupled to transmembrane movement of substances; Cellular component=integral to membrane; Biological process=transport
  Homolog annotation: Hit_ID=Q7FMW1; Match level="QueryCoverage=96%, HitCoverage=27%, E-value=1e-145, Identity=65%"; Hit description=MRP -like ABC transporter
  Pfam annotation: Domain name=ABC_tran; Domain location=179-362; Score= 161.0; E_value=3.1e-45; Accession=PF00005.17; Description=ABC transporter
  Pfam annotation: Domain name=MMR_HSR1; Domain location=180-266; Score= -21.6; E_value=0.095; Accession=PF01926.13; Description=GTPase of unknown function
  Pfam annotation: Domain name=Miro; Domain location=181-268; Score= -10.2; E_value=0.053; Accession=PF08477.3; Description=Miro-like protein
  Pfam module annotation: Pfam domain module=ABC_tran::MMR_HSR1::Miro; Domain location=179-362::180-266::181-268
MVGIRKAPIWHHFSESIAGAATIRCFNQEKLFMTKIKALIDDYSRVAFHNFGTMEWLSVRINFLFNLVFYFVLVILVTLPRSTIDPSLAGLVATYGLNLNVLQAWVIWNLCNVENKMISVERILQFSSIPSEAPLIIQDCRPEPEWPKEGKVELRNLHIRYDPAAPMVLKGVTCVFPAQKKIGVVGRTGSGKSTLVQALFRVVEPLEGCILIDGVDISKIGLQDLRSKLGIIPQDPTLFLGTVRTNLDPLEQHADQELWEVLSKCHLAEIVRRDPRLLDAPVAENGENWSVGQRQLVCLARLLLKKRRILVLDEATASIDTATDNLIQKTIREETNGCTVITVAHRIPTVIDNDRVLVLDEGTIVEYDEPAQLLQNNSSSFSKLVSEFLRRSSQSSFQKR

SEQ ID NO: 127510 - protein, 113 aa, Glycine max
  Coding DNA Sequence Number=SeqID_10732
  Gene Ontology: Mol. function=2-oxoglutarate decarboxylase activity; Cellular component=chloroplast; Biological process=menaquinone biosynthetic process
  Homolog annotation: Hit_ID=Q15KI9; Match level="QueryCoverage=87%, HitCoverage=5%, E-value=4e-34, Identity=68%"; Hit description =Chloroplast Phyllo
LDHANELSNSLKESANINTVWASLIVEECTRLGLMYLCIAPGSRPSPVAVAVASHKLITCISCFDERSLAYHAVGYGRGSHIPAVAITSSGTAVSNLLPAGDQNCGLSIIGDQ

SEQ ID NO: 127511 - protein, 108 aa, Glycine max
  Coding DNA Sequence Number=SeqID_10733
  Gene Ontology: Mol. function=ATPase activity, coupled to transmembrane movement of substances; Cellular component=integral to membrane; Biological process=transport
  Homolog annotation: Hit_ID=Q7FB56; Match level="QueryCoverage=79%, HitCoverage=10%, E-value=2e-16, Identity=41%"; Hit description =Putative multidrug resistance-associated protein 15
MVLKDVTCIFPGQKKIGIVDRTGNGKSTLVQALFQVVDPYERCILIDGVDISKIGLQVLRYQELWEVLSKCHLTELVTQDQIEEEIDSDRQPFHGANIVKGYPRMIVN

SEQ ID NO: 127512 - protein, 255 aa, Glycine max
  Coding DNA Sequence Number=SeqID_10734
  Gene Ontology: Mol. function=zinc ion binding; Cellular component =plastid; Biological process=peroxisome organization and biogenesis
  Homolog annotation: Hit_ID=Q9SR44; Match level="QueryCoverage=98%, HitCoverage=57%, E-value=5e-97, Identity=65%"; Hit description =Putative amino acid permease
  Pfam annotation: Domain name=Aa_trans; Domain location=1-242; Score =35.9; E_value=1.3e-08; Accession=PF01490.8; Description =Transmembrane amino acid transporter protein
MHSYSTIAWVASIGKGKLPDVDYGYKAHSTADGVFNFMLALGEVAFSYAGHNVVLEIQATIPSTPEKPSKKAMWKGVIFAYLGVAFCYLPVAFIGYYIFGNSVQDNILITLEKPTWLIAAANMFVIVHVIGGYQVFSMPVFDIIETFLVKHLKFSPCFTLRFVARTVFVAMSMLIAICIPFFGSLLGFLGGFAFAPTSYFLPCIIWLKLYKPKRFSLSWIVNWTCIVLGMLLMILAPIGSLRKIIVSAANYKFFS

SEQ ID NO: 127513 - protein, 84 aa, Glycine max
  Coding DNA Sequence Number=SeqID_10735
MVKAKDSIDEEDARPTSSTWNYITRKVCENPRAFFSSSNPILLEPLAHGSSDWSLPREDCITKCHVKESLVCGACLARGHLLLV

SEQ ID NO: 127514 - protein, 698 aa, Glycine max
  Coding DNA Sequence Number=SeqID_10736
  Gene Ontology: Mol. function=cation transporter activity; Cellular component=membrane; Biological process=cation transport
  Homolog annotation: Hit_ID=UPI00001622D8; Match level="QueryCoverage =81%, HitCoverage=70%, E-value=1e-103, Identity=56%"; Hit description= cation transporter/ efflux permease
  Pfam annotation: Domain name=Cation_efflux; Domain location=406-663; Score=35.9; E_value=1.1e-10; Accession=PF01545.11; Description =Cation efflux family
  Subcellular localization annotation: CTP_CleavageSite=28; ConfidenceScore=5.53e-01
MADNDHSHSHPHHHHHHHRPHRLSVPPRSTTFGGTPGTQPAFWYSSSTTPTPTPSKTRRSLSFPKSKSKSRSSVFLLLFFSLRSLYSLLPFLRSSPSFSLFPFSFLVSLLSFSLTLSFSLFSSSSTSSKDPFLHHKPKHPLLSPSLTPSQQRILVTKSILLALVFLLRFQALRYCGTASMILAELMGSIAARPRNPYRHNLRGFLSLSLGLLLLSFGWDRIECFPFSPACLTRRIWPLILPFASGFLAHYRLVDSGTTLKQLGRKRVRLITLLFTTVILFVPAVVSFFVFEAEEDSVAFGNLAWPLVNTVVFGVLLSESYSGDDNDDDDSFASSREFLVTFVCTLVLELFYFPELSLWGLLLCGLLLYVGVRDLDPFHSSNEGEFSGDMIMKPIRHVLSERKSRKIALFLLINAGYMVVEFAAGFMSNSLGLISDACHMLFDCAALAIGLYASYISRLPANNHYNYGRGRFEVLSGYTNAVFLVLVGALIVVESFERILDPQEISTNSLLVVSIGGLVVNVIGLIFFHEEHHHAHGHVLSGSSCSHSHTHTESHSHHTHHHHDHDHDHDHLHSHGHETTIHGSNQEYISVSSDCRDDSCPGDHGHHHNHNHCSHERKHHGECHDHEDKHSIPSFKHHDAAAHCHDHGEHHDQTGHSCHEDAPLVRKEHDHRHIDHNMEGIFLHVLADTMGSVGVVIST

SEQ ID NO: 127515 - protein, 205 aa, Glycine max
  Coding DNA Sequence Number=SeqID_10737
  Gene Ontology: Mol. function=helicase activity
  Homolog annotation: Hit_ID=Q1SM26; Match level="QueryCoverage=65%, HitCoverage=34%, E-value=4e-40, Identity=60%"; Hit description =Nucleic acid-binding, OB-fold
  Pfam annotation: Domain name=DUF889; Domain location=1-105; Score= -23.5; E_value=6.6e-10; Accession=PF05970.5; Description=Eukaryotic protein of unknown function (DUF889)
MECLSSDSVDKSETSEDSYFQSITTEFLTSLNTSSLPTHSIKLKIGSPIMLLRNLDQNQGLCNGTRLVVTKMAKHVIAAEIILGKNIGLAVYIPRMSMSPSQSPWPFKLLRRQFPIMLSYAMTINKSQGQSLSMVGLYLPKPFVATYPSAGGRRETRGMRVPRKEYARSRHQRLFEENVGKTGKDAIYELLSERFGSCIYARGRY

SEQ ID NO: 127516 - protein, 113 aa, Glycine max
  Coding DNA Sequence Number=SeqID_10738
  Gene Ontology: Mol. function=unspecific monooxygenase activity
  Homolog annotation: Hit_ID=O04892; Match level="QueryCoverage=88%, HitCoverage=18%, E-value=9e-29, Identity=76%"; Hit description =Cytochrome P450 like_TBP
MRTLKAEEGKGPCERHLHMGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 127517 - protein, 177 aa, Glycine max
  Coding DNA Sequence Number=SeqID_10739
  Homolog annotation: Hit_ID=Q5CEG7; Match level="QueryCoverage=58%, HitCoverage=99%, E-value=1e-43, Identity=82%"; Hit description =Senescence-associated protein
  Subcellular localization annotation: CTP_CleavageSite=52; ConfidenceScore=5.15e-01
MIGRADIEGSRSNVAMNAWLPQASYPCGNFSDTSSFKFRRTKGSIGHAFTVRIRTGNQNQTSFYPFVPHEISVLIELIIGHLRYLLTDVPPQPDSPPDNVFRPDRPAESDLGSRKRDSAPLPIHGITPTYPTPLKSFHKVGLESSSTGSSFPADSAQAQFQLAVVSLDSRQGQWESR

SEQ ID NO: 127518 - protein, 105 aa, Glycine max
  Coding DNA Sequence Number=SeqID_10740
  Gene Ontology: Mol. function=DNA binding; Biological process=DNA integration
  Homolog annotation: Hit_ID=Q1SIT1; Match level="QueryCoverage=87%, HitCoverage=31%, E-value=2e-15, Identity=43%"; Hit description =Integrase, catalytic region
LVRKKLQLSELDEIRLEAYENAKFYKEKTKKFHDSMVIKKDFMVGQKVLLYNSRLGLMSVEIKSDSTNKSFKVNGHRLKPFLTNPSLMDAVVEETSLLHPTSLSP

SEQ ID NO: 127519 - protein, 136 aa, Glycine max
  Coding DNA Sequence Number=SeqID_10741
MEPSFGVTQLKEATFLKMGIVDNFPDYGKKHIKKKVEKEPQPSSKLSPPSPRLVRILKPSQPKPASPSFKLEVLGTSTPFPSPSLALPSQPTPKPASPLPRKAEVATIAKAKHCSLTYAKKKARVEKALQKHKKKE

SEQ ID NO: 127520 - protein, 1270 aa, Glycine max
  Coding DNA Sequence Number=SeqID_10742
MEIIGNLRGIGNGKKKRMKRKLKRKVCWNRWITLVLICTFGCSEEAMNAAVYPGVSSTLVLDAYCMSVQECYSLRFEWYRVMKPEQRVHDERKWGFADIVVFVLGLYRELEVALVVGHCIGLESGLPSREKDDDLALFSEMQSREEESFLLQPSDDLEDSFSSKLRDFPDIKLGISIPGRGETSELLNADGDENDYDWLLTPPDTPLFPSLDDEPRELNVVSRGRPRSKPISISRSSTTERSYKSRRGSASPGRLSSSPHSGNNTLQSRGMSSSTPNSSPTQVLRHATPTRRSSPPTKPTTPAPRPSTPTPRRISTGSSSPALSLGIRGTSPVKTSRGNSASPKIRWQTNIPVFSSEAPLNLRTSLADQPASYVRGSSPASKNSRDSTSKFGRQSMSPTPSRSSSYIHSHDRAQSSSHSKGSVVSSSDDDLDSLQSIPVGSLDRFGSRRDGSFSNSKSPSISKKSAKMVSPSSAPKRSFDSAIRQMDRKSPQNMFRPLLSSVPSTTLYVRKANSAQHSLVSRNSSVTTSSNAICDHGTNFVPDAEGSDHNQDDMACESKILYTDIREEVFSFDKIGGLNANIGHEINDESVDVLHNKTRGPVIALDPTESEASFYHGIDKEFNESLETSHAIGDISETGGFENTTICSNCGCPLEATDQTEKNLRLCPKCSRKTTLLRHVIPEANLAVSSENSVNSTDILAEDRPSAKTDQLTVVSELPQETDVGNMRFPLGEPDAVEIQTFPSEFIQDHSQQNSLSSSLVEGSRQMPANQLEVDQSGVDDKKPDNHSSSQQLYLSNDSSNLKVDLLEGTGISVLLKRSSSSKGHVIQGRTFTATTLSYDDLSFARSSINSIRSSTGRSSYSTTSSADFSSARHSDFRVQRQSSGRKLDVDYGYDVRIRPPSPGLSFSGMSNHSYHGLGFATQETSSGNTECSILEEIPQDLREMQASENAVTDVIDSSSMGLIVVREDNLEYHDCGRTTDACSSGLVSQATGVQHDDNSVSAFPNHGSFISNDSIEDQPNNVSSVSNTETTVKDPESSFDEKHDMENSCVDGLDALVTINTSTIEESEIEGENCCQKDTGVVDVDPSLVSKCPIADFQEHSVPNSSSDCLAASVSELHASEYSLGIEGSTVTVECQDGGNARNLTLEEATNTILFCSSIIHDLAYQAATIAMEKEHSEPLEGSEPTVTILTKPNSDIKDSRSRTAGKRAMKPQKATRPKMVEVDVKSPSKIENDENIDESLTRNVGLPNKIDNVKPLPNKLESKCNCVI

SEQ ID NO: 127521 - protein, 114 aa, Glycine max
  Coding DNA Sequence Number=SeqID_10743
  Gene Ontology: Mol. function=oxidoreductase activity; Biological process=electron transport
  Homolog annotation: Hit_ID=Q0JY74; Match level="QueryCoverage=99%, HitCoverage=30%, E-value=2e-24, Identity=50%"; Hit description=NADH -dependent flavin oxidoreductase yqiG
  Subcellular localization annotation: CTP_CleavageSite=31; ConfidenceScore=5.07e-01
MAGGRCRSAPGVCAAGRLRYRLSAPDRTRCVAASVRGRGRVAATAGAPGCATVAGGDQRIAVRCRTRRHGVVSGRRLCGAGQKRAGQSGLATARSPRPAAARLRSKPAGTVRGC

SEQ ID NO: 127522 - protein, 66 aa, Glycine max
  Coding DNA Sequence Number=SeqID_10744
MTLAIANLASIISPMLCGWLAQYYGYNAMFTVTACIAFGSMLAMTLLQPEKRLQADAPPAAAQQAV

SEQ ID NO: 127523 - protein, 265 aa, Glycine max
  Coding DNA Sequence Number=SeqID_10745
  Gene Ontology: Mol. function=acyltransferase activity; Cellular component=membrane; Biological process=transposition, DNA-mediated
  Homolog annotation: Hit_ID=Q8UG93; Match level="QueryCoverage=74%, HitCoverage=94%, E-value=1e-63, Identity=60%"; Hit description =Acetyl transferase
  Pfam annotation: Domain name=Hexapep; Domain location=113-130; Score =11.4; E_value=3.2; Accession=PF00132.14; Description=Bacterial transferase hexapeptide (three rep
  Pfam annotation: Domain name=Hexapep; Domain location=168-185; Score =11.3; E_value=3.7; Accession=PF00132.14; Description=Bacterial transferase hexapeptide (three rep
  Pfam annotation: Domain name=Hexapep; Domain location=186-203; Score =12.7; E_value=1.4; Accession=PF00132.14; Description=Bacterial transferase hexapeptide (three rep
  Pfam annotation: Domain name=Hexapep; Domain location=79-96; Score =4.3; E_value=43; Accession=PF00132.14; Description=Bacterial transferase hexapeptide (three rep
  Pfam module annotation: Pfam domain module=Hexapep::Hexapep::Hexapep:: Hexapep; Domain location=113-130::168-185::186-203::79-96
  Subcellular localization annotation: CTP_CleavageSite=25; ConfidenceScore=5.03e-01
MAAWVGCSCASSTCTISPALMSGGRAAKAGAVLNSKANNGRDAFIPFSPEDLLVEQHDSIPHPAKLQHTAIDPSVRLRDTQIGQQCEILAHSYLEYSELGDFSYLGEHCCVADTQIGRFTAIANQVRIGAPNHPMDRASQHRFTYCPEYYDSHAQRDAGFFAGRRADRVIIGHDVWIGHGVIVLPGVTVGDGAVLAAGAVVSKDVPPYTIAGGVPAKPIRARFSADIAAQLQAIAWWNWPLEKLMAHLADFQSPDIAAFCQRHGR

SEQ ID NO: 127524 - protein, 300 aa, Glycine max
  Coding DNA Sequence Number=SeqID_10746
  Gene Ontology: Mol. function=nucleotide binding; Biological process =translation
  Homolog annotation: Hit_ID=Q2L097; Match level="QueryCoverage=66%, HitCoverage=55%, E-value=9e-35, Identity=36%"; Hit description =Putative lipoprotein precursor
  Pfam annotation: Domain name=ParBc_2; Domain location=29-226; Score =195.6; E_value=1.2e-55; Accession=PF08857.1; Description=Putative ParB-like nuclease
MKASLPLLALLFSTAPAFAALPPDIKAGEIVQVELAQLHPTQAAIGYRQLDYKQHRYQADPEKLFDDYCESMGQKGVKSFTPRSTLRDPASFSCKAPVGSEPGPMKTAVIGPDNQLYLTDGHHTFSNFADMAGLSTPVQVRITDDFRPLKSQAAFWQKMAAAHLVWLETPNGKIAPEALPQELGRQHMQDDEYRSLIYFVRDIGFDKPDNPPPFLEFFWGQWLSRELPLKAFNLRDRDGYAAAVKKVAEKMVSVPKDTVIAQSDNGPLTAQALGARDAVNQKALNKLSADNGKLSWAFKR

SEQ ID NO: 127525 - protein, 81 aa, Glycine max
  Coding DNA Sequence Number=SeqID_10747
MLSFTKFPSPAPDVRGFTLGIGALEPIRLGSWLFPRFLKSAPSARESDAPEVKTGCSTSEGSRLRRGLRIFEKEAEWEEEK

SEQ ID NO: 127526 - protein, 92 aa, Glycine max
  Coding DNA Sequence Number=SeqID_10748
  Gene Ontology: Mol. function=DNA binding; Biological process =metabolic process
  Homolog annotation: Hit_ID=Q49KC8; Match level="QueryCoverage=89%, HitCoverage=20%, E-value=2e-25, Identity=63%"; Hit description =Transposase
MCQPGNSRDLNVLDLGVFNAIQALQHKEAPHTIDGLFGVVVKAFKEFPTSKCNKVFLTLQSCMVEIMKAKGCNNYKIPRIKKELCKKESMED

SEQ ID NO: 127527 - protein, 406 aa, Glycine max
  Coding DNA Sequence Number=SeqID_10749
  Gene Ontology: Mol. function=transferase activity; Biological process= carbohydrate biosynthetic process
  Homolog annotation: Hit_ID=Q64UT2; Match level="QueryCoverage=52%, HitCoverage=69%, E-value=9e-37, Identity=41%"; Hit description =Glycosyltransferase
  Pfam annotation: Domain name=DUF1792; Domain location=1-223; Score =189.5; E_value=7.9e-54; Accession=PF08759.1; Description=Domain of unknown function (DUF1792)
MTLFKNIGFQSFDERLSIRLKEIMRRGTQSDNRCLLCMPDAFRGTGNMRFGSALFWFFHKAFFFRHYEHLLKKGYRYGNTSVTRPYHDYKDKQPAARIFAKFKQLFHDKKILIVEGSGTRLGLGNDLLEGARQIRRITTLNRNAFSVYNELYSNVLAHAREFDMVLISLGPTATVLAYDLSQHGIRCIDTGHIDIEYEWMRSAARTKVQVAGKNVNEVGATAQCRSGHAADSVMQRTVTDRAGDRFGAARSDSGSRMMKASSTRYTIFSLLFLIALINYIDRGALSFAANAISQEFHFSKVQLGAVLGYFGFGYLFGSLCGGFLADRLGTKKVWLMAGILWSLLEIATAWAGELGMALFGGSAIMGFAALRVLFGFSEGPAYALMNKTIAHWHRITNAVSRWELVC

SEQ ID NO: 127528 - protein, 367 aa, Glycine max
  Coding DNA Sequence Number=SeqID_10750
  Homolog annotation: Hit_ID=Q9ZUM1; Match level="QueryCoverage=50%, HitCoverage=43%, E-value=5e-31, Identity=41%"; Hit description =Expressed protein
  Pfam annotation: Domain name=Remorin_C; Domain location=246-357; Score=159.8; E_value=6.8e-45; Accession=PF03763.4; Description =Remorin, C-terminal region
MRYVEDKGCYNNNGPTQETPNSSAMYSEFHKGKDATSVSNHHHRATMGKPTPSKWDDAQKWLVGLSKGGGEKSHSKSKPRNSNADDLRLIAPVPQKENDYSSSEKEEEENDACHDFIMTNNIISANATAAQYEAEAKRVECDESNWRSNNNNNKRSSENYTIQVQPICFRDMGTEMTPIASQEPSRTGTPIRATTPATRSPIHSGASTPMRGQNGSQHVAETTRKCGNGEGSTSPCKRTHEDHQARKLSPLESRAMAWDEAERAKYMARFKREEVKIQAWENHQIRKAEMEMKKMEVKAERMKALAQERFTNKLASTKRIAEEKRANAQVKLNDKALRATERVEYIRRTGHVPSSFSLSFKLPSICW

SEQ ID NO: 127529 - protein, 705 aa, Glycine max
  Coding DNA Sequence Number=SeqID_10751
  Gene Ontology: Mol. function=ATP-dependent helicase activity; Cellular component=intracellular; Biological process=DNA recombination
  Homolog annotation: Hit_ID=Q8W028; Match level="QueryCoverage=99%, HitCoverage=76%, E-value=1e-132, Identity=58%"; Hit description =Helicase
  Pfam annotation: Domain name=DEAD; Domain location=30-197; Score =105.0; E_value=2.1e-28; Accession=PF00270.19; Description=DEADDEAH box helicase
  Pfam annotation: Domain name=Helicase_C; Domain location=219-291; Score=87.5; E_value=4.2e-23; Accession=PF00271.21; Description =Helicase conserved C-terminal domain
  Pfam annotation: Domain name=ResIII; Domain location=26-191; Score= -21.5; E_value=0.0029; Accession=PF04851.6; Description=Type III restriction enzyme, res subunit
  Pfam module annotation: Pfam domain module=DEAD::Helicase_C::ResIII; Domain location=30-197::219-291::26-191
EEAATAARKEPSEENLVKLLRLVHGYDCFRDGQVEAIKMVLAGKSSVVVLPTGAGKSLCYQLPAVILPGVTLVVSPLVALMIDQLRQLPHVIMGGLLSSTQTPEEASESLKQLRQGGIKVLFVSPERFLNEEFLSTISSLPAISLVVIDEAHCISEWSHNFRPSFMRLRASLLHKTLNVRSVLAMTATATTTTLDAIMSALDIPSTNLIQKAQLRDNFHLSVSLSYHSGISAKERSYVQELFNSNKIRVVVATVAFGMGLDKRDVGAVIHYSLPESLEEYVQEIGRAGRDGRLSYCHLFYDDETYFKLRSLTHSEGVDEYAVNKFLREVFPADKNSCGKICSLIKESASRRFDMKEEKQPLYICKGKAAYNIPPPYLRIAKSLWAMGLYLCLYKKSGFVLSFFAKSLSPKRSRLTLNQIKLRYRGQSSLSIYMTFNMLLMKPVPVMLTLLTRLELGDVQYLQLHPQINVTGTLNFHKSPPPLLAQKVSAIAVILKRSETKHGQYIFDIPTVANDMGVTAVELINQLYDLKLMGEITYEMKDLAYCYRIIEVPTDLLSLSADITRWLSEVENCKVRKMDAMFNAAYFALNLCDTMQGCSGANHTPCLQRKILDYFSGVDNADFCKKIGQSSPFLRADIKVFLQSNSQARFTPRAVARVMHGIASPAYPSTAWSKTHFWGRYTHIDFQVVMEAAKEELKNFVGKDTL

SEQ ID NO: 127530 - protein, 239 aa, Glycine max
  Coding DNA Sequence Number=SeqID_10752
  Homolog annotation: Hit_ID=Q1RTB4; Match level="QueryCoverage=38%, HitCoverage=20%, E-value=4e-08, Identity=38%"; Hit description=IMP dehydrogenase/GMP reductase
GFSNVPLMGTRGCINYNPVLAIRQLGYPMRGALSEESIVPFIAWGFSNPNARILQGVHKAWSTVQRKDKELRGSNNGIIGSYHKWLKAWTQELDWLLKLKVSSEEEAETPEESEEVKALKAKLERAQAVKEKFKTTTIMVRKECDGLRDVNVATLKLRRSERDQSRVEGMILEDKLKACQRLKKNLSEQLSRTGENMWAIIDQYKEKLSLAATYEQRLEDEYAKCRNLPFGGRAMRGPW

SEQ ID NO: 127531 - protein, 397 aa, Glycine max
  Coding DNA Sequence Number=SeqID_10753
  Gene Ontology: Mol. function=oxidoreductase activity; Cellular component=peroxisome; Biological process=response to oxidative stress
  Homolog annotation: Hit_ID=Q1QZE8; Match level="QueryCoverage=99%, HitCoverage=81%, E-value=0.0, Identity=85%"; Hit description=Catalase
  Pfam annotation: Domain name=Catalase; Domain location=1-300; Score =574.0; E_value=1.4e-169; Accession=PF00199.9; Description=Catalase
MRFSTVAGERGSPDTWRDPRGFAIKFYTSEGNYDMVGNNTPVFFIRDPMKFQHFIRSQKRRADNNLRDNDMQWDFWTLSPESAHQVTWLMGDRGIPKSWRHMNGYSSHTYMWVNAAGEKFWVKYHFKTDQGVEFLTQDNADLLAGQDGDYHTRDLFTAIKNGDFPSWTLYMQIMPFAEAETYRFNPFDLTKVWPHSDYPLIKVGKLMLNRNPTDNHAQIEQAAFEPNNLVPGIGLSPDKMLIGRVFAYADAHRARLGVNYKQIPVNAPQAPVHTYRKDGAMRINPVSDPVYAPNSKGGPAADGERYPTDSTWEAHGNMVRAPYTLRQDDDDFGQANTLVNKVLDEAARDRLVNNVSGHLLNGVEEPVLSRAFEYWRNIDQTIGDRIAQRVQTERAKR

SEQ ID NO: 127532 - protein, 412 aa, Glycine max
  Coding DNA Sequence Number=SeqID_10754
  Gene Ontology: Mol. function=protein serine/threonine kinase activity; Biological process=protein amino acid phosphorylation
  Homolog annotation: Hit_ID=Q6K5F8; Match level="QueryCoverage=100%, HitCoverage=52%, E-value=5e-17, Identity=26%"; Hit description =Putative PITSLRE alpha 2-1
MAASRHGGYRENEFKERESKLEVSRRGFANSKEDYDRVRNGGGGEVVRGGSRDRVRVRQKDIKEREGVNGGGYRSSSSRSDSGSSGLGPRRCGFSVKAVDREPGELSSESGSDDAIESEPGLKGSEVAMLEETRTLSPPVPERKRKFSPIVWDQDDKEVNELSKVRVSASAVKVAALPPPPPLPKVFRQSQSPNAPNSGVEIVPVKNRETEELQLNAASNVTLSSPSGLHSLPPKGKWDNDQEAEHPEGEDYVPTRNISSSRWAAGDNSPVDEGEILNDEEMPKSRWRVSPDLLDGRLRNKLLSPEESKVEGIERARARSSESEERGARGRTSSGDDYPGSEKDDYMEVDVQGGKSETSISHSDTDSEDEDDGRETPEPTAQPQRTFNMLQGCRSVDEFERLNKIDEGTYGV

SEQ ID NO: 127533 - protein, 61 aa, Glycine max
  Coding DNA Sequence Number=SeqID_10755
MSLDQLALTLKMLQVFMVTMCHTLISSRKWARYSKWGQNGHFGDIFQSLGPPGPLENLKVK

SEQ ID NO: 127534 - protein, 72 aa, Glycine max
  Coding DNA Sequence Number=SeqID_10756
MGSNQAPLSKKRFYQVKIKSLEVASLQELGQLMDQLQLQAFRKTYGKIWDLAMIEVSIEAIASLTQYYDQPL

SEQ ID NO: 127535 - protein, 542 aa, Glycine max
  Coding DNA Sequence Number=SeqID_10757
  Gene Ontology: Mol. function=sugar porter activity; Cellular component=integral to membrane; Biological process=ion transport
  Homolog annotation: Hit_ID=Q1QZE8; Match level="QueryCoverage=41%, HitCoverage=45%, E-value=1e-127, Identity=93%"; Hit description =Catalase
  Pfam annotation: Domain name=LamB; Domain location=319-542; Score= -125.2; E_value=0.0002; Accession=PF02264.6; Description=LamB porin
ELHTLIGFEVVFNPEFFPGGVNPHIGVTGVTVHVAPAFRNAAVAHQPGHLVRRLWRQRPEIPLHIVITQIVVGTALLRADKVLELHRVTDKEHRRVIAHHVVVAFAGVKLDREAARIAPGVRAAALAGHGGEAHHHIGFGAGLKYRRFGVTADIFCHLKIAKCTAAFGVRLTLWNTFAVEVSHLLNQVVIVQHQRAVWTDGQRMFVAGYRNASIRGGRLAIVIAHNISSFCEDNPTTKRSSEAQACPNNCAVSSEINMVMHKAKTARLALAIAGMMVGGSAAAQSLTLEQRLAQLEEKIARDEQQQKEASAGTTNTFRFSGYARSGLLVNDKGRGGRAGPAISPASSIGGDAHIGRLGNEKDHYIELGFHNQTRFSNGSWANFKALLADGSSSPDPWVQNNDNNLNIRQVYVEMGDLPSFGGAAQHASLWAGKRFDGDNFDLHFTDTDIVFLGGTGGGISNLQWNEQWRSDFSIYGRSFGDLGSSRYDDNNVQNLLLTSNQFYGNWQWMLTGMSANGNDELKGRASTTGSYALRSDDTAKHG

SEQ ID NO: 127536 - protein, 191 aa, Glycine max
  Coding DNA Sequence Number=SeqID_10758
MPHLLAEAELSGGMTPVQQQRLQQLLLSLTPWFDAILITCSTLGAAADSFRDPQQRCAVYRTDRMLADEVHRRGAPALVLCAAESTLHSTRQLFCPESLAPDQRPQVRLIPDAWAAFKAGRLDDYYTLIADAVAQGQQQGAVQVALAQVSMAGAASRFPALQRPLTSPHLALSFVLQQAKGADEGHSKPLI

SEQ ID NO: 127537 - protein, 68 aa, Glycine max
  Coding DNA Sequence Number=SeqID_10759
MADLLRRNAERLRGVIKNSNITGGGMQAGNGHNDSLSLQVHFTAGWQASPDAVPAFRTYYSPYGSRND

SEQ ID NO: 127538 - protein, 82 aa, Glycine max
  Coding DNA Sequence Number=SeqID_10760
MQNLEAITRSFLDQWRLLVLLKLIELLRDGVAKRCKASTSHSASIYWMGDNAIASVLRENELLVNEDWSMLKDLERWLKWAG

SEQ ID NO: 127539 - protein, 202 aa, Glycine max
  Coding DNA Sequence Number=SeqID_10761
  Gene Ontology: Mol. function=transporter activity; Cellular component= integral to membrane; Biological process=transport
  Homolog annotation: Hit_ID=Q6D8V7; Match level="QueryCoverage=99%, HitCoverage=43%, E-value=4e-74, Identity=68%"; Hit description =Probable transport protein
MGNSRVWMLCLIYFGFIYGLYALAFFLPTIIAGFQQQFGTTFNVMQKGLITGVPYLIAAVVMFFWSRDAARRGCKTWHIAIPAVAGGVSVPLALYMDSPFTTILVIAVTASAIFAALPNFWTLPTQFLTGASAAAAIALINTLGNVAGFSAGYITGALHDATHSYVLPMFVVGGFMVLSAVLMLFLNRRRAQPLPASFVQEQ

SEQ ID NO: 127540 - protein, 259 aa, Glycine max
  Coding DNA Sequence Number=SeqID_10762
  Gene Ontology: Mol. function=transporter activity; Cellular component= integral to membrane; Biological process=transport
  Homolog annotation: Hit_ID=Q6D8V7; Match level="QueryCoverage=85%, HitCoverage=48%, E-value=1e-105, Identity=82%"; Hit description =Probable transport protein
MFRFQFGYQPVFLVVIQPLRLTRRVHQPEQRHNPDEDCWQRYAHKHYAPALQAKQAVLLNQRGSQRCAKYHRQRLCQVEQRENFAAVARRHPQAEIKDGAREETGLGNPQQQAQRVQPFDTADPGKQQRDDAPADHDARQPAPRAELMQRQVAGHFQQDVTNKEDAGGETKLQRTEAEVLRHAVWAGKGNGGAIEEVDKEHQRHKRYQAPGDFADCGLLNRADSRVIHNAPPKRAQVDGVGQAQNRRWRQTKCEGHANK

SEQ ID NO: 127541 - protein, 685 aa, Glycine max
  Coding DNA Sequence Number=SeqID_10763
  Gene Ontology: Mol. function=hydrolase activity; Cellular component =cytosol; Biological process=nitrogen compound metabolic process
  Homolog annotation: Hit_ID=Q7XAC5; Match level="QueryCoverage=99%, HitCoverage=98%, E-value=0.0, Identity=68%"; Hit description=Embryo -specific urease
  Pfam annotation: Domain name=Amidohydro_1; Domain location=405-683; Score=37.9; E_value=3.6e-08; Accession=PF01979.10; Description =Amidohydrolase family
  Pfam annotation: Domain name=Urease_alpha; Domain location=281-399; Score=257.6; E_value=2.5e-74; Accession=PF00449.10; Description =Urease alpha-subunit, N-terminal domain
  Pfam annotation: Domain name=Urease_beta; Domain location=157-261; Score=177.4; E_value=3.4e-50; Accession=PF00699.10; Description =Urease beta subunit
  Pfam annotation: Domain name=Urease_gamma; Domain location=1-124; Score=206.7; E_value=5.2e-59; Accession=PF00547.9; Description =Urease, gamma subunit
  Pfam module annotation: Pfam domain module=Amidohydro_1::Urease _alpha::Urease_beta::Urease_gamma; Domain location=405-683::281 -399::157-261::1-124
MKLSPREVEKLGLHNAGYLAQKRLARGLRLNYTEAVSFIVTQVLNIGCGCVAVSWRLLISWTNAITAIMEFARDGEKTVAQLMCIGKHLLGRQVLPEVQHLLNAVQVEATFPDGTKLVTVHDPISCEHGDLEQALFDSFLPVPSLDKIAEIMEDNRIPGEIKYGDGSLVLNPGRKAVILKVVNNGDRPIQGSHYHFIEVNPYLTFDRRKSYGMRLNISAGTAVRFEVQFYIGDTKSVNLVSIGDNKVIRGGNGIADGGFGHKEEENASEGITGDSDSPFTTIIPREEYTNKYGPTTDKIRLGDTDLFAEIEKDFLYGNECVFGGGKVLRDRMGQSCGHPPAISLDTVITNAVIIDYSGIIKAYIGIKDGLIVSIGKAGNPDIMDGVFFNMIMGANTEVIAGEGLIVTAGAIDCHVPLNIDEWSRKCRADIISLYMQMNLMEFNESLFTLYVGITTLVGGGTGPTAGTRATTCTPAPSQMKLMLQSTDDLPLNFGFTGKGSSSKPDELHEIIKAGAMGLKLHEDWGSASAAIDSAGGGHAPDIIKVCGMKNVLPSSTNPTRPFTVNTIDEYLDMLMVCHHLNREIPEDLAFACSRIREGTIAAEDILHDIGAISIISSDSQAMGRVGEAELNALYGLNKRVEAVGNVRKLTKLDMKLNDSLPQITADPEKYTVTADGENLTSFATT

SEQ ID NO: 127542 - protein, 425 aa, Glycine max
  Coding DNA Sequence Number=SeqID_10764
  Gene Ontology: Mol. function=extracellular ligand-gated ion channel activity; Cellular component=membrane; Biological process=transport
MTNLQIQTEEPPLSQTPLLISIQQQLQNQNEGNSNNNNNNNVNKKNEDVQVDADGEIEEDQSKVEASLVRLDRFLTVLGFNQDSPLSFVVSWSVFAAVGVVAPLLALSMCDCPECDRYEIQSFEMAIVAFQASLAAVSLLCLSHNLRKYGLRRFLFVDRYSGKMHCFHRDYVARISGSMRMLFLWVLPCFILKTVREIIRIFYVQHGSWWLSLAILSALIISWTYMSTISLSACILFHLVCSLQVIHFDDYGKLLQRESDVLVFMEEHIRLRYHLSKISHRFRIYLLLEFLVVTASQVVTLLQVTGYGQMLTFINGGDFAVSTLVQVVGIIICLHAATRISHRAQNIVSVASRWHAMLTCTSSDAPSQLRSSASAGSLEAANHLNAIQVDYSESDLESMDYAGMFTNTQWTSYVSSHHKRQAFGV

SEQ ID NO: 127543 - protein, 786 aa, Glycine max
  Coding DNA Sequence Number=SeqID_10765
  Gene Ontology: Mol. function=ubiquitin-protein ligase activity; Cellular component=ubiquitin ligase complex; Biological process =protein ubiquitination
  Homolog annotation: Hit_ID=Q6Z2G6; Match level="QueryCoverage=97%, HitCoverage=97%, E-value=3e-76, Identity=28%"; Hit description =Armadillo repeat containing protein-like
  Pfam annotation: Domain name=Arm; Domain location=476-520; Score =10.2; E_value=0.65; Accession=PF00514.13; Description=Armadillobeta -catenin-like repeat
  Pfam annotation: Domain name=Arm; Domain location=522-560; Score=5.9; E_value=2.2; Accession=PF00514.13; Description=Armadillobeta-catenin -like repeat
  Pfam annotation: Domain name=Arm; Domain location=561-602; Score =14.7; E_value=0.18; Accession=PF00514.13; Description=Armadillobeta -catenin-like repeat
  Pfam annotation: Domain name=Arm; Domain location=645-686; Score=2.0; E_value=6.8; Accession=PF00514.13; Description=Armadillobeta-catenin -like repeat
  Pfam annotation: Domain name=U-box; Domain location=302-374; Score =67.1; E_value=5.8e-17; Accession=PF04564.6; Description=U-box domain
  Pfam module annotation: Pfam domain module=Arm::Arm::Arm::Arm::U-box; Domain location=476-520::522-560::561-602::645-686::302-374
MDVAEVEENLFAASDAKLHGQMCKTLSIIYCKVLSVFPSLEAARPRSKSGIQALCSLHVALEKVKNVLQHCSECILFADYVSKYSFYFSLSREAVLSCWQAITGDSVLLKFEKAKCALEDSLRRVEDIVPQSIGCQVQEIVNEFATIEFALDPSEKQVGDDLIALLQQGRKLNDSNDSNELESFHQAATRLGIASSRAALAERRALKKLIVRARSEEDKRKESIIAYLLHLMRKYSKLFRNEFSDDNDSQGSAPCSPSVQGSIEDSVPGSHCQAFDRQLSKLSCFNFKPNNSRKSGQMPLPPEELRCPISLQLMYDPVTIASGQTYERVWIEKWFSDGHNNCPKTQQKLSHLCLTPNYCVKGLVASWCEQNGVPIPEGPPESLDLNYWGMVLSESESTNSKSIDSVSYCKLKGVLVVPLEESGISEEYVENGTESVSAQEEDSEQYFSFLKVLTEGNNWRKQCEVVEQLRLLLRDDEEARIFMGANGFVEALLQFLQSALREGSLMALESGAMALFNLAVNNNRNKEIMLSAGVLSLLEEMISKTSSYGCTTALYLNLSCLEEAKPMIGVTQAVQFLIQLLQSDSDVQCKQDSLHALYNLSTVPSNIPCLLSFGIISGLQSLLVGEGDSIWTEKCVAVLINLATSQVGREEIVSTPGLIGALASILDTGELIEQEQAVSCLLILCNRSEECSEMVLQEGVIPALVSISVNGTPRGQEKAQKLLMLFREQRRDPSPVKTHKCPPETASDLSMPPAEMKPICKSILRRKSGRAFSFFWKNKSYSVYQC

SEQ ID NO: 127544 - protein, 829 aa, Glycine max
  Coding DNA Sequence Number=SeqID_10766
  Gene Ontology: Mol. function=oxidoreductase activity, acting on single donors with incorporation of molecular oxygen, incorporation of two atoms of oxygen; Cellular component=chloroplast; Biological process=fatty acid biosynthetic process
  Homolog annotation: Hit_ID=Q9FEN8; Match level="QueryCoverage=87%, HitCoverage=99%, E-value=1e-154, Identity=67%"; Hit description =Lipoxygenase
  Pfam annotation: Domain name=Lipoxygenase; Domain location=232-813; Score=780.6; E_value=9.5e-232; Accession=PF00305.9; Description =Lipoxygenase
  Pfam annotation: Domain name=PLAT; Domain location=120-220; Score =44.0; E_value=5e-10; Accession=PF01477.13; Description=PLATLH2 domain
  Pfam module annotation: Pfam domain module=Lipoxygenase::PLAT; Domain location=232-813::120-220
  Subcellular localization annotation: CTP_CleavageSite=41; ConfidenceScore=5.73e-01
MLALKPLPSDLSLRPSPATLAINRRRRIQFPASVRRSVDVKAAVSGGDKSQTTSTTTTSPSLDSKERKGKSSVASSGSGIDEEGIQVKAVVTIRKKMKENITEKLGDQWENMVNGFGQGIQIQLISEEIHPVTNSGKSVQSYVRGWLPKPSNVAYIVEYSAEFSVPSDFGCPGAVLVTNLHGKEFYLVEIIVHGFSGGPIFFPANTWIHSRNDNPETRIIFKNKAYLPSQTPAGIKDLRREDLLSIRGTQHGQRKQHDRIYDYATYNDLGNPDKDEELARPVLGGHEMPYPRRCRTGRPPTLSACLMGCVIGAMSMQLDPLSESRIEKPHPVYVPRDETFEEIKQDTFSAGRLKALFHNLLPSLAATLSSSDVPFKCFSDIDKLYIDGVVLRDEEQKGVMENLLVGKVMKQVLSAGESLLKYEIPAVIKGDKFCWLRDNEFARQTLAGVNPVNIELLKEFPIRSKLDPSLYGPSESAITKELLEQELGGMNLEQAIEEKRLFILDYHDMLLPFIKKMNSLPGRKAYASRTILFNTKTGGIIEASFSPGKYAMELSSAAYKKLWRFDMESLPADLIRRGMAVDDPSMPCGVKLVIDDYPYAADGLLIWSAIKEWVESYVAHFYSDPNSVTSDVELQAWWREIKLKGHSDKKNEPWWPKLDTKEDLSGILTTMIWIASGQHAAINFGQYPFGGYVPNRPTLMRKLIPQENDPDYEKFIQNPQLVFLSSLPTQLQATKVMAVQDTLSTHSPDEEYLGQLKPLQNHWINDHEIMELFNKFSARLEEIEEIINARNKDPRLRNRSGAGVPPYELLLPSSGPGVTGRGIPNSISI

SEQ ID NO: 127545 - protein, 53 aa, Glycine max
  Coding DNA Sequence Number=SeqID_10767
MNSHSDIQAGIYRIAKEISVGQQVHKHIFKFMPYKADQFLSNGGNLGRKASGF

SEQ ID NO: 127546 - protein, 380 aa, Glycine max
  Coding DNA Sequence Number=SeqID_10768
  Gene Ontology: Mol. function=mannosyl-oligosaccharide glucosidase activity; Cellular component=endoplasmic reticulum; Biological process=oligosaccharide metabolic process
  Homolog annotation: Hit_ID=Q940D4; Match level="QueryCoverage=86%, HitCoverage=38%, E-value=1e-106, Identity=55%"; Hit description =Alpha-glucosidase I
  Pfam annotation: Domain name=Glyco_hydro_63; Domain location=58-380; Score=-375.8; E_value=7.9e-07; Accession=PF03200.6; Description =Mannosyl oligosaccharide glucosidase
MTGSGRSSVRSRARSLSDSDADADSLRQKRPPLNRHRERSKYGSYIPIYSNANLKVLLGICFVAFFIIWFMIHHLSNSVTEPKLPRAVTPFPAPKIMDLPQFEGEHKESLYWGTYRPHVYLGIRARTPKSLMAGLMWIGVKDGKYHLRHVCRHEDDLSTYGWTRHNGRDFGHQVLVDHGMTLTTEFLKSKEEGSGYGGDWAVRINMQIDKSKWNEGFGRGAQLFFYLADEAGNALDVSRENLNIHEDSLLASGSRADIGDWQLHLKSTDDLQLHYAGFRIPHLHNLSDPVEENLASQIQKHARLQLSDSLDDSPNVLVFQIIGGFPFTTDIVLISGTDLETSREEERVSMLTGTSLSNKLKYKEQEFDEKFEKIFNLTEK

SEQ ID NO: 127547 - protein, 113 aa, Glycine max
  Coding DNA Sequence Number=SeqID_10769
  Gene Ontology: Mol. function=mannosyl-oligosaccharide glucosidase activity; Cellular component=endoplasmic reticulum; Biological process=oligosaccharide metabolic process
  Homolog annotation: Hit_ID=Q8RZJ2; Match level="QueryCoverage=87%, HitCoverage=11%, E-value=5e-46, Identity=82%"; Hit description =Putative alpha-glucosidase 1
MSYWSAELYTAVPSRSFFPRGFLWDEGFHQLIIWRWDIHISLDIIGHWLDLINVDGWIPREQILGAEALSRVPEEFVPQHPTNGNPPTLFLALNGYNKQSHSLSLESRTPGCM

SEQ ID NO: 127548 - protein, 166 aa, Glycine max
  Coding DNA Sequence Number=SeqID_10770
MAHSKMVLIPKTILECGSFKDNFLTYGDLDDDGNPRVDLESSFLDSIKLGDDSPGAPSCAKVGSIVNGKAEGSTASDTQVFVPNISSKKMLDLKKIKVKKWLVTYCIKVVVVIVEGVAVETVEKSLPHPLSVMPSVNHSPPSTPYSLPHAASLLTCGGGLTPFLTH

SEQ ID NO: 127549 - protein, 57 aa, Glycine max
  Coding DNA Sequence Number=SeqID_10771
MYSYKRILIVLNNYCISHYFQSSLRVTLEDGRDGGRTMGTRLTTENASLRRATRPMS

SEQ ID NO: 127550 - protein, 226 aa, Glycine max
  Coding DNA Sequence Number=SeqID_10772
WATGDGVLMPGLVEMGYLFCAIARSPPSTTYERVVPEDMSRGSGDLGDVRWGAIAQNQAWPIPTQPGHSQPVRTCDVPQQASSWQSTNTGTKVHEARRLGVWETLEGNERCRFRGTVQLTATSLVHPEQPACTLQQLMEWILPTPTPYRLVEPVQLIEMSSSEEDLEEDPEELPPEPAMDAPDLPKDGEDPLPDVDSPKDIMSAYEADSTEESGPRGTGNSDDSSS

SEQ ID NO: 127551 - protein, 873 aa, Glycine max
  Coding DNA Sequence Number=SeqID_10773
  Gene Ontology: Mol. function=peptidase activity; Cellular component =integral to membrane; Biological process=proteolysis
  Homolog annotation: Hit_ID=UPI000019713B; Match level="QueryCoverage =99%, HitCoverage=99%, E-value=0.0, Identity=60%"; Hit description =peptidase
  Pfam annotation: Domain name=Peptidase_M20; Domain location=147-325; Score=9.6; E_value=0.0004; Accession=PF01546.18; Description =Peptidase family M20M25M40
  Pfam annotation: Domain name=Peptidase_M28; Domain location=144-313; Score=212.0; E_value=1.3e-60; Accession=PF04389.7; Description =Peptidase family M28
  Pfam module annotation: Pfam domain module=Peptidase_M20::Peptidase _M28; Domain location=147-325::144-313
MAFGSSEDVSGVKLLVLLAVMYGLLSALTYSVIHMKFVNPLGNDAPFDRFSEARTVEHVRMLSQEIDGRQEGRPGLKKAAQYIKRQLEVIKERATSNVRIEIEETTVSGSFNMLFLGHNIALGYRNHTNILMRISSVDSKETDPSVLVNGHFDSPLGSPGAGDCGSCVASMLEIARLIVDSGWAPYRPVIFLFNGAEELFMLGAHGFMKTHKWHDTIGAFINVEASGTGGPDLVCQSGPSSWPSNVYAEAAIYPMANSAAQDVFPVIPGDTDYRIFSQDYGDIPGLDIIFLLGGYFYHTSYDTVERLLPGSIQARGENLFSIIKTFTNSANIQNTYKKKSSEVTASTFNDERAVFFDYFSWFMIFYPRWVAKILHSIPVFFFLVMPFTHGRSHSWSAALCDFIKGFMFHAVGIILAVGVPVAFSILRLLFSSQTMNWFAHPYLAFAMFVPCALVGLLIPRIIWRHFPLSQDISIVKTSKEALSDEARFWGAFGFYAVLTLAYLVAGLSGGFVTFFVCASLLPAWISFCLSVKFFGQRSLRSTMFYILPLVPCLAYSVYFGGFLAQFLIERMGMMGSLPLPYGHYVPDVIVAALIGTVTGWCTGPLMPICGHWLARSSILQFLLHLSVFALALSSQFFPYTMSAPKRIVFQHTFHTAGSSQILESTYDFSVTDSNSLLFLFKHSPEVAKELNITSEFSFESASLSKHNDWMAIFPLSFLFSNSLKFPAKKDDILKQYEFFPKLSVQNPSLNSKKGPRRVHLELYLGSLEEVWVAVLNITGPLSSWSFADNLLPACICTGTETYGDGPQSYICRLSGPSDGNWTFWLEANNSEALRVDLAILDQKLVDPIKRLKNLFPDWVDVVAYSSFMSSYIF

SEQ ID NO: 127552 - protein, 388 aa, Glycine max
  Coding DNA Sequence Number=SeqID_10774
  Gene Ontology: Mol. function=protein binding; Cellular component =transcription factor complex; Biological process=ubiquitin cycle
  Homolog annotation: Hit_ID=Q6K649; Match level="QueryCoverage=88%, HitCoverage=89%, E-value=1e-145, Identity=69%"; Hit description =Kelch repeat-containing F-box protein-like
  Pfam annotation: Domain name=F-box; Domain location=50-97; Score =29.6; E_value=1.1e-05; Accession=PF00646.23; Description=F-box domain
  Pfam annotation: Domain name=Kelch_1; Domain location=139-188; Score =46.1; E_value=1.2e-10; Accession=PF01344.15; Description=Kelch motif
  Pfam annotation: Domain name=Kelch_1; Domain location=190-236; Score =57.7; E_value=3.7e-14; Accession=PF01344.15; Description=Kelch motif
  Pfam annotation: Domain name=Kelch_1; Domain location=238-285; Score =36.9; E_value=7.2e-08; Accession=PF01344.15; Description=Kelch motif
  Pfam annotation: Domain name=Kelch_2; Domain location=139-188; Score =7.6; E_value=3.8; Accession=PF07646.5; Description=Kelch motif
  Pfam annotation: Domain name=Kelch_2; Domain location=190-236; Score =29.1; E_value=1.5e-05; Accession=PF07646.5; Description=Kelch motif
  Pfam annotation: Domain name=Kelch_2; Domain location=238-285; Score =27.1; E_value=6e-05; Accession=PF07646.5; Description=Kelch motif
  Pfam module annotation: Pfam domain module=F-box::Kelch_1::Kelch _1::Kelch_1::Kelch_2::Kelch_2::Kelch_2; Domain location=50-97::139 -188::190-236::238-285::139-188::190-236::238-285
MPSFVAEKKIFVEPNMCFTNLANHDRPTLTKNNHYVRSEALDDDDDGTSPILPGLPDDVSKHCLALVPRSNFPAMGGVCKRWRGFIRSKEFITVRKLAGMHEEWLYILTAGSEGKGSHWEVMDCLGHNRRSLPPMPGPAKAGFGVVVLNGKLLVMAGYSSIDGTASVSAEVYQYDSCLNSWSRLSSMNVARYDFACAEVDGLVYAVGGYGATGDSLSSAEVYDLDTDKWTPIESLRRPRWGCFACGFEGKLYVMGGRSSFTIGNSKFVDVYNPEKHGWCEMKNGCVMVTAYAVLEKKLFCMEWKNQRKLAIFNPEDNSWKMVPVPLTGSSSIGFRFGILDGKLLLFSLEEEPSYKTLLYDPNAAPGSEWHTSDIRPSGLCLCSVTIKA

SEQ ID NO: 127553 - protein, 36 aa, Glycine max
  Coding DNA Sequence Number=SeqID_10775
MEVLNECSPTTLDPSEPITMVKTWKTQKGRLKNIVN

SEQ ID NO: 127554 - protein, 168 aa, Glycine max
  Coding DNA Sequence Number=SeqID_10776
  Gene Ontology: Mol. function=structural constituent of ribosome; Cellular component=ribonucleoprotein complex; Biological process =translation
  Homolog annotation: Hit_ID=Q947H2; Match level="QueryCoverage=73%, HitCoverage=71%, E-value=2e-62, Identity=93%"; Hit description =Ribosomal protein
  Pfam annotation: Domain name=Ribosomal_L22; Domain location=3-140; Score=240.2; E_value=4.5e-69; Accession=PF00237.9; Description =Ribosomal protein L22pL17e
MDAVVSWVSGHSSLNTRETAFAIRKLPLVKAKRYLEDVLAHKQAIPFRRFCRGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPETKLTTSKKSQALRSGASS

SEQ ID NO: 127555 - protein, 55 aa, Glycine max
  Coding DNA Sequence Number=SeqID_10777
  Gene Ontology: Mol. function=small conjugating protein ligase activity; Cellular component=nucleus; Biological process=protein modification process
  Homolog annotation: Hit_ID=Q45W76; Match level="QueryCoverage=83%, HitCoverage=29%, E-value=9e-17, Identity=85%"; Hit description =Ubiquitin-conjugating enzyme 2
MIAFISHFPRNFRLLEELERGEKGIGDGTVSYGMDDADDIYMQSWTGTIIGPPST

SEQ ID NO: 127556 - protein, 70 aa, Glycine max
  Coding DNA Sequence Number=SeqID_10778
MIIYIPEDYERHAHTGNMPLLFHQLQTENRGSPNNNGYYIPEGYERPAHTGNMPLLFSSGFVISQNKLSK

SEQ ID NO: 127557 - protein, 200 aa, Glycine max
  Coding DNA Sequence Number=SeqID_10779
GQWIPFDADAIGQLLGHPLVLEEGQECEYGQRRNRSNGFDEEAITQLLCIPEQDFARTTAGRRVRIMRTNMTTLTQIWMTLLLSNIQPSDHNSDLPLPKCQLVYAILTRMSIHVAQLITDAIYIFAGMAPTRHPLDPDKSNRALGFPALITGLCQSFGVPVALREAPTEAPAEAPDEANEARKDEEMADLFDFLGGSGAT

SEQ ID NO: 127558 - protein, 130 aa, Glycine max
  Coding DNA Sequence Number=SeqID_10780
  Gene Ontology: Mol. function=small conjugating protein ligase activity; Cellular component=cytosol; Biological process=protein modification process
  Homolog annotation: Hit_ID=Q45W76; Match level="QueryCoverage=64%, HitCoverage=45%, E-value=2e-28, Identity=75%"; Hit description =Ubiquitin-conjugating enzyme 2
MSTQNLIALTSPKLKEISRTKKAFPWELNFQLPRVSMDSCGAWDYPDNPPSVRFQTRINMTCVNQETGVVRGNSCRGFIAVVEPHLFPMLANWKRERTMEDILIQLKREMMSPQNRKLTQPPEGVSISFL

SEQ ID NO: 127559 - protein, 271 aa, Glycine max
  Coding DNA Sequence Number=SeqID_10781
  Gene Ontology: Mol. function=transferase activity; Cellular component= membrane
  Homolog annotation: Hit_ID=Q5BM99; Match level="QueryCoverage=95%, HitCoverage=50%, E-value=4e-67, Identity=45%"; Hit description =Secondary cell wall-related glycosyltransferase family 47
  Pfam annotation: Domain name=Exostosin; Domain location=1-219; Score =196.3; E_value=7.2e-56; Accession=PF03016.6; Description=Exostosin family
VDLMELLKKSKYWQRSGGRDHVFPMTHPNAFRFLRGQLNESIQVVVDFGRYPRGMSNLNKDVVSPYVHVVDSFTDDEPQDPYESRSTLLFFRGRTYRKDEGIVRVKLAKILAGYDDVHYERSVATEENIKASSKGMRSSKFCLHPAGDTPSSCRLFDAIVSHCVPVIVSDQIELPFEDDIDYSQFSVFFSFKEALQPGYMIDQLRKFPKEKWTEMWRQLKSISHHYEFEYPPKREDAVDMLWRQAKHKLPGVKLSVHRNRRLKIPDWWQRR

SEQ ID NO: 127560 - protein, 192 aa, Glycine max
  Coding DNA Sequence Number=SeqID_10782
  Homolog annotation: Hit_ID=Q9C9W3; Match level="QueryCoverage=19%, HitCoverage=16%, E-value=4e-07, Identity=68%"; Hit description =Putative caffeoyl-CoA O-methyltransferase At1g67980
MDELFSNREGSSAQKGLLKSPALLKYIFERSGYPKEHEQLKQLREITVQKYGVKVLQDDGLPTKLTLANIGIITITICPIICNRLDESLSHIFWNCVALTLAQLWKSLNVPPPDFYQLDVKERIFKNIRFPSHPPLLDTIFSWPSLFVAAVYEIWHMRNYIVYSQMQYNVERISKSHAAPPSLIRLVPPPIG

SEQ ID NO: 127561 - protein, 97 aa, Glycine max
  Coding DNA Sequence Number=SeqID_10783
  Gene Ontology: Mol. function=O-methyltransferase activity; Biological process=lignin biosynthetic process
  Homolog annotation: Hit_ID=Q2YHM9; Match level="QueryCoverage=76%, HitCoverage=28%, E-value=3e-17, Identity=59%"; Hit description =Caffeoyl-CoA O-methyltransferase
  Pfam annotation: Domain name=Methyltransf_3; Domain location=21-97; Score=-89.3; E_value=1.9e-05; Accession=PF01596.8; Description=O -methyltransferase
MTSPSVNKNILQSPAFLKYILETSSYPNEHEQLKQLRETTEQKYQENMGYLLSIPAEEAQFISILHKILNAKKTLEIGVFSDYFLLATALALPLDDK

SEQ ID NO: 127562 - protein, 91 aa, Glycine max
  Coding DNA Sequence Number=SeqID_10784
MRILNIGAWVSGNRVEIAEGAANEKSIEFAPSSLSGNMEATSTYFLFKIQTSKDGHHGASKGKRKEKQLYATFSFSSDPIPTQLPILTVLS

SEQ ID NO: 127563 - protein, 230 aa, Glycine max
  Coding DNA Sequence Number=SeqID_10785
MDAKRELEVEDWELLHPNDDDSIVFGGPPLDSILPDHFSLNPNSSCSSNSNSNSSSEVDRNFDDSYVANQIFPNSTLAPWNGDSDSDTTATNAPVVAMAEAEAEVVVEQEEEQKKMEEVEEKDDDEEDEGEEEEEEEEEKEKRLVWWKVPFEVLRYWVNPLPLPLPVWSLSVAAAAAFLGLFFLGRRLYRMKRKTQTFNLNLALDDKGLPCIVYVETLEDECNTNNFFLE

SEQ ID NO: 127564 - protein, 88 aa, Glycine max
  Coding DNA Sequence Number=SeqID_10786
MVTKRESIIHRRWFKANLSQIWGRYYQGMKAKCLRKRASKGKVILRMNALLEPKLLNPRKTMNCWHPNPITSLESPSDSFLCVHYCMI

SEQ ID NO: 127565 - protein, 113 aa, Glycine max
  Coding DNA Sequence Number=SeqID_10787
  Gene Ontology: Mol. function=protein-tyrosine kinase activity; Cellular component=integral to membrane; Biological process=protein amino acid phosphorylation
  Homolog annotation: Hit_ID=O22938; Match level="QueryCoverage=96%, HitCoverage=15%, E-value=5e-19, Identity=45%"; Hit description =Putative receptor-like protein kinase
  Pfam annotation: Domain name=LRR_1; Domain location=29-51; Score =12.4; E_value=1.3; Accession=PF00560.23; Description=Leucine Rich Repeat
  Pfam annotation: Domain name=LRR_1; Domain location=53-74; Score=4.6; E_value=39; Accession=PF00560.23; Description=Leucine Rich Repeat
  Pfam annotation: Domain name=LRR_1; Domain location=79-101; Score =4.7; E_value=37; Accession=PF00560.23; Description=Leucine Rich Repeat
  Pfam module annotation: Pfam domain module=LRR_1::LRR_1::LRR_1; Domain location=29-51::53-74::79-101
MLGSWTNLRVFAAYENDFNGRIPGSYSRKLKVLILTQNNLSGYLPNEIGDCQAVFNVRISNNNLEGNIPKIESVGNLSSLAYFEASHNNLYGELVSEFSMFKYDLLELGFKCM

SEQ ID NO: 127566 - protein, 508 aa, Glycine max
  Coding DNA Sequence Number=SeqID_10788
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=40%, E-value=9e-90, Identity=34%"; Hit description=Chromo
MKLCFHTLLFMWYCKGGLPPQCPYYHTINLLPYLGPVGAHLYRNVHHHKDEIEKQVKELLLEGMIHHFVSPFSSPVILVKKKDNSWRICVDFQALNKVTVLGKHPIPTINELLDELHVFSKVDLKFSFNQICMKRKCVFVFFDDILVYSPTWQTHLNNLVAIISLSQQHQFKANCKKCSFSLTSDDYLNNIISTMDPSKVQAVLKWPKLQNTKEVRGFLGLTGFYCRFIRDYGKIAEPVTLLTKKDKLALPDFTKEFFSECDASGHDIGAVLMQDRQPIGYFSKALSHGTISKFVYEKEMMALALSVQHWRHYLLGHNFKFEVLYKPGLENKVANALSSKTLNLELNTILMNPYWVDFPKLCNDLNNNLTLNYIREALQHDPALMPKYFSREGLLFFKERLVLSPNFTLIPFFLTKFHDTTTGDHSGFTKTYKKLAATFFFWKGMKKHIMDYIQGAILGYEVILVVVDHFSKYTHFLALKHPFTVKTVAECFIKEMGTALRMSISYHC

SEQ ID NO: 127567 - protein, 46 aa, Glycine max
  Coding DNA Sequence Number=SeqID_10789
MEALDKFKWSIMFEMVEIEHGNSWQIQMAVTFDLDVRFRPIIYRDA

SEQ ID NO: 127568 - protein, 99 aa, Glycine max
  Coding DNA Sequence Number=SeqID_10790
  Gene Ontology: Mol. function=catalytic activity; Biological process =cellular metabolic process
  Homolog annotation: Hit_ID=Q1SZ12; Match level="QueryCoverage=99%, HitCoverage=96%, E-value=7e-23, Identity=59%"; Hit description=NADPH HC toxin reductase-related
MKEGCSKVCVTGASGCIASSLVKKLLAKGHSVHATLRDLKFAIAENESKVSLLKSLPQSEGKLVLFEADIYNPNDFDLAIEGYEFVFHVATPMIHDPGS

SEQ ID NO: 127569 - protein, 135 aa, Glycine max
  Coding DNA Sequence Number=SeqID_10791
  Gene Ontology: Mol. function=protein kinase activity; Cellular component=integral to membrane; Biological process=protein amino acid phosphorylation
  Homolog annotation: Hit_ID=Q69F86; Match level="QueryCoverage=72%, HitCoverage=29%, E-value=6e-18, Identity=45%"; Hit description =Serine-threonine kinase
MVGKGKKSTIGQIIATACSWLATWWPNSQTSNFPYKDRIMHQSKNYRQYQHKGIYGYAAPEIPQNNTLTEKCDVYSFGVVLLEVVCKDKLVNVENRQKHPVEENIDPNLKGKIAPECWKAFIDITEICLKFDPNE

SEQ ID NO: 127570 - protein, 78 aa, Glycine max
  Coding DNA Sequence Number=SeqID_10792
MDAAMKCTWLKEARLSARLSTKNLTMLPGLSNSASLSHNHFIKRMSVHPQKMNWLSVIGALSEFFREHVYSMNTDELA

SEQ ID NO: 127571 - protein, 109 aa, Glycine max
  Coding DNA Sequence Number=SeqID_10793
  Subcellular localization annotation: CTP_CleavageSite=33; ConfidenceScore=5.22e-01
MDMNLGALISGQITSMAQSNSSRLGFPALITALCKSRGVASDSLIFERLSSVINLAYIRKNYWNPDDLTVTIRGARKVRTRLVEAPSTSTAPPLAHTLTVPFVTAFADS

SEQ ID NO: 127572 - protein, 101 aa, Glycine max
  Coding DNA Sequence Number=SeqID_10794
MTQCRQALFLTAITEVHEAKRHSWQLSEIPCGNRLEKCKKTNCVFYIFWKNAMNSQSEHATLSEFINTHCIEAFSEELVKRFHTLRMNTHPLAELPAAKRG

SEQ ID NO: 127573 - protein, 46 aa, Glycine max
  Coding DNA Sequence Number=SeqID_10795
MERLANISEFLLSALFSLSGWTEARMLAKPADWLGEKVKNNTSKLA

SEQ ID NO: 127574 - protein, 282 aa, Glycine max
  Coding DNA Sequence Number=SeqID_10796
  Homolog annotation: Hit_ID=Q8ZPK1; Match level="QueryCoverage=44%, HitCoverage=53%, E-value=7e-45, Identity=74%"; Hit description=ABC -type transport systems
  Pfam annotation: Domain name=BPD_transp_1; Domain location=52-201; Score=4.6; E_value=0.0041; Accession=PF00528.12; Description=Binding- protein-dependent transport s
MKHFTDTLISANIGTKAGTGPPLEVDGIDKLDVWGLGLDTLRDRKVDLLYLGQQHLYLVFWSMLCALLVGIPSGILLSRPFARRWAEYVMQIFNVGNTLPPLAVLALAMVIVGIGDRPALIALFLASLLPIVRNTYAGLSAVPPSLIEAANGIGMTKLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 127575 - protein, 562 aa, Glycine max
  Coding DNA Sequence Number=SeqID_10797
  Homolog annotation: Hit_ID=Q1SAZ0; Match level="QueryCoverage=11%, HitCoverage=4%, E-value=1e-12, Identity=60%"; Hit description =Integrase, catalytic region
MDQMSQQRHGYFHSESIHFRGSNISQPNVCTLVTASGNGTNLDSHYLLDAYDNGMVYGMTQYNGVQHQHNLDMGVPAAANLYYSSMNPSSGAAVSLNAEVMRGNYQYFNASASSSVAPPNARHTENGIPSLPHCTSWSRSGESMMVRDPNRITRVNYLSQHFQPAAPPPWLDQQLNSNNNDGHALPWHQSLLMPYVQAPSANGSSLENARMGPQRYHDTAGSRSGHRFPHPPLVNPHYHSFHHQTQPVQEMRGHSINFHPPPPVTAPSYRVPTNPSRSSSIFIQDSIEMGARHVGAAPFAVMMDWIMGHTYGCFIITIQFHGIYAKHFQFIHQPLTGSLSKSSEFCFCTAASYNRLLFLASPSVLTSLLQSIHVSFDKSKVYFLWEMKNPLFLWATSIPEKYLSFCNQTCLVPFYITIRLVLDGENHLHPADLFPSVQLMSYSLYLLKVFCPFAEKQGGTVFQVEEAVFLPLLFNLPLSLDPAARNAIAATLLVVHLASQIGYGRAVRFQPSFAKQSQDVTLLVDHHNDMRLDIEDMSYEAIFGVGKQELLALGERIGKVNT

SEQ ID NO: 127576 - protein, 183 aa, Glycine max
  Coding DNA Sequence Number=SeqID_10798
  Gene Ontology: Mol. function=protein serine/threonine kinase activity; Cellular component=integral to membrane; Biological process=protein amino acid phosphorylation
  Homolog annotation: Hit_ID=P47735; Match level="QueryCoverage=50%, HitCoverage=8%, E-value=2e-12, Identity=50%"; Hit description =Receptor-like protein kinase 5 precursor
  Pfam annotation: Domain name=LRR_1; Domain location=124-151; Score =4.1; E_value=49; Accession=PF00560.23; Description=Leucine Rich Repeat
  Pfam annotation: Domain name=LRR_1; Domain location=152-174; Score =3.9; E_value=54; Accession=PF00560.23; Description=Leucine Rich Repeat
  Pfam annotation: Domain name=LRR_1; Domain location=75-97; Score =13.7; E_value=0.65; Accession=PF00560.23; Description=Leucine Rich Repeat
  Pfam annotation: Domain name=LRR_1; Domain location=99-122; Score =11.1; E_value=2.4; Accession=PF00560.23; Description=Leucine Rich Repeat
  Pfam module annotation: Pfam domain module=LRR_1::LRR_1::LRR_1::LRR _1; Domain location=124-151::152-174::75-97::99-122
AYIYLGCYTENKRGYISCGSVQVECTSSWLFKENKGGYIPCGSFLVKDFTRPLDPTESPCSSTSTSLVSLVALSHLKTLILVSNLLTGTIPYSLSNLTSLKHLQLANNPFSRSCILSQLRNLRNLEMLFLTGCNFILCELTGTIPTVLCELPLASLNLYENKLKGVLPPILVRSHQPLRALIV

SEQ ID NO: 127577 - protein, 127 aa, Glycine max
  Coding DNA Sequence Number=SeqID_10799
MWMKEEEGWIEEENGIMDIERGFPLFEILKLRMYSLEISKSREYGSDCALNVRFALSVPLGFFGGLLHAKLELATRRGDMSGLSWALSELSQSSTFSSRLFLQVFASIFLQSTCNFLLLNPASHNLT

SEQ ID NO: 127578 - protein, 90 aa, Glycine max
  Coding DNA Sequence Number=SeqID_10800
MKEKPDSIEKTLEVSVERIKSLENNTLSTSIVHVEFNTWLYPFILVVQLGTLAKESTIIAKRSKGCNNIWHITTRIGFLHQLLRTLNIGY

SEQ ID NO: 127579 - protein, 613 aa, Glycine max
  Coding DNA Sequence Number=SeqID_10801
  Gene Ontology: Mol. function=RNA-directed DNA polymerase activity; Cellular component=chromatin; Biological process=chromatin assembly or disassembly
  Pfam annotation: Domain name=RVP_2; Domain location=339-472; Score= -32.8; E_value=0.00036; Accession=PF08284.2; Description=Retroviral aspartyl protease
  Pfam module annotation: Pfam domain module=RVP_2::Retrotrans_gag; Domain location=339-472::106-196
MVDSTRSKTTLDRLEEALAKLTSSHLHITGKLDDLLNRVAVLENTPHPTPSPSSSSANPVIPTHPLQPHRLKLEVPRFDGTDPSGWVFKISQFFEYHSVPDLERLTIASFYMDGPALAWFQWMARNHQLPTWTGFLQAIEARFAHSPYEDPTGQLFKLMQKGSVRDYLTQFEALANRITGLSPSSLLSCFISGLDPAIRREVQALQPLTMVHAAGLARLQEEKFQDTQRNPRIRPSFPSSPSTPLSFSTPSPPSPLPLLPSPAKPPPLPVKRLSPEELASHRERGLCFYCDNKFTRGHRCSSRFFLLIADDDTGDAPLKPNIEGLPHLPNPPLDPIPHEPPQAQISLHALSGQTVPETLHLTGRIAHHTVVILIDGGSTHNFVQSHLVKSLGLTPQPTPTLRVLVGNGSEVECSQICVAVPVITQGRTFTVDLHVLALSGADIVLGVQWLRSLGPVLTDYNQLTMKFIHEGQLVELRGNSDMNSLAVSPPQLRRLLQTQSASELFHIRISSSQPSSPTHHPAIVSIIDQFQALFQPPTTLPPSLPHHKPLNSPNTKHFPGQYPPLQISPFPETGNRDSGVDHAPTRNHPSEHQSLLFTRALSKEEGWFMVLLR

SEQ ID NO: 127580 - protein, 116 aa, Glycine max
  Coding DNA Sequence Number=SeqID_10802
  Homolog annotation: Hit_ID=Q5NBD6; Match level="QueryCoverage=36%, HitCoverage=6%, E-value=4e-09, Identity=71%"; Hit description=5' -nucleotidase, cytosolic II-like
MVQHAGLAPSTISLAPSAAILLNEAIAGACAEAATYPFEVSPLSRNSPRGIFCTRTLNLRSIRAVRYDMDNTLVHYNVKIFGIYLIKEDNEPTIEDVLQTGKNMLAVGYCIMEALA

SEQ ID NO: 127581 - protein, 404 aa, Glycine max
  Coding DNA Sequence Number=SeqID_10803
  Gene Ontology: Mol. function=chromatin binding; Cellular component =chromatin; Biological process=chromatin assembly or disassembly
  Homolog annotation: Hit_ID=Q1SAV4; Match level="QueryCoverage=91%, HitCoverage=98%, E-value=1e-114, Identity=52%"; Hit description =Integrase, catalytic region
  Pfam annotation: Domain name=Chromo; Domain location=335-386; Score =21.0; E_value=0.0033; Accession=PF00385.14; Description='chromo' (CHRromatin Organisation MOdifier
  Pfam annotation: Domain name=rve; Domain location=52-208; Score =121.2; E_value=3e-33; Accession=PF00665.16; Description=Integrase core domain
  Pfam module annotation: Pfam domain module=Chromo::rve; Domain location=335-386::52-208
MGVMKTLAHVPENFVWPSMKQDIHQFVTSCVTCQQIKTDHRRSPGLLSPLPIPAQPWEDLSLDFIVGLPSYHGHSVILVVVDRFSKGLHLGSLPQHHTAAGVAQLFMEISGKLHGMPKSLVSDRDPLFFSHFWQELFRLSGTKLQMSSAYHPQSDGQTEVMNRIVEQYLRAFVHDRPSTWGSFLTWAEWSYNTSVHSATGMTPYEITFGKKPPCFRQYIEGTSKIEAIDEWFIQRDRMIGSLEVQYAEGDQVLVRLRPHRQTSASGTAHSKLAKRFYGPFQITKRIGSVAYQLQLPLDSRIHPVFHCSLLKPYLPSNDLVPLSLPPKSIDNQPCISPLAILDTKWEETASGKQLMVLVQWVGLFPEDTSWELWDTIKQDYNLEDKVVLEACRDDMNREATRDNA

SEQ ID NO: 127582 - protein, 85 aa, Glycine max
  Coding DNA Sequence Number=SeqID_10804
  Subcellular localization annotation: CTP_CleavageSite=58; ConfidenceScore=5.37e-01
MSAEKYQSRLFTAPMSAVVLSIQSLNNIWMMSIRKCSIGVTRKCSIGVIRRCFFFKPRSVTFPGRSRLAFFSISAGESCFSAEVG

SEQ ID NO: 127583 - protein, 172 aa, Glycine max
  Coding DNA Sequence Number=SeqID_10805
MDMDLGNMISCQITQIAQSNSSRLDIPTLIMTFCDAKEVHSDTLTFESLNLVIKLAYIWKNWWNLTDTSVVSRETKKTQGKATQERNSSSALQGSKTDLLMLRGGGGEPTTAATSIEEAKPTIIYAAKIVEAELATATTVEIDPVDDPATNVAEPRLDKDYIDDVSVAQTPT

SEQ ID NO: 127584 - protein, 71 aa, Glycine max
  Coding DNA Sequence Number=SeqID_10806
MGRKFSIVSASGNFGIRAIKLELRPRRIQLCKKNCKTELKTLVPIMSQMHHKLGALFYLEITAKGLRPRLD

SEQ ID NO: 127585 - protein, 295 aa, Glycine max
  Coding DNA Sequence Number=SeqID_10807
  Gene Ontology: Mol. function=RNA-directed DNA polymerase activity; Biological process=RNA-dependent DNA replication
MAAEWRRKRERRRHFKEKISLEEAHHHRRPWIRAWRKKEMNEGRGREEHEILCSKRALKSESARLSFGVNGASVGYLACKRGVRQGALSPLLFCIVEDVLSRGIMYLVENKYLLPMASPKGPKKCKFFSGSMPHNRTIKVQQCLGFGQGPLPFTYLGVPIFIVAWSQVCKPLVEGGLGLKSIVKLNEASIFKSSSIWTSMKSKWHMVLDNAGWVVNRGDCVNFWLDTWCLDSSLADALNIPEQHRCALRSLVSYFVMNQHWNVPESLLHHLPQLCATLSSIPASLLDNQAPNQPI

SEQ ID NO: 127586 - protein, 207 aa, Glycine max
  Coding DNA Sequence Number=SeqID_10808
  Gene Ontology: Mol. function=nucleic acid binding
MAGDEPQRVTLEDYSNSSTPQYFTRLPNEDPYALLVTYMELCNTVKIVGVLEGAIHLHLFSFSLAREAKRWLHMFKGNSLRTWEEKLLDAFTGGKVKLKASDEAMELIENMAANDNAILRDRAYTSAKKSRLELTSQDALLAQNKFLAKQLETLTETLSKLPQQLHLGNPTNVSVMKGPITRTMSKRPQEDWARAAEEGPRVLMNLR

SEQ ID NO: 127587 - protein, 71 aa, Glycine max
  Coding DNA Sequence Number=SeqID_10809
MTSSSRRVTSILQLDSMNLFVKARAWFNPITQGMAILIANTSSTFHRDERLGNTHAMHGKWENARVTHEQT

SEQ ID NO: 127588 - protein, 150 aa, Glycine max
  Coding DNA Sequence Number=SeqID_10810
YIMNSVIKVLYFNGRVYEENDGVIFEGRKYVALQICDDEDVETMIDSFQQQQQISVLELYIEKDDAGGSMFHSANSVTSCGHNLSHNESELPRNISNLHDDDDDYLASNSYVEESLDEDDSVDGISDTDDEVTDIIELVLIVHPTEDIFY

SEQ ID NO: 127589 - protein, 295 aa, Glycine max
  Coding DNA Sequence Number=SeqID_10811
  Gene Ontology: Mol. function=calpain activity; Cellular component =intracellular; Biological process=proteolysis
  Homolog annotation: Hit_ID=Q1SPD3; Match level="QueryCoverage=96%, HitCoverage=68%, E-value=2e-34, Identity=34%"; Hit description =Cyclin-like F-box; F-box protein interaction domain
  Pfam annotation: Domain name=F-box; Domain location=7-54; Score=38.3; E_value=2.6e-08; Accession=PF00646.23; Description=F-box domain
MRSKKKPWSPLLCDKLIEEILSRLPVKPLIQFKCVCKGWNSLMSDPYFIKLHLSKSAAKDDLEHLQLMKNVCLGSIPEIHMESCDVSSIFHSLQIETFMFNFANMPGYHLVGSCNGLHCGVSEILEEYRVCFWNKATRVISRESPTLSFSPGIGRRTMFGFGYDPSSDKYKVVAIALTMLSLDVFEKTEMKVYGAGDSSWRNLKGFPVLWTLPKVGGVYLSGTLNWVVIKGKETIHSEIVIISIDLEKETCRSLFLPDDFCFFDTNIGVFRDSLCVWQDSNTHLGLWQMRKFGDD

SEQ ID NO: 127590 - protein, 54 aa, Glycine max
  Coding DNA Sequence Number=SeqID_10812
MRGTMHEPQANLGADKKFSPENPQGFTLAHLRRKLIRPAARGKCPKTIVIVGYI

SEQ ID NO: 127591 - protein, 131 aa, Glycine max
  Coding DNA Sequence Number=SeqID_10813
  Homolog annotation: Hit_ID=Q9SEE4; Match level="QueryCoverage=30%, HitCoverage=13%, E-value=2e-10, Identity=77%"; Hit description=Pirin- like protein
WKNSEAAVRCKRFKSFTHKSPNVAGGAKAFEVASKFFHGINVEFTLYKQSSIIKGETIYPWVKTVITTEEEIKVHRREVPMEKGTSLPMEKVLKKVLAKSQHEGDGAVVRRGIGRSELKNLDPFLMLDHFS

SEQ ID NO: 127592 - protein, 282 aa, Glycine max
  Coding DNA Sequence Number=SeqID_10814
  Gene Ontology: Mol. function=protein kinase activity; Biological process=protein amino acid phosphorylation
  Homolog annotation: Hit_ID=Q1SG68; Match level="QueryCoverage=51%, HitCoverage=34%, E-value=5e-55, Identity=70%"; Hit description=Lipid- binding START
  Subcellular localization annotation: CTP_CleavageSite=45; ConfidenceScore=5.64e-01
MMSALNIYGYVVAAVVVFLILLLWQRNRFFFASSPSSPSASLLLSDSINSNSSSRSRTSNFVTDADLKFLMEILDEKLDSDKWEDVLDKRNHHLCYSVKCCKPKECPGTDTNAESNHPLNGPLKYLSKTVFNDISSEMLRNFYMDNDYRKQWDKTLVEHNQLQVDKSDGTEVGHTIKKFPLLKPREYVLAWKLWEGSDETFYCFMKKLLTIARLGLVELSYALLVLANSSARVMHPILHSFHLSVHNLPVDIFQIVSAYLDNRQDPILNFSLLSMILPREIQ

SEQ ID NO: 127593 - protein, 142 aa, Glycine max
  Coding DNA Sequence Number=SeqID_10815
  Homolog annotation: Hit_ID=Q6Z0T2; Match level="QueryCoverage=58%, HitCoverage=13%, E-value=2e-12, Identity=47%"; Hit description =Putative rubisco subunit binding-protein beta subunit
VKLTQGVEMLTIFKNYETDVSILDDFDFYEDRQKAMQERKARQQSSMVATGLVGENEHRSSANTTGDFMKQMSKSFALVVRLDENNKEVVVADRDSLVSHGHGPIGNVVKPDDGQSVTASSTQTSSVAVVIQFKSMESGVSK

SEQ ID NO: 127594 - protein, 47 aa, Glycine max
  Coding DNA Sequence Number=SeqID_10816
MTPFIITVVNIQMPLGAATTCWNRGRVVGKRKRRWCGGCTARMDLSS

SEQ ID NO: 127595 - protein, 85 aa, Glycine max
  Coding DNA Sequence Number=SeqID_10817
MAVRRVPLVPLAGHVLSRRELRDVCGTAGAASSGCGMGRSVPPLEMAGQVREWYRQPPLRDRGRERESVWVPPTVAARQGREDLF

SEQ ID NO: 127596 - protein, 287 aa, Glycine max
  Coding DNA Sequence Number=SeqID_10818
  Gene Ontology: Mol. function=nucleic acid binding; Biological process= DNA integration
  Homolog annotation: Hit_ID=Q1S1X7; Match level="QueryCoverage=45%, HitCoverage=13%, E-value=3e-17, Identity=35%"; Hit description =Integrase, catalytic region; Zinc finger, CCHC-type; Peptidase aspartic, catalytic
MVVFDRAFPNSMEVQVDLGKLLVIPDSAKACSPRPKARLVAKWMDVMTTFLHGDLEEQIYIKQPQGFTKGGPDQLGYVEKVLDMFIMNNVKPVIGCLMYAMVCTRPNLADDVSQVCKSMCNPGMRHWEAMKGTIGRGIMFGSQQGDPLVIRYVDYDYVGDLDDKKSTIGYVFTLASGPVYWKFIIQSLVEMSTIEVEYMSVVEASKEVVWLVELVKELGIEVHTLEDAIDMLTKTITTDRAEYSPRLRVQWSSHGFGGNGDKAGGAVIVGEVVPALEHGVDRVQLVD

SEQ ID NO: 127597 - protein, 51 aa, Glycine max
  Coding DNA Sequence Number=SeqID_10819
MDTNDRERREEEFSGLSCAACLARASSLTPRLAPVPPVSLSASCALSVSLG

SEQ ID NO: 127598 - protein, 248 aa, Glycine max
  Coding DNA Sequence Number=SeqID_10820
MEALDWEELEERVMTTIRLCLADEVLYHVMELKSLGEEGLDFQQHVNAFNNHIDDLARLEMKIKDEDKTLGSTQDDGLYVKRKHECRRTQGKCSGELKKSGEMASHLANVGETDNSNYYTEGDVYYSEGDVLSDSCSNDKACVVVRMGQVKIAMDDSGVRMLCDVRHIPELRKNLISFGTLYVNGFRIKIGIPSDPLNERGMIGLHKRELLKGVRSCKLDLDSSLGGTHYFVTFIDDFSRKVWVYFMK

SEQ ID NO: 127599 - protein, 122 aa, Glycine max
  Coding DNA Sequence Number=SeqID_10821
MVVILPKENVVIWFCSLHNKSDNYLKGIINRSVLFFNTFALTLVSALKGLDDTQQSKSKPPVRLICTERCISKFHNAFSVIDKKEALSYFTDSRPLESERLNALRNQWTKYYLKVKNETYNV

SEQ ID NO: 127600 - protein, 102 aa, Glycine max
  Coding DNA Sequence Number=SeqID_10822
MYNKLIEGLKYIANLAIFARLYINYMVRLYNHENLGDELLNGSSPCTKDVSVGSFSYWTCTRSKKKKQEQAQQNKQGPTPVLRGSAVCLHPREMVVHHHLVR

SEQ ID NO: 127601 - protein, 97 aa, Glycine max
  Coding DNA Sequence Number=SeqID_10823
MAAQLIHDRMVMECLEGVWETLEGNERCRFRGTIRLTATSLVHPEEPTRTLQQPVEWILPTPTPYRLVEPVQVIEVSSSEEDPEEDPEELPPEPNVG

SEQ ID NO: 127602 - protein, 42 aa, Glycine max
  Coding DNA Sequence Number=SeqID_10824
MERVSPTRGICGRCLIRIRLDYHEESGFSISGDTIERMSIVK

SEQ ID NO: 127603 - protein, 68 aa, Glycine max
  Coding DNA Sequence Number=SeqID_10825
  Subcellular localization annotation: CTP_CleavageSite=35; ConfidenceScore=5.38e-01
MSLPPLEPHNHSQTHLKFSGQLPLQARFSVGGSVRAHALSAILNRLVRLFSFSGWTEAVHLAGWPFAH

SEQ ID NO: 127604 - protein, 50 aa, Glycine max
  Coding DNA Sequence Number=SeqID_10826
  Homolog annotation: Hit_ID=Q64HC0; Match level="QueryCoverage=56%, HitCoverage=11%, E-value=2e-07, Identity=89%"; Hit description =ASF/SF2-like pre-mRNA splicing factor SRP30
MSRRSSRTVYVGNLPGDIREREVEDLFLKLVTKDLFHWLPGVFISNNRTN

SEQ ID NO: 127605 - protein, 64 aa, Glycine max
  Coding DNA Sequence Number=SeqID_10827
  Subcellular localization annotation: CTP_CleavageSite=43; ConfidenceScore=5.77e-01
MAFCSLPTSAPNCTSSIKRNSQSLTNSSQALRTAPASSSSLCRSSHSKISQHSIELGPFSLYNL

SEQ ID NO: 127606 - protein, 54 aa, Glycine max
  Coding DNA Sequence Number=SeqID_10828
MESIISHYQVMNKSIIQDYNYVNHREHPNHDPFKCSSTFQAPSHSFLVVTFPTF

SEQ ID NO: 127607 - protein, 122 aa, Glycine max
  Coding DNA Sequence Number=SeqID_10829
  Gene Ontology: Mol. function=protein serine/threonine kinase activity; Cellular component=cytoplasm; Biological process=protein amino acid phosphorylation
  Homolog annotation: Hit_ID=Q9XFS5; Match level="QueryCoverage=85%, HitCoverage=19%, E-value=6e-34, Identity=64%"; Hit description=MAP kinase
MLLIFLSFMQYLTLMVKKFRDVMGKGAMKTVYRAFDKLLGIEVAWNQVKIGDVFHSPEQLQCLYSEVHLLKHLNHDSMMIFYGSWKYVNNRTFNFVTELFISDTLRENWQNYKRVHIRVVKN

SEQ ID NO: 127608 - protein, 120 aa, Glycine max
  Coding DNA Sequence Number=SeqID_10830
MPPRGQHILKESQSSTAIRTATHFLSLQCVTSPLLKYSTEHPILLAMGVLDRMGGHKGKIAAEDTPSLNLKKDLEKGVALLSSSKPRSLGSFPKLASTHILANLDEPNWLTLTAHNLPIS

SEQ ID NO: 127609 - protein, 271 aa, Glycine max
  Coding DNA Sequence Number=SeqID_10831
  Subcellular localization annotation: CTP_CleavageSite=37; ConfidenceScore=5.14e-01
MPEASHLLSVQDVPLAPLTVEAPTVATPAPSPPSVVPSQEATPTIFVNVLATLPGPVMRSLAILEENEQQHQEALHKVTSSEGEVSKWRAIACTDWRVELPNVANATITFVDVIKLNRQLSSQVRGVLAKLLRITLDGDELFKHYKDLKEDKKDLASKVDDVMIEKDELAKKVANLEARLKKLESREKEAHKELEEELLIYKKEAVEQHEKGFNKVFRLIGFFAKNLDLGHFETFKDVKDDVLFDEEEIATKEEAIDEEQGAKEPGDDDQV

SEQ ID NO: 127610 - protein, 332 aa, Glycine max
  Coding DNA Sequence Number=SeqID_10832
  Gene Ontology: Mol. function=protein binding; Cellular component =cytoplasm
  Homolog annotation: Hit_ID=Q6Z0T2; Match level="QueryCoverage=74%, HitCoverage=39%, E-value=1e-86, Identity=63%"; Hit description =Putative rubisco subunit binding-protein beta subunit
  Pfam annotation: Domain name=AT_hook; Domain location=33-45; Score =14.9; E_value=0.061; Accession=PF02178.9; Description=AT hook motif
  Pfam annotation: Domain name=YTH; Domain location=231-315; Score =169.8; E_value=6.7e-48; Accession=PF04146.6; Description=YT521-B -like family
  Pfam module annotation: Pfam domain module=AT_hook::YTH; Domain location=33-45::231-315
MVENRLRWFGHVERRPVDSVVRRVDQMERRQTIRGRGRPKKTIREVIKKDLELNDLDRSMASHQQQSLYGFGSASNSYGRGYLPNQGSSFGGTSISNLNDRRFASLENSRRQGRPTASLCNCNGTLDILSEQNRGPRASKLKNQISAESNSVDGSKNSGSTAKFQNESLNWSDFATDYKDAKFFVIKSYSEDNVHKSIKYGVWASTPNGNRKLDAAYLQAMEKQDACPIFLFFSVNASAQFCGVAEMVGPVNFDKSVDFWQQDKWSGQFPVKWHIIKDVPNSQFRHIVLENNDNKPVTNSRDTQEVGIIGSFTVYEYMNHAFSSFYSSFLAC

SEQ ID NO: 127611 - protein, 178 aa, Glycine max
  Coding DNA Sequence Number=SeqID_10833
  Gene Ontology: Mol. function=protein binding; Cellular component =cytoplasm
  Homolog annotation: Hit_ID=Q6Z0T2; Match level="QueryCoverage=93%, HitCoverage=21%, E-value=4e-23, Identity=40%"; Hit description =Putative rubisco subunit binding-protein beta subunit
MGVYNENPSLIFHSGYGFNPQMPYGPYSPVTTPLPSVGGDTQLYSPQQFPYTGPPYYHQLVPPSLPYLNSPTPVSQPELTSLVGIDQQVDNMFFGPRAGYPSVGSFGRGNFPVAPGSFGFHESQQGFEGSRSGGIWSDCSKPSERQRSLMPLSPSVSPQPMGSLGSFGPSVGMVCSIT

SEQ ID NO: 127612 - protein, 395 aa, Glycine max
  Coding DNA Sequence Number=SeqID_10834
  Gene Ontology: Mol. function=transporter activity; Cellular component= integral to membrane; Biological process=transport
  Homolog annotation: Hit_ID=Q1SG73; Match level="QueryCoverage=99%, HitCoverage=78%, E-value=1e-157, Identity=71%"; Hit description =Major facilitator superfamily
  Pfam annotation: Domain name=MFS_1; Domain location=2-356; Score= -9.3; E_value=0.00084; Accession=PF07690.6; Description=Major Facilitator Superfamily
  Pfam annotation: Domain name=Sugar_tr; Domain location=1-393; Score= -51.7; E_value=3e-05; Accession=PF00083.14; Description=Sugar (and other) transporter
  Pfam module annotation: Pfam domain module=MFS_1::Sugar_tr; Domain location=2-356::1-393
  Subcellular localization annotation: CTP_CleavageSite=62; ConfidenceScore=5.02e-01
KGFLITAIVTALAGFLSAFAPNYILLIALRSLVGLGLGGGPVLSSWFLEFVPAPNRGTWMVVFSAFWTLGTIFEASLAWIVMPKLGWRWLLALSSLPSSFLLLFYKVTPESPRYLCLKGRTADAINVLEKIARVNGRELPSGNLVSDHEIELHKIDNPSEDTRLLSPRTNEVEHPKGTVSNLGGISSLLVLLSPKLARPTLLLWAVFFGNAFSYYGLVLLTTELNGHSKCMPDKLQTEKSQDVKYKSVFIASFAELPGLLLSAAAVDKLGRKLSMSTMFFMCCIFLLPLLFYLPEGLTTSFLFLARICITATFTIVYIYAPEMYPTSVRTTGVGIASSVGRIGGMICPLIAVGLVHGCHQTAAVLLFEIVALLSGICVMFFPIETMGQELRDSVQ

SEQ ID NO: 127613 - protein, 558 aa, Glycine max
  Coding DNA Sequence Number=SeqID_10835
  Gene Ontology: Mol. function=catalytic activity; Biological process =cellular metabolic process
  Homolog annotation: Hit_ID=Q6YXY0; Match level="QueryCoverage=67%, HitCoverage=56%, E-value=1e-134, Identity=66%"; Hit description =Putative UOS1
  Pfam annotation: Domain name=3Beta_HSD; Domain location=133-351; Score=-121.5; E_value=0.00051; Accession=PF01073.9; Description=3 -beta hydroxysteroid dehydrogenaseisomerase family
  Pfam annotation: Domain name=CIA30; Domain location=267-467; Score= -16.2; E_value=0.00019; Accession=PF08547.2; Description=Complex I intermediate-associated pro
  Pfam annotation: Domain name=Epimerase; Domain location=132-373; Score=-40.6; E_value=0.0016; Accession=PF01370.11; Description=NAD dependent epimerasedehydratase family
  Pfam annotation: Domain name=KR; Domain location=130-243; Score= -88.8; E_value=0.033; Accession=PF08659.1; Description=KR domain
  Pfam annotation: Domain name=NmrA; Domain location=132-346; Score= -106.4; E_value=0.048; Accession=PF05368.3; Description=NmrA-like family
  Pfam annotation: Domain name=adh_short; Domain location=130-243; Score=-30.1; E_value=0.00053; Accession=PF00106.15; Description =short chain dehydrogenase
  Pfam module annotation: Pfam domain module=3Beta_HSD::CIA30::Epimerase ::KR::NmrA::adh_short; Domain location=133-351::267-467::132-373::130- 243::132-346::130-243
  Subcellular localization annotation: CTP_CleavageSite=41; ConfidenceScore=5.09e-01
MNAATAANSSVYSQTQCRPLSSDVRGSIPYLNERKSRLVVRAGGGGRPPKEDGEKQQQQQQQPVSLRLDDVNPVGLGRRSRQLFDEVWRKFSGLGQISGTIRSDDQEALDALLVREGPMCEFAIPGAQNTTVLVVGATSRIGRIVVRKLMLRGYAVKALVRRADQEVVELLPRSVEIVIGDVGDPATVKAAVEGCNKIIYCATARSAITGDLFRVDHRGVSNLTKAFQDHNNKLAQSRAGKSSKSKLLIAKFKSASSLNGWQVRQGTYFQDVVATKYDGGMDAKFEFNENGDAVFSVSVAAALRLLISRINAVDAVPIVVTNRYVFNRGGYVELSKKLSLPLGYTLDRKFYHAFKHNEFICNDRYEGLVLSVGGNGRSYVLILEAGPSADPSQSRLYFARISTKVGFCRVRVPFSSFRPVKPDDPVLDPFLVHTLKIRFEPRRQCLHPKLTARYYGPYLVLIKVERAVGQQHLVEAELQQELQLDPIIYLPAKVFAESVVMQKDEQIPQDYFPEDKVIVGEEALLEKLAEMRETQPRKRSGRNAAPVDKNYALLLWIN

SEQ ID NO: 127614 - protein, 48 aa, Glycine max
  Coding DNA Sequence Number=SeqID_10836
MALHFRAVAVANGTCSMQFSCLGWVWFACTGISLYAIGGLYKPRCWFR

SEQ ID NO: 127615 - protein, 168 aa, Glycine max
  Coding DNA Sequence Number=SeqID_10837
  Homolog annotation: Hit_ID=Q5Z8V8; Match level="QueryCoverage=46%, HitCoverage=12%, E-value=1e-27, Identity=78%"; Hit description =Putative UOS1
MGCRILGEERNQIFLPVQWGVFSLRIAFTRFNPGYIFLSLIYFFLVLIRPVEGNATMKQDLRSFKLILEYIKVLPTGQETDFVLVSCSGLGIEPSRREQVLKAKRAGEDSLRRSGLGYTIVRPGPLQWTKKCLREANWRVNIIDDRSLYGLHCIHNCYNIHILMLLST

SEQ ID NO: 127616 - protein, 341 aa, Glycine max
  Coding DNA Sequence Number=SeqID_10838
  Pfam annotation: Domain name=DUF841; Domain location=130-266; Score =32.5; E_value=1.5e-08; Accession=PF05809.3; Description=Eukaryotic protein of unknown function (DUF841)
MTPSADTDESEVLSLRRNLKEEYLTYEAKERVKELFDAIEKLRTQFKSIERPILEIEIPAKVETPPLEKKFDATLSVYVPPQGVAAQAKLAKLEYEFGKVSKDYSAEEIGDWEFDELLLLPMAYPFSDFKYSSDGLTIVGISFCTTIVCEAISWTDNNKINIKKSKTIKIDRVETSLKESSRDLSLFKFKSGGVVALVLFVVFGLLNSLYEGKGKPVNVDANEDAARGSLFDGGDREVRDGGRQGIGWRRRGKGFLNNPLPPNSHYNPAYENWLLSHTTESEDANANNGNSNDVAVPVPETLTQDIESQNDAVEDAPKQQNVNADPVLPEPEVISLDIRKG

SEQ ID NO: 127617 - protein, 331 aa, Glycine max
  Coding DNA Sequence Number=SeqID_10839
  Gene Ontology: Mol. function=transcription coactivator activity; Cellular component=nucleus; Biological process=regulation of transcription, DNA-dependent
  Homolog annotation: Hit_ID=Q1SG77; Match level="QueryCoverage=80%, HitCoverage=15%, E-value=1e-146, Identity=91%"; Hit description=Zinc finger, TAZ-type; Zinc finger, ZZ-type; Transcriptional coactivation; Zinc finger, FYVE/PHD-type
  Pfam annotation: Domain name=C1_3; Domain location=156-186; Score =10.7; E_value=0.028; Accession=PF07649.3; Description=C1-like domain
  Pfam annotation: Domain name=ZZ; Domain location=152-198; Score=29.6; E_value=1.1e-05; Accession=PF00569.8; Description=Zinc finger, ZZ type
  Pfam annotation: Domain name=zf-TAZ; Domain location=214-293; Score =135.7; E_value=1.3e-37; Accession=PF02135.6; Description=TAZ zinc finger
  Pfam module annotation: Pfam domain module=C1_3::ZZ::zf-TAZ; Domain location=156-186::152-198::214-293
MQMEELKVGGGMRVAGECRQPPKRTQLRWAIGMTTIKATFQHSTSCPRLLAWSMTTVDILEYLWCYEAELKREERERHPINQREKHTLYPVEITDVPSDTKDKDDILESEFFDTRQAFLSLCQGNHYQYDTLRRAKHSSMMVLYHLHNPTAPAFVTTCNICYLDIETGQGWRCEVCPEYDVCNACYQKDGGIDHPHKLTNHPSMVDRDAQNKEARQHRVSQLRKMLDLLVHASQCRSAHCQYPNCRKVKGLFRHGMHCKTRASGGCVLCKKMWYLLQLHARACKESECHVPRCRDLKEHLRRLQQQSDSRRRAAVMEMMRQRAAEVANNAG

SEQ ID NO: 127618 - protein, 129 aa, Glycine max
  Coding DNA Sequence Number=SeqID_10840
MCCGLVRKGLLVIGCSSVITIHGWSSKVIKNALGSRIDVAGRNHGVSNDGNPRKINECGKLDPARKINEKIKGDEGGPRPKENEEDGEKGYKAISGVIPFNVTKSEEFDKKFELVAQHGLGFKPSSYMD

SEQ ID NO: 127619 - protein, 116 aa, Glycine max
  Coding DNA Sequence Number=SeqID_10841
MVKARRMEDKNRVLGILPLSNSQGYNLQKPSYLGSSGWQGRRIFHNLSSAEVNEKMRKGECFTCEEKYNPARVCKNKQFRLMIMEEEDEGETLAYEMQAVFLNLTLRTRSILNGGY

SEQ ID NO: 127620 - protein, 980 aa, Glycine max
  Coding DNA Sequence Number=SeqID_10842
  Gene Ontology: Mol. function=transcription coactivator activity; Cellular component=nucleus; Biological process=regulation of transcription, DNA-dependent
  Homolog annotation: Hit_ID=Q1SG77; Match level="QueryCoverage=96%, HitCoverage=55%, E-value=0.0, Identity=67%"; Hit description=Zinc finger, TAZ-type; Zinc finger, ZZ-type; Transcriptional coactivation; Zinc finger, FYVE/PHD-type
  Pfam annotation: Domain name=zf-TAZ; Domain location=658-737; Score =71.2; E_value=3.3e-18; Accession=PF02135.6; Description=TAZ zinc finger
  Subcellular localization annotation: CTP_CleavageSite=46; ConfidenceScore=5.09e-01
MKLQAHIPGEMSGQVPNQAGSQLSGLTQLNGNALTHQMPPLGGVPRSTINMDPEFLRARTFIQEKIFDMLLQRQQLPVTDVQRRKLKDLANRLEEGMLKAALSKEDYMNLDTLESRLSNFLRRASMNNHNQQYPQRVNSSPIGTMIPTPGMSHVPNSSMMVASSMDASVISASGRNSIASTSFNSVNMLPAGGMLGSTLNRFDGLSNGYQQSSTSFSAASGGNISSMGVQRIASQMIPTPGFTVSSNHSHMNIDSNNTNGGAFSSVESTMVPLSQLQQQKQHVGGQNSHVLQNLSGQMGSGMRSGLLQKPFANSNGAISSGSGLIGNNIQLTNEPGTSSDSYASTYANSPKHLQQPFDQKQKPVVQGDGYGMNNVDNFASGNFYTSATSSGSMMNNQNTNSVKLPSMPKISSLMNSHSNLHGMQQAAHIKSQPTNQLEKLNFQSSLTSRDGLLHSQQQYQQRPQQLQQPDQYAQQQFQSMQSQQPPHVINSDTFSQSLLSSNLENRVKPEPGIEHHKEVPNSHVSEQFHISEMQSQFHQNSSEDCSRGAQYLPFPSGHHDLLSSTPQISQQMLHQHQLVAESQNNFNKSVILNQWPQSQDCNHIPDSISHDQHLHMDFHQRISGQDEAQCNNLSSDGSIIGRAVLSRGSAEQLDSGNAIKKAHRNQQRWLLFLLHARRCSAPEGRCKERFCSNAQKLCKHLDRCTLRHCQYPRCHHTRVLLHHFINCKDPCCPVCVFVRKYRRAFQLKPQIQPEPESSLPTAVNGSCKPYNIVGTSPRLISKPPLVVETSEDLHPSIKRIKIEHCAQPINPENDHSASSFTENCESVVSRDAQSQPQAYPNIEKSISIESELTEVKAEAPAHVVHEKLSEMKMDNNNADDKMPIAEPVKYDEPANLARPENIKTEKETGQDRKENVVQTSENAAGTKSGKPKIKGVSLTELFTPEQVREHITGLRQWVGQACNSSVTSGFIARPLLKGQQ

SEQ ID NO: 127621 - protein, 92 aa, Glycine max
  Coding DNA Sequence Number=SeqID_10843
MGYDEPKTVNNRVQTKHEFDIAIWNWKGTPKLSTTTPTKIHDASAVEKEKGISTKEVFESLHDDLEGTYTVVGGVEGEVALLDPQRSKQMVD

SEQ ID NO: 127622 - protein, 114 aa, Glycine max
  Coding DNA Sequence Number=SeqID_10844
  Gene Ontology: Mol. function=RNA-directed DNA polymerase activity; Biological process=RNA-dependent DNA replication
MRNERFPEQRKSKLQHRGDRPFQVLEMISDNAYKIDIPSGDSEDFRTNAFQEAGNGENPKAIQIQGPMTRSRTKLLEDTLQQIVSVILDKTQVEKDEGLKALSRIILIIVKGPN

SEQ ID NO: 127623 - protein, 100 aa, Glycine max
  Coding DNA Sequence Number=SeqID_10845
  Subcellular localization annotation: CTP_CleavageSite=86; ConfidenceScore=5.21e-01
MLTRQNTCTPCRIATKNLRKKRERTNKAAGSVQTKRGLSFRNQNGMENGGSIIPSLFSFLFFHYRNKHHSPILSPLPSTWKMKRVMDKEAKDANNDVLVT

SEQ ID NO: 127624 - protein, 89 aa, Glycine max
  Coding DNA Sequence Number=SeqID_10846
MNRCLAAGNLREQSAQSEKQAYAASRCKNKGEVVAIFCSKGWAMQFPCFYEKKPANPKMPHCMDGYRTPKILLTSNRDGQRRYFKFFNI

SEQ ID NO: 127625 - protein, 62 aa, Glycine max
  Coding DNA Sequence Number=SeqID_10847
MPDLPFQVGDLAESRCFEKVVILVLGLDASDSKRYGWESSTYSFFLTQQILIVQTSVTIPLH

SEQ ID NO: 127626 - protein, 55 aa, Glycine max
  Coding DNA Sequence Number=SeqID_10848
MEYYDDSVFLALAIVVARLLRWLWACCFILLKGSPYKSSDLGGFAATNDRGKNGA

SEQ ID NO: 127627 - protein, 189 aa, Glycine max
  Coding DNA Sequence Number=SeqID_10849
  Gene Ontology: Mol. function=microtubule binding; Cellular component =cortical microtubule, transverse to long axis; Biological process =positive regulation of microtubule polymerization
  Homolog annotation: Hit_ID=Q10PE0; Match level="QueryCoverage=95%, HitCoverage=35%, E-value=1e-52, Identity=51%"; Hit description =Microtubule associated protein family protein, putative, expressed
MCSFDADRLQKVLQCVNEVHSLCSVLGLDFGQTVGDVHPSLHGTQVEQSTNISNSTLEGLEQAILKLKIERKTRISEASESEITERGILSIEMIEKASAEVDRLAKLKASRMKELVFKKRSELEEICRLTHIEPDPSTVAEKASALIDSGLVDPSELLAKIKEQIIKAEDEVLSRKEVTDRIDKWVCCM

SEQ ID NO: 127628 - protein, 117 aa, Glycine max
  Coding DNA Sequence Number=SeqID_10850
MGPDGCRETRETETREVARKLRQDFSIQKPHSLSSLNRFSEAFSSSPTLFFFSLSPPPLFPIKAPNFAHHFYSKLQREAIFGVVKRTSTLSDFEFQVWVDFFSHEFRGYWVFGRYDG

SEQ ID NO: 127629 - protein, 146 aa, Glycine max
  Coding DNA Sequence Number=SeqID_10851
  Gene Ontology: Cellular component=integral to membrane
  Homolog annotation: Hit_ID=Q6D0D4; Match level="QueryCoverage=98%, HitCoverage=92%, E-value=7e-59, Identity=77%"; Hit description =Putative membrane protein
DAVGGGAGAGLRHGVQRAAARAALLRVARSYRARLAHADDAWRHEHRVGLAAGGDPDRYHRHLLVALATGAPEGVHRGGGDPDVPRHFRLYRDDNGGGDLASGLQRSPDGDHDHQLPQGQFYRWRIVDRPVVAGPVAVPQTPQRVK

SEQ ID NO: 127630 - protein, 176 aa, Glycine max
  Coding DNA Sequence Number=SeqID_10852
  Gene Ontology: Mol. function=dihydrofolate reductase activity; Biological process=nucleotide biosynthetic process
  Homolog annotation: Hit_ID=Q7CG83; Match level="QueryCoverage=76%, HitCoverage=84%, E-value=2e-52, Identity=74%"; Hit description =Dihydrofolate reductase type I
  Pfam annotation: Domain name=DHFR_1; Domain location=2-149; Score =187.6; E_value=3e-53; Accession=PF00186.9; Description=Dihydrofolate reductase
MIISLIAALAADRVIGMENAMPWHLPADLAWFKRNTLNKPVIMGRKTFESIGRPLPGRHNIVLSSRPGNAAGVTWVTSLDEALAAAGEVEEVMVIGGGRIYTQLLPRADRLYLTHIDAEVGGDTHFPDYEPDEWETTAADLSALATLPRGGHPLLQTAADPSGRKVLGTFGNCANG

SEQ ID NO: 127631 - protein, 57 aa, Glycine max
  Coding DNA Sequence Number=SeqID_10853
MAGTGSLSVMVKYRAKSKTEMNRGARKRVRVDARPLISRSSSHIRLRMIKKHYWEAT

SEQ ID NO: 127632 - protein, 141 aa, Glycine max
  Coding DNA Sequence Number=SeqID_10854
  Gene Ontology: Mol. function=nucleic acid binding; Biological process= DNA integration
  Pfam annotation: Domain name=zf-CCHC; Domain location=104-121; Score =12.7; E_value=0.0079; Accession=PF00098.13; Description=Zinc knuckle
MKFDGSRIMHEHVIEMKNIVARIKTLGIAVNENFLVQFILNSLPSGYDPFQMCYNTMKDKWNMHQWHRIQGARKKFVKKHDKGKWPLKINDSPIQIQNKTSKSNNCHFYGKSGHFQKNFPKWIPYNPNHKPKRTSSSWGIE

SEQ ID NO: 127633 - protein, 74 aa, Glycine max
  Coding DNA Sequence Number=SeqID_10855
MAEKTKKRLEEAAQSGSTKGIIDPPSPIRCHVKWKMARTKKTGQMTFEAAKEIADKIDSLDEQASQGSFVPYGR

SEQ ID NO: 127634 - protein, 260 aa, Glycine max
  Coding DNA Sequence Number=SeqID_10856
  Gene Ontology: Mol. function=serine-type endopeptidase activity; Biological process=proteolysis
  Homolog annotation: Hit_ID=Q6X5Y8; Match level="QueryCoverage=66%, HitCoverage=29%, E-value=4e-59, Identity=71%"; Hit description=Minor extracellular protease StmPr2 preproprotein precursor
  Pfam annotation: Domain name=Subtilisin_N; Domain location=135-224; Score=6.3; E_value=0.039; Accession=PF05922.7; Description =Subtilisin N-terminal Region
MLDCASGKPVPVTGFLRYGPGGQIPFPWEKDLAPKQRTPMSANVICTADRKGDPLARRTSNLANASQPRVRAGASADSGIHTTRKGNTMSQVTQPRVRRVWVVLGASVLSSLLLATPALAGDVQLSGLQSAPTHQRFIVKYRDGSAPVANTTALASSLKSAAAGLASSQGRALGLQEVRKLAVGPTLVRTDRPLDQAESELLMRKLAADPNVEYVEVDQIMRATLTPNDTRFSEQWGFGTSNASINVQPAWDKATGTGVV

SEQ ID NO: 127635 - protein, 49 aa, Glycine max
  Coding DNA Sequence Number=SeqID_10857
MERNLVFVTRDDVLHWTHSVTYDIGFVMVIMRSDTDTEKREMTSCFNWL

SEQ ID NO: 127636 - protein, 185 aa, Glycine max
  Coding DNA Sequence Number=SeqID_10858
  Gene Ontology: Mol. function=DNA-directed RNA polymerase activity; Cellular component=mitochondrion; Biological process=transcription
  Homolog annotation: Hit_ID=O47884; Match level="QueryCoverage=99%, HitCoverage=24%, E-value=5e-35, Identity=44%"; Hit description=RNA polymerase
MEMLTKNNLPSAKEFLRGKYLMDKEYPGRMTIYAESRSGDSLETSGSELSDEENKNLRCVLSESDKSLLVELGEHSIECLLVHTLGHLFNLENIVSLASLVDRIERNVRDYASSSTLYYNSRVCNLSMDAADKGASLVYAECLFNPALLPIKLNLPMVFPPKDWEPHKPEQKPTLRAKSTALNGV

SEQ ID NO: 127637 - protein, 92 aa, Glycine max
  Coding DNA Sequence Number=SeqID_10859
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=69%, HitCoverage=12%, E-value=1e-30, Identity=96%"; Hit description=NADH -plastoquinone oxidoreductase subunit 2
MGFSWLYGSSGGEIELQEIVNGLINTQMYNSPGILIALLFITVGIGFKLSPAPSHQWTPDVYEGVRCYIVGSHPSETTSIIGASVNKRITLR

SEQ ID NO: 127638 - protein, 69 aa, Glycine max
  Coding DNA Sequence Number=SeqID_10860
  Subcellular localization annotation: CTP_CleavageSite=35; ConfidenceScore=5.32e-01
MISCLVRPRYKSIKVLSDPPSVSRRISNTHPRHLCAKRNTNLVRKVRQVNLINFRILTIFISMLFVLPL

SEQ ID NO: 127639 - protein, 190 aa, Glycine max
  Coding DNA Sequence Number=SeqID_10861
MARTKKTGEMTTEAAKEIAEKIVSHVQLTITIMFEYFENAMYHCVFSVQDSFEEQATQGSFVPHGRQDVLAAAIGRPEHPGRVCAAGAGVTNKQYFGSAPRTSRSASSLPPDELQQLTQQIRDQLEESITEKVTRHVMASFSHLQSQMQSQGVAVPPEPVVGPGPSGPRVSTKGSCVDPSGNDPETGDSD

SEQ ID NO: 127640 - protein, 59 aa, Glycine max
  Coding DNA Sequence Number=SeqID_10862
MSAEKYQSRLYNGRCRLLKCSIGVIRDENHETGQIQSKGPSGEGRRPKWRRTKPPSGEG

SEQ ID NO: 127641 - protein, 84 aa, Glycine max
  Coding DNA Sequence Number=SeqID_10863
MSDRVALRWPPLDLRKKKRKVPPSLVSTSEYDKEDISNYIMCMVQILRPTKIYRFNDWHICFLRQEGENEFNIFLKINEVSRTY

SEQ ID NO: 127642 - protein, 280 aa, Glycine max
  Coding DNA Sequence Number=SeqID_10864
  Gene Ontology: Mol. function=binding; Cellular component=nucleus; Biological process=photosynthesis
  Homolog annotation: Hit_ID=Q5NRN1; Match level="QueryCoverage=98%, HitCoverage=49%, E-value=2e-87, Identity=57%"; Hit description=TPR domain containing protein, putative
NFHCALQDCDHALELDATHSKTLLCKGKILLCLNRYSSALECFRSAAIDGNAENASGYLERCKSLELLSKTGCLDLSDWVSNGFKGKVPELAEHIGAVEIRKSEISGRGLFATKNIDAGALILVTKAIAMERSIIMGGVQDLCEDAQLAMWKNFIDKVFEVVGKCYKTKGLITRLSCGENEDELEVLDVGLFRPESVEKDDGDAVVGVDMVKLVGILDVNSLTEDAVSANVLTRGNDCYGVGLWLLPSFVNHSCVPNARRLHVGDYLVVHASKDLKAGEE

SEQ ID NO: 127643 - protein, 79 aa, Glycine max
  Coding DNA Sequence Number=SeqID_10865
MLQPYGINIGLKEHSNRVTPKAYTLKSPSGSLPPDSVYNSMHTTSQYSQHLNHVHTQFITYTQSQLQWYNLKIACHHTS

SEQ ID NO: 127644 - protein, 77 aa, Glycine max
  Coding DNA Sequence Number=SeqID_10866
MRGPLNESISCFLIRLDPLRATRPRLHEGCTSLPPEGYTSSLPEGCMSSHSEGCTSSPSEGYTSSPSENSRSSAIIA

SEQ ID NO: 127645 - protein, 97 aa, Glycine max
  Coding DNA Sequence Number=SeqID_10867
MESAMEESINKTQLSPKIIPTSSCRLGDSRKESRFSYSTVVILFPRTKVKVLPVGGHCCGGWFVIGGTPEARYFDVLMMPKDQVLLKFYSRQESKNP

SEQ ID NO: 127646 - protein, 70 aa, Glycine max
  Coding DNA Sequence Number=SeqID_10868
  Subcellular localization annotation: CTP_CleavageSite=21; ConfidenceScore=5.18e-01
MATTNGRGNAPLPQGNGKNPRKTKRWPMPKKRGREISRQVLGSLLEVWGGGGERVCGLLILDYFTDIENR

SEQ ID NO: 127647 - protein, 268 aa, Glycine max
  Coding DNA Sequence Number=SeqID_10869
MAEPSKKRKGSSSRSQRHSKAQEMQIPSSISSSSLFSIEEQRIQYKNLFSSHSIIDPKFIDMDFFSNESFECIQAFENSNLILFMSLKLSFYSELVKAFYSNLEIQENTLISEVYGIKMVIDQSLFYDLTQLSSEGVPFEGTLNDDWKFDFSVHDARRLVCTNQTDMTGRLLAGSLAFESRILRYLIVRILLSRSSNLAQASRLNAPLPYPHLITLFLQHFNIPLDSEPYVPIKRSFLIGVIVISSFGYRKEHDGSWVKKGAQPIDEE

SEQ ID NO: 127648 - protein, 321 aa, Glycine max
  Coding DNA Sequence Number=SeqID_10870
  Homolog annotation: Hit_ID=Q88BS2; Match level="QueryCoverage=97%, HitCoverage=30%, E-value=2e-91, Identity=54%"; Hit description=TraU protein
  Subcellular localization annotation: CTP_CleavageSite=40; ConfidenceScore=5.32e-01
PSAIPVRAWAATLTASSAASGPCLTYPPLSEALNRMPLTRPTTAWSEEGDALFVSPDGKLMPVALAAANQTKKTSIVAGESGGGKSVLINRQPIILAMSAQKQLPFYSGIDKGFSSQGMVSILRTALPPERQDEVLSIVLRNDPEYCRNLFDIQLGLQKPLSYEAEFIENALTALCIDPGTGEPPNGRDTPIILRRLVSDSFKASREEPRRYEPGLVPVVDAALQEAAVWEKHPEYQDNATWYEVRDLLQDAGRTDAAQRAQFQAVPELADMAPRLLSEDYRSMYGNIERDSSSEPLIEYIARCLRDACGQYRMFAGARAL

SEQ ID NO: 127649 - protein, 207 aa, Glycine max
  Coding DNA Sequence Number=SeqID_10871
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=31%, E-value=2e-97, Identity=74%"; Hit description =Photosystem I P700 chlorophyll a apoprotein A1
  Pfam annotation: Domain name=PsaA_PsaB; Domain location=1-207; Score=- 250.3; E_value=0.013; Accession=PF00223.9; Description=Photosystem I psaApsaB protein
AWLSDPTHIRPSAQIWRASGITSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTGQGHK

SEQ ID NO: 127650 - protein, 131 aa, Glycine max
  Coding DNA Sequence Number=SeqID_10872
MSSDLPSLDDKGADDDVRITISYLCMSSDSLSLDDKGADGDVRITIRYLCMSSDSPSLDDKGADDDVWITIRYLCMSSDSPSLDDKGADDDVRITIRYLRMSSDSPSLDDKGIDDDVSHCMLSDPRVTIAE

SEQ ID NO: 127651 - protein, 205 aa, Glycine max
  Coding DNA Sequence Number=SeqID_10873
MATIALSSRYGTKLAYDTGIWGMAFVDNWVVGKEKGCYWLSNDIVGPTLIFSPVKTKSAKLEGSSKVICRGIPPTACPSVAYPRQGSKLARLCMGAELLTPSLGVYAILGGVQLGGKPYGGKACLFFALNEGRPSTSTMVLVAAIATALTSIISFMLIMASIIVAIFSFKASMSAFICSCSSATSHITLICLCVPSNTIVSGWQK

SEQ ID NO: 127652 - protein, 80 aa, Glycine max
  Coding DNA Sequence Number=SeqID_10874
MNSTDTIALFIITETQSPLETPRPPERLNIYRVLTSWLPDKSINVDPMTYVPMLFTLQHILHIYDNSFDFIATRINVARI

SEQ ID NO: 127653 - protein, 288 aa, Glycine max
  Coding DNA Sequence Number=SeqID_10875
  Gene Ontology: Mol. function=chitin binding; Cellular component =extracellular region; Biological process=chitin metabolic process
  Homolog annotation: Hit_ID=UPI00006A17C9; Match level="QueryCoverage =84%, HitCoverage=100%, E-value=2e-18, Identity=28%"; Hit description= UPI00006A17C9 related cluster
MIGTSKPYTGAMRVPIFFRGLHVLAIRGLQVLTFRGLQVLTFRGLHVLAFRGLHVLAFRGLHVLAFRGLHVLAIRRLHVLAIRGLHVLTFRGLHVLTFRGLHDYTSSPPEDYMSSPLEDYTSSPSEGYTPSPLEDYMSSPLKDYTSSPSEGHTPSHSEDYTSLPSEDYTSPPSGGYTSSPSKGCMPSPLEDYLSSPSKGYTPSSSKGLHALTFKGLHALIFKGLHALIFKGLHALTFRGLHVPFFRRLHALAFRGRHVLTFGGLRSPSPFEGYVSSLSVAPYPHLKRI

SEQ ID NO: 127654 - protein, 186 aa, Glycine max
  Coding DNA Sequence Number=SeqID_10876
  Gene Ontology: Mol. function=iron-sulfur cluster binding; Cellular component=intracellular; Biological process=metabolic process
  Homolog annotation: Hit_ID=Q1H0G0; Match level="QueryCoverage=97%, HitCoverage=44%, E-value=7e-81, Identity=80%"; Hit description =Radical SAM
MHRLLGRQGAQAGFGRQFHVDGQAVGIAPGTGQQFRRGLGNGLEVDVAGVTVFFAQLPGNLHHLFHGVVRIADDPAGQEQALNVVALVEVQGERDHLVHAETCSGHVAGNPVHAISAVVDAEVGQQDLQQRNAAAIGCVAVADAHALGAADTATGARIALARAAGGAGGIVLGGIGQNGQLADGFH

SEQ ID NO: 127655 - protein, 141 aa, Glycine max
  Coding DNA Sequence Number=SeqID_10877
  Subcellular localization annotation: CTP_CleavageSite=45; ConfidenceScore=5.51e-01
MNSLPSAIHVSSTIESGAPRIHCLALFANSPFSTFIRRPMNSFPSAVHVSSTIESGAPRIHCLALFANSPFSNLIRRPMNSLPSAVHVSSTIESGAPRIHCLAVFANSPFSTFIRRPMNSLPSLVHVSFVIKRGTSGDWEI

SEQ ID NO: 127656 - protein, 54 aa, Glycine max
  Coding DNA Sequence Number=SeqID_10878
MDEHQQTWKEMTNIMIKINKESNEMFNTVHVIDQLYGEVGRSFAIRWKDELEPT

SEQ ID NO: 127657 - protein, 274 aa, Glycine max
  Coding DNA Sequence Number=SeqID_10879
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=5e-37, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MDYTSLPLEDYAFSSSKGYTPPFRRLHVLPLRELLVHAFRGLHVLTIRGLHVLAFRGLHDLTFRGLHVLAFRGLHDLTFRGLHVLAFRGLHVLAFRGLHILAFRGIDVLNFRDLHVLAFGGIHILAFRGLHIFAFRALHVLPFRELHALAFRGLHVLTFRELHVLAFRGLHVLAFRTLHVLTLRGLHVLPFRELHALAFRGLQVLTFRRLHVLAFRGLHVLPFRGLHVLTIRGLHALAFRGLHVLLFRELHALAFRGLHTFTFRGLHVLVCRGL

SEQ ID NO: 127658 - protein, 136 aa, Glycine max
  Coding DNA Sequence Number=SeqID_10880
MANNIISNRDSGELTLAISSIKTRVDHLAGHNNKGLVSMTEQQSWKRLLLSSCKYPCPIKRAQNRPSSSFGANTEKNPKEECKAVMTRSRMVRMNEGEMRIGEEKQQLVTEPTIDPVMEPLSETEEEVEVEDDQQK

SEQ ID NO: 127659 - protein, 135 aa, Glycine max
  Coding DNA Sequence Number=SeqID_10881
DDIKLKGSRILHDDLKNQRISSRCLRLNQEHFKVQEEFDFKNQKSKIKLQGSSFQESRSRFKTQDSRIKISIKKFFQKLSSTWIFSQNMFTKEFLLSVIVSQPTLLRVSEARLTGTSFKGGKCTESPPTFIERET

SEQ ID NO: 127660 - protein, 171 aa, Glycine max
  Coding DNA Sequence Number=SeqID_10882
  Subcellular localization annotation: CTP_CleavageSite=37; ConfidenceScore=5.17e-01
MICYFQRQFSNNRCQKVILNFKNAPVFFLTSNLRKPSGSKIVYLKPQKGCNRLAEVVHTLTLLNKDMCSYPYKNSGDRRIVKRSINQVEKDDSQIELGKQMQEKEVIGVSTDQHIISLVQKREDVNVVMTRRKRIQEDSEETENSFPKVTDDVLTEKDQAPKKVEVPTDGI

SEQ ID NO: 127661 - protein, 204 aa, Glycine max
  Coding DNA Sequence Number=SeqID_10883
  Homolog annotation: Hit_ID=Q9SHZ3; Match level="QueryCoverage=19%, HitCoverage=7%, E-value=8e-08, Identity=76%"; Hit description =Putative membrane transporter
  Subcellular localization annotation: CTP_CleavageSite=27; ConfidenceScore=5.70e-01
MALHSCVLTVIVTTPSPFVSTAIVLQSCALVVTTMTLLFAYSVSLTLNPFILFLLPLSLLLVPVNSFVSARFGFLELMLTVIFVERQKVWVSGIGVWERWIRILLPILFQAATTTMRAANPARLYGPWNLFFMRMAICLQSSLKSFGFIFLGHGDKAQVIQTLLFVIDISTLLQALFRTRLPAVVGGLFAYMTSRVPWYYASWY

SEQ ID NO: 127662 - protein, 788 aa, Glycine max
  Coding DNA Sequence Number=SeqID_10884
  Gene Ontology: Mol. function=protein serine/threonine kinase activity; Cellular component=integral to membrane; Biological process=protein amino acid phosphorylation
  Homolog annotation: Hit_ID=Q9LY50; Match level="QueryCoverage=94%, HitCoverage=93%, E-value=0.0, Identity=53%"; Hit description =Receptor kinase-like protein
  Pfam annotation: Domain name=APH; Domain location=503-671; Score= -14.9; E_value=0.066; Accession=PF01636.13; Description =Phosphotransferase enzyme family
  Pfam annotation: Domain name=Pkinase; Domain location=487-772; Score =155.7; E_value=1.2e-43; Accession=PF00069.15; Description=Protein kinase domain
  Pfam annotation: Domain name=Pkinase_Tyr; Domain location=487-772; Score=95.9; E_value=1.2e-25; Accession=PF07714.7; Description =Protein tyrosine kinase
  Pfam module annotation: Pfam domain module=APH::Pkinase::Pkinase_Tyr; Domain location=503-671::487-772::487-772
  Subcellular localization annotation: CTP_CleavageSite=49; ConfidenceScore=5.72e-01
MKKNKSPFSAATFTLFIATLLILSSLSPSHALGSAATLAVTSSAVCGVVASEPTRRIACYRHGEVVAVAPNVSFSTISGGRSYFCGLRCGNYSLLCWDTLSAFQSKRLYNNGTVLFENLALGDSQVCATVVGAGKASCWRTNAAFESPSGSDRFDSISSGSGFSCGVLKGSDRVRCWGVGSIARKMESEFRNMSMVSLVAGESHVCGLNSSGYLVCRGSNNFGQIDVPEGGALEFSGLALGVEHTCAIRRSNGSVVCWGGRGLFEDNVTKGVSFEVIVSGSNFTCGLTTNNFSVICWGPGWDNGSGYEIPLPPILPGPCVQSPCSECGIYPQSASLCSGYGNICKPKPCLPEMLVPAPPVVMPATPPSPPPASRSKALTKGLLAFAIVGCVGGVAGICTAIYSLWTGVCFGKKKVHNSVQPTITRGGSVNGVGGSNNSISPPSRSSTIRRQGSRIMRRQRSGTSSTKHPERAEEFTLAELVAATDNFSLENKIGAGSYGVVYKGKLADGREVAIKRGETSTKMKKFQEKETAFESELAFLSRLHHKHLVRLVGFCEEKDERLLVYEYMKNGALYDHLHDKNNVDKSSSVLNSWRMRIKVALDASRGIEYLHNYAVPSIIHRDIKSSNILIDATWTARVSDFGLSLMSPESDHDYQPMKAAGTVGYIDPEYYGLNVLTAKSDVYGLGVVLLELLTGKRAIFKNDENGGTPVSVVDFAVPVIMTGELAKILDPRVKPPEMNETEAVELVGYTAMHCVNLEGKDRPTMADIVANLERALALCDSSHGSISS

SEQ ID NO: 127663 - protein, 71 aa, Glycine max
  Coding DNA Sequence Number=SeqID_10885
MNIKEKQRQIDDTERGTCSGDVVAVSFLFTDLASMLGLYLRGAVREWEGEVVVVVVDRGVFMENREEVGGV

SEQ ID NO: 127664 - protein, 710 aa, Glycine max
  Coding DNA Sequence Number=SeqID_10886
  Gene Ontology: Mol. function=protein serine/threonine kinase activity; Cellular component=cytoplasm; Biological process=protein amino acid phosphorylation
  Homolog annotation: Hit_ID=Q5QLC6; Match level="QueryCoverage=99%, HitCoverage=99%, E-value=1e-166, Identity=47%"; Hit description =Putative dual-specificity tyrosine-(Y)-phosphorylation regulated kinase TbPK4
  Pfam annotation: Domain name=APH; Domain location=406-592; Score= -17.1; E_value=0.096; Accession=PF01636.13; Description =Phosphotransferase enzyme family
  Pfam annotation: Domain name=Pkinase; Domain location=404-706; Score =184.7; E_value=2.2e-52; Accession=PF00069.15; Description=Protein kinase domain
  Pfam annotation: Domain name=Pkinase_Tyr; Domain location=404-704; Score=-66.0; E_value=2e-08; Accession=PF07714.7; Description=Protein tyrosine kinase
  Pfam module annotation: Pfam domain module=APH::Pkinase::Pkinase_Tyr; Domain location=406-592::404-706::404-704
MAVSNGVEAVLEFLRKNGLSEAESALRQDIIENNDLGNFDYEKFFFPMVPPPPPVRVRSFSRLSELSADGNCSKSSSDEFVSIGSPTSRVSSSVIGDHSLFEVTETTQNDSASSSERLSQFGTARDYHDFEMQNEPYWYNEKDDDYFMTPSFEGPDFFACQSEDKFVMTAETENQHDNSLDLVYNSEEFLLKGNGNGGYMDKACLYNHSSVRDGNATYSKEYCHVDNNNLFEGELEGKAEKHTVACSCEVPFCKSSPGGSCSLDPTNFGYPNLKEIHLKFGDINSFDSTSELTVNQSFDYYTKNDSSKEYNGPYDLTIKVNQKDLPNGLDTYKARDGGELAEECQDPEITADGEDTTDDELLKYTQEEEYEVFDLRIIHRKNRTGFEENKELPIVLNTVLAGRYYVTEYLGSAAFSRVVQAHDLQTGIDVCLKIIKNDKDFFDQSLDEIKLLKLVNKHDPADLHHFLRLYDYFYHQEHLFIVTELLQANLYEFQKFKQESGGEEYFTLNRLQLITRQCLEALQYLHSLGIVHCDLKPENILIKSYRRCEIKVIDLGSSCFQTDNLCLYVQSRSYRAPEVMLGLQYDEKIDIWSLGCILAELCSGEVLFPNDAVVMILARMIGMFGSIDMEMLVKGQETHKYFTKEYDIYYVNEETDQLEYIIPEESSLEQHLQVTDTTFIDFVRYLLSINPKRRPTARQALRHPWLSYVY

SEQ ID NO: 127665 - protein, 184 aa, Glycine max; identical to SEQ ID NO: 118830
  Coding DNA Sequence Number=SeqID_10887

SEQ ID NO: 127666 - protein, 165 aa, Glycine max
  Coding DNA Sequence Number=SeqID_10888
MLPEKNIDVTLVKEFYSNIYNQCKVRGKVIKFDAQTLNTFLETPVVLQEGERYQENVHLRNILPERNVQLAYSDYDEFLEELERGHWDRKLIRLLEKNIYVALVKEFYSNIYDPEDDSPKQCKNSLVRLAQLSRMSTWIKWSRAKRKMPLVRDSCLPMWLLVLSG

SEQ ID NO: 127667 - protein, 217 aa, Glycine max
  Coding DNA Sequence Number=SeqID_10889
  Subcellular localization annotation: CTP_CleavageSite=60; ConfidenceScore=5.34e-01
MASSAQVPNLFGSATSALPPTPAAHHDNIMSSSDAADALSCLLHRLPPTLSLPTRLPSPSSAAATSPPSLSLNDVFSCVSKLGYAQLTDHSVPSELANSAESEALALFDLSKEQKNSLFPKNWPLGYGGDDEDEDELAESFRFDSACSTESNELALFSLRKFARELEMLGLKIVDGLTKGLGYQIRNLKYSLLSDSGWVSVLPHVDSILDTVGDIAQ

SEQ ID NO: 127668 - protein, 466 aa, Glycine max
  Coding DNA Sequence Number=SeqID_10890
  Homolog annotation: Hit_ID=Q9FFF8; Match level="QueryCoverage=28%, HitCoverage=10%, E-value=4e-33, Identity=54%"; Hit description =Arabidopsis thaliana genomic DNA, chromosome 5, P1 clone:MOP10
MRLSWQQAGHGQRWLRITVHFDGKKIGRSKRARCTILVIHAAPEDEALHEETENRNTNLASRGTKQTKARRRSSWIGSSSTMFSRFFHKSPPQQRPQQQDVVQDSFPSPNFDLRVVLHHGVPSTASILAFDHIQRLLAVGTLDGKIKLFGGDNIEGTLISPKQASFKNLEFLENQGFLASVSSDNEIQVWDLKSKQIASALQWESIITSFSVIMAPVTCKWVFYIFALLMRFKYIGTEHGMPLCICKGKATYNIPLPYLRIAKSLWASGECFCELLDASLRGRFGPKSTLTCAKASKSVMSFMISLIQTLVNSLTAVGETVTSTEHLDLVLDGLPLEYDSSISLISRCVANFTIDEVETMLLEHESRIDMAKKRSLVSVNLTEGNFRANDSFQPSNSNLQGTILVVGALDAVVVVEIILLMSNAKCVTNDENYVATIPMASTTSAASSAVSTVASPVASTTTQAPA

SEQ ID NO: 127669 - protein, 138 aa, Glycine max
  Coding DNA Sequence Number=SeqID_10891
  Subcellular localization annotation: CTP_CleavageSite=20; ConfidenceScore=5.36e-01
MSLCQGVSVLHFSFRKIFNSAQKKWTRQKPQISNMWSNGKLKKVRGRPMATVGDENGSRCITMSLLITLPTDSRVAPLLPKATCNKEQKEEEVDEESNDGGEELEKRVFNSFDFEDYAWRVYHERIIFKDPLDRYRVA

SEQ ID NO: 127670 - protein, 513 aa, Glycine max
  Coding DNA Sequence Number=SeqID_10892
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q8S237; Match level="QueryCoverage=67%, HitCoverage=66%, E-value=1e-120, Identity=58%"; Hit description =Lustrin A-like
  Pfam annotation: Domain name=DUF231; Domain location=336-509; Score =262.6; E_value=7.8e-76; Accession=PF03005.6; Description=Arabidopsis proteins of unknown function
MQPLRRKTPLFTTSEMGAMKGRKNNNLSIFVVVFSIFLFGLFMYNEDVKSIAEFPFSSPKAHETQEGGEPNKHVDSVQEDNVVVVQRESEKKDVEDSVTVKISKSTSRAQLEKSGAEDEDSDERVDLKTVVEKEKKIEMPRAEEEEEVEEEEEDEKVELPPEDCDLFTGEWVLDNVTHPLYKEDKCEFLTSQVTCMKNGRPDSLYQNWKWKPRDCSLPKFKPKLLFQKIRGKRLMFVGDSLNRNQWESMVCMVNSAVPSYNKTWYKTGSLAIFKIEEPEHVTTVEFYWAPFLVESNSDDPNMHSILNRIIMPESIEKHGMNWKDVDYLIFNTYIWWMNTFSMKVLRGSFDEGSTEYDEVPRPIAYGRVLKTWSKWVDDNIDSNRTKVFFSSTSPLHIKSEDWNNPDGIKCAKETTPILNMSTPLDVGTDRRLFAIVNNVIQSMKVSVYFINITSLSELRKDAHTSVYTIRQGKMLTPEQQADPTTYADCIHWCLPGLPDTWNEFLYTQIISQS

SEQ ID NO: 127671 - protein, 79 aa, Glycine max
  Coding DNA Sequence Number=SeqID_10893
  Subcellular localization annotation: CTP_CleavageSite=12; ConfidenceScore=5.06e-01
MARSLDAALSLVCSPSPSGGHHSPPTMKGVQRRQRGYVEASGEGLLVGLHADASAVSAPMIATPSVHNGNTRSASQVSR

SEQ ID NO: 127672 - protein, 426 aa, Glycine max
  Coding DNA Sequence Number=SeqID_10894
  Gene Ontology: Mol. function=pancreatic ribonuclease activity; Cellular component=nucleus; Biological process=regulation of progression through cell cycle
  Homolog annotation: Hit_ID=Q9FFF9; Match level="QueryCoverage=82%, HitCoverage=20%, E-value=1e-118, Identity=63%"; Hit description =Meiotic check point regulator-like protein
  Pfam annotation: Domain name=PC_rep; Domain location=118-151; Score =9.1; E_value=0.67; Accession=PF01851.12; Description=Proteasomecyclos ome repeat
  Pfam annotation: Domain name=PC_rep; Domain location=285-319; Score =26.6; E_value=8.9e-05; Accession=PF01851.12; Description =Proteasomecyclosome repeat
  Pfam module annotation: Pfam domain module=PC_rep::PC_rep; Domain location=118-151::285-319
MSELSPELSDFTPSCLGIDRQENMGDPNNESRIGSDIILEFGFRALGIPLLDTLYFHIPVRHPSSYPELEVPTLLQSAALMSLGILYEGSAHPQTMQGEIGCRSGGDNVLEREGHAVSAGFALGLVALGRGEDALGFIDTFVNRLFLYIGEKERSHFSTVSMDESRGSAQMMDGTTVNVDVTAPGAIIAIALMFMKTESEAIVSRLSIPNTCFDLQYVRPDFIMLRVIARNLIMWNRVHPSKNWVWSQIPEIVRCSVEGIGVDDNNIEDMDAEAFIQAYVNIIAGACISLGMVFAGTRNENAQELLYEFVIYFLNEMKPVSPTCGKVFPKGLSRYIDRGTLETCLHLIVLSLSVIKIMTKILWLNFCIPGYGWVWTFTDLSVVEIPKEQKLCRWAVKLWYSDGRGWGLNFPTLSGRRWLGTIMLSH

SEQ ID NO: 127673 - protein, 140 aa, Glycine max
  Coding DNA Sequence Number=SeqID_10895
  Homolog annotation: Hit_ID=Q9FFF9; Match level="QueryCoverage=75%, HitCoverage=6%, E-value=1e-12, Identity=45%"; Hit description =Meiotic check point regulator-like protein
LVLLLHSRHHREELEVELALSSEKMSIGVRCLTVLGEFKPFGLIAEALDGKPPDTVTDKYDYFLFDPEIARDRDADDDCDDVASAPSNRGDHELFIRGNRSCTVAALLLSNVVMFCDRIIWSTGARVFKRFTLSSDIVKV

SEQ ID NO: 127674 - protein, 352 aa, Glycine max
  Coding DNA Sequence Number=SeqID_10896
  Gene Ontology: Mol. function=protein binding; Cellular component =nucleus; Biological process=regulation of progression through cell cycle
  Homolog annotation: Hit_ID=Q9FFF9; Match level="QueryCoverage=70%, HitCoverage=12%, E-value=1e-82, Identity=64%"; Hit description =Meiotic check point regulator-like protein
MVGERFGLQQLDSLPSGVSLPLRHALDKCRDSPPNDWPAAAYVLLGRQDLAMSTLARECKYRGMETPTNVNVISMSTPYMLNLHPVTISSTISDAIGLEGTKFEDTDSVDGSMTDGMEHIFNSSTQLRYGRDLRLNEVRRLLCSSRPVAIQTSVNHSASDQDLQQAQLWHLAQRTTSLPVGRGAFTLATIYTLLTEAFSVPKLVLAGRLPAQQNATVNLDPNIRNIQELRSWPEFHNAVAAGLRLAPLQTMKISLNGFNELLPLADTPDQELEKRKTFFILNFPEAPRLVVGKYNLLRFVVDAKLDGICQSSDEMQKQGKPKKAVRVNQEVKATIRWVFIAVEVVQARRKLV

SEQ ID NO: 127675 - protein, 311 aa, Glycine max
  Coding DNA Sequence Number=SeqID_10897
  Gene Ontology: Biological process=regulation of progression through cell cycle
  Homolog annotation: Hit_ID=Q9FFF9; Match level="QueryCoverage=96%, HitCoverage=17%, E-value=2e-74, Identity=49%"; Hit description =Meiotic check point regulator-like protein
MATDDDTAPVVCFFHQEQRKLLSVSLQIVEINNEIVFDVKPDMSWNISAIAASPVTVTRPRVKVGLLPYSDIMVLAPENVLLLYSGKQCLCKYVLPSCLNKDKILHDLELSEESPLPNYLKITGLADAVEGRVNVIVNNRQIFRCALRQSPSSTLANDCIAALAEGLRSSYYRHLLGLLWKDSDPAHLSETESIVDSEWDSFCHVIMQICRKYNIICQKRSDSVPHSAWDFLVSSQFHYNFCKVNSMFGIPCAVSLDQQELNFQRSSVDDAQSFDKPFYTDLLWESLESLHGLYESLKLDNLRKRYVSDPV

SEQ ID NO: 127676 - protein, 91 aa, Glycine max
  Coding DNA Sequence Number=SeqID_10898
  Homolog annotation: Hit_ID=Q9FFF9; Match level="QueryCoverage=80%, HitCoverage=4%, E-value=6e-19, Identity=62%"; Hit description =Meiotic check point regulator-like protein
MSRTWVLYNKPEEPNSVHAGLLLALGLHGYLRVLAVTDIYQYFSQEHESTTVGLMLGLAASYGGTMHPAISKVLSSTIFLVELLQISALRY

SEQ ID NO: 127677 - protein, 1610 aa, Glycine max
  Coding DNA Sequence Number=SeqID_10899
  Gene Ontology: Mol. function=binding; Cellular component=clathrin vesicle coat; Biological process=intracellular protein transport
  Homolog annotation: Hit_ID=Q2RBN7; Match level="QueryCoverage=94%, HitCoverage=90%, E-value=0.0, Identity=86%"; Hit description =Clathrin heavy chain, putative, expressed
  Pfam annotation: Domain name=Clathrin; Domain location=1052-1193; Score=128.5; E_value=1.9e-35; Accession=PF00637.10; Description =Region in Clathrin and VPS
  Pfam annotation: Domain name=Clathrin; Domain location=1198-1344; Score=128.4; E_value=2e-35; Accession=PF00637.10; Description=Region in Clathrin and VPS
  Pfam annotation: Domain name=Clathrin; Domain location=1347-1506; Score=87.8; E_value=3.4e-23; Accession=PF00637.10; Description =Region in Clathrin and VPS
  Pfam annotation: Domain name=Clathrin; Domain location=460-602; Score= 71.0; E_value=3.7e-18; Accession=PF00637.10; Description=Region in Clathrin and VPS
  Pfam annotation: Domain name=Clathrin; Domain location=609-751; Score= 99.5; E_value=1e-26; Accession=PF00637.10; Description=Region in Clathrin and VPS
  Pfam annotation: Domain name=Clathrin; Domain location=756-896; Score= 108.9; E_value=1.5e-29; Accession=PF00637.10; Description=Region in Clathrin and VPS
  Pfam annotation: Domain name=Clathrin; Domain location=903-1048; Score=129.5; E_value=9.1e-36; Accession=PF00637.10; Description =Region in Clathrin and VPS
  Pfam annotation: Domain name=Clathrin-link; Domain location=253-276; Score=35.9; E_value=1.4e-07; Accession=PF09268.1; Description =Clathrin, heavy-chain linker
  Pfam annotation: Domain name=Clathrin_propel; Domain location=117 -157; Score=16.3; E_value=0.11; Accession=PF01394.10; Description =Clathrin propeller repeat
  Pfam annotation: Domain name=Clathrin_propel; Domain location=175 -210; Score=19.5; E_value=0.012; Accession=PF01394.10; Description =Clathrin propeller repeat
  Pfam annotation: Domain name=Clathrin_propel; Domain location=218 -252; Score=21.1; E_value=0.0039; Accession=PF01394.10; Description =Clathrin propeller repeat
  Pfam module annotation: Pfam domain module=Clathrin::Clathrin::Clathri n::Clathrin::Clathrin::Clathrin::Clathrin::Clathrin-link::Clathrin _propel::Clathrin_propel::Clathrin_propel; Domain location=1052 -1193::1198-1344::...
  Pfam module annotation: Domain location=1347-1506::460-602::609 -751::756-896::903-1048::253-276::117-157::175-210::218-252
MWKAPLQQWKMSQQKMPQGRWTVPDKSEQGLSINPCGVFLWLIFHCWTWRLPLVIKRSVTRPVSSGFAEKTRVWLETTLVSTECWWFVSKQRAQLVKGNMQLFSVDQQRSQALEAHAASFAQFKVPGNENPSVLISFASKTLNAGQVISKLHVIELGAQPGRPSFTKKQADLFFPPDFADDFPVAMQISHKYNLIYVITKLGLLFVYDLETATAVYRNRISPDPIFLTSEATSVGGFYAINRRGQVLLATVNEQTIVNFVSGQLNNLELAVSLAKRGNLPGAEKLVVERFHELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGSPVDYNTITDLFLQRNLIREATAFLLDVLKPNLPEHGFLQTKVLEINLVTFPNVADAILANGMFSHYDRPRIAQLCEKAGLYVRALQHYTELPDIKRVIVNTHAIEPQSLVEFFGTLSKEWALECMKDLLLANLRGNLQIIVQVAKEYCEQLGVDACIKLFEQFRSYEGLYFFLGSYLSSSEDPDIHFKYIEAAAKTGQIKEVERVTRESNFYDAEKTKNFLMEAKLPDARPLINVCDRFGFVPDLTHYLYTNNMVRYIEGYVQKVNPGNAPLVVGQLLDDECAEDFIKGLILSVRSLLPVEPLVEECEKRWNRLRMLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWAKVLDPDNEYRRQLIDQVVSTALPESSSPEQVSAAVKAFMTADLPHELIELLEKIVLQNSAFSGNFNLQNLLILTAIKADPSRVMDYVNRLDNFDGPAVGEMAVEAQLYEEAFAIFKKFNLNVQAVNVLLDKIHSIDRAVEFAFRVEEDAVWSQVAKAQLRDGLVSDAIESFIRADDATQFLDVIRAAEDGNVYHDLVKYLLMVRGKAKEPKVDSELIYAYAKIDRLSDIEEFILMPNVANLQNVGDRLYDEALYEAAKIIFAFISNWAKLAITLVKLQQFQGAVDAARKANSSKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWKELTYLYIQYGEFDNAATTIMNHSPEAWDHMQFKDVVVKVANVELYYKAVHFYLEEHPDLINDVLNVLALRVDHARVVDIMRKAGHLRLVKPYMIAVQSNNVSAVNEALNEIYVEEEDYDRLRESIDLHDNFDQIGLAQKIEKHELLEMRRVAAYIYKKAGRWKQSIALSKKDNLYKDAMETASQSGERELAEELLVYFIDQGKKECFASCLFVCYDLIRADIVLELAWMHNMIDFAFPYLLQFIREYTGKVDELVKDKIEAQNEVKAKEQEEKDVVAQQNMYAQLLPLALPAPPMPGMGGFAPPPPMGGLGMPPMPPYGMPPMGSSF

SEQ ID NO: 127678 - protein, 48 aa, Glycine max
  Coding DNA Sequence Number=SeqID_10900
MERGGQRCSKKVGVSKRKVTTLSDDGTNVLRARRRLELASTVALPYQC

SEQ ID NO: 127679 - protein, 78 aa, Glycine max
  Coding DNA Sequence Number=SeqID_10901
  Subcellular localization annotation: CTP_CleavageSite=51; ConfidenceScore=5.26e-01
PKLPHNLLGFLVGYKLLQPSQFLSSESSFTSQQLRLGFRNEKGFGVLFAMRAKAVEEEAYEEVEEEAPKDETEIQVVR

SEQ ID NO: 127680 - protein, 228 aa, Glycine max
  Coding DNA Sequence Number=SeqID_10902
  Gene Ontology: Mol. function=DNA binding; Cellular component=nucleus; Biological process=regulation of transcription
  Homolog annotation: Hit_ID=Q0PJF7; Match level="QueryCoverage=68%, HitCoverage=100%, E-value=2e-51, Identity=64%"; Hit description=MYB transcription factor MYB166
  Pfam annotation: Domain name=Myb_DNA-binding; Domain location=12-58; Score=55.5; E_value=1.8e-13; Accession=PF00249.21; Description=Myb -like DNA-binding domain
  Pfam annotation: Domain name=Myb_DNA-binding; Domain location=64-109; Score=49.5; E_value=1.1e-11; Accession=PF00249.21; Description=Myb -like DNA-binding domain
  Pfam module annotation: Pfam domain module=Myb_DNA-binding::Myb_DNA -binding; Domain location=12-58::64-109
MTTMTGGDNRVKGSWSPQEDATLLKLVNEHGARNWSVISAGIPGRSGKSCRLRWCNQLSPEVQHRPFTPAEDKMIIKAHAIHGNKWATISRLLPGRTDNAIKNHWNSTLRRRRTAEQSSSSSASPPAKRPSSLFDTLHPLKKQCIEKENEEESPVTTSLSLFPPGEKSEEEEEEEEKEEFANQKVSDQNYFMQMMQRMIAEEVRNYMETLRNCSLEPGLDLLSPTLPK

SEQ ID NO: 127681 - protein, 239 aa, Glycine max
  Coding DNA Sequence Number=SeqID_10903
  Gene Ontology: Mol. function=DNA binding; Cellular component =chromatin; Biological process=chromosome organization and biogenesis (sensu Eukaryota)
  Homolog annotation: Hit_ID=Q9LTA2; Match level="QueryCoverage=68%, HitCoverage=58%, E-value=1e-13, Identity=29%"; Hit description =Similarity to AT-hook DNA-binding protein
  Pfam annotation: Domain name=DUF296; Domain location=87-212; Score =74.9; E_value=2.5e-19; Accession=PF03479.5; Description=Domain of unknown function (DUF296)
  Subcellular localization annotation: CTP_CleavageSite=92; ConfidenceScore=5.47e-01
MTNNSMAISTSQNSVSFDLDLTSSWLNHTSSSSQCPRCPPSPATNQPLENLPLTNPPTKKPHGRPAGSKNKPKITPFQVAQPVEPCMKVIIVNVTRSSDIIESILDVAHQGHVSLTVLSASGTITGVTLNNSSHGVDALTLRGPFTLLSLNGSYLYNNHYALHPGATPAPPLSFGISFSTSQGQVFGGAIGGRVIADNDVSLTICTFKNPVMYKHASRDKERDRGDNDNNNNYNNNYSF

SEQ ID NO: 127682 - protein, 278 aa, Glycine max
  Coding DNA Sequence Number=SeqID_10904
MVDIILYERPRPKSVNNKTMEGLVFDKDWEDITKETVDIMLYERPSPKSIDKKTMDGLFFWKNPVPCTIAPMPYFGEQIGPTKVMWLLLQYRKRNTEKALKTAKVICIAGFFWQRASLLQEFLICKPKIWHPLGRWHMVPIGKGYCNSSFSLVQDLRKGYHKSIETSYPILHRNRCWDPLCTDDAMNSRAFGRYAWIFVDVDLDRKLRTSLSGKERICLLCGYRSAKRNQRNQTMFYNRSKEERGSCPPKRKIKRSFCKTMPLLGKVQAMLGRMGIAV

SEQ ID NO: 127683 - protein, 441 aa, Glycine max
  Coding DNA Sequence Number=SeqID_10905
  Gene Ontology: Mol. function=transferase activity; Cellular component= nucleus; Biological process=paclitaxel biosynthetic process
  Homolog annotation: Hit_ID=Q94CD1; Match level="QueryCoverage=82%, HitCoverage=78%, E-value=1e-42, Identity=33%"; Hit description =Putative N-hydroxycinnamoyl/benzoyltransferase
  Pfam annotation: Domain name=Transferase; Domain location=3-435; Score=202.0; E_value=1.4e-57; Accession=PF02458.6; Description =Transferase family
MGSSVRVKEASVITPSEPTPSSVLALSALDSQLFLRFTIEYLLVYNPCPGLDQAATTARLKAALARALVLYYPFAGRVRPRPDGPGLEVVCGAQGAVFIEASADCYNVNDFEKAPKTVTHWRSLLSLHVADVLKGSPPLVVQMTWLRDGAAALGVGINHCICDGIGSAEFLNHFAELANEKRELLLGLRPKQKPVWERHLLNPPRGKQTRVDSASHPEFNRVADLCNFMSKVSTGLKPTSVTFDKRRLNELKRLARCTSQPGESVCYTSFEVLAAHVWRSWARAIGFPPNQKLKLVFSVNVRNRVKPGLPEGYYGNAFVLGCAETSAKELEERGIGFGSGLVKRAKERVGNEHVREVMELVWERKACPDPVGVLIVSQWSRLGLEKIDVGMGKLLHVGPVCCDRYCLFLPLREHCVSVKVMVAVPTLAVDNYQLFMRASHL

SEQ ID NO: 127684 - protein, 105 aa, Glycine max
  Coding DNA Sequence Number=SeqID_10906
MNLSSNSFATAKDIESERSSDDEMPPLEDCIDVDVAEPINEDVLVTRCALNMKPKVGGCRNLPFGGRATRDSRVRVLRKEYARSRHQRLFEENVGKTGKDVIYEL

SEQ ID NO: 127685 - protein, 87 aa, Glycine max
  Coding DNA Sequence Number=SeqID_10907
MYLLLLGTTALSLVTTPLLFKLIPAVMNLGVLMHWFPNESSTQIEVSLFISISMPSYIWSDNCSPSQITRVLRKPYLSTLEPWYITF

SEQ ID NO: 127686 - protein, 128 aa, Glycine max
  Coding DNA Sequence Number=SeqID_10908
MVSRGIIPFEKHIAAVGTTNNNMLSKRKTLDEGSQLSGKSETQHDHRFTSTPYVPMDPGIGPLFNSLCVQKGVGVSPVESSTVATYPSAGGRCGAHGCFFQGRKARGVATNVYSRKTSEKPERVVYEL

SEQ ID NO: 127687 - protein, 58 aa, Glycine max
  Coding DNA Sequence Number=SeqID_10909
MAKYDPKLVMGFYANAWTMEEGVRDKRSWRRANAANSVRGGARPRGLMRRPSLSNCVF

SEQ ID NO: 127688 - protein, 513 aa, Glycine max
  Coding DNA Sequence Number=SeqID_10910
  Gene Ontology: Mol. function=molecular_function; Cellular component =outer membrane; Biological process=biological_process
  Homolog annotation: Hit_ID=Q9FFG3; Match level="QueryCoverage=87%, HitCoverage=89%, E-value=1e-145, Identity=52%"; Hit description =Arabidopsis thaliana genomic DNA, chromosome 5, P1 clone:MOP10
  Pfam annotation: Domain name=Bac_surface_Ag; Domain location=189-513; Score=17.4; E_value=1.6e-05; Accession=PF01103.13; Description =Surface antigen
  Pfam annotation: Domain name=Surf_Ag_VNR; Domain location=82-160; Score=11.6; E_value=0.1; Accession=PF07244.5; Description=Surface antigen variable number repea
  Pfam module annotation: Pfam domain module=Bac_surface_Ag::Surf_Ag _VNR; Domain location=189-513::82-160
MTNTEEEEATPPNPKNYTQHSTNDDVEPRDDEDIEEDQENDEDDVVQEPNRGIPQSAASKLREQRFKVETLSRRLSSELVPIRVHDVVINGNTKTKDWVIEAELKGIENATSMQELMQASQIAIAKLQGLEIFDSCMVRLEAGPRELPNTANVIVDVVETDNKVSGEFGIYTKPSTSSWTAEGALKYKNLLGYGDLCDASLAYGANQATEVSVGVYAPRVKGFLTPIVTRISMLSQDWQESSSYKERLLGAYLGLISTKHHDLAYTLGWRTLTDPSKKSSRRNSTIRPTKGYVFLSTTHVGGLTLDPRSLRFLRQEFDVRFSVPFGFYNTALNLGISAGAVFPWGNGFKTKPSPLPERFYLGGDFSPVCTLGGPTTLWGFKTRGLGPTEPRRQNRDGSNDDNVDSSGWDFIGGDFAVTAFADLSFDLPIMWLREHGIHGHVFAGSGNAAKLTKNEYKHFSPRKFLESFRMSVGCGVVIPTRLFRLEGNYFYILRKGEHDRGKTGFRFSFSAPS

SEQ ID NO: 127689 - protein, 101 aa, Glycine max
  Coding DNA Sequence Number=SeqID_10911
  Gene Ontology: Mol. function=hydrolase activity, acting on ester bonds; Biological process=lipid metabolic process
  Homolog annotation: Hit_ID=Q1SEL6; Match level="QueryCoverage=96%, HitCoverage=26%, E-value=6e-21, Identity=51%"; Hit description =Lipolytic enzyme, G-D-S-L
MTINSIRGLQHQASIPYPFYSNIYTPILGMAQNPTKYGFAQTLQGCCGTGLLEMGPVCNAHDLTCPDSSKYMFCDAVHLTEAGNYVLAESGRQNVLPYLGS

SEQ ID NO: 127690 - protein, 643 aa, Glycine max
  Coding DNA Sequence Number=SeqID_10912
  Gene Ontology: Mol. function=protein-tyrosine kinase activity; Cellular component=integral to membrane; Biological process=protein amino acid phosphorylation
  Homolog annotation: Hit_ID=Q84U00; Match level="QueryCoverage=48%, HitCoverage=96%, E-value=1e-118, Identity=64%"; Hit description=Ser -thr protein kinase
  Pfam annotation: Domain name=LRRNT_2; Domain location=35-78; Score =57.1; E_value=5.9e-14; Accession=PF08263.3; Description=Leucine rich repeat N-terminal domain
  Pfam annotation: Domain name=LRR_1; Domain location=105-127; Score =14.5; E_value=0.39; Accession=PF00560.23; Description=Leucine Rich Repeat
  Pfam annotation: Domain name=LRR_1; Domain location=129-151; Score =16.1; E_value=0.12; Accession=PF00560.23; Description=Leucine Rich Repeat
  Pfam annotation: Domain name=LRR_1; Domain location=153-175; Score =4.8; E_value=36; Accession=PF00560.23; Description=Leucine Rich Repeat
  Pfam annotation: Domain name=LRR_1; Domain location=81-103; Score =2.2; E_value=1.1e+02; Accession=PF00560.23; Description=Leucine Rich Repeat
  Pfam annotation: Domain name=Pkinase; Domain location=355-612; Score=- 1.6; E_value=1.8e-08; Accession=PF00069.15; Description=Protein kinase domain
  Pfam annotation: Domain name=Pkinase_Tyr; Domain location=356-612; Score=-28.3; E_value=9.8e-11; Accession=PF07714.7; Description =Protein tyrosine kinase
  Pfam module annotation: Pfam domain module=LRRNT_2::LRR_1::LRR_1::LRR_ 1::LRR_1::Pkinase::Pkinase_Tyr; Domain location=35-78::105-127::129 -151::153-175::81-103::355-612::356-612
MDKNRKLSRFKDLSIAFCFVAVFFLFHHLGLCCSLNEEGNALLKLRQRIVSDPFDALSNWVDDEASVDPCNWFGVECSDGRVVVLNLKDLCLGGTLAPELVKLVNIKSIILRNNSFSGTIPEGFVQLKELEVLDLGYNNFSGHLPADLGSNISLTILLLDNNEFLVGLSPEINELRMLSECQVDENQLTNAAKMPACTERATTRHIGQGKGTRRSQHSNTSPAANHYQFNRVAAPPLESPSSPSASPSGSAKPPVPKLAPHRKNASDSSPPHSTSGSGTLSKTKSTSSKVHTVPILAGVIGGAVFLIFSSIGIYLCKTKVANVRPWAMGLSGQLQKAFVTGAQKLKRSDLEAACEDFSNVIGNSPIGILYKGTLSGGVEIAVAFVSITSSKNWSKTLEAQFRSKIDKLSKVNHKNFVNLIGYCEEEEPFTRMLVFEYAPNGTLFEHLHIKEAEHLDWGTRLRVATGVAYCLQHMHQLDPPMALIKLNSSAVYLTDDYAAKLSDLSFSNDIASAETRAMDKPLATPESNVYSLGVLLFEMVTGRLPYSVEHKDSLENWASHYLEVDQPLKEIVDPILVSYQEDQLEQVASLITSCVHPDPQKRPTMKDVSERLREITKITPESAVPKLSPLWWAEIEIASAEAR

SEQ ID NO: 127691 - protein, 118 aa, Glycine max
  Coding DNA Sequence Number=SeqID_10913
  Gene Ontology: Cellular component=chloroplast
MGDKLHRREGNSPDHQLRPLNDRSVIKEMNGAKRSAEAVGCKKESVGERSALEGRTRASSAGRSGSENVGLSNANVGENPMPRKPKGSSARPKGVVDGQQVNIPVLPFVGPEGRRRLG

SEQ ID NO: 127692 - protein, 85 aa, Glycine max
  Coding DNA Sequence Number=SeqID_10914
  Homolog annotation: Hit_ID=Q9SIZ3; Match level="QueryCoverage=65%, HitCoverage=10%, E-value=3e-08, Identity=49%"; Hit description =Expressed protein
MEAPVEVCEPAEVRIEFALNCKCRAMSWPKPWPQRLNSKQPSLPTDSDAKDSKRWSEFVSDVYVNGLSMSSVQNVMDMNAGYASK

SEQ ID NO: 127693 - protein, 269 aa, Glycine max
  Coding DNA Sequence Number=SeqID_10915
  Gene Ontology: Cellular component=nuclear chromosome; Biological process=chromosome organization and biogenesis (sensu Eukaryota)
  Homolog annotation: Hit_ID=Q9S7T7; Match level="QueryCoverage=80%, HitCoverage=34%, E-value=3e-45, Identity=50%"; Hit description =Sister chromatid cohesion 1 protein 1
  Pfam annotation: Domain name=Rad21_Rec8_N; Domain location=1-99; Score=6.2; E_value=0.00017; Accession=PF04825.4; Description=N terminus of Rad21  Rec8 like protein
MAATMHAKINRRKLDKLNIIKICEEILNPSIPMALRLSGILMGAHSLSLMLCDLQSHFPFQLIGRNVEINEAWKVKTAPDPTLLPKSKSKAKKEAVTLPGTGETNMEDIEQSLQFSNTGTTTGFQHNAYFTMRLDNVDEPFTNNGAREDQDQSELLHQVDAENITLFERFETFQANTDTYNRFERFDIEEDEETQVNVTSGDQILTTLVPSPPHQDEPTKAYINTGFLTQDSTVPSRPNSVMTQPQYDLTTPSNSIPPHNLEAWKFVLD

SEQ ID NO: 127694 - protein, 391 aa, Glycine max
  Coding DNA Sequence Number=SeqID_10916
  Gene Ontology: Cellular component=nuclear chromosome; Biological process=chromosome organization and biogenesis (sensu Eukaryota)
  Homolog annotation: Hit_ID=Q9S7T7; Match level="QueryCoverage=92%, HitCoverage=52%, E-value=3e-34, Identity=33%"; Hit description =Sister chromatid cohesion 1 protein 1
  Pfam annotation: Domain name=Rad21_Rec8; Domain location=337-391; Score=72.0; E_value=1.9e-18; Accession=PF04824.7; Description =Conserved region of Rad21  Rec8 like protein
MTNRSAMQQEPRRRGPNKRKRGQPSAIEMDYEQTIIPAHIYQHWLQNASDIVSRRGRRKKLGTEETDHQNDVMSSTKIASLMKLPPVVQIDDLFTAVNDNIYYPKPILDLWIKSIQPPHDSPSGQHRVSLWGAWGVLKWRKCCLLLIKCTNVKPSEDFDGRPDYQAPPMEKAREHILMDELTASLLRGHEATPQVSSGKAGGSVHSFPRPTSENGPASHSDFDSGRTVHRFKNKRYSSSANSSGGLEPLAEDVNFKLARLYEDGPTPDQGFSSIRSSLAVMVYSLSTHSTYISLVSFFSELLVETGPTQTQVNINHPSDKITDSIQAQMKAHFDTPGAPPVESLHILAAGMTRTSAAQLFYQICVLASRDALKVDQKVPYGEILFSRGLRM

SEQ ID NO: 127695 - protein, 607 aa, Glycine max
  Coding DNA Sequence Number=SeqID_10917
  Gene Ontology: Mol. function=zinc ion binding; Cellular component =cellulose and pectin-containing cell wall
  Homolog annotation: Hit_ID=Q9SIZ3; Match level="QueryCoverage=92%, HitCoverage=92%, E-value=0.0, Identity=66%"; Hit description =Expressed protein
  Pfam annotation: Domain name=DUF248; Domain location=93-599; Score =1007.6; E_value=4.2e-300; Accession=PF03141.7; Description=Putative methyltransferase
  Pfam annotation: Domain name=Methyltransf_11; Domain location=212 -307; Score=28.2; E_value=2.9e-05; Accession=PF08241.2; Description =Methyltransferase domain
  Pfam annotation: Domain name=Methyltransf_12; Domain location=212 -305; Score=7.7; E_value=0.085; Accession=PF08242.2; Description =Methyltransferase domain
  Pfam module annotation: Pfam domain module=DUF248::Methyltransf _11::Methyltransf_12; Domain location=93-599::212-307::212-305
MAILAENFFKERKYPFILTLLILLICVTLFLFSFNHTTSNAVAFYSVIQEKPPLNPSQASADYTANPKEQELPPNMTNVRFDWKLCEEPQNVDFIPCLDNFKAIKALKSRRHMEHRERHCPETSLHCLLPLPKGYKVPVPWPKSRDKIWYDNVPYSKLVEYKKDQHWVVKSGKYLVFPGGGTQFKDGVDHYIKFLEKTLPAIKWGKHIRVVLDVGCGVASFGGYLLDKNVITMSFAPKDEHEAQIQFALERGIPATLSVIGTQKLTFPDNGFDLIHCARCRVHWDADGGKPLYELNRILRPGGFFAWSATPVYRDDERDQKVWNAMVDITKAMCWKVVAKGHDSSGIGLVIYQKPTSSSCYEKREGNNPPLCENKDGKNSSWYARLDSCLTPLPVDGMGNLQSWPKPWPQRLTSKPPSLPTDSDAKDKFFKDSKRWSELVSDFYMNGLSIKWSSVRNVMDMNAGYAGFATALIDLPVWVMNVVPIDVPDTLSIIMDRGFIGMYHDWCESFNTYPRTYDLLHSSFLFKYLEQRYMNLIMNIFLVRCDIVDVAVEIDRILRPNGYLVVQDSMEILNKLISILRSLHWSVTLHQNQFLVGRKGLWRPKGS

SEQ ID NO: 127696 - protein, 1088 aa, Glycine max
  Coding DNA Sequence Number=SeqID_10918
  Gene Ontology: Mol. function=DNA binding; Cellular component =intracellular; Biological process=DNA integration
  Homolog annotation: Hit_ID=Q1SS72; Match level="QueryCoverage=98%, HitCoverage=99%, E-value=0.0, Identity=44%"; Hit description =Integrase, catalytic region
  Pfam annotation: Domain name=zf-CCHC; Domain location=203-220; Score =9.3; E_value=0.029; Accession=PF00098.13; Description=Zinc knuckle
  Pfam annotation: Domain name=zf-CCHC; Domain location=239-256; Score =12.8; E_value=0.0078; Accession=PF00098.13; Description=Zinc knuckle
  Pfam module annotation: Pfam domain module=RVT_2::zf-CCHC::zf-CCHC; Domain location=585-840::203-220::239-256
MNEASINSAESYLYLHPSENPAIALVSPVLDSTNYHSWSRSMVTALSAKNKVEFIDGSAPEPLKTDRTYGAWRRCNNMVVSWLVHSVATSIRQSILWMDKAEEIWRDLKSRYSQGDLLRISDLQQEASTMKQGTLSVTEYFTHPTQSARAISDVPVVPSPSSHSASLKIGPCNSYEQERQLLGNTSPSINFEPKDASINAAKTICDFCGRVGHVESVCYKKHGIPATYDGRNKSNNGRKTCTHCGKIGHTVDVCYRKHGYPPGYKPFGGKTTVNNIMAVEGRTTDDHAQQHESQDIVHFSPEQYKALLALIQQPQAGNSTTNQPKQVASMTSSTINTSLSPGATDHVTCSLHNLHSYTKIDPITVKLPNGHHVHATHSGTETNNHVKIGIVEARHGLYHLIPNQIPTKAANSIITHPQCNTIPIDLWHFRMGHPSTERLQLSRNVTFYENHFPQLPETQPSNRNNSAPSPIPFSGKELHPPEETQIPQTSIPTHPPCNDHLREQAPSQSRRSTRSKRSPAYLQDYHRSLASTTSTASMVVRYPLSSVLSYSRLSPAHRNFVMTISSAIEPVTYVEASRHDCWIKAMTAELQALQMNNTWRLMPLPPHKTAIGCRWIYKIKYRADGSIERYKARLVAKGYTQTEGLDYLDTFSPVAKLTSVRVLLALAALNKWHLRQLDVNNAFLHGDLEEEVYMQVPPGLPVDNPQLVCRLQRSLYGLKQASRQWFTKLSSFLTSHGFQRSDSDHSLFLRITGSTITILLVYVDDIILTGNSLTEIQAITTLLDQEFRIKDLGNLKFFLGLEIARTSKGIHLCQRKYVLDILSESGMLGCKPHSTPMDYSVKLQKSSGNPLPNESSSSYRRLIGKLIYLTNTRPDIAYAVQQLSQYMSAPTTAHLQAAFRVLRYLKGTPGSGLFFAATGTPQLRAFSVSDWAGCKDSRKSTTGFLVYLGSSLVSWQSKKQSTVSRSSSEAEYRALASTTCELQWLTYLLQDLRVTFVQPATLYCDNQSAIQIATNPVFHERTKHIEIDCHLVRNKVTSGFIKLLPVSSSLQLADIFTKPLTPVVFQHLCNKLGMINIHSQLEGGVLTV

SEQ ID NO: 127697 - protein, 592 aa, Glycine max
  Coding DNA Sequence Number=SeqID_10919
  Gene Ontology: Mol. function=peptide-N4-(N-acetyl-beta-glucosaminyl)as paragine amidase activity
  Homolog annotation: Hit_ID=Q9FFG6; Match level="QueryCoverage=96%, HitCoverage=91%, E-value=1e-157, Identity=48%"; Hit description =Arabidopsis thaliana genomic DNA, chromosome 5, P1 clone:MOP10
MTTTFLCSLLFLLMTTLSESQPDRFMRRKPLSGSQQEYFEVSYPPNSHEPTTPSCTHRIIHHAFANTIDSPPYTTSYTPPPRCGAPWSRVVLHFHARCKGEQYDRIAAIWLAGAEILRTSTAEPSPAGIFWNVRKDVTKYSALLAKPNQDLTMMLENIVNNEFTGVYHVTVTLLFYNKYAVRAPVRVPFVPCPEALNFDPIQSRSRSRSLVQEPGSRGVNESPADLIIPISDDGRRGFWFKLEEEKGSCSRRIRIPRNTYRAVLELYVSFHGNDEFWYSNPPNSYITANGLETERGNGAYREVYVTIDGQVVGWEIPFPVIFTGGINPLFWEPMVAIGAFDLPSYDIDLTPFLGKVLDGKEHVFGIGVVKGISYWLLNANLHLWLDHESTVVHANPVVHHSPETSIERQEDFKGLDGAFGVDAEKETQITGWVMTSVGNITTTVSQGFSFKNSIKFQHNGSIKTVKQKFKAKKKVKVIDGKGESITRLKVRRRYPLRVVTNTKQFRDGTYRLITDLSHTLKEKHVSGCFVKSISNEQNSKGWIQVKGHSVVSGQASTSQNYSYFDRFTCYSRNVAATNGRVVADNSTFVCEL

SEQ ID NO: 127698 - protein, 60 aa, Glycine max
  Coding DNA Sequence Number=SeqID_10920
MMTIVGSNGNDHAITMRDENDDYNNGGVGGGNDGGEGGILMQQCSGSDNDNVRMVMVTTT

SEQ ID NO: 127699 - protein, 178 aa, Glycine max
  Coding DNA Sequence Number=SeqID_10921
MNLLRVHAALNELAKCAYWAKRVHLLGKNIHLPEEMASRKRKSIGARPIAQYDTRRFHSLDAWNRYTDNVLGRRILPKRKVEIYHTEFDDFKTELERRNLHKRLTNLADGTIDVAFVKEFYANLYSSEDPSPKQARVRGHLVKIDVDSLNTFLETPVVLEEGETLPTYSRYYKLPTNH

SEQ ID NO: 127700 - protein, 247 aa, Glycine max
  Coding DNA Sequence Number=SeqID_10922
  Gene Ontology: Mol. function=endonuclease activity
  Homolog annotation: Hit_ID=Q74VR1; Match level="QueryCoverage=99%, HitCoverage=49%, E-value=8e-36, Identity=40%"; Hit description =Predicted ATP-dependent endonuclease of the OLD family
MFTEQDFHFPPGEVEARLYKLQLVFRFRAQGDEHEALFAPFWQQDDAGRYLRFSTLATRQGNEVKTRWRFIDARGEVLPLAGTDAALAQLRAYYPVLRLRDARFGRRSRHNDNDTQRRADTLSALAQEMHSLTRDLVARPQTLSDELLRQGLHTMQQLMAHYFLVQQPDTGAARVAPELRDGSQGWRSLDQLNQLIAGARQRCAASGRAPLAAGGGSGNAAASHHAVGGVESAGADAAAKNRHHELR

SEQ ID NO: 127701 - protein, 106 aa, Glycine max
  Coding DNA Sequence Number=SeqID_10923
EQQAEWEQQAEWVNAQRQILRPLSFRSNKLSGSSEAGDKRAETNSAPLVIQISQVGLDHVQRHAEINYGHSAPGVNQEESIVAQPVNFRDMPEVKRKCKCTIRKVP

SEQ ID NO: 127702 - protein, 182 aa, Glycine max
  Coding DNA Sequence Number=SeqID_10924
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=99%, HitCoverage=36%, E-value=1e-66, Identity=86%"; Hit description=NADH -plastoquinone oxidoreductase subunit 2
  Pfam annotation: Domain name=Oxidored_q1; Domain location=1-114; Score=-71.0; E_value=0.00069; Accession=PF00361.10; Description=NADH- Ubiquinoneplastoquinone (comple
MILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSGRLIFLSFNRTPYECCFYLLLFKNNQVINDWTKPRNNSSRAKLSKAPFKIKQFHRIKYDCMCDSIYYTRNINEPYY

SEQ ID NO: 127703 - protein, 167 aa, Glycine max
  Coding DNA Sequence Number=SeqID_10925
MSSRKRKSIGARPTTQYDTRRFHSFEAWTRYTDNVLGRHLLAERKVEIYHMELDEFKAELERHNFHKHLTNLADSNIDLALVKEFYANLYSPKGPLPKQVRIQGHLIKIDADNLNTFLETPVVLAEGESLPAYSRYCRMPIDIKEIEAALCIPGRGFGVFSHTPTCL

SEQ ID NO: 127704 - protein, 369 aa, Glycine max
  Coding DNA Sequence Number=SeqID_10926
  Gene Ontology: Mol. function=peptidase activity; Cellular component =integral to membrane; Biological process=sodium ion transport
  Homolog annotation: Hit_ID=Q6D0B9; Match level="QueryCoverage=47%, HitCoverage=44%, E-value=4e-54, Identity=63%"; Hit description =Na(+)/H(+) antiporter 1
IAGVEQRNNHDGTEIVNDGQRHQEHFQRRRYATAEQRQHAERKGDIGGRGNCPAVAGNLVIMIEQQENERRRNHAAQRSNHREDRTIAAGQLAADQFALHFEANQQKEQRHQRIVNPQQQVFADIQRAEANLYRLRQQVLIALRGGGIIGQHHRRHRRQNQHHAVAGVTFDKAFQQASNTTGPGVLQRREGLKADGRNTALVAKQVARRQAWWPPGGEKGSAIWALASAENATSAVESNNVYRTIYALSDFDRNVKGALQQIRRAVAEIELNQVLARPPRHAERRQMVVVHLCGERIDLFRRAVPVNLRIQSAFTGPVLYIAGQHVGVLALQRLKQADMLLIAGVDARTELETEPATLHMLTSESDEIT

SEQ ID NO: 127705 - protein, 90 aa, Glycine max
  Coding DNA Sequence Number=SeqID_10927
MWDIPFSSLGKCTRESHVALLPKGVAYSDDEGSTDLRTNPLQEGGDDAILPRRGPITRAMARRLREDRTRDAKEGPKILMSLRIDFRPMS

SEQ ID NO: 127706 - protein, 105 aa, Glycine max
  Coding DNA Sequence Number=SeqID_10928
  Subcellular localization annotation: CTP_CleavageSite=83; ConfidenceScore=5.11e-01
MGFADFRPQATIFALLLPFLVFLVTPYKKWLRKSFPRRGLEEMPQRKGPVPPPSLIVTVSEAPSTNSASRPSKDGRSTEIGTSSSGRMSIRTFRRRQLADIRRCW

SEQ ID NO: 127707 - protein, 51 aa, Glycine max
  Coding DNA Sequence Number=SeqID_10929
  Subcellular localization annotation: CTP_CleavageSite=33; ConfidenceScore=5.08e-01
MAGVGPYMAPTYIFQPKLRNFFYKRWPSARFFRASSTEGSFRQTWHVVLLI

SEQ ID NO: 127708 - protein, 288 aa, Glycine max
  Coding DNA Sequence Number=SeqID_10930
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=100%, E-value=3e-43, Identity=30%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MHALAFRGLHVLAFRRLHAFAFRGLQVLTFRGLHGLTFRGLHVLTFRELHALAFRGPHVLAFRGLQALAFRGLHTLAFRGLHALTFRGLHVLTFRGLHALALRGLHALAFRGLHALTFRGLLALTFRGLDILAFRGQYISPSEDYTGLHDLAFKGLHALPFRGLHVLAFKGLHVLAFKGLHALTFRGLHVLIFRGLHGRTFKGILALAFRGLHVLAFRGVHVLPYRGLQVLAIRWLHILTFRGLHVLTFRGLHALAFRGLHVLPFRGLHVLALRTTRPRLQRTTHPQL

SEQ ID NO: 127709 - protein, 192 aa, Glycine max
  Coding DNA Sequence Number=SeqID_10931
  Gene Ontology: Mol. function=RNA-directed DNA polymerase activity; Biological process=RNA-dependent DNA replication
MVAFIRQYQYNSDMALDRMQLQNMCKKEGESFKEYIQRWRDLAAQVGLPMMEREMITMIVDTLPVFYYVKMVGYMPSSFADLVFTGKRIEVRLRRGKFDYLALMNEKPGANRESKNEGGTHAMIAIPTWPNFPPAQQYQYSANINPSHYPPPYQPRTLNHPKRPPLNQPQSHPKHHPSHKSKHQPGKEFSRK

SEQ ID NO: 127710 - protein, 906 aa, Glycine max
  Coding DNA Sequence Number=SeqID_10932
  Gene Ontology: Mol. function=protein binding; Cellular component =membrane; Biological process=defense response
  Homolog annotation: Hit_ID=Q1SW19; Match level="QueryCoverage=99%, HitCoverage=95%, E-value=1e-177, Identity=41%"; Hit description =Disease resistance protein
  Pfam annotation: Domain name=LRR_1; Domain location=616-637; Score =7.3; E_value=12; Accession=PF00560.23; Description=Leucine Rich Repeat
  Pfam annotation: Domain name=LRR_1; Domain location=639-660; Score =9.4; E_value=5; Accession=PF00560.23; Description=Leucine Rich Repeat
  Pfam annotation: Domain name=LRR_1; Domain location=780-802; Score =7.9; E_value=9.6; Accession=PF00560.23; Description=Leucine Rich Repeat
  Pfam annotation: Domain name=LRR_1; Domain location=852-874; Score =2.8; E_value=86; Accession=PF00560.23; Description=Leucine Rich Repeat
  Pfam annotation: Domain name=NACHT; Domain location=195-357; Score= -37.4; E_value=0.048; Accession=PF05729.3; Description=NACHT domain
  Pfam annotation: Domain name=NB-ARC; Domain location=157-473; Score =258.0; E_value=1.9e-74; Accession=PF00931.13; Description=NB-ARC domain
  Pfam module annotation: Pfam domain module=LRR_1::LRR_1::LRR_1::LRR _1::NACHT::NB-ARC; Domain location=616-637::639-660::780-802::852 -874::195-357::157-473
MEKLQEIAVSLAVDYLLPPLKKAVNSVMEVPKDAADMKDKLDGIQAMIHDVDKMAAAEEGNSRDGLKAKVKQLVETSFCMEDLVDEYIIHEERQLADDPGCASLHCKAIDFVKTTASRLQFAYMNQDVKSEFRGIKERNKSEDCYQIHSSGGPQNITFDNLRMAPMFLKEAEVVGFDSPRDTLERWLKEGPEKLTVVSVVGMGGSGKTTLAKKVFDKVQTHFTRHVWITVSQSYTIEGLLLKFLEALLKFLEAEKGKDPSQSVYSTMDKASLIHEVRNHLSCNIYVVVFDDVWNENFWEEMKFALVDVENGSRIIITTRHREVAESCRTSSLVQVHELQPLTDDKSFELFCKMAFGSELDGHCPNNLKGISTEIVKKCEGLPLAIVATGGLLSRKSRDAREWQRFSENLSSELGKHPKLTPVTKILGLSYYDLPYHLKPCFLYFGIYPEDYEVECGRLILQWVAEGFVKSDEASQTLEEVAEKYLNELIRRSLVQVSSFTKCGKIKRCRVHDVVREMIREKNQDLSFCHSASERGNLSKSGMIRHLTIVASGSNNSTGSVESSNIRSLHVFSDEELSESLVKSMPTKYMLLRVLQFECAPMYDYVPPIESLGDLSFLRYLSFRCSNIVHLPKLIGELHNLETLDLRQTRVCMMPREIYKLKKLRHLLNKYGFLMDSGIGDLTSLQTLRGVDISYNTEEVVKGLEKLTQLRVLGLRKVESRFKSFLCSLINKMQHLEKLYISADGDGNLDLNFDVFAPVLQKVRLRGQLKELPNWVGKLQNLVTLSLFSTRLTHDPLPLLKDLPILTHLSINYAYDGEVLQFPNRGFPNLKQILLLHLFPLKSIVIEDGALPSLEKLKLKFIRYLTEVPRGIDKLPKLKVFHCVDMSDEFKESFNLNRGQRRQWIIE

SEQ ID NO: 127711 - protein, 111 aa, Glycine max
  Coding DNA Sequence Number=SeqID_10933
DKATGLEAENALDADDIMSKEINEEEAIHSVSFDLEGSSSATRKNNRPSKSGEKEGKISSMKEVVESLKEFVEVTKKKMENKKKMEIKKAQEVVHEVVSVLNNIPNFNGAL

SEQ ID NO: 127712 - protein, 173 aa, Glycine max
  Coding DNA Sequence Number=SeqID_10934
  Subcellular localization annotation: CTP_CleavageSite=71; ConfidenceScore=5.40e-01
MAEPSKKQKGTSSRSQRHSGSQEAPIPPSIPSGSLFSSEEQRTRYTNLFSSRSIVDPKFIDMEFFSNENFECFQAFENSNLIPFMSLKLPVYSELVKAFYSNLEIHEDVLMYEIYGIKMVIDQSLFYDLTKLPSEGVPFEGALIDEWKFDFSEHDARRLVCTNQADMTGRLLA

SEQ ID NO: 127713 - protein, 200 aa, Glycine max
  Coding DNA Sequence Number=SeqID_10935
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=22%, E-value=1e-106, Identity=81%"; Hit description=DNA -directed RNA polymerase beta chain
  Pfam annotation: Domain name=RNA_pol_Rpb2_6; Domain location=1-190; Score=102.6; E_value=1.2e-27; Accession=PF00562.18; Description=RNA polymerase Rpb2, domain 6
MAKESSYSPEDRLLRAILGIQKREIKVGDKVAGRHGNKGIVSKILSRQDMPYLQDGRPVDMVFNPLGVPSRMNVGQIFECSLGLAGGMLERHYRITPFDERYEQEASRKLVFSELYEASKQTSNPWIFEPEYPGKSKIFDGRTGNSFKQPAIMGKPYILKLIHQVDDKIHGRSSGHYALVTQQPLRGRAKQGGQRVGEME

SEQ ID NO: 127714 - protein, 92 aa, Glycine max
  Coding DNA Sequence Number=SeqID_10936
MAMQPAQLAELQPPQGGFSPKNRHARGGLRGSKGQHLRELREKKKKERKKKKKEEERKPRRYRITTVIILYVISCSVFFMRQSLSFVFKDLM

SEQ ID NO: 127715 - protein, 132 aa, Glycine max
  Coding DNA Sequence Number=SeqID_10937
MIENHVNMVPNALLTRKGWKQCVLRCPYRTRAKARVMSEIEEVQEHMTTMMEAMMSMKKMMEVNTDAIVSASTATEEDPTHPSGLNQVPQPMGETHEVPRDRTLVDFEPHLGYATRGQAFGVVPLPNTLGGP

SEQ ID NO: 127716 - protein, 161 aa, Glycine max
  Coding DNA Sequence Number=SeqID_10938
  Gene Ontology: Mol. function=DNA-directed RNA polymerase activity; Cellular component=mitochondrion; Biological process=transcription
  Homolog annotation: Hit_ID=O47884; Match level="QueryCoverage=91%, HitCoverage=14%, E-value=5e-35, Identity=53%"; Hit description=RNA polymerase
MEKHSVRVFNSYLKKAHNVTLSFPSKERDKRKSGVSTFVNFIHQKDAQIAMSIAFYENSYNIPLYTVHDNFITNIHYCKYISKIYLHVIKEMGPPLKIINRFIYKNIMEPAIAKGLYNNVKGYNLKSFDERIIPEPILDEFLKIGLISPEDVTNAAGLEMP

SEQ ID NO: 127717 - protein, 454 aa, Glycine max
  Coding DNA Sequence Number=SeqID_10939
  Gene Ontology: Mol. function=RNA-directed DNA polymerase activity; Cellular component=intracellular; Biological process=RNA-dependent DNA replication
  Homolog annotation: Hit_ID=Q6EPP6; Match level="QueryCoverage=97%, HitCoverage=91%, E-value=1e-119, Identity=51%"; Hit description =Pentatricopeptide (PPR) repeat-containing protein-like
  Pfam annotation: Domain name=PPR; Domain location=134-167; Score =19.4; E_value=0.013; Accession=PF01535.11; Description=PPR repeat
  Pfam annotation: Domain name=PPR; Domain location=168-202; Score =41.1; E_value=3.9e-09; Accession=PF01535.11; Description=PPR repeat
  Pfam annotation: Domain name=PPR; Domain location=203-237; Score =47.4; E_value=4.9e-11; Accession=PF01535.11; Description=PPR repeat
  Pfam annotation: Domain name=PPR; Domain location=238-272; Score =50.9; E_value=4.4e-12; Accession=PF01535.11; Description=PPR repeat
  Pfam annotation: Domain name=PPR; Domain location=273-307; Score =34.3; E_value=4.2e-07; Accession=PF01535.11; Description=PPR repeat
  Pfam annotation: Domain name=PPR; Domain location=309-343; Score =39.4; E_value=1.3e-08; Accession=PF01535.11; Description=PPR repeat
  Pfam annotation: Domain name=PPR; Domain location=344-378; Score =26.6; E_value=9.1e-05; Accession=PF01535.11; Description=PPR repeat
  Pfam annotation: Domain name=PPR; Domain location=64-98; Score=6.5; E_ value=1.3; Accession=PF01535.11; Description=PPR repeat
  Pfam annotation: Domain name=PPR; Domain location=99-133; Score=10.4; E_value=0.44; Accession=PF01535.11; Description=PPR repeat
  Pfam module annotation: Pfam domain module=PPR::PPR::PPR::PPR::PPR::PP R::PPR::PPR::PPR; Domain location=134-167::168-202::203-237::238 -272::273-307::309-343::344-378::64-98::99-133
ATIAKLVLESDPRTLSEALTKPRIHWTPELVNKTLKRLWNHGPKALLFFKHLDRHLPSYTHSPSSFDHAVDIAARMRDFNSAWALVGRMRSLRLGPSPKTLAILAERYASIGKPHRAVRTFLSMHEHGLHQDLHSFNTLLDILCKSNRVETAHDLLRTLKSRFRPDTVSYNILANGYCLKKRTPMALRVLKEMVQRGIEPTMVTYNTMLKGYFRSNQIKEAWEFYLEMKKRKCEIDVVSYTTVIHGFGEAGEVKKAKRVFDEMVKEGVAPNVATYNALIQVFCKKDSVQNAVAVFEEMVREGVCSPNVVTFNVVIRGLCHVGDMERALGFMERMGEHGLRASVQTYNVVIRYFCDAGEIEKGLEVFGKMGDGLCLPNLDTYNVLISAMFVRKKSEDLVVAGKLLMEMVERGFLPRKFTFNRVLNGLVITGNQDFAKDILRMQSRCGRVVRRLKL

SEQ ID NO: 127718 - protein, 305 aa, Glycine max
  Coding DNA Sequence Number=SeqID_10940
  Gene Ontology: Mol. function=protein serine/threonine kinase activity; Cellular component=cytoplasm; Biological process=protein amino acid phosphorylation
  Homolog annotation: Hit_ID=Q05006; Match level="QueryCoverage=86%, HitCoverage=90%, E-value=1e-142, Identity=92%"; Hit description=Cell division control protein 2 homolog 2
  Pfam annotation: Domain name=Pkinase; Domain location=4-285; Score =347.3; E_value=2.6e-101; Accession=PF00069.15; Description=Protein kinase domain
  Pfam annotation: Domain name=Pkinase_Tyr; Domain location=4-292; Score=29.0; E_value=3e-14; Accession=PF07714.7; Description=Protein tyrosine kinase
  Pfam module annotation: Pfam domain module=Pkinase::Pkinase_Tyr; Domain location=4-285::4-292
MDQYEKVEKIGEGTYGVVYKARDRATNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEDTWPGVTSLPDFKSTFPKWPSKDLANVVPNLDAAGLNLLSFNYHHPQSLRLGCGDVFKRFNSLLDYLLHSHSTYLPPMFP

SEQ ID NO: 127719 - protein, 292 aa, Glycine max
  Coding DNA Sequence Number=SeqID_10941
  Gene Ontology: Mol. function=catalytic activity; Cellular component =nucleus; Biological process=metabolic process
  Homolog annotation: Hit_ID=Q10MK9; Match level="QueryCoverage=98%, HitCoverage=50%, E-value=1e-120, Identity=70%"; Hit description=AMP -binding enzyme family protein, expressed
  Pfam annotation: Domain name=AMP-binding; Domain location=47-292; Score=-128.9; E_value=0.038; Accession=PF00501.18; Description=AMP -binding enzyme
MGVGRDIDDLPKNNANHTALTPLWFLERAALVHPTRTSVVHGSRHYTWHQTYQRCRRFASALSKHSIGLGHTVAVIAPNIPAIYEAHFGIPMAGAVLNTINIRLNAPAIAFLLAHSSAVAVIVDQEFFTVAEESLKIWSEKSKSFKPPILIVIGDDENCHPKALTHALAKGAVEYEKFLESGDPEFKWKPPQDEWQSIALGYTSGTTASPKGVVLHHRGAYLMSLSGALHWGMNEGAVYLWTLPMFHCNGWCYPWTLAALCGTNICLRQVTAKAVYAAIAKYKVTHFCAAPV

SEQ ID NO: 127720 - protein, 77 aa, Glycine max
  Coding DNA Sequence Number=SeqID_10942
MTSIATGTILGEGIITTLDGRILHNSSNNNNNLISRMLLAQANYTFLHQSSSNNNNSNNPRNNKQLRLLHNLPLKNL

SEQ ID NO: 127721 - protein, 286 aa, Glycine max
  Coding DNA Sequence Number=SeqID_10943
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=1e-37, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
FRGLHILTFRGLHALAVRGLHILTLRGLHVFTFRGLHTLAVRGLYVLTSRGLHVLTFRGLHFHSFRGLHVLIFRGMHSLAFRGLHVPIFRGLHVLTFRGLHVLTFRGLHSLAFRGLHVLAIRGLHVLAIRGLDVLAFRELHVLAIRGLHALTFRGLHVLTFRGLHVLTFRGLHVLTYIGLHALTFRGLHVLILIDYTPSPLEDYIGLHVLAFRGQHVLAFAFIELDALTFRGLHVLAFRGLHVLTFRGLRVFIFRGLHVLTFRGLHVLAFRGLHICTLREFKVLYP

SEQ ID NO: 127722 - protein, 93 aa, Glycine max
  Coding DNA Sequence Number=SeqID_10944
MGPFFDVLRSFFIVLQSSTVVLGEKNCFHEENPSQGALVTLPRRFREQICEGFPSFFTVLRSSTAFIFILFIFGFLFFHFKRALTDRLSRYLA

SEQ ID NO: 127723 - protein, 91 aa, Glycine max
  Coding DNA Sequence Number=SeqID_10945
MDLARKRNKAIGAIADSSDREFSNSLPSNLFGQRKLKTPSTGKTDYLILVNVTSAEVTSISTIGRGLKVGKKIGLSLELRTSSSLSERSVQ

SEQ ID NO: 127724 - protein, 55 aa, Glycine max
  Coding DNA Sequence Number=SeqID_10946
  Subcellular localization annotation: CTP_CleavageSite=33; ConfidenceScore=5.02e-01
MVLPIEDTTLLCTFFSIALSVKGGATLNFTGSRRAAVKSRADWRRPGGASQPSAK

SEQ ID NO: 127725 - protein, 297 aa, Glycine max
  Coding DNA Sequence Number=SeqID_10947
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=95%, HitCoverage=41%, E-value=1e-147, Identity=81%"; Hit description =Photosystem I P700 chlorophyll a apoprotein A1
  Pfam annotation: Domain name=PsaA_PsaB; Domain location=44-297; Score= -37.9; E_value=1e-05; Accession=PF00223.9; Description=Photosystem I psaApsaB protein
LFVCVVWKEEDSMIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQVVWPIVGQEILNGDVGGGFRGIQITSALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNW

SEQ ID NO: 127726 - protein, 82 aa, Glycine max
  Coding DNA Sequence Number=SeqID_10948
MHSSTHLESRLHAFYLLNLCKGIWETCRTAVGDLALINLEIEATCRRNNAARKRREQEAQGSSQTSSPPSPQIYIQMEEERA

SEQ ID NO: 127727 - protein, 359 aa, Glycine max
  Coding DNA Sequence Number=SeqID_10949
LKPLMVGGASVFTPLDGFVTLEIITNGLSTVEVVLLVPTLLLPTPLGIGEELESSSDSSISLPFSDEETSQNLMKGPEVTSGFKVIASNTSNDDVKVISIESDEEETEEDVFEQFRKEIDVERGDVVVGSGASENIVRSYALKSNKRKGPLRRFDHMTVSHDLPSLWNIDLKGFEFITTNKLLTKVDVEMMDYVGVDNYLDFIELLIMRRWFFPRFLRMKNWSRLFDGLNMKLNLAVKDLVGTKKIVSAFNDQLTTREEKKKFLELERDNLLKEKKLMQQAFIMGHEDGFQKALCQIQLLAFEVDLMLFDCLKNVKNGELVRESQMETFEEASGNETTSKEEDIEATSSLTLTSNIPTA

SEQ ID NO: 127728 - protein, 143 aa, Glycine max
  Coding DNA Sequence Number=SeqID_10950
MLLVFTKIPPPPNKDGFVMTDFKCASWNTLLLVVNIALLAKQWWKLMVNGESLMFKVINARWVIDRSIYVIKDKWIPNITGNRTQLRNEEVVLKDFRVQNLFGEEKKVIGFPKWKDGLQAGVAENAWYLEMTTREGVRAAINC

SEQ ID NO: 127729 - protein, 252 aa, Glycine max
  Coding DNA Sequence Number=SeqID_10951
MAMNVPRMIPDMLKLEPLDGINYKRWSQKLLILFEALEVDYVLSKDPPTDIVSPTNPSPATPVVTSFSEGTKKAHEEAKKKYEKDNKIVRGHLLNHMANNLFDLFINQKSAKANLLLEKFPPSWSDYHNQLKHKKRDLSLQELINHMKGKQNQNQNSVAPFAPQAHLAENEEVIVIVVVEENLVDNKDVADGECVFMGNSATAGVLGKGKTLLKLTSGKNLSLSDVLYAPSLRRNLISLNRDGLKLVWEADK

SEQ ID NO: 127730 - protein, 276 aa, Glycine max
  Coding DNA Sequence Number=SeqID_10952
  Gene Ontology: Mol. function=nucleic acid binding; Cellular component= intracellular; Biological process=DNA integration
  Homolog annotation: Hit_ID=Q1SRR6; Match level="QueryCoverage=88%, HitCoverage=35%, E-value=1e-49, Identity=52%"; Hit description =Integrase, catalytic region; Zinc finger, CCHC-type
MGDQVTSMLLDISTSEGSLSEHVSLSKMTLSLLDSSSALNEQVNEPRRTFLIKEDPKTYIEVVTSIDAKFWKEAINSELDFIMSNHTWDLVDLPKGSKPIRCKWIFRKKLRTDGTIDKFKARLVVVGYTQKKDIDFFDTFSPITKIAIIRSLVALVVIHGLVVHQMDVKMTFLNGDLREEIYVEQPEGFVVQGFCDANLVTDNDEVSSTSGYVFTLGGGTISWKSTKQTCIARSTMESKFIALDLASQEAELLRNLLTDVPLWGKWSIPVSLHCDS

SEQ ID NO: 127731 - protein, 199 aa, Glycine max
  Coding DNA Sequence Number=SeqID_10953
MSYIRKNCWNLDDPSITFSGSRKARVRAPTEAPPIAHPPPKPLASSSSSTSSDQLVPIKWLGLKSGLPLLGGEALEAQGPANGAYAGVEIAQEPTNEADDADPGAADTEIDADYVADVTAAQGAWDPWPTHDSSAKMLRVSETVSLHDRKLWSGRLIACKPVSCVNLNCERTTDSKLLIWHKSLNAEWMHDVEMIKAML

SEQ ID NO: 127732 - protein, 327 aa, Glycine max
  Coding DNA Sequence Number=SeqID_10954
MGGSDSGGSIEQPMMDREVISIGGSSSEDTRCGASDSESSSSERVRASRRTGGGTSRPSRRVQPSTAFGEPVSITMILPSSTSWGVKRSSGSGDVKESPSVRRSHRVGLSSSTPVVVSYEWVRDDILKYKSSLTSAVSVATLQCQVKLTSPENSCNIVVQACRSDDFPFLRAVCLFEVLGLILPSTAFQCIMLKHLNVACSQPHQNSWAMRVNNAILEQLLASLDVWTILSLPSASDPLTALDVVARFACIMGYFAWRPLMKQVEPTGHTREAGIMGQLVDEVGPIAIATEVTPNALFVLAKRKRDNGTVLSGHKKSKTHMSLRALR

SEQ ID NO: 127733 - protein, 321 aa, Glycine max
  Coding DNA Sequence Number=SeqID_10955
  Gene Ontology: Cellular component=nucleus; Biological process =regulation of progression through cell cycle
  Homolog annotation: Hit_ID=Q9ZR04; Match level="QueryCoverage=91%, HitCoverage=98%, E-value=2e-48, Identity=40%"; Hit description =Putative D-type cyclin
  Pfam annotation: Domain name=Cyclin_C; Domain location=150-279; Score= 20.1; E_value=0.001; Accession=PF02984.9; Description=Cyclin, C -terminal domain
  Pfam annotation: Domain name=Cyclin_N; Domain location=15-148; Score =39.4; E_value=1.2e-08; Accession=PF00134.13; Description=Cyclin, N -terminal domain
  Pfam module annotation: Pfam domain module=Cyclin_C::Cyclin_N; Domain location=150-279::15-148
MEFDLENPLENLHSDDVSYLFLIESDHTPSQNHSQTLKARDLDISVRRELISLISQLSCALDPVLSYLAINYLDRFLTNQGILQPKPWALRLVAVSCISLTVKMMGTEYPATDIQALLNQSDGGIIFETQTIQRMEALILGALQWRMRSITPFSFVAFFIALMGLKESPMGQVLKNRASEIIFKSQREIRLWGFKPSIIAASALLCASHELFPFQYPFFLKAISDSSYEIVEQCYKVIQDIAIEEEYSSALNGVSRSDTPINVLDHHFLSSESEKTNGITVANATDSPLGDLKRRKITGCGGNNPTILNSWIQPCERECEK

SEQ ID NO: 127734 - protein, 123 aa, Glycine max
  Coding DNA Sequence Number=SeqID_10956
  Gene Ontology: Mol. function=nucleoside transporter activity; Cellular component=membrane; Biological process=transport
  Homolog annotation: Hit_ID=Q69S28; Match level="QueryCoverage=71%, HitCoverage=21%, E-value=9e-28, Identity=60%"; Hit description =Putative equilibrative nucleoside transporter ENT8 splice variant
MYHLDQGFVFHHVAEIDTREESKAAMENNEPPRRLEGKHAAMAVCWLLGTGCLFAWNSMLTIEDYYVYLFPKYHPSRVLTLVYQPFAVGTLAILAYKEDRINTRIRNLFGYTLFFISTLSILI

SEQ ID NO: 127735 - protein, 43 aa, Glycine max
  Coding DNA Sequence Number=SeqID_10957
  Gene Ontology: Mol. function=plastoquinol-plastocyanin reductase activity; Cellular component=ubiquinol-cytochrome-c reductase complex; Biological process=electron transport
  Homolog annotation: Hit_ID=P26291; Match level="QueryCoverage=97%, HitCoverage=18%, E-value=2e-09, Identity=69%"; Hit description =Cytochrome b6-f complex iron-sulfur subunit, chloroplast precursor
  Subcellular localization annotation: CTP_CleavageSite=35; ConfidenceScore=5.16e-01
MASTTLSAATPSQLCSGKSGIFCPSQALFVKPMKSQMMGRARE

SEQ ID NO: 127736 - protein, 135 aa, Glycine max
  Coding DNA Sequence Number=SeqID_10958
  Gene Ontology: Mol. function=nucleoside transporter activity; Cellular component=membrane; Biological process=transport
  Homolog annotation: Hit_ID=Q69S28; Match level="QueryCoverage=78%, HitCoverage=53%, E-value=4e-24, Identity=86%"; Hit description =Putative equilibrative nucleoside transporter ENT8 splice variant
  Subcellular localization annotation: CTP_CleavageSite=21; ConfidenceScore=5.17e-01
SFLAGLAASGALTSALRLITKAAFENSKNGLRKGAIMFFAISTFFELLCVLLYAFVFPKLPIVKYYRSKAASEGSKTVSADLAAVWHTGLDDNVDIFFGVIQWLLHCLCSHFSTQRLQGTGTKCLGKFVGVVSSG

SEQ ID NO: 127737 - protein, 66 aa, Glycine max
  Coding DNA Sequence Number=SeqID_10959
DVVVTHNGVVVVDSEEGKTGMKKVDKGANYKNKEGIDSDNRFFKWDLWWVLSSKKMVAKVVVMGEG

SEQ ID NO: 127738 - protein, 54 aa, Glycine max
  Coding DNA Sequence Number=SeqID_10960
MARSVFAPCPYLRDLQGRELTRHLAITPQEHIAAVGTTSNNKFSKRKALDEGSL

SEQ ID NO: 127739 - protein, 125 aa, Glycine max
  Coding DNA Sequence Number=SeqID_10961
VFNQDFPLYIKHEDLSEIAHGGQCLCISVIQLWILHLTNTSMRAENSDVHGFLEPQFIQRFGQSQFESKSYMKNWMHNSKRDVYLGAYLNGPNNYLKGINNRALKGLDDTPQPKFKAGARWIVVK

SEQ ID NO: 127740 - protein, 47 aa, Glycine max
  Coding DNA Sequence Number=SeqID_10962
MAMAKYAYFCTVQKHSQEKTWKVLRKENERNGSQTNHPGKRNLNQEL

SEQ ID NO: 127741 - protein, 67 aa, Glycine max
  Coding DNA Sequence Number=SeqID_10963
MSTNKDANSKMGDSSFNGEVDEREICEHENSSNRDFSHKTVYVHLTHWTISSKSILLLSFHPSFLKQ

SEQ ID NO: 127742 - protein, 118 aa, Glycine max
  Coding DNA Sequence Number=SeqID_10964
MAGAGDNGGVYHQLDGSQRLLLDVMTTQMQCLLNRNNEELYRRIERLEQQLNPNAGRPYGGNTRVSDGSNRIEGQDRIEGVKLNVSSFKSRSDLDTYVDWEMKIQHAFSYNDYPEEQK

SEQ ID NO: 127743 - protein, 136 aa, Glycine max
  Coding DNA Sequence Number=SeqID_10965
MPPTVPVNHYSDPEGQHNRIRILWCYPMLITGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 127744 - protein, 471 aa, Glycine max
  Coding DNA Sequence Number=SeqID_10966
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=73%, HitCoverage=28%, E-value=2e-70, Identity=44%"; Hit description=Chromo
  Pfam annotation: Domain name=Chromo; Domain location=371-416; Score =17.3; E_value=0.0089; Accession=PF00385.14; Description='chromo' (CHRromatin Organisation MOdifier
  Pfam annotation: Domain name=rve; Domain location=161-317; Score =48.0; E_value=3.3e-11; Accession=PF00665.16; Description=Integrase core domain
  Pfam module annotation: Pfam domain module=Chromo::rve; Domain location=371-416::161-317
EKEGGGCRPARPECCGTLWIARKCSLSTSGMPRNFTNYLTMGVKYLEAVKQRLQAIKQWSPDKIRTPKQQQWLPKFLGYDFNIKYKPGKENIPADALSKSLFIAWSKPTNHWLAKVVVVTKEDKLFSELISRYAHRGTIDPKYDAKVDQAVPAGLLQPLPIPQQIWEDIALYFITNLPSSHGHSTIMVIVDRLSKFGHFIALKVEFNSKLEADAFINNVTKIHGFPLSIVFDRDRVSINSFWQQLFKAQGTTLAMSSSYYPQSDGQMEILNKTLEMYLRCFVFDKPKLWYPMLALAKYWNNSSYHHNLGMSPFKVVFGREPPAVVPYQVHPKDHVSLQETLVGDLALVKLQPYMQHSIALRKNQKLGMHFFGPFEVVEREGQVLIQWESFDASEASWEDLVAMKQSYPRFNLEDKVDFKGKGIVASNFVGDNYAGNFVMNDGHVEGDPQNMATRRSTRAHRENVHLRGYAH

SEQ ID NO: 127745 - protein, 92 aa, Glycine max
  Coding DNA Sequence Number=SeqID_10967
MVGYAPSSFADLVFASERIEVERSELSRIRVIRLNMSTEKILQLFLILEKFFLRGSTAFFILPCYKVVETKQRWVPQSLTLGQGGAPCMSLK

SEQ ID NO: 127746 - protein, 63 aa, Glycine max
  Coding DNA Sequence Number=SeqID_10968
MLVRMIRTHLFVAARVKSCPSMHSGCMIASLFGCARTDLEFSEGAYMESHEGDGVQPYEGEGK

SEQ ID NO: 127747 - protein, 67 aa, Glycine max
  Coding DNA Sequence Number=SeqID_10969
MIIKSSNIFALIWFHRNISISRAHRNPAYKSQVFENKETEVAAEPHRIGVGFRKPRNRNGGRAAQDR

SEQ ID NO: 127748 - protein, 57 aa, Glycine max
  Coding DNA Sequence Number=SeqID_10970
MSPGVRRPWARQVGCYCPKPSLADPDPTRAKSAKRSVAAGNRLPFVCNRLHSVICCW

SEQ ID NO: 127749 - protein, 789 aa, Glycine max
  Coding DNA Sequence Number=SeqID_10971
  Gene Ontology: Mol. function=hydrogen ion transporting ATP synthase activity, rotational mechanism; Cellular component=proton -transporting two-sector ATPase complex; Biological process =regulation of transcription, DNA-dependent
  Homolog annotation: Hit_ID=P0AG30; Match level="QueryCoverage=50%, HitCoverage=95%, E-value=0.0, Identity=97%"; Hit description =Transcription termination factor rho
  Pfam annotation: Domain name=ATP-synt_ab; Domain location=137-345; Score=263.9; E_value=3.3e-76; Accession=PF00006.15; Description=ATP synthase alphabeta family, nucleotide-binding domain
  Pfam annotation: Domain name=Glycos_transf_4; Domain location=483 -646; Score=55.3; E_value=2.1e-13; Accession=PF00953.11; Description =Glycosyl transferase
  Pfam annotation: Domain name=OB_RNB; Domain location=33-96; Score =12.6; E_value=0.0011; Accession=PF08206.2; Description=Ribonuclease B OB domain
  Pfam annotation: Domain name=Rho_N; Domain location=1-27; Score=30.3; E_value=7e-06; Accession=PF07498.2; Description=Rho termination factor, N-terminal doma
  Pfam annotation: Domain name=Rho_RNA_bind; Domain location=29-106; Score=203.6; E_value=4.5e-58; Accession=PF07497.2; Description=Rho termination factor, RNA-binding doma
  Pfam module annotation: Pfam domain module=ATP-synt_ab::Glycos_transf_ 4::OB_RNB::Rho_N::Rho_RNA_bind; Domain location=137-345::483-646::33 -96::1-27::29-106
MGLENLARMRKQDIIFAILKQHAKSGEDIFGDGVLEILQDGFGFLRSGDSSYLAGPDDIYVSPSQIRRFNLRTGDTISGKIRPPKEGERYFALLKVNEVNYDKPENARSKILFENLTPLHANNRLRMERGNGSTEDLTARVLDLASPIGRGQRGLIVAPPKAGKTMLLQNIAQSIAYNYPDCVLMVLLIDERPEEVTEMQRLVKGEVIASTFDEPASRHVQVAEMVIEKAKRLVEHKKDVIILLDSITRLARAYNTVVPASGKVLTGGVDANALHRPKRFFGAARNVEEGGSLTIIATALVDTGSKMDEVIYEEFKGTGNMELHLSRKIAEKRVFPAIDYNRSGTRKEELLTSQEELQKMWILRKIIHPMGEIDAMEFLINKLAMTKTNDEFFDMMKRSKAAVFSANARAATEFRPGIYSNGGKIAYCSFLFFARKAAKKIGLVDTPNSRKRHHGAIPLVGGISVYAGICFAFAISNYYLPHAVLYLFCAGVLVLVGALDDRFDISVKIRAVVQAAIAIVMMVGAKLYLLSLGFIIGPVELIVGPFGYVLTLFAVWAAINAFNMVDGIDGLLGGLSCVTFAAMGIILYFDGQTSLAMWCFAMIAATIPYILLNLGFLGRRYKVFMGDAGSTMIGFTIIWILLETTQGLSHPITPVTALWLIAIPLMDMVAIMYRRLRKGMSPFSADRQHIHHLIMRAGFTSRQAFLLITVAAALLAGIGVLGEYLAFIPEWVMLALFLAAFLLYERTGCTRPRLHAVARQRLDYWPGAAVCAAGVVGFHVNEAILERHG

SEQ ID NO: 127750 - protein, 728 aa, Glycine max
  Coding DNA Sequence Number=SeqID_10972
  Gene Ontology: Mol. function=3-octaprenyl-4-hydroxybenzoate decarboxylase activity; Cellular component=membrane; Biological process=ubiquinone biosynthetic process
  Homolog annotation: Hit_ID=P0AAB4; Match level="QueryCoverage=65%, HitCoverage=96%, E-value=0.0, Identity=90%"; Hit description=3 -octaprenyl-4-hydroxybenzoate carboxy-lyase
  Pfam annotation: Domain name=Peptidase_S51; Domain location=63-217; Score=213.9; E_value=3.6e-61; Accession=PF03575.7; Description =Peptidase family S51
  Pfam annotation: Domain name=UbiD; Domain location=246-668; Score =813.7; E_value=1e-241; Accession=PF01977.7; Description=3-octaprenyl- 4-hydroxybenzoate carboxy-lyase
  Pfam module annotation: Pfam domain module=Peptidase_S51::UbiD; Domain location=63-217::246-668
MDAKNNKPVVRVIAHRRPETRNGKVADDAPLLSYAHPQLHAMIAQRGITSAVLVPYAIIRDDHAQRAQALSQSLGIPVRTVHEFETPVAAIEQAELILVSGGNTWLLNQMLHEQGLIVAIQRAVRERDVPYVGWSAGCNVATPSIRTTNDMPVRSSVVLPALGLFPVQINPHYLDAHVSGHMGETRDERLAEFCAVNPQESVIALREASFLHVSENRLRYYSARGEDFKVFRHGEAIAAYHDVLALQSLRGELKRITQEIDPVLEMTEIADRTLRAGGPALLFENPKGYSMPVLCNLFGTPKRVAMGMGQEEVSALREVGKLLAFLKEPEPPKGFRDLFDKMPQFKQVLNMPTKRLRNAPCQEEIFSGDEVDLARIPVMKCWPGDAAPLITWGLTVSRGPHKERQNLGIYRQQVIGKNRVIMRWLSHRGGALDFQEWCKAHPGERFPVAVALGADPATILGAVTPVPDTLSEYAFAGLLRGNKTEVVKCVSNDLEVPASAEIVLEGYIEPGDMAPEGPYGDHTGYYNEVDSFPVFTVTHVTQRRNPIYHSTYTGRPPDEPAVLGVALNEVLVPILIKQFPEIVDFYLPPEGCSYRLAVVTIKKQYAGHAKRVMFGVWSFLRQFMYTKFVIVCDDDVNARDWNDVIWAITTRMDPARDTVLVENTPIDYLDFASPVSGLGSKMGLDATNKWPGETQREWGTPIVKDPAVTARIDAIWDELAIFAEPPQR

SEQ ID NO: 127751 - protein, 327 aa, Glycine max
  Coding DNA Sequence Number=SeqID_10973
  Gene Ontology: Mol. function=hydrolase activity
  Homolog annotation: Hit_ID=Q6DAP9; Match level="QueryCoverage=48%, HitCoverage=98%, E-value=1e-65, Identity=74%"; Hit description =Transcriptional activator
  Pfam annotation: Domain name=NusG; Domain location=2-91; Score=108.6; E_value=1.8e-29; Accession=PF02357.9; Description=Transcription termination factor nusG
MESWYLLYCKRGQLLRAKEHLERQEVNCLSPMIALEKIVRGKRTTVSEPLFPNYLFIEFDPEAIHTTTISSTRGVSHFVRFGAMPATVPYEVIEALQTDAPQILLDPETPQVGDEVLITDGTFEGLRAIFAEPDGETRSILLLNLLNKQVMRSVDNKQFLRLAVHHASAPPAERYAAESRVRYGARSDADAYRAAADRARPSPAADDLPESAAACHAAPFRAVHRTPSRAPPRPPVSAATAAAPPENVHVPHDSVKTPAAAVPPPAGAAHQTRTPAARARKGGAAYWQFPPTTRWHDAGARRRSTSSSPRAGSPADAPAGSPGHWCR

SEQ ID NO: 127752 - protein, 1256 aa, Glycine max
  Coding DNA Sequence Number=SeqID_10974
  Homolog annotation: Hit_ID=P27829; Match level="QueryCoverage=31%, HitCoverage=95%, E-value=1e-175, Identity=76%"; Hit description=UDP -N-acetyl-D-mannosamine dehydrogenase
  Pfam annotation: Domain name=3Beta_HSD; Domain location=407-678; Score=-62.3; E_value=2e-08; Accession=PF01073.9; Description=3-beta hydroxysteroid dehydrogenaseisomerase family
  Pfam annotation: Domain name=3HCDH_N; Domain location=3-114; Score= -112.3; E_value=0.062; Accession=PF02737.8; Description=3-hydroxyacyl- CoA dehydrogenase, NAD binding domain
  Pfam annotation: Domain name=Acetyltransf_1; Domain location=1166 -1244; Score=60.5; E_value=5.4e-15; Accession=PF00583.14; Description= Acetyltransferase (GNAT) family
  Pfam annotation: Domain name=ApbA; Domain location=6-147; Score= -29.4; E_value=0.057; Accession=PF02558.6; Description=Ketopantoate reductase PanEApbA
  Pfam annotation: Domain name=Epimerase; Domain location=406-654; Score=322.9; E_value=5.6e-94; Accession=PF01370.11; Description=NAD dependent epimerasedehydratase family
  Pfam annotation: Domain name=NAD_binding_2; Domain location=3-164; Score=-67.0; E_value=0.0042; Accession=PF03446.5; Description=NAD binding domain of 6-phosphogluconate dehydrogenase
  Pfam annotation: Domain name=NAD_binding_4; Domain location=408-638; Score=-13.5; E_value=9.1e-08; Accession=PF07993.2; Description=Male sterility protein
  Pfam annotation: Domain name=NTP_transferase; Domain location=753 -991; Score=394.8; E_value=1.3e-115; Accession=PF00483.13; Description=Nucleotidyl transferase
  Pfam annotation: Domain name=Polysacc_synt_2; Domain location=406 -716; Score=-136.3; E_value=3.3e-05; Accession=PF02719.6; Description= Polysaccharide biosynthesis protein
  Pfam annotation: Domain name=RmlD_sub_bind; Domain location=405-736; Score=-114.6; E_value=2.6e-06; Accession=PF04321.7; Description=RmlD substrate binding domain
  Pfam annotation: Domain name=UDPG_MGDP_dh; Domain location=204-296; Score=163.6; E_value=5.1e-46; Accession=PF00984.10; Description=UDP -glucoseGDP-mannose dehydrogenase family, central domain
  Pfam annotation: Domain name=UDPG_MGDP_dh_C; Domain location=323-418; Score=73.2; E_value=8.3e-19; Accession=PF03720.5; Description=UDP -glucoseGDP-mannose dehydrogenase family, UDP binding domain
  Pfam annotation: Domain name=UDPG_MGDP_dh_N; Domain location=4-196; Score=297.2; E_value=3e-86; Accession=PF03721.5; Description=UDP -glucoseGDP-mannose dehydrogenase family, NAD binding domain
  Pfam annotation: Domain name=adh_short; Domain location=404-581; Score=-6.9; E_value=1.6e-05; Accession=PF00106.15; Description=short chain dehydrogenase
  Pfam module annotation: Pfam domain module=3Beta_HSD::3HCDH _N::Acetyltransf_1::ApbA::Epimerase::NAD_binding_2::NAD_binding _4::NTP_transferase::Polysacc_synt_2::RmlD_sub_bind::UDPG_MGDP _dh::UDPG_MGDP_dh_C::UDPG_MGDP_dh_N:...
  Pfam module annotation: Pfam domain module=:adh_short; Domain location=407-678::3-114::1166-1244::6-147::406-654::3-164::408 -638::753-991::406-716::405-736::204-296::323-418::4-196::404-581
MRFSTISVIGLGYIGLPTAAVFASHGKQVIGVDINARAVETINRGEIHIVEPELGDVVRAAVHNGNLRATTQPEAADAFLIAVPTPFVGDHQPDLSYVQAAALSIAPVLKAGDLVILESTSPVGATEQMAQWLAAGRPDLRFPQHGEQPDVFIAYCPERVLPGKVMVELLENDRVIGGMTPACSARAIELYRIFLRGECVETNARTAEMCKLTENSFRDVNIAFANELSLICAEQGINVWELIALANRHPRVNILQPGPGVGGHCIAVDPWFIVAQNPQQARLIRTAREVNDAKPGWVLDQVKQALAECLTASGKRATDVTIACFGLAFKPNIDDLRESPAMSVAQRIAGWHSGRTWVVEPHVADIPPQLAERATLVSLADALQHADILVMLVDHAQFRAVTPEEFLVTGGAGFIGSALVRFLIANTDHRVVVVDKLSYAGNLASLAPVEQDARFAFEQVDICDRAALDRVLAQYQPDCIMHLAAESHVDRSIDGPIAFVETNIVGTYQLLEATRHYWNGMTDERKKGFILHHISTDEVFGDLHGTEDFFTETTPYAPSSPYSATKASSDHLVRAWLRTYGLPVVVTNCSNNYGPYHFPEKLIPLTIINALAGKPLPVYGNGSQIRDWLYVEDHARALYTVVSSGKVGETYNIGGHNERRNIEVVETLCDLLDELAPQQRAAGLSSYRELITFVHDRPGHDLRYAIDASKIARELGWTPQETFDSGIRKTVQWYLANPQWWQAILNGRGATMKGIILAGGSGTRLHPITRAISKQLLPVYDKPMIYYPLSVLMLAGIRDILIITTPDDRAHFERLLGDGSEFGLQLQYAEQPSPDGLAQAFIIGESFIGDDSCCLVLGDNLYFGQGFSPKLKKVAARSHGATVFAYQVMDPERFGVVEFDDDFNALSIEEKPQQPKSRWAVTGLYFYDNRVVEFAKQVQPSARGELEITAINQMYLEQGELAVELLGRGFAWLDTGTHDSLIEASVFVQTVEKRQGFKIACLEEIAWRNGWLSDEQLLAAAQALTKTGYGHIDPLAWESDFFRCATARLTLDGDVPLAEALQQPYTLWQVKVPAQDSAAIDALSQHGFQLVEGEADLAINIKRTERQTGVRIAREAQIPQLRAAAAQAFSQSRFRAPWFDAEDSGRFYAKWIENAVRGTFDHQCLIACDEQGALQGFVSMREVAGDARIGLLAVLPAAQGNGVGQRLLLAAADWGRVRQLERLRVATQLSNLTAMRLYLRSGARLESTAYWFYRKA

SEQ ID NO: 127753 - protein, 540 aa, Glycine max
  Coding DNA Sequence Number=SeqID_10975
  Gene Ontology: Cellular component=membrane; Biological process =polysaccharide biosynthetic process
  Homolog annotation: Hit_ID=Q7CKZ1; Match level="QueryCoverage=60%, HitCoverage=77%, E-value=1e-110, Identity=63%"; Hit description =Putative cytochrome
MALLEKVQIAARGKHLRHAPLGDTPQQIKQAVLQPGALFIEIGAPDVPERLLSPQLAAEQRQPQARIELAVKEEALTAIGGACDHRLRQRALAGIHVDLQLRIGQQGIRRGRYHHKLTRRVGWRFNAHDVVKEAQQRVIVMRDIGAQHVSENIGAYFKDVTAQLPDKKIAHGTELRGKQQPDGDIAQQPDTKAGRRHRRQHKAQRAANFARDVGFMLQPRQRWQQPDAERGGDKLQIRIGDAGDALPQPDLRPALLLRQQITHHHPGYRQGHGRHQRHQGKFGQITRQRRLPLRHQPAQRQFLAVASQHPQRRPDQQRRHQRQPDQRTGIATQPPAQHITHHADQAAGDQRQRVTARIAKTFQQRQCEVGPGNAQLQKGDDTHHVLPGGVAKQRPADGLRRQQEQQRQQCGKPQHHCRRGAGHGAQLRRLLAELRDIGGYAVEDTRAGQHAEHGNQLAKVTRLADALGAEAHRQQFHHQQASDNFYQRGRGGKEAQQRTDYRTLVVVRQVVEQRQPQQALALARSERIRAVEAAKTRAGR

SEQ ID NO: 127754 - protein, 75 aa, Glycine max
  Coding DNA Sequence Number=SeqID_10976
  Gene Ontology: Mol. function=transferase activity, transferring glycosyl groups; Cellular component=1-2nm peptidoglycan-based cell wall; Biological process=enterobacterial common antigen biosynthetic process
  Homolog annotation: Hit_ID=Q7MYM4; Match level="QueryCoverage=84%, HitCoverage=17%, E-value=7e-14, Identity=53%"; Hit description=4 -alpha-L-fucosyltransferase
MPETAIPAPAASDSFTILLGNSGDRSNRHIEGLQAIRRQFGEQVNVVIPLGYPASNYEYIDEIDAAAQRLFPRGQ

SEQ ID NO: 127755 - protein, 872 aa, Glycine max
  Coding DNA Sequence Number=SeqID_10977
  Homolog annotation: Hit_ID=UPI00005F7CCD; Match level="QueryCoverage =36%, HitCoverage=93%, E-value=1e-120, Identity=63%"; Hit description= COG2267: Lysophospholipase
  Pfam annotation: Domain name=Abhydrolase_1; Domain location=370-609; Score=111.4; E_value=2.6e-30; Accession=PF00561.10; Description =alphabeta hydrolase fold
  Pfam annotation: Domain name=Hydrolase; Domain location=614-847; Score=35.2; E_value=2.3e-07; Accession=PF00702.16; Description =haloacid dehalogenase-like hydrolase
  Pfam annotation: Domain name=Hydrolase_3; Domain location=617-872; Score=278.2; E_value=1.6e-80; Accession=PF08282.2; Description =haloacid dehalogenase-like hydrolase
  Pfam annotation: Domain name=LysE; Domain location=1-166; Score =125.0; E_value=2.1e-34; Accession=PF01810.9; Description=LysE type translocator
  Pfam annotation: Domain name=S6PP; Domain location=613-867; Score= -64.9; E_value=5.2e-06; Accession=PF05116.4; Description=Sucrose-6F -phosphate phosphohydrolase
  Pfam module annotation: Pfam domain module=Abhydrolase_1::Hydrolase::H ydrolase_3::LysE::S6PP; Domain location=370-609::614-847::617-872::1 -166::613-867
MGVLGITLGIVIWAGVALMGLHLILEKMAWLHEIIMVGGGLYLLWMGWQLLRSARQRHKQPHTEAPVVELPKRGMSFLKGFLTNLSNPKAIIYFGSVFSLFVGNDVGAIERWGLFLLIVGETFAWFTLVAAIFALPWMRDKYQRMAKWVDGMAGVLFAGFARRYDQCQSLRHFTCAGQQCADRHKQATKHPVQQLHLLRTFDPAGDARRQRGVTNHHNDVDHDGGHAEHQILHQLRLVRHDKLRKQRGEKHNALRIGCRTAIAVADAGAHGVDRAGTGREAEDGRGGRMQQHKQSWLGREHAFSAFATGPLLDFWRQREECEFSGVGNLTIRYVRFTSPQHRRVILIVPGRIESYIKYPELAYDLFHCGYDVVIIDHRGQGRSDRLLADSHRGHVVEFSDYVDDLETLYLKEIVSHHYQQRYVLAHSMGGAIVALFLARQPQAFHAAVFCAPMFGIVLPLPPFLAHRILDWAEKLPALRDGYALGTGRWRASPFGINRLTHSRERYRRNLRFYADDPAIRVGGPTYHWVREGIQAGRHILNQVAQITTPILLLQASEDDVVDNRAQDLFCEAMAAAGHAVEGTTPYIIQGARHEILFETDAMRAEALNAVAYMYHIVASDLDGTLLSPQHRLTPFARTTLQELVARDVHFIFATGRHYIDVGQMRDKLGIPAYMITSNGARVHNADGELVFSHNLDSDIASELYGLKYHDEKILTHVYRDDEWHISRHNPQEAEFFQESVFTYQVYQPGMLATDGISKVFFTCDDPEHLVPLEQAIEARWGDRVNVSFSLPTCLEVMAGGVSKGHALEAVAKQLGYSLKECIAFGDGMNDVEMLSMAGKGCIMRNAHQRLKDTLPTLEVIGSNADDAVPQTL

SEQ ID NO: 127756 - protein, 160 aa, Glycine max
  Coding DNA Sequence Number=SeqID_10978
  Homolog annotation: Hit_ID=Q1R9V0; Match level="QueryCoverage=93%, HitCoverage=86%, E-value=3e-42, Identity=55%"; Hit description =Hypothetical protein yehS
  Pfam annotation: Domain name=DUF1456; Domain location=3-70; Score =124.8; E_value=2.4e-34; Accession=PF07308.3; Description=Protein of unknown function (DUF1456)
  Pfam annotation: Domain name=DUF1456; Domain location=86-153; Score =114.5; E_value=3e-31; Accession=PF07308.3; Description=Protein of unknown function (DUF1456)
  Pfam module annotation: Pfam domain module=DUF1456::DUF1456; Domain location=3-70::86-153
MTNNDVLRSVRYMLDLSDSKVVEIFALAGSEVPREDVQAWLKKDDDEAFRKLPDVLMGYFLNGLIFYRRGKSEDAPAPSVERRMNNNIFLKKLRIAFALKTTDIPDILLKANFKVSQAEIGAIFRNPDHKNYRECGDQILRNFLKGLTLIQRPSTPAKKS

SEQ ID NO: 127757 - protein, 360 aa, Glycine max
  Coding DNA Sequence Number=SeqID_10979
  Gene Ontology: Mol. function=transferase activity, transferring glycosyl groups; Cellular component=membrane fraction; Biological process=nucleotide catabolic process
  Homolog annotation: Hit_ID=UPI00002F4B6D; Match level="QueryCoverage =66%, HitCoverage=94%, E-value=1e-105, Identity=80%"; Hit description= uridine phosphorylase
  Pfam annotation: Domain name=PNP_UDP_1; Domain location=47-273; Score= 351.1; E_value=1.9e-102; Accession=PF01048.10; Description =Phosphorylase family
MVLSVLASAQSRNYSLALRQGWRRESDMAQSDVFHLGITKADLKGATLAIVPGDPERVKKIAALMENPQHLASHREFTTWLAEIDGKPVVVCSTGIGGPSTSIAVEELAQLGVRTFLRVGTTGAIQPHINVGDVLVTTASVRLDGASLHFAPMEFPAVADFACTTALVAAAEACGATTHIGVTASSDTFYPGQERYDTFSGRVVSRFQGSMKEWQQMGVLNYEMESATLLTMCASQGLRAGMVAGVIVNRTQKEIPDAATMKQTESDAAYRELSNCLIRMRAISADSEKFPMRKTISVPRPGFTSRPAAMQARVESAAARFRQAMAASDYPLARQCCEEVLRVMPNQMQVLSDYALTLMR

SEQ ID NO: 127758 - protein, 503 aa, Glycine max
  Coding DNA Sequence Number=SeqID_10980
  Gene Ontology: Mol. function=protein binding; Biological process=DNA recombination
  Homolog annotation: Hit_ID=Q8ZAL8; Match level="QueryCoverage=77%, HitCoverage=87%, E-value=1e-162, Identity=71%"; Hit description=DNA recombination protein rmuC homolog
  Pfam annotation: Domain name=RmuC; Domain location=186-466; Score =396.2; E_value=5e-116; Accession=PF02646.7; Description=RmuC family
MNVLDIHTVALYLLLSETIRGGIMDQQLIISGALALAGLGIGWIIAQLRAGHQHASFTTERRLLEQAQQRQQQQLEQLQQQLQQREQELRQLHGTLSGAQERLQQLDYWRAESEQLSRELRNQLEVNSAQEAELREVTIRLEETRFAAEEKQRLLTNSEQRLSAQFENLANRIFENSGKRVDEQNRQSLNSLIGPLREQLDGFRRQVNDSFGQEARERHTLAHEIRQLQQLNAQMAQEAINLTKALKGDNKIQGNWGEVVLSRVLEASGLREGYEYQTQVSVQLEQQCRMQPDVIVRLPQGKDVVIDAKMTLIAYERYFNADDELTREQAIQEHINAVRGHIRLLGRKDYQQLPGYARWIIEALQQNIMLVSPTTLLVALRTINNLWRYEHQSRNAQRIADRAARLYDKMRLFVDDMSGIGHSLDKAQQSYQLAMKKLAQGRGNLIAQSESFRALGVEIKRPINPQLAEQAQPDAADDTWADDSEPAENAADSSAASLRRINE

SEQ ID NO: 127759 - protein, 320 aa, Glycine max
  Coding DNA Sequence Number=SeqID_10981
  Homolog annotation: Hit_ID=Q6JE33; Match level="QueryCoverage=98%, HitCoverage=82%, E-value=1e-20, Identity=28%"; Hit description=S3 -locus linked F-box protein
  Pfam annotation: Domain name=F-box; Domain location=6-53; Score=35.5; E_value=1.9e-07; Accession=PF00646.23; Description=F-box domain
  Pfam annotation: Domain name=FBA_3; Domain location=216-316; Score= -21.1; E_value=0.013; Accession=PF08268.2; Description=F-box associated
  Pfam module annotation: Pfam domain module=F-box::FBA_3; Domain location=6-53::216-316
MVDGNLKQEFLPYDVIINILKRLPVKSLIRFKCVSKDWFNLFQNTPNFFTQQHLNHSAHTNAFLLLQRIPRQPRPLPFSTCLIGPDINFVHPPQFFDIASPAAKIVASCNGILCLRDKTALSLFNPASRQIKQVPGTTLFGLYYVGFGFSPVANDYKIVRISMGVFDEEHQVVVLDNVRVDRAEVYSLTTGSWRQIDATKLRPLCLVSSSVATTETIFWLATMTSDSDTDSEIVVSFDIGREMFTLLNGPPLPPSPTRSYDNVLAECNDKLAVFRHYIIGDYESCSFDLWVLEDVHNHTSSGESWIKMYSVGPFSRGRVV

SEQ ID NO: 127760 - protein, 76 aa, Glycine max
  Coding DNA Sequence Number=SeqID_10982
MWELVKAHEIQALRQIRDNDWKQEPSLTKSDILEKVFARCESWKGIYGSHTSCGESVYGGIRFKRTNGTVAQKQLT

SEQ ID NO: 127761 - protein, 98 aa, Glycine max
  Coding DNA Sequence Number=SeqID_10983
MTVNDRCFKLQITDVRVGAKSYHESVLDVISVPHHHDLTLKLHQVVDIDAIFPSTTNEVKVMIYADGGQFEKHWAIEKLRDMGSKFRTMRRWPEMVVH

SEQ ID NO: 127762 - protein, 156 aa, Glycine max
  Coding DNA Sequence Number=SeqID_10984
  Gene Ontology: Mol. function=structural molecule activity
  Homolog annotation: Hit_ID=Q06Z73; Match level="QueryCoverage=71%, HitCoverage=40%, E-value=1e-34, Identity=65%"; Hit description =Fibrillin 8
  Pfam annotation: Domain name=PAP_fibrillin; Domain location=26-156; Score=-4.8; E_value=1.1e-05; Accession=PF04755.3; Description=PAP _fibrillin
MKSGLSWRSLSLVPCALKAYYDYELENKKHLLLTSIQDTQRGLLTTTNQCSCIEEALVSLEGCNIGCHPINLSNLDGTWRLQYTSSSDVLILLQAVATFPFFQVGQIFQKFECCHQSNGGVIRYVVRWSIPNLLEEILDSIAERNDFNGFIVFVQM

SEQ ID NO: 127763 - protein, 86 aa, Glycine max
  Coding DNA Sequence Number=SeqID_10985
MDREKLALTFFHEAHKVHLHMNYDTIVWKLILDKIQTNTTKLTTETVGRRPRWDHSRVKARRLAITGVRLMETTMSISQGLESDAS

SEQ ID NO: 127764 - protein, 87 aa, Glycine max
  Coding DNA Sequence Number=SeqID_10986
MTEGCGEGFCLANLPGDAFSLWGNFFEAKKQMMADAKVGGAGLWPRAKFRIGWPPPPPRDQFCCQDFANFGLRPLAKSVPRWWIIMS

SEQ ID NO: 127765 - protein, 72 aa, Glycine max
  Coding DNA Sequence Number=SeqID_10987
MAEQLIRDRVEMECLEGAWETLEGNTRCRFRGTIRFTATSLVHPDEPARTLQRTAEWTAPWISFVYFLGPDV

SEQ ID NO: 127766 - protein, 57 aa, Glycine max
  Coding DNA Sequence Number=SeqID_10988
MTFQTSCPSTPPTPTKIVMTNTTSFDDGERLLKKVLPWPSMCTREGSLVKKLKALHP

SEQ ID NO: 127767 - protein, 70 aa, Glycine max
  Coding DNA Sequence Number=SeqID_10989
MAFGTMAARPNELMVHPEVTGSPRKVGSFSPKQFRGPGEPEASLSELGVRSENTFPGYRPMRDHGSSPTQ

SEQ ID NO: 127768 - protein, 81 aa, Glycine max
  Coding DNA Sequence Number=SeqID_10990
MSPTSNADLLNAYVDQLKHITNQKEAETKTMGRKAYLDVDDGAKPHGGPQCHQSKAPKHTNEMKKKTTMQEEAERPRRAVT

SEQ ID NO: 127769 - protein, 114 aa, Glycine max
  Coding DNA Sequence Number=SeqID_10991
MVPLSMNCNTFIYDEVTMLVRCRNMDDGTQFFYQPDLLYGVKPNDENDGIEDSNDKNMGGEDTDLQAQPSYPDFSSYFITDEGERSRNSTKTSQCANPPELENVGVLLNQKGGL

SEQ ID NO: 127770 - protein, 121 aa, Glycine max
  Coding DNA Sequence Number=SeqID_10992
MNSCGGVEEGNTMWPRLEALVDMTTVFADGIRMRTTINEYQKENDKCTSGRTNLERLQKSWGGTEGESLLLIVFATWLLGLCLKIPFFSIVQGFVNLGIRIRVQKELDLMGCLCVVQFLRD

SEQ ID NO: 127771 - protein, 115 aa, Glycine max
  Coding DNA Sequence Number=SeqID_10993
MQIAARIGVFLLDATPDSGVASFNGVLQELGLASLTGELRGAQFLGAGQQRLFPRLQSAMCRGCRVSPAPMAFWLAKSASTSSDLCCLGFLNPPSPVDHSCEKKIQKREACWCCV

SEQ ID NO: 127772 - protein, 150 aa, Glycine max
  Coding DNA Sequence Number=SeqID_10994
  Gene Ontology: Mol. function=cysteine-type endopeptidase activity; Cellular component=endoplasmic reticulum; Biological process =proteolysis
  Homolog annotation: Hit_ID=Q6Y1E6; Match level="QueryCoverage=99%, HitCoverage=43%, E-value=3e-72, Identity=84%"; Hit description =Cysteine protease 8
  Pfam annotation: Domain name=Peptidase_C1; Domain location=1-149; Score=172.3; E_value=1.2e-48; Accession=PF00112.13; Description =Papain family cysteine protease
MDGAFKFIIQNHGLNTEANYPYKAVDGKCNANEAANHAATITGYEDVPVNNEKALQKAVANQPVSVAIDASGSDFQFYKTGVFTGSCGTQLDHGVTAVGYGVSADGTQYWLVKNSWGTEWGEEGYIMMQRGVKAQEGLCGIAMMASYPTA

SEQ ID NO: 127773 - protein, 98 aa, Glycine max
  Coding DNA Sequence Number=SeqID_10995
YVNGFSCNPSSLNDALRLAFEFEKVKMIRGKEGVGPTCENSSMRPLGLLHTFLSPSPSIPSFFLKFHASFSLKSPTSTFRAFSDAEEDEEDDEEEDQD

SEQ ID NO: 127774 - protein, 398 aa, Glycine max
  Coding DNA Sequence Number=SeqID_10996
  Gene Ontology: Mol. function=general RNA polymerase II transcription factor activity; Cellular component=holo TFIIH complex; Biological process=regulation of global transcription from RNA polymerase II promoter
  Homolog annotation: Hit_ID=Q017B7; Match level="QueryCoverage=78%, HitCoverage=75%, E-value=3e-68, Identity=42%"; Hit description =Chromosome 06 contig 1, DNA sequence
  Pfam annotation: Domain name=Ssl1; Domain location=47-302; Score =562.9; E_value=3.1e-166; Accession=PF04056.5; Description=Ssl1-like
CILDFPATSAAPGLLTVASFGLAIMNNVAERPLNGDVEDDDEDDGGGLEAWERTYAEDRSWEALQEDESGLLRPIDTTAIYHAQYRRRLRTLAATAATARIQKGLIRYLYIVVDLSKAASERDFRPSRMAVMGKQVEAFIREFFDQNPLSHVGLVTIKDGIAHCITELGGSPESHIKALMGKLECSGDASLQNALELVLGYLNQIPSYGHREVLILYSALSTCDPGDLMETIQKCKKSKIRCSVIGLAAEMFVCKHLCQETGGTYSVALDESHFKELILEHAPPPPAIAEYATANLIKMGFPQRSAEGSVAICTCHEEAKTGGGYTCPRCKVRVCELPTECRVTPSSQNDSNHSFPNTCFGCQQSLLSQEVLRYAKVWRRDVVRSLTLAYAKRLFPDS

SEQ ID NO: 127775 - protein, 262 aa, Glycine max
  Coding DNA Sequence Number=SeqID_10997
  Gene Ontology: Mol. function=RNA-directed DNA polymerase activity; Biological process=RNA-dependent DNA replication
MGEVEEVQEQIKANMEAMKEQMATMVEAMMSMKKIMEANAVTVAATSAVAKVKSMPPSGLNQMNHPTSVMVGKDFGSMSGPYYVQIQNKHTFPPYGLPLNYTPPNMAYTPSEDVNNSTPILIESRQPQTDHAHVSQPMGETHEMPHHNLADFEPCLGYATEGQAVGYIPLQNTLESPQYHTQPHPLHSTPEERLRAIEGGEDYAFANLEELFLVPNIITPPKFKVSNFNKYKGTTCPKNHLKMYCRKMGAYTKDEELLIHFF

SEQ ID NO: 127776 - protein, 211 aa, Glycine max
  Coding DNA Sequence Number=SeqID_10998
  Gene Ontology: Mol. function=transcription regulator activity; Cellular component=nucleus; Biological process=regulation of transcription
  Homolog annotation: Hit_ID=Q9LET0; Match level="QueryCoverage=67%, HitCoverage=65%, E-value=2e-37, Identity=56%"; Hit description =Putative HLH DNA binding protein
MDGFNAVFFVSSDHENVACSSSESGHFCFEGFEVKRIEDFYEVGDEVGAVLAAQRGLEDEPSVAATGGVVASGGGEHRDLVGLRRNGFKLGNLRGLLLQLLHPLDNLRQKRSLVVEVGVDSLPPSLLSLLVVLHGSKGSIMVGGCFGNLGEVEGVVISIIGGISREGVVHGVSVRCSMEEGGVGGGGGGGGVGKELEEVRVVHGKVVHDDR

SEQ ID NO: 127777 - protein, 130 aa, Glycine max
  Coding DNA Sequence Number=SeqID_10999
MEWLLGSVFWVGLLLGEMTRGCKYWTGLSVPGTGRIMCCVGFPNLAFGGRKRKKGVVTGRRKRASLLQRIRTQKVVLTTLVGHHYQYNNIIVRFFNTLSHAQYFLDLVREQQMIGGRNGSEDEVQDQNKL

SEQ ID NO: 127778 - protein, 347 aa, Glycine max
  Coding DNA Sequence Number=SeqID_11000
  Gene Ontology: Mol. function=transporter activity; Cellular component= integral to membrane; Biological process=auxin mediated signaling pathway
  Homolog annotation: Hit_ID=Q673E5; Match level="QueryCoverage=98%, HitCoverage=57%, E-value=1e-150, Identity=80%"; Hit description =Putative auxin efflux carrier protein 10
  Pfam annotation: Domain name=Mem_trans; Domain location=1-347; Score=- 19.9; E_value=1.2e-06; Accession=PF03547.8; Description=Membrane transport protein
YRGARLLIVEQFPDTAGSIISFKVDSDIISLDGKEPLQTEAEVGDDGKLHVTVRKSASSRSEIFSRRSHGGLNSVSLTPRPSNLTNAEIYSLQSSRNPTPRGSSFNHTDFYSIVNGGGGRNNNVSVSPRQSNFGGFDEESGGGMRVNGGYPGPANAGIFSPVAKKKGGESGGGGGGGGKDLHMFVWSSSASPVSEGGIHAFRGGGDYGSDQLPVCGVAHQKDYDEFGHDEFSFGNRTIANGVDKEGPVLSKLGSSSTAELHPKAQGESKPTSMPPTSVMTRLILIMVWRKLIRNPNTYSSLFGLTWSLISFKWNVVMPAIVAKSISILSDAGLGMAMFSLGIFNKID

SEQ ID NO: 127779 - protein, 70 aa, Glycine max
  Coding DNA Sequence Number=SeqID_11001
MSDQQQLQSKFSPSKNSDSRLVENRVRKRGEERDGLGGAGGSPEGPWRWWPVKVVEEDEPLRFFDDSSIL

SEQ ID NO: 127780 - protein, 83 aa, Glycine max
  Coding DNA Sequence Number=SeqID_11002
MSRNLTDYAIVPSLASGMLRNFTDCALTLPFNSRHVAELHGLPNDGCQVPRNGQAKVTSHQTDGPRMKLGYDSCPSLLVIYWR

SEQ ID NO: 127781 - protein, 90 aa, Glycine max
  Coding DNA Sequence Number=SeqID_11003
  Gene Ontology: Cellular component=integral to membrane
  Homolog annotation: Hit_ID=Q9SJH9; Match level="QueryCoverage=75%, HitCoverage=34%, E-value=6e-08, Identity=43%"; Hit description =Expressed protein
MEGILMMEHFGWRGMDAIGSGNWGFWQWNPLPQSRRSRIRSKSGSADATGGGGYRFLAKQAVTAASLTLTGDTIPQLSNHWRKAKEGGGS

SEQ ID NO: 127782 - protein, 122 aa, Glycine max
  Coding DNA Sequence Number=SeqID_11004
  Homolog annotation: Hit_ID=Q1RY24; Match level="QueryCoverage=56%, HitCoverage=15%, E-value=4e-15, Identity=60%"; Hit description =Pentatricopeptide repeat
MEAVVALFERMSQRDVFSWTIVDSFALNGNFDASIRFFRKMMIHKDVVDGLVKPNEVTCSGVLSSCANLDVMQASLELVGLGSSSSMDSFASWRMNGSGMEKGREKGDATSRRSESRRSSPP

SEQ ID NO: 127783 - protein, 61 aa, Glycine max
  Coding DNA Sequence Number=SeqID_11005
  Gene Ontology: Cellular component=integral to membrane
  Homolog annotation: Hit_ID=Q9SJH9; Match level="QueryCoverage=60%, HitCoverage=15%, E-value=1e-10, Identity=81%"; Hit description =Expressed protein
MTSYGFLLYGPGSYAWYQCLDHFLPKPTVQNLMLKELAGVKDSGDTFYVIFVSSSSSSLMA

SEQ ID NO: 127784 - protein, 194 aa, Glycine max
  Coding DNA Sequence Number=SeqID_11006
  Gene Ontology: Mol. function=methyltransferase activity; Cellular component=intracellular; Biological process=regulation of transcription
  Homolog annotation: Hit_ID=Q1RY24; Match level="QueryCoverage=99%, HitCoverage=44%, E-value=4e-69, Identity=68%"; Hit description =Pentatricopeptide repeat
  Pfam annotation: Domain name=PPR; Domain location=20-54; Score=46.5; E_value=9e-11; Accession=PF01535.11; Description=PPR repeat
  Pfam annotation: Domain name=PPR; Domain location=55-89; Score=0.2; E_ value=7.1; Accession=PF01535.11; Description=PPR repeat
  Pfam annotation: Domain name=PPR; Domain location=91-125; Score=4.4; E_value=2.2; Accession=PF01535.11; Description=PPR repeat
  Pfam module annotation: Pfam domain module=PPR::PPR::PPR; Domain location=20-54::55-89::91-125
MGCLSNAENVFRVMVVREVSTWNAMVSSLASHGRENEALDMFKRMKLHGLKPNSITFVVVLTTYARGNLIREGLDLFRSMWYDFGIKQNLEHYGCVIDLLGKAGHNEEATEIIRNMSFQPYASILGACRIHGAIELGEGIGKKMLRLQTQYCGQYVLLSSMNAKERWDRAAGLRREIMEAGIHKFPEYSMVDLT

SEQ ID NO: 127785 - protein, 110 aa, Glycine max
  Coding DNA Sequence Number=SeqID_11007
MDCFSSPYHHYRHYHHCSRTKSSSRLARKTENGTVEPIQISLDTLPATAKPSSPSLLRSPTSSLPIKELLLLSPSSARRSKEEEAQWETQEGETQLGAFSTTFNFFSKYA

SEQ ID NO: 127786 - protein, 97 aa, Glycine max
  Coding DNA Sequence Number=SeqID_11008
MKIKKRTKERKEGFPIKDRKEVKRGKEATLDQRKEENRKSPKPDCHSESFLTGNIPPHMNKEEKTETPSFLSKNADLEKILLISPMFPLRVCLKARS

SEQ ID NO: 127787 - protein, 76 aa, Glycine max
  Coding DNA Sequence Number=SeqID_11009
RKGESGRASTSRPRVKREISALSTAGVFSQAQRKTGAKSKPTYSRKREDLCTLFQSANFSKRALEATRGAACALKP

SEQ ID NO: 127788 - protein, 80 aa, Glycine max
  Coding DNA Sequence Number=SeqID_11010
  Subcellular localization annotation: CTP_CleavageSite=57; ConfidenceScore=5.40e-01
MFQNTNTKIQHPLHRSQAHSHQNPTPHLTNAFLTKKCPSLTFVGIAPRRFWHNVRILALLEWYLTDGSGPPRWRPSLPST

SEQ ID NO: 127789 - protein, 110 aa, Glycine max
  Coding DNA Sequence Number=SeqID_11011
  Gene Ontology: Mol. function=enzyme inhibitor activity
  Homolog annotation: Hit_ID=Q1S1D0; Match level="QueryCoverage=94%, HitCoverage=60%, E-value=1e-14, Identity=41%"; Hit description =Pectinesterase inhibitor
AILQLSLYKAIEGQKFLRTLMKSENVPAIAQCANSDYESVITAYKSALSKLKDDPKTAKHYARDAGNGPVSCETALAATTVYFNFEISNLNIQMGSLSYIATLAIDKLII

SEQ ID NO: 127790 - protein, 329 aa, Glycine max
  Coding DNA Sequence Number=SeqID_11012
  Gene Ontology: Mol. function=DNA binding; Cellular component =mitochondrion; Biological process=protein amino acid phosphorylation
  Homolog annotation: Hit_ID=Q1SMD3; Match level="QueryCoverage=90%, HitCoverage=86%, E-value=6e-93, Identity=39%"; Hit description=TonB box, N-terminal; Tetratricopeptide-like helical
  Pfam annotation: Domain name=PPR; Domain location=129-163; Score =49.8; E_value=9.3e-12; Accession=PF01535.11; Description=PPR repeat
  Pfam annotation: Domain name=PPR; Domain location=164-198; Score =54.7; E_value=3.1e-13; Accession=PF01535.11; Description=PPR repeat
  Pfam annotation: Domain name=PPR; Domain location=199-233; Score =38.6; E_value=2.2e-08; Accession=PF01535.11; Description=PPR repeat
  Pfam annotation: Domain name=PPR; Domain location=234-268; Score =49.8; E_value=9.2e-12; Accession=PF01535.11; Description=PPR repeat
  Pfam annotation: Domain name=PPR; Domain location=24-58; Score=48.1; E_value=3.1e-11; Accession=PF01535.11; Description=PPR repeat
  Pfam annotation: Domain name=PPR; Domain location=269-303; Score =14.7; E_value=0.13; Accession=PF01535.11; Description=PPR repeat
  Pfam annotation: Domain name=PPR; Domain location=59-93; Score=36.8; E_value=7.3e-08; Accession=PF01535.11; Description=PPR repeat
  Pfam annotation: Domain name=PPR; Domain location=94-128; Score=38.6; E_value=2.2e-08; Accession=PF01535.11; Description=PPR repeat
  Pfam module annotation: Pfam domain module=PPR::PPR::PPR::PPR::PPR::PP R::PPR::PPR; Domain location=129-163::164-198::199-233::234-268::24 -58::269-303::59-93::94-128
EGKMKEAFSLLNEMKLKNINPDVYTFNILIDALGKEGKMKEASSLMNEMILKNINPDVCTFNILIDALGKKGRVKEAKIVLAVMMKACVEPDVVTYNSLIDGYFLVNEVKHAKYVFYSMAQRGVTPNVQCYNNMINGLCKKKMVDEAMSLFEEMKHKNMIPDIVTYTSLIDGLCKNHHLERAIALLKEMKEHGIQPDVYSYTILLDGLCKGGRLENAKEFFQHLLVKGCHLNVWTYNVMINGLCKAGLFGEAMDLKSKMEGKGCMPNAITFRTIICALSEKDENDKGEKILREMIARGLLKEGWWDSNVPLGFGSGLLAGVAWGSSFSH

SEQ ID NO: 127791 - protein, 118 aa, Glycine max
  Coding DNA Sequence Number=SeqID_11013
  Gene Ontology: Mol. function=oxidoreductase activity; Cellular component=proton-transporting two-sector ATPase complex; Biological process=ethylene biosynthetic process
  Homolog annotation: Hit_ID=Q1S835; Match level="QueryCoverage=69%, HitCoverage=22%, E-value=2e-26, Identity=60%"; Hit description=2OG -Fe(II) oxygenase
  Pfam annotation: Domain name=2OG-FeII_Oxy; Domain location=36-115; Score=65.2; E_value=2.1e-16; Accession=PF03171.10; Description=2OG -Fe(II) oxygenase superfamily
MEFSRHGQVLGNLLFELLSEALGLLPDHLKDMDCAKGHLIFCHCYPSCREPELKMGTRSHTDPDFITILFQDHVGGLKVLVQNYWIDMPPIPGALVLNIGDLLQHTTSMPICCTTKDD

SEQ ID NO: 127792 - protein, 66 aa, Glycine max
  Coding DNA Sequence Number=SeqID_11014
MKHLGIDNKKFVIENEKAMKVAYLGMVGTWNSKIKPAKGHKINFRVESSNILVENDRVTNKEVIEE

SEQ ID NO: 127793 - protein, 767 aa, Glycine max
  Coding DNA Sequence Number=SeqID_11015
  Gene Ontology: Mol. function=protein serine/threonine kinase activity; Cellular component=mitochondrion; Biological process =protein amino acid phosphorylation
  Homolog annotation: Hit_ID=Q1RSC2; Match level="QueryCoverage=85%, HitCoverage=92%, E-value=1e-159, Identity=37%"; Hit description =Pentatricopeptide repeat
  Pfam annotation: Domain name=PPR; Domain location=122-156; Score =19.3; E_value=0.014; Accession=PF01535.11; Description=PPR repeat
  Pfam annotation: Domain name=PPR; Domain location=157-191; Score =24.2; E_value=0.00045; Accession=PF01535.11; Description=PPR repeat
  Pfam annotation: Domain name=PPR; Domain location=192-226; Score =33.8; E_value=5.8e-07; Accession=PF01535.11; Description=PPR repeat
  Pfam annotation: Domain name=PPR; Domain location=227-261; Score =46.9; E_value=7.1e-11; Accession=PF01535.11; Description=PPR repeat
  Pfam annotation: Domain name=PPR; Domain location=262-296; Score =48.3; E_value=2.6e-11; Accession=PF01535.11; Description=PPR repeat
  Pfam annotation: Domain name=PPR; Domain location=297-331; Score =36.2; E_value=1.1e-07; Accession=PF01535.11; Description=PPR repeat
  Pfam annotation: Domain name=PPR; Domain location=332-366; Score =38.4; E_value=2.5e-08; Accession=PF01535.11; Description=PPR repeat
  Pfam annotation: Domain name=PPR; Domain location=367-401; Score =54.7; E_value=3.1e-13; Accession=PF01535.11; Description=PPR repeat
  Pfam annotation: Domain name=PPR; Domain location=402-436; Score =49.4; E_value=1.2e-11; Accession=PF01535.11; Description=PPR repeat
  Pfam annotation: Domain name=PPR; Domain location=437-471; Score =37.2; E_value=5.8e-08; Accession=PF01535.11; Description=PPR repeat
  Pfam annotation: Domain name=PPR; Domain location=472-506; Score =44.5; E_value=3.6e-10; Accession=PF01535.11; Description=PPR repeat
  Pfam annotation: Domain name=PPR; Domain location=507-541; Score =17.4; E_value=0.051; Accession=PF01535.11; Description=PPR repeat
  Pfam annotation: Domain name=PPR; Domain location=562-596; Score =32.7; E_value=1.3e-06; Accession=PF01535.11; Description=PPR repeat
  Pfam annotation: Domain name=PPR; Domain location=597-631; Score =43.8; E_value=6e-10; Accession=PF01535.11; Description=PPR repeat
  Pfam annotation: Domain name=PPR; Domain location=632-666; Score =53.9; E_value=5.4e-13; Accession=PF01535.11; Description=PPR repeat
  Pfam annotation: Domain name=PPR; Domain location=667-701; Score =39.8; E_value=9.2e-09; Accession=PF01535.11; Description=PPR repeat
  Pfam annotation: Domain name=PPR; Domain location=87-121; Score=15.8; E_value=0.1; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR; Domain location=122-156::157-191::192-226::227-261::262-296::297-331::332 -366::367-401::...
  Pfam module annotation: Domain location=402-436::437-471::472 -506::507-541::562-596::597-631::632-666::667-701::87-121
  Subcellular localization annotation: CTP_CleavageSite=34; ConfidenceScore=5.48e-01
RGKYVPKIHPSSIFCTLCPSSLPMPSFSSLRTFRVSVFSHFLLSYPPIATATLHYQSHSQPHYHHHHHHAVASFDRMLLMRPPPPTFHFNYILSSLVNNKHYPTVISLFKKFESNGATPDLCTLNILMNCFCHLTHITFAFSVLANILKRGYHPNAITLNTLIKGLCFRGEIKKALYFHDQVVAQGFQLNQVSYRTLINGLCKTGETKAVARLLRKLEGHSVKPDVVMYNTIIHSLCKNKLLGDACDLYSEMIVKGISPNVVTYNALVYGFCIMGHLKEAFSLLNEMKLKNINPDVCTFNTLIDALGKEGKMKAAKIVLAVMMKACIKPDVVTYNSLIDGYFFLNKVKNAKYVFYSMAQSGVTPNVRTYTTMIDGLCKEKMVDEAMSLFEEMKYKNMIPDIVTYTSLIDGLCKNHHLERAIALCKKMKEQGIQPDVYSYTILLDALCKGGRLENAKEFFQRLLVKGYHLNVQTYNVMINGLCKADLFGEAMDLKSKMEGKGCMPDAITFKTIICALFEKDENDKAEKILREMIARGLQEVRLKEAKIVLAVMTKACIKPDVVTYGTLMDGYFLVNELKHAKYVFYSMAQMGVTPNVQCYTIMIDGLCKKKTVDEAMSLFEEMKHKNMFPNIVTYTSLIDALCKNHHLERAIALLKEMKEHGIQPDVYSYTILLDGLCKSGRLEGAKEIFQRLLVKGYHLNVQGNQGFCGNQLLNKCEYNGRSPFGPPSASDNDQDSGFLGEFDGKVVLIGFGSGLLAGVTLGSSFSH

SEQ ID NO: 127794 - protein, 232 aa, Glycine max
  Coding DNA Sequence Number=SeqID_11016
  Gene Ontology: Mol. function=helicase activity; Biological process =protein amino acid phosphorylation
  Homolog annotation: Hit_ID=Q1SRJ5; Match level="QueryCoverage=99%, HitCoverage=33%, E-value=4e-41, Identity=40%"; Hit description =Probable helicase [imported]-Arabidopsis thaliana-related
MGFLQDDREFIDSTKEAKDRGSAHYLRKVFVLLLLTELHFDDDNLKNLVLREIEQLLQANQRSLRDYPSMPYPENGNLATYLDNNLILAELNYNNEELRLEFLQLFSQMTNQQATIYNQIIQAVNPNEGCMFFLYGYGGIGKTFIWKALASSLRASNKIVIMVASSGITSLLLPEGRTTHSKFKVPTPIFEDSTCNIHQGTQLAELLNEASLIIWDEAPWLTNFFLKHLIKV

SEQ ID NO: 127795 - protein, 96 aa, Glycine max
  Coding DNA Sequence Number=SeqID_11017
  Subcellular localization annotation: CTP_CleavageSite=27; ConfidenceScore=5.06e-01
MCRLGSRFRFSNSSRAVRVRSVPRPKSCGHKREMKHQVEARDTWRVVKVESEVSRGVFGYLTGRRGTGRDFGCDWEAPKTKVTALQVSKDASRGRQ

SEQ ID NO: 127796 - protein, 32 aa, Glycine max
  Coding DNA Sequence Number=SeqID_11018
MAWVTGDPLGFISEFTAQTNKFILIAIYFKRK

SEQ ID NO: 127797 - protein, 250 aa, Glycine max
  Coding DNA Sequence Number=SeqID_11019
  Gene Ontology: Mol. function=nucleic acid binding
  Homolog annotation: Hit_ID=Q9FNZ2; Match level="QueryCoverage=94%, HitCoverage=53%, E-value=1e-55, Identity=46%"; Hit description=Zfwd1 protein
  Pfam annotation: Domain name=WD40; Domain location=124-162; Score =31.8; E_value=2.4e-06; Accession=PF00400.22; Description=WD domain, G-beta repeat
  Pfam annotation: Domain name=WD40; Domain location=203-239; Score =8.9; E_value=3.3; Accession=PF00400.22; Description=WD domain, G -beta repeat
  Pfam annotation: Domain name=zf-CCCH; Domain location=12-36; Score =16.5; E_value=0.0086; Accession=PF00642.15; Description=Zinc finger C-x8-C-x5-C-x3-H type (and similar)
  Pfam annotation: Domain name=zf-CCCH; Domain location=93-118; Score =12.9; E_value=0.026; Accession=PF00642.15; Description=Zinc finger C- x8-C-x5-C-x3-H type (and similar)
  Pfam module annotation: Pfam domain module=WD40::WD40::zf-CCCH::zf -CCCH; Domain location=124-162::203-239::12-36::93-118
MDTKFARRTERIGSTTCSYWRAGRCNRNRCRFLHIETPSPPAACGYGNTAYSYGKKPHSSSENTPKYGSKKALLGDNGDRGDATRVAKAFKKSSPRICKYWINNNCVHGEQCLYLHSWFRGDGFSTVTKLHEHKKVITGIALPVGSDKLYSGSTDGTVRIWDCHTGQCAKVINLGAEVTSLISEGSWIFVGLQNAVKAWNIQTMSEFTLDGPKGRVRAMTVGNNTLFAGAEDGVIFAWRGSSKADSPFEL

SEQ ID NO: 127798 - protein, 126 aa, Glycine max
  Coding DNA Sequence Number=SeqID_11020
  Gene Ontology: Mol. function=protein phosphatase inhibitor activity; Biological process=regulation of signal transduction
  Homolog annotation: Hit_ID=Q9LTK0; Match level="QueryCoverage=78%, HitCoverage=53%, E-value=5e-21, Identity=50%"; Hit description =Arabidopsis thaliana genomic DNA, chromosome 5, BAC clone:F17P19
MGYEVFFISGQSFRGRVRWDEANIGEIEANKPVRQKITEPKTPYHPMIDDDSSLSPVRGSFDACIDDQNHTMHAEAIWSALNDVASSSRRGTGQSGGWTSSEDEPEAMEQDDDDNDGIRVLTDLVK

SEQ ID NO: 127799 - protein, 50 aa, Glycine max
  Coding DNA Sequence Number=SeqID_11021
LALERQGYSYQACHHQAMVSSLSDGGRACFGEAGVFIPGMPSPSNGIITK

SEQ ID NO: 127800 - protein, 106 aa, Glycine max
  Coding DNA Sequence Number=SeqID_11022
MEDVWVSGVGGKSLRANTKVKVFTGTVCLKHSVQLWWGYSLEVLVGVTPKFNELSIVDEFHDHISTTYQKNVEVRGEHVTLYLNSSIWTEMVTLNLVTISYEYPQS

SEQ ID NO: 127801 - protein, 351 aa, Glycine max
  Coding DNA Sequence Number=SeqID_11023
  Gene Ontology: Mol. function=RNA-directed DNA polymerase activity; Cellular component=chromatin; Biological process=chromatin assembly or disassembly
  Subcellular localization annotation: CTP_CleavageSite=33; ConfidenceScore=5.14e-01
MQFASLFQPPTTLPPSRPTNHAIHLTPNSTPVNIQPYRYPYFQKQEIETQVATMLQTGIIRPSTSPFSLQVLALNALTVKDRFLIPTIDELLDELGGTSWFSKLDLMQGYCQILMAVDDISKTAFRTHHSHYEFLVEYLGHLVSHRGVEPVPTKVKAVQQWSTPQSTRALRKFLGLSGFYRWFIKGYASIAAPPTRLLTTDSFQWNPEATQAFELQKELFQDSTFLEYHQQIQQAPQEYPECCIRQGFILKKGRIWLPKGLSSIQMILAEFHATPTGGHMGIAKILACLSENFVWLSMKNNEDLSLDFIMGLPSLQGHSAVLVIVDHFSKGSGLRSRPFVREPLLARAVQA

SEQ ID NO: 127802 - protein, 147 aa, Glycine max
  Coding DNA Sequence Number=SeqID_11024
  Gene Ontology: Mol. function=oxidoreductase activity; Cellular component=integral to membrane; Biological process=electron transport
  Homolog annotation: Hit_ID=Q6QNI4; Match level="QueryCoverage=52%, HitCoverage=15%, E-value=3e-21, Identity=57%"; Hit description =Cytochrome P450
MACFYDAVEEHVGKKCHDGHVDVDDGEDQNDFVDILLSIQETNTTDFQIDRTFVKTLVMDIVNAWAISTDPSYWDQPLEFQPGRFLKSSLDIKGHDFELIRFGARRRGCPGIGFAMALNEVVLANIVHQFYWAVPGGVVEGTDTEYV

SEQ ID NO: 127803 - protein, 47 aa, Glycine max
  Coding DNA Sequence Number=SeqID_11025
MRFSFERNYEVPFECKHNGNIQVTYDYECKGKMSRCRCEKIVNSWCL

SEQ ID NO: 127804 - protein, 585 aa, Glycine max
  Coding DNA Sequence Number=SeqID_11026
  Gene Ontology: Mol. function=calcium ion binding; Cellular component =mitochondrion; Biological process=protein amino acid phosphorylation
  Homolog annotation: Hit_ID=Q1SMD0; Match level="QueryCoverage=91%, HitCoverage=89%, E-value=1e-133, Identity=35%"; Hit description =Tetratricopeptide-like helical
  Pfam annotation: Domain name=PPR; Domain location=132-166; Score =24.5; E_value=0.00039; Accession=PF01535.11; Description=PPR repeat
  Pfam annotation: Domain name=PPR; Domain location=167-201; Score =35.8; E_value=1.5e-07; Accession=PF01535.11; Description=PPR repeat
  Pfam annotation: Domain name=PPR; Domain location=202-236; Score =46.4; E_value=9.7e-11; Accession=PF01535.11; Description=PPR repeat
  Pfam annotation: Domain name=PPR; Domain location=237-271; Score =52.0; E_value=2e-12; Accession=PF01535.11; Description=PPR repeat
  Pfam annotation: Domain name=PPR; Domain location=272-306; Score =49.2; E_value=1.4e-11; Accession=PF01535.11; Description=PPR repeat
  Pfam annotation: Domain name=PPR; Domain location=307-341; Score =47.7; E_value=3.9e-11; Accession=PF01535.11; Description=PPR repeat
  Pfam annotation: Domain name=PPR; Domain location=342-376; Score =40.1; E_value=7.6e-09; Accession=PF01535.11; Description=PPR repeat
  Pfam annotation: Domain name=PPR; Domain location=377-411; Score =40.1; E_value=7.6e-09; Accession=PF01535.11; Description=PPR repeat
  Pfam annotation: Domain name=PPR; Domain location=412-446; Score =48.7; E_value=1.9e-11; Accession=PF01535.11; Description=PPR repeat
  Pfam annotation: Domain name=PPR; Domain location=447-481; Score =48.9; E_value=1.7e-11; Accession=PF01535.11; Description=PPR repeat
  Pfam annotation: Domain name=PPR; Domain location=482-516; Score =33.5; E_value=7.3e-07; Accession=PF01535.11; Description=PPR repeat
  Pfam annotation: Domain name=PPR; Domain location=517-551; Score =45.2; E_value=2.2e-10; Accession=PF01535.11; Description=PPR repeat
  Pfam annotation: Domain name=PPR; Domain location=552-585; Score =14.7; E_value=0.14; Accession=PF01535.11; Description=PPR repeat
  Pfam annotation: Domain name=PPR; Domain location=62-96; Score=19.6; E_value=0.011; Accession=PF01535.11; Description=PPR repeat
  Pfam annotation: Domain name=PPR; Domain location=97-131; Score=20.2; E_value=0.0076; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR; Domain location=132 -166::167-201::202-236::237-271::272-306::307-341::342-376::377 -411::412-446::...
  Pfam module annotation: Domain location=447-481::482-516::517 -551::552-585::62-96::97-131
MPSFSFLRTLRLSLFPPYTPIAIPTATLHSQSHSQPHSHHHHHDAVASFNRMLLMRPPPPTFLFNNILSSLVKNKRYPTVISLFKQFEPNGITPDLCTLSILINCFCHLTHITFAFSVFANILKRGYHPNAITLNTLIKGLCFCGEIKRALHFHDKVVAQGFQLDQVSYGTLINGLCKAGETKAVARLLRKLEGHSVKPDLVMYTTIIHCLCKNKLLGDACDLYSEMIVKGISPNVFTYTTLIHGFCIMGNLKEAFSLLNEMKLKNINPDVYTFNILIDALAKEGKMKEAFSLTNEMKLKNINPDVYTFSILIDALGKEGKMKEAFSLLNEMKLKNINPSVCTFNILIDALGKEGKMKEAKIVLAMMMKACIKPNVVTYNSLIDGYFLVNEVKHAKYVFHSMAQRGVTPDVQCYTIMIDGLCKKKMVDEAMSLFEEMKHKNMFPNIVTYTSLIDGLCKNHHLERAIALCKKMKEQGIQPNVYSYTILLDALCKGGRLENAKQFFQHLLVKGYHLNVRTYNVMINGLCKAGLFGDVMDLKSKMEGKGCMPNAITFKTIICALLEKDENDKAEKFLREMIARGLLKV

SEQ ID NO: 127805 - protein, 60 aa, Glycine max
  Coding DNA Sequence Number=SeqID_11027
MACFYDEAVEEHVGKKCHDGHGDVDDGEDQNDFVDILLSIQETNTTDFQIDRAFVKTLVM

SEQ ID NO: 127806 - protein, 583 aa, Glycine max
  Coding DNA Sequence Number=SeqID_11028
  Gene Ontology: Mol. function=calcium ion binding; Cellular component =mitochondrion; Biological process=protein amino acid phosphorylation
  Homolog annotation: Hit_ID=Q1RSC2; Match level="QueryCoverage=92%, HitCoverage=91%, E-value=1e-134, Identity=47%"; Hit description =Pentatricopeptide repeat
  Pfam annotation: Domain name=PPR; Domain location=130-164; Score =23.5; E_value=0.00075; Accession=PF01535.11; Description=PPR repeat
  Pfam annotation: Domain name=PPR; Domain location=165-199; Score =37.1; E_value=6.3e-08; Accession=PF01535.11; Description=PPR repeat
  Pfam annotation: Domain name=PPR; Domain location=200-234; Score =47.8; E_value=3.6e-11; Accession=PF01535.11; Description=PPR repeat
  Pfam annotation: Domain name=PPR; Domain location=235-269; Score =51.3; E_value=3.2e-12; Accession=PF01535.11; Description=PPR repeat
  Pfam annotation: Domain name=PPR; Domain location=270-304; Score =48.1; E_value=3.1e-11; Accession=PF01535.11; Description=PPR repeat
  Pfam annotation: Domain name=PPR; Domain location=305-339; Score =50.2; E_value=6.8e-12; Accession=PF01535.11; Description=PPR repeat
  Pfam annotation: Domain name=PPR; Domain location=340-374; Score =40.1; E_value=7.6e-09; Accession=PF01535.11; Description=PPR repeat
  Pfam annotation: Domain name=PPR; Domain location=375-409; Score =40.1; E_value=7.6e-09; Accession=PF01535.11; Description=PPR repeat
  Pfam annotation: Domain name=PPR; Domain location=410-444; Score =48.2; E_value=2.8e-11; Accession=PF01535.11; Description=PPR repeat
  Pfam annotation: Domain name=PPR; Domain location=445-479; Score =49.4; E_value=1.2e-11; Accession=PF01535.11; Description=PPR repeat
  Pfam annotation: Domain name=PPR; Domain location=480-514; Score =33.5; E_value=7.3e-07; Accession=PF01535.11; Description=PPR repeat
  Pfam annotation: Domain name=PPR; Domain location=515-549; Score =45.7; E_value=1.5e-10; Accession=PF01535.11; Description=PPR repeat
  Pfam annotation: Domain name=PPR; Domain location=550-583; Score =15.8; E_value=0.1; Accession=PF01535.11; Description=PPR repeat
  Pfam annotation: Domain name=PPR; Domain location=60-94; Score=17.6; E_value=0.046; Accession=PF01535.11; Description=PPR repeat
  Pfam annotation: Domain name=PPR; Domain location=95-129; Score=23.2; E_value=0.00091; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR; Domain location=130 -164::165-199::200-234::235-269::270-304::305-339::340-374::375 -409::410-444::...
  Pfam module annotation: Domain location=445-479::480-514::515 -549::550-583::60-94::95-129
MPSFSFLRTFRLSLFPPYPPIATATLHSQSHSQPHSHHHHHHAVASFNRMLLMRPPPPTFHFDNILSSLVKNKHYLTVISLFKQFQSNGVTPNLCTLNILINCFCHLAHITFAFSVFANILKRGYHPDAITLNTLIKGLCFCGEIKRALYFHDKVVAQGFQLDQVSYGTLINGLCKAGETKAVARLLRKLEGHSVKPDVVMYTTIIHCLCKNKRVGDACDLYSEMIVKGISPNVFTYNTLIYGFCIMGNLKEAFSLLNEMKLKNINPDVYTFNILIDALGKEGKMKEASSLMNEMILKNINPDVYTFNILIDALGKEGKMKEAFSLLNEMKLKNINPSVCTFNILIDALGKEGKMKEAKIVLAMMMKACIKPNVVTYNSLIDGYFLVNEVKHAKYVFHSMAQRGVTPDVQCYTIMINGLCKKKMVDEAISLFEEMKHKNMFPNIVTYTSLIDGLCKNHHLERAIALCKKMKEQGIQPDVYSYTILLDALCKGGRLENAKQFFQHLLVKGYHLNVRTYNVMINGLCKAGLFGDVMDLKSKMEGKGCMPDAITFKTIICALFEKDENDKAEKFLREMIARGLLEV

SEQ ID NO: 127807 - protein, 271 aa, Glycine max
  Coding DNA Sequence Number=SeqID_11029
  Gene Ontology: Mol. function=nucleic acid binding; Biological process= regulation of transcription
  Homolog annotation: Hit_ID=Q1RY40; Match level="QueryCoverage=92%, HitCoverage=81%, E-value=2e-56, Identity=48%"; Hit description=Zinc finger, CCCH-type
  Subcellular localization annotation: CTP_CleavageSite=31; ConfidenceScore=5.62e-01
MAPPTPPTMTPATPTPPINSACLSSRSGAVLAAGAMTGQTVHLYIPARRPAVGTLAGFITLQQSVQSFAAVSVTVAMHACKDGRNCKRKVCFFAHTPRQLRVLHSNENSNKKKCTNMSPHNNNNNTNNCCLVCHCSSSTRSPTSTLFGMSHFSPPLSPPSPSSPSRFETNHHHGVVKYNKDVLSELMCSMEGLNFGEASLLSAASKPHNNLSSWLDVSEDHNQKQFSTLSPTITACGSFSNNGNGRFLREESGVVDDVISPDLAWVNELLM

SEQ ID NO: 127808 - protein, 68 aa, Glycine max
  Coding DNA Sequence Number=SeqID_11030
  Gene Ontology: Mol. function=oxidoreductase activity; Cellular component=integral to membrane; Biological process=electron transport
  Homolog annotation: Hit_ID=Q40985; Match level="QueryCoverage=85%, HitCoverage=66%, E-value=5e-12, Identity=54%"; Hit description=Pisum sativum clone MFRTPCR117 wound-inducible cytochrome P450
VQPGRFLKSSLDIKGHDFELIRFGARRRGCPGIGFAMALNEVVLANIVHQFYWAVPGVVVEGTDIGYV

SEQ ID NO: 127809 - protein, 383 aa, Glycine max
  Coding DNA Sequence Number=SeqID_11031
  Gene Ontology: Mol. function=sequence-specific DNA binding; Cellular component=nucleus; Biological process=regulation of transcription, DNA-dependent
  Homolog annotation: Hit_ID=Q9SCW4; Match level="QueryCoverage=82%, HitCoverage=92%, E-value=8e-63, Identity=43%"; Hit description=Heat shock factor protein 6
  Pfam annotation: Domain name=HSF_DNA-bind; Domain location=31-224; Score=155.3; E_value=1.6e-43; Accession=PF00447.8; Description=HSF -type DNA-binding
MAPPPPVEHNGDSAATASASASAESQRSIPTPFLTKTYQLVDDQSIDDVISWNDDGSTFIVWNPTVFARDLLPKFFKHNNFSSFVRQLNTYGFRKVVPDRWEFSNDYFRRGEKRLLCEIQRRKISSPAPSPTAPTTVTVPMPLTAIPIISPSNSGEEQVISSNSSPLRAPAELLDENERLRKENVQLTKELAEMRSLCNNIYSLMSSYGNKNGNSNGSYQTDGGAGGAQGSRESGMTAVKPLDLMPVKRSSGEDAADTVPKEINLIPNPKLFGVAIGAKRAREGGGGSGSGRDCGGGGGGGEEDTLLRLHHVGSADVKSEPLDCQNHRENQETPWLSPCHRTNQRNYELLGELNEFENHEELMRIKVEEERKTIKEILAIKTR

SEQ ID NO: 127810 - protein, 810 aa, Glycine max
  Coding DNA Sequence Number=SeqID_11032
  Gene Ontology: Mol. function=transferase activity, transferring groups other than amino-acyl groups; Cellular component=chloroplast; Biological process=lipid A biosynthetic process
  Homolog annotation: Hit_ID=P21645; Match level="QueryCoverage=81%, HitCoverage=97%, E-value=1e-165, Identity=66%"; Hit description=UDP -3-O-[3-hydroxymyristoyl] glucosamine N-acyltransferase
  Pfam annotation: Domain name=FabA; Domain location=447-573; Score =218.2; E_value=1.8e-62; Accession=PF07977.3; Description=FabA-like domain
  Pfam annotation: Domain name=Hexapep; Domain location=181-198; Score =15.6; E_value=0.18; Accession=PF00132.14; Description=Bacterial transferase hexapeptide (three rep
  Pfam annotation: Domain name=Hexapep; Domain location=199-216; Score =18.9; E_value=0.018; Accession=PF00132.14; Description=Bacterial transferase hexapeptide (three rep
  Pfam annotation: Domain name=Hexapep; Domain location=217-234; Score =13.7; E_value=0.65; Accession=PF00132.14; Description=Bacterial transferase hexapeptide (three rep
  Pfam annotation: Domain name=Hexapep; Domain location=235-252; Score =12.5; E_value=1.6; Accession=PF00132.14; Description=Bacterial transferase hexapeptide (three rep
  Pfam annotation: Domain name=Hexapep; Domain location=272-289; Score =14.9; E_value=0.3; Accession=PF00132.14; Description=Bacterial transferase hexapeptide (three rep
  Pfam annotation: Domain name=Hexapep; Domain location=294-311; Score =17.9; E_value=0.038; Accession=PF00132.14; Description=Bacterial transferase hexapeptide (three rep
  Pfam annotation: Domain name=Hexapep; Domain location=312-329; Score =13.0; E_value=1.1; Accession=PF00132.14; Description=Bacterial transferase hexapeptide (three rep
  Pfam annotation: Domain name=Hexapep; Domain location=330-347; Score =7.7; E_value=17; Accession=PF00132.14; Description=Bacterial transferase hexapeptide (three rep
  Pfam annotation: Domain name=Hexapep; Domain location=565-582; Score =24.6; E_value=0.00036; Accession=PF00132.14; Description=Bacterial transferase hexapeptide (three rep
  Pfam annotation: Domain name=Hexapep; Domain location=583-600; Score =14.9; E_value=0.3; Accession=PF00132.14; Description=Bacterial transferase hexapeptide (three rep
  Pfam annotation: Domain name=Hexapep; Domain location=601-618; Score =14.6; E_value=0.35; Accession=PF00132.14; Description=Bacterial transferase hexapeptide (three rep
  Pfam annotation: Domain name=Hexapep; Domain location=631-648; Score =8.0; E_value=16; Accession=PF00132.14; Description=Bacterial transferase hexapeptide (three rep
  Pfam annotation: Domain name=Hexapep; Domain location=668-685; Score =12.2; E_value=1.9; Accession=PF00132.14; Description=Bacterial transferase hexapeptide (three rep
  Pfam annotation: Domain name=Hexapep; Domain location=686-703; Score =14.5; E_value=0.39; Accession=PF00132.14; Description=Bacterial transferase hexapeptide (three rep
  Pfam annotation: Domain name=Hexapep; Domain location=710-727; Score =6.9; E_value=21; Accession=PF00132.14; Description=Bacterial transferase hexapeptide (three rep
  Pfam annotation: Domain name=LpxD; Domain location=93-162; Score =119.2; E_value=1.2e-32; Accession=PF04613.4; Description=UDP-3-O-[3 -hydroxymyristoyl] glucosamine N-acyltransferase, LpxD
  Pfam annotation: Domain name=OmpH; Domain location=1-86; Score=9.6; E_ value=0.00031; Accession=PF03938.4; Description=Outer membrane protein (OmpH-like)
  Pfam module annotation: Pfam domain module=FabA::Hexapep::Hexapep::Hex apep::Hexapep::Hexapep::Hexapep::Hexapep::Hexapep::Hexapep::Hexapep::H exapep::Hexapep::Hexapep::Hexapep::Hexapep::LpxD::OmpH; Domain location=447-573:...
  Pfam module annotation: Domain location=:181-198::199-216::217 -234::235-252::272-289::294-311::312-329::330-347::565-582::583 -600::601-618::631-648::668-685::686-703::710-727::93-162::1-86
MKASDRSRMEKDIMSQREASSTKAQAFDQDNRRRQMEERNKLLSRIQDAVKKVADSEGYDVVIDANAVAYASNAKDITADVLKQLDAELHGDGDIAISGIASMQSATPGQITFLANSRYREQLAQVQASAVVLTEADLEWCKTAALVVKNPYLTYARMAQLLDTTPQPAQNIAPSAVIDPSAKLGNNVSVGANAVIESGVELGDDVVIGAGCFVGKRTRIGRGSRLWANVTVYHEIQIGQDCLIQSGTVIGADGFGYANDRGNWVKIPQLGTVVIGDRVEIGACTTIDRGALDNTLIGNGVIIDNQCQIAHNVVIGDNTAVAGGVIMAGSLKIGRYCMIGGASVINGHMEICDKVTVTGMGMVMRPITEPGVYSSGIPLQPNKTWRKTAALVMNIDDMSKRLKAIERKRTFFHLGVNQSAAAGIMDRKSILTTETHTLKIEEILELLPHRYPFLLVDRVLEFEEHKYLRAVKNVSVNEPFFQGHFPGKPIFPGVLILEAMAQATGILAFKSVGKLEPGELYYFAGIDEARFKRPVVPGDQMIMEVTFEKTRRGLTRFKGVATVDGAVIGANVQIGPFCVVGANVEIGEGTVLKSHVVVNGHTRIGKDNQIYQFVSIGEVNQDLKYAGEPTRVEVGDRNRIRESVTIHRGTTQGGGLTKVGSDNLLMVNAHIAHDCVIGNRCILANNVTLGGHVTVDDFAIIGGVTAVHQWCTIGAHVMVGGCSGVAQDVPPYVIAQGNHATPFGVNIEGLKRRGFSKEALHAIRNAYKLLYRSGKTLDEVKPEIEELAKLHSEVQPFYDFFARSTRGLIR

SEQ ID NO: 127811 - protein, 686 aa, Glycine max
  Coding DNA Sequence Number=SeqID_11033
  Gene Ontology: Mol. function=1-deoxy-D-xylulose-5-phosphate reductoisomerase activity; Cellular component=chloroplast; Biological process=isoprenoid biosynthetic process
  Homolog annotation: Hit_ID=Q5PD59; Match level="QueryCoverage=52%, HitCoverage=90%, E-value=1e-147, Identity=72%"; Hit description=1 -deoxy-D-xylulose 5-phosphate reductoisomerase
  Pfam annotation: Domain name=DXP_redisom_C; Domain location=117-210; Score=217.9; E_value=2.3e-62; Accession=PF08436.3; Description=1 -deoxy-D-xylulose 5-phosphate reduct
  Pfam annotation: Domain name=DXP_reductoisom; Domain location=1-103; Score=162.7; E_value=9.1e-46; Accession=PF02670.7; Description=1 -deoxy-D-xylulose 5-phosphate reductoisomerase
  Pfam annotation: Domain name=Prenyltransf; Domain location=411-621; Score=365.9; E_value=6.3e-107; Accession=PF01255.10; Description =Putative undecaprenyl diphosphate syntha
  Pfam module annotation: Pfam domain module=DXP_redisom_C::DXP _reductoisom::Prenyltransf; Domain location=117-210::1-103::411-621
VTALVAGQNVALMAEQCQQFKPRYAAMSDDASAAALRERLKALNMDTEVLSGVQAACELAALDEVDQVMAAIVGASGLQPTLAAIRAGKTVLLANKESLVTCGRLFMEAVRQHQAQLLPVDSEHNAIFQSLPASIQHQLGYADLRENGIESILLTGSGGPFRDTPLAELAAMTPDQACAHPNWSMGRKISVDSATMMNKGLEYIEARWLFNATDAQMEVILHPQSVIHSMVRYCDGSVLAQLGSPDMRTPIAHSMAWPARITAGVTPLDFTRMKALTFAEPDYARYPCLKLAIDACATGQAATTTLNAANEVAVAAFLQHQIRFTDIAAINSEVLATLQCQEPGSVDDVMEIDRIARSLARVLRPDIVSMSSGEVTGVCRRRNVFRNHSISDERNYYALCRPTITIQSMTGRTARHGKLRISGHKAGVKSVRRAVSFAVSNKLEALTLYAFSSENWSRPVQEVTALMELFVWALDSEVKSLHKHNVRLRIIGDISRFNNRIQERIRRAEELTQQNDGLTLNIAANYGGRWDIIQGVKKLAEQVQEGLLRPDQITEESLAPHLCMQELAPVDLVIRTGGEHRISNFLLWQIAYAEFWFTDVLWPDFDEHVFEVSSDHRVYSDSAGDRCSVLVAAVRFCDYHHHHLHACRLGVGAAGGDGNASAAYLAGGAMRPAAGGDAVHPATLST

SEQ ID NO: 127812 - protein, 263 aa, Glycine max
  Coding DNA Sequence Number=SeqID_11034
  Gene Ontology: Mol. function=methionyl aminopeptidase activity; Cellular component=cytoplasm; Biological process=proteolysis
  Homolog annotation: Hit_ID=Q7N8P8; Match level="QueryCoverage=73%, HitCoverage=73%, E-value=2e-97, Identity=86%"; Hit description =Methionine aminopeptidase
  Pfam annotation: Domain name=Peptidase_M24; Domain location=1-228; Score=249.5; E_value=7e-72; Accession=PF00557.14; Description =metallopeptidase family M24
MRVAGRLAAEVLEMIAPHVVPGVTTGELDRLCHQHITEKQQAISACLGYHGFPKSVCISVNEVVCHGIPSDDRVLKDGDIVNVDVTVIKDEYHGDTSKMFIVGKPTIQGERLCRVTQESLYIALRLVKPGIRLRELGRAIQKYVEAQDFSVVREYCGHGIGKGFHEEPQVLHYDADDSGVVLQAGMTFTVEPMVNADPDAARRRHYSSGAGKQRVTLVIRITGRLKTNACQFRFTHPCTSRSGAISCALIRAATAVMSRTVTN

SEQ ID NO: 127813 - protein, 339 aa, Glycine max
  Coding DNA Sequence Number=SeqID_11035
  Gene Ontology: Mol. function=[protein-PII] uridylyltransferase activity; Biological process=nitrogen compound metabolic process
  Homolog annotation: Hit_ID=P27249; Match level="QueryCoverage=96%, HitCoverage=40%, E-value=1e-154, Identity=74%"; Hit description =[Protein-PII] uridylyltransferase
MTHQPRHQLHFARIEAVQLSKVQRVLRAKNRVVTTAPFGDIVQQRGHQQQLRLRQTRPQLDAQRVHRARGFVGKTFQLLQHADGVLIHGVGMEQVELHLADNVAPQRRIGPQYAVAMHRQQRALYRAWMAQNRHKGAARFGDLTQRLLQMTAGVAQLAQRGGIDAGDGFVTHHHVKHAQNRLRLALKQRGIAQVNQITAQLKILINAARLLGGRQRQNGFVKQLQQHLVQLADTARDAIEIFHHALNRLIAFTAIVEALCHVELAIEHEKAKADHLIHGGGAKVAARDPLQSMNVAQPARAAFDIRFEVVAGAVIALMAFQLLLNFGGEESVTTARNRR

SEQ ID NO: 127814 - protein, 611 aa, Glycine max
  Coding DNA Sequence Number=SeqID_11036
  Homolog annotation: Hit_ID=P0AFN6; Match level="QueryCoverage=37%, HitCoverage=89%, E-value=1e-103, Identity=81%"; Hit description =Inner membrane transport permease yadH
  Pfam annotation: Domain name=ABC2_membrane; Domain location=196-408; Score=169.0; E_value=1.2e-47; Accession=PF01061.14; Description=ABC -2 type transporter
  Pfam annotation: Domain name=ABC_tran; Domain location=4-110; Score =47.6; E_value=1e-11; Accession=PF00005.17; Description=ABC transporter
  Pfam module annotation: Pfam domain module=ABC2_membrane::ABC_tran; Domain location=196-408::4-110
PGYYGVERAEANKRAEKYLNQLDLWGKRNERARMLSGGMKRRLMIARALMHEPKLLILDEPTAGVDIELRRSMWVFLKELNAKGTTIILTTHYLEEAEMLCRNIGIIQSGELVENTSMKGLLSKLQSETFILDLAPRSPLPQLEGFQYRLVDTSTLEVEVMREQGLNSVFSQLSAQGVQPDAGKNRSNRMTHLYWVALKSIWSKEINRFARIWIQTLVPPVITMTLYFIIFGNLIGSRIGDMHGFSYMQFIVPGLIMMAVITNAYANVASSFFSAKFQRNIEELLVAPVPTHIIIAGYVGGGVARGVCVGVLVTAVSLFFVPFHVFSWPMVAITLLLTAILFSLAGLLNAVFARTFDDISLIPTFVLTPLTYLGGVFYSLALLPPFWQAVSKLNPVVYMISGFRYGFLGINDVPLVLTLADAACAPEAQPVAFPIVAADQKSSGEVKSESAGESAAGAGAYGADVLCLRTVRRQRFTPRAGALSAKQSQQHSLSVCRLGADLRRAEVDLQRDGQSPTVAAGHRARSSERRRYHLVSALAVSVFCADYPGAPPACGAGADTVRYRCGAAAAASYTAAAVADRLYAAHGVQPVGRAASAFAVAAAAGAALNPA

SEQ ID NO: 127815 - protein, 747 aa, Glycine max
  Coding DNA Sequence Number=SeqID_11037
  Gene Ontology: Mol. function=cystathionine gamma-synthase activity; Cellular component=chloroplast; Biological process=amino acid metabolic process
  Homolog annotation: Hit_ID=Q2JZS3; Match level="QueryCoverage=57%, HitCoverage=99%, E-value=1e-169, Identity=69%"; Hit description =Cystathionine gamma-synthase protein
  Pfam annotation: Domain name=Aminotran_1_2; Domain location=55-433; Score=-94.1; E_value=0.012; Accession=PF00155.11; Description =Aminotransferase class I and II
  Pfam annotation: Domain name=Beta_elim_lyase; Domain location=59-340; Score=-111.6; E_value=0.0034; Accession=PF01212.11; Description=Beta -eliminating lyase
  Pfam annotation: Domain name=Cys_Met_Meta_PP; Domain location=19-425; Score=384.7; E_value=1.4e-112; Accession=PF01053.10; Description =CysMet metabolism PLP-dependent enzyme
  Pfam module annotation: Pfam domain module=Aminotran_1_2::Beta_elim _lyase::Cys_Met_Meta_PP; Domain location=55-433::59-340::19-425
MAASSGKKTQIGTRELHPETQMLNYGYDPRLSEGAVKPPVFLTSTFVFNSAEEGKEFFDFVAGRQQPPAGKSGGLVYSRFNHPNSEIVEDRLAIYEGAESAALFSSGMSAIATTLLTFARPGEVILHSQPLYGGTETLLSKTLHDLEIKAVGFSDGNDENKVYEAAKLAWQRGRVAMILIETPANPTNSLVDIQLMRQVAEVITQQQGSRPILACDNTLLGPLFQRPLQHGADISLYSLTKYVGGHSDLIAGAALGSRALINKVRSLRSAIGTQLDPHSSWMIGRSLETLSLRMEKAASNAEQVAAFLRDHAQVAKLHWLPYLDASSPAGETWQRQCSGAGSTFSFDIEGGQAAAFRFLNALALFKLAVSLGGTESLASHPASTTHSGVPQEVRERIGITDATVRLSIGIEHADDLIEDIRLTLEAAMAVRHIGIFSIGDVVEAHQHFTAPAVDADHVFPAGAMRRRRLAVLGQNAELRAVNVERMQHGVAFAGDGPFFIFAQRHGKHGLFHGCPDPSPYRRDPCCHDPSRHGPCSCCHDPSLCPRRAGCPSLWHRSAAAAPACPADPAADPSSAVASGSAALPLPAAAAHPPAGPAAYRWPSRAAAESAPAAAADRTAPAIHQHFKALARQQRQALHLHRFSQQATVARHHVQRTFIAGGDVQRARVAAVEQAQPQPAARHRVLRIRHAVAAYPGKSAAHHLRPTASAAAACRTPHLPAVPAPPAPAPPDSRFCRADADGTSRSPP

SEQ ID NO: 127816 - protein, 475 aa, Glycine max
  Coding DNA Sequence Number=SeqID_11038
  Gene Ontology: Mol. function=oxidoreductase activity; Cellular component=periplasmic space; Biological process=cell division
  Homolog annotation: Hit_ID=Q8ZRS2; Match level="QueryCoverage=92%, HitCoverage=82%, E-value=1e-148, Identity=60%"; Hit description=Blue copper oxidase cueO precursor
  Pfam annotation: Domain name=Cu-oxidase; Domain location=214-357; Score=-31.4; E_value=0.059; Accession=PF00394.12; Description =Multicopper oxidase
  Pfam annotation: Domain name=Cu-oxidase_3; Domain location=86-202; Score=148.2; E_value=2.1e-41; Accession=PF07732.5; Description =Multicopper oxidase
  Pfam module annotation: Pfam domain module=Cu-oxidase::Cu-oxidase_3; Domain location=214-357::86-202
MGHWRAFYPGGRFHRLTLPQGKGLRCAPIHDKDMNMQRRHFLKLTAALSAAGALPFWSRSLMAATRPLLPIPSLLEPDAHGQYTLTAMTGSSQWNGKSVPTWGYNGSLLGPALRLQREKSVTVNIHNRLPEATTLHWHGLEIPGAVDGGPQALIAPGATRQVSFTPDQPAATCWFHPHQHGKTGYQVAQGLAGLVLLEDEASGKLRLPMQWGEDDVPLIFQDKQLTQDGTRIDYQLDIMRAAVGWFGDLMLTNGVPYPQHAVPRGWLRLRLLNGCNARSLHIAASDKRPLYVVASDGGLLAEPVKVESLPLLPGERFEVLVDTSDGKTFDIVTLPVTQMGMTLAPFDQPLPLVQILPLRVMASGTLPDQLVDVPPLPATEGLQSRWLQLMMDPQLDQQGMQALQQRYGAKAMGSQHAAGKAMDHGSMNMDHGAMDHGNMEHGDMAMDQGNPASSAAYDFHNGNKINGQAFNMEKP

SEQ ID NO: 127817 - protein, 358 aa, Glycine max
  Coding DNA Sequence Number=SeqID_11039
MAPMLYSREQQDKMELAFEESSMEGRLGEGYNLEDGGKQHPKSSNKKTLVSFLRIGNLTYIYRVIHMMLGEKVNFPKVIFYWLQAFKEKFHAKDKKILVPYGMLFIQLMRNSGLDVSMLKPSTSGAQLKGLTFVKMGIAENFPKYAQKHIKRKSKKEEPRCNLEGLGRKVLEEVPKYVILESLKTLSVEEVQRKEVEETAMVDVFGEPHGAKLFSTNTATRQEKVEVALIPDDLDPMEKEAPEEAWNDQQQATEWLLSSRSLPPPPPPKGFPIEPDVNLEKLNLLKLWKEGFLGIDLFSYQSWDTLPEEEEHALGVYGKKEPIFKMFRPRQTIALNPNRLIFEHLPTDRKIYPLVLSI

SEQ ID NO: 127818 - protein, 177 aa, Glycine max
  Coding DNA Sequence Number=SeqID_11040
MPAQKRSFPDAPNDHHRHAKYHHQEEEEEEEDNYKSDGSALFIFSPRRQIRLVSFEPRRMPFLNPPDSIRNRSFACFDFRLLRAFATPSFFIRAGFVLHVEIGSDDLECHGAVVDDVYEKQDNFVKLKLGFSSIHKFFVAMRYVFVELLEIRKEVQCPICLGDLILWDKTIIVVASC

SEQ ID NO: 127819 - protein, 198 aa, Glycine max
  Coding DNA Sequence Number=SeqID_11041
  Gene Ontology: Mol. function=metal ion binding; Cellular component =endoplasmic reticulum; Biological process=ubiquitin cycle
  Homolog annotation: Hit_ID=O77347; Match level="QueryCoverage=92%, HitCoverage=23%, E-value=6e-20, Identity=29%"; Hit description=Zinc finger protein, putative
MRYLLAIWKASRPLSNGEGWETMRRELSVLYSRFYGILLGGILLMYEFHNHLRPILLLVYSFWIPQIITNVIRDSRKPLHPHYILGITVTRLAIPLYIFGCPNNFLHIEPDQSWCVCLAIFVGLQAAILLLQHYFGSLWFIPRQFLPEKYCYYRRFAQDTNHATDCVICMTAIDLSPRSNDCMACECNLWLFKLIFTT

SEQ ID NO: 127820 - protein, 417 aa, Glycine max
  Coding DNA Sequence Number=SeqID_11042
  Gene Ontology: Mol. function=protein binding; Cellular component =cellulose and pectin-containing cell wall; Biological process =protein amino acid phosphorylation
  Homolog annotation: Hit_ID=O49448; Match level="QueryCoverage=89%, HitCoverage=93%, E-value=1e-140, Identity=64%"; Hit description =Extensin-like protein
  Pfam annotation: Domain name=LRRNT_2; Domain location=56-95; Score =18.7; E_value=0.0097; Accession=PF08263.3; Description=Leucine rich repeat N-terminal domain
  Pfam annotation: Domain name=LRR_1; Domain location=129-151; Score =13.8; E_value=0.61; Accession=PF00560.23; Description=Leucine Rich Repeat
  Pfam annotation: Domain name=LRR_1; Domain location=153-175; Score =7.7; E_value=10; Accession=PF00560.23; Description=Leucine Rich Repeat
  Pfam annotation: Domain name=LRR_1; Domain location=177-199; Score =13.7; E_value=0.68; Accession=PF00560.23; Description=Leucine Rich Repeat
  Pfam annotation: Domain name=LRR_1; Domain location=200-222; Score =4.0; E_value=51; Accession=PF00560.23; Description=Leucine Rich Repeat
  Pfam annotation: Domain name=LRR_1; Domain location=223-245; Score =0.7; E_value=2.1e+02; Accession=PF00560.23; Description=Leucine Rich Repeat
  Pfam annotation: Domain name=LRR_1; Domain location=248-270; Score =8.0; E_value=9.1; Accession=PF00560.23; Description=Leucine Rich Repeat
  Pfam annotation: Domain name=LRR_1; Domain location=272-294; Score =16.7; E_value=0.086; Accession=PF00560.23; Description=Leucine Rich Repeat
  Pfam annotation: Domain name=LRR_1; Domain location=296-318; Score =10.8; E_value=2.8; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=56-95::129 -151::153-175::177-199::200-222::223-245::248-270::272-294::296-318
MASASASYSFTITVLFLLYLHLSCFINNLNANHTNASGHNHHKHQHTQNPPLNSRLDMAFLGLQAWKQVIYSDPNNFTSNWVGPSVCNYTGVYCAPSLDDPKVTVVAGIDLNFADLAGFLPNEIGLLSDLAVLHLSNNRFCGILPMSFTNLTLLYELDLSNNRFVGPFPLVVLSLHMLKYLDLRYNEFEGPLPPQLFNNTIDAIFVNNNRFSSTIPPNLGKISASVVVFANNKFGGCLPESIVNFADTLEELVLINTSLSGCLPQQVGFLYKLRVLDVSFNNIVGPIPYSLSGLSHLEQLNLGHNMMSGTVPVGVCELPNLANFTFSYNFFCEEEGICQNLTSKRIVFDDRRNCLPEKPLQRSEKECKAKLEHPVDCSELCCVVGSNVSAGSVAVPPAAAVPAAMPVSAPLLAPSHP

SEQ ID NO: 127821 - protein, 556 aa, Glycine max
  Coding DNA Sequence Number=SeqID_11043
  Gene Ontology: Mol. function=protein serine/threonine kinase activity; Cellular component=nucleus; Biological process=protein amino acid phosphorylation
  Homolog annotation: Hit_ID=Q7XIR5; Match level="QueryCoverage=67%, HitCoverage=99%, E-value=1e-105, Identity=50%"; Hit description =Serine/threonine-protein kinase bub1,checkpoint-associated-like protein
  Pfam annotation: Domain name=Mad3_BUB1_I; Domain location=13-125; Score=77.1; E_value=5.7e-20; Accession=PF08311.2; Description =Mad3BUB1 homology region 1
  Pfam annotation: Domain name=Pkinase; Domain location=257-528; Score=- 54.0; E_value=2.4e-05; Accession=PF00069.15; Description=Protein kinase domain
  Pfam module annotation: Pfam domain module=Mad3_BUB1_I::Pkinase; Domain location=13-125::257-528
MATMLSYSPPRFKIAVDAHHDPLLPFLRSIKKALEASDDSASNLSNLLKDCIRNFKNNDRYRNDVRFLKIWLLYMGVSDDFESVFKEMLDSNVCTNSSSLYVWSASFFELKGRLHDALTIYQLGICRNAEPIEWLKKAHALFLNRISEIQNAASTQKVDDKESKKFEDNGINPWGTSTMDSLLKKIYPLIMKFDGYRSSTKPYTGKVALSTLKNSSRNKVYLLLYKLLPYMWASICFTNGAIAPLCPYHDIKGGKKYHIKGCAGQGGFAQVYKANVDSDPDNVVALKIQKPAFPWEFYIYRQLDKRILDRERSSYGFAHRIHIYSDCSILICDYLANGTLQDVINSYVVLGKSMEEVLCIYYTIEMLHMVETLHGFGLIHGDFKPDNLLIRYARGDLTEDGFFSRIGPWCDQGLCLVDWGRGIDLHLFPDHILFKGDCRTSGFRCIEMLEDKPWKFQASHLLNYTTNAISYMEVVKKEQSDGSYMYLPKLPFKRYWNIELWKTFFTKMLNQYPHDDDRSLLQDLKKSFQDYMSSNPQLIKKLKELLSKQRASLCSA

SEQ ID NO: 127822 - protein, 144 aa, Glycine max
  Coding DNA Sequence Number=SeqID_11044
MSILATLHCRDEPNPHSSTLKFQSFRVNLNHVKPQTQHTSQKIQFEQPSSQVITGNPKEKSKAHHRKLLKKDKGLLRMESKERIAGSQTTTSHLTHRERMIQIRGEGERDSERPTTRKQNSLHQQSLPPNEATLVVIKKWVNII

SEQ ID NO: 127823 - protein, 112 aa, Glycine max
  Coding DNA Sequence Number=SeqID_11045
  Gene Ontology: Mol. function=metal ion binding
MDKLEFIKAWAILTSRVSFGVELGPTQVQDGNWKFLDTTNGSTGFPDIRKINGNSVIELVSMPTKITGVHYVQGVVIFHDVFDNEYNVGGAQIRVEGVYIWPYRQLRMVANR

SEQ ID NO: 127824 - protein, 186 aa, Glycine max
  Coding DNA Sequence Number=SeqID_11046
  Gene Ontology: Mol. function=unfolded protein binding; Cellular component=prefoldin complex; Biological process=protein folding
  Homolog annotation: Hit_ID=Q3B7M7; Match level="QueryCoverage=66%, HitCoverage=23%, E-value=1e-15, Identity=33%"; Hit description =Similar to RPB5-mediating protein isoform a
  Pfam annotation: Domain name=Prefoldin; Domain location=29-147; Score= 107.0; E_value=5.4e-29; Accession=PF02996.8; Description=Prefoldin subunit
MDESTKKGSVTSLASLFPVEEAQRAAKRVEDTIADKQSELDRLRGFATDNNSLINLVHKLPEQLSHDIMVPFGKAAFFPGRLIHTNEFLVLLGEGYYAERTSKQTVEILQRRGKSLDSQVDSLEANIKDLEAEASFFNATASQVAVRDRTQYHAIGLGCYDASAEQSNPQFLDVVVVTLHFKAKNM

SEQ ID NO: 127825 - protein, 83 aa, Glycine max
  Coding DNA Sequence Number=SeqID_11047
MGLKKRRCKKLLMNSLSEAASSLSGCKILEDDTLEISALSAQAARPMRMLSLLTLSVPKLAYQIFTYFHSLSEPSCTGKSKSL

SEQ ID NO: 127826 - protein, 101 aa, Glycine max
  Coding DNA Sequence Number=SeqID_11048
  Homolog annotation: Hit_ID=Q2HUH8; Match level="QueryCoverage=93%, HitCoverage=24%, E-value=2e-09, Identity=38%"; Hit description =Histidine triad (HIT) protein; Homeodomain-like
MDNDVTFHAYAIWKEDKGSDFGLEHVCQLLKDQLKWSYLFTENCSKRMKIFASRAYSSSTNPETPIEDSEADTSSPIVLPMGQKATKRKSIGKEYEHLPIH

SEQ ID NO: 127827 - protein, 100 aa, Glycine max
  Coding DNA Sequence Number=SeqID_11049
MHGHLQQEAPNLGNATADDGEYARMLAIMDELEKEELAAESGNHSDQNDESTGDFHDISYQEHIDNKLQNSKVISLIILLKSGLEAMSTMDCDRLITHFL

SEQ ID NO: 127828 - protein, 115 aa, Glycine max
  Coding DNA Sequence Number=SeqID_11050
MRPRRYQIATVIDFYIVLHSSSEEDQQVPIILGRSFVRTTHVPINVCKGVYTLREGKKKMFYYIQGIEDFPNKSTHQQHLYNPYAIRQAIDIKEVLIGWQSNFLTLTFYITFIVF

SEQ ID NO: 127829 - protein, 712 aa, Glycine max
  Coding DNA Sequence Number=SeqID_11051
  Gene Ontology: Mol. function=nucleic acid binding; Cellular component= cytoplasm; Biological process=transcription-coupled nucleotide -excision repair
  Homolog annotation: Hit_ID=Q5WMW4; Match level="QueryCoverage=98%, HitCoverage=80%, E-value=0.0, Identity=63%"; Hit description=Uknown protein
  Pfam annotation: Domain name=DEAD; Domain location=4-146; Score= -23.0; E_value=0.00049; Accession=PF00270.19; Description=DEADDEAH box helicase
  Pfam annotation: Domain name=Helicase_C; Domain location=396-474; Score=94.2; E_value=3.8e-25; Accession=PF00271.21; Description =Helicase conserved C-terminal domain
  Pfam annotation: Domain name=SEC-C; Domain location=251-271; Score =22.0; E_value=0.0015; Accession=PF02810.6; Description=SEC-C motif
  Pfam annotation: Domain name=SNF2_N; Domain location=1-313; Score =153.4; E_value=6.1e-43; Accession=PF00176.13; Description=SNF2 family N-terminal domain
  Pfam module annotation: Pfam domain module=DEAD::Helicase_C::SEC -C::SNF2_N; Domain location=4-146::396-474::251-271::1-313
GLGKTIQAIAFLAAVFAKEGHSTLNENHVEKRDPALIICPTSVIHNWESEFSKWSNFSVSIYHGANRNLIYDKLEANEVEILITSFDTYRIHGSSLLDINWNIVIIDEAHRLKNEKSKLYKACLEIKTLRRYGLTGTAMQNKIMELFNLFDWVAPGSLGTREHFREFYDEPLKHGQRSTAPDRFVQIANKRKQHLVAVLHKYLLRRTKEETIGHLMMGKEDNIVFCAMSDVQKRVYRRMLQLPDIQCLINKNLPCSCGSPLTQVECCKRIVPDGAIWPYLHRDNPDGCDSCPFCLVLPCLVKLQQISNHLELIKPNPKDDPDKQNKDAEFAAAVFGPDIDLVGGNTQNESFMGLSDVTHCGKMRALEKLLYSWFSQGDKVLLFSYSVRMLDILEKFLIRKGYCFSRLDGSTPTNLRQSLVDDFNSSPSKQVFLISTRAGGLGLNLVSANRVVIFDPNWNPAQDLQAQDRSFRFGQKRHVVVFRLLAAGSLEELVYSRQVYKQQLSNIAVSGKMEKRYFEGVQDCKEFQGELFGISNLFRDLSDKLFTGEIIELHEEHGHETEQPEEVNLSEEETSSSVLESETRLCNKSVRDATSKPDLVDLGIVYTHRNEDIVNFGPGIQGKIDTSIPLDDSLVKPSISLDLDHQRKKPDSIPKKQKVPLIDERKRTQYRLLAQSLGMGELAFSKWLLSATPLEREKVLLDFKKKKKIPNG

SEQ ID NO: 127830 - protein, 79 aa, Glycine max
  Coding DNA Sequence Number=SeqID_11052
  Gene Ontology: Mol. function=helicase activity
  Homolog annotation: Hit_ID=Q6YTQ6; Match level="QueryCoverage=83%, HitCoverage=4%, E-value=2e-14, Identity=56%"; Hit description =Helicase-like protein
MLATKMLGDTISRLIWVSPSAGELFYHRMMLSTAKGAQSYSDIRTINGVVYPTFREACFAKGFLGGDQEFISALQEANN

SEQ ID NO: 127831 - protein, 91 aa, Glycine max
  Coding DNA Sequence Number=SeqID_11053
  Subcellular localization annotation: CTP_CleavageSite=49; ConfidenceScore=5.03e-01
MVLAGTPQPYCSPWVINGNSRVVDGSLQVIGGSSRTEGFTWHQLSPDTLCSTTRSTIILLLLVIRMVQKCNSQGLKLCMEGCNNFLIELRG

SEQ ID NO: 127832 - protein, 69 aa, Glycine max
  Coding DNA Sequence Number=SeqID_11054
MSSETLNVRERKGKKWGRGRRRWQRPRSPWSGRTCFWNPTPTLTLEAKFYSLKPSPERETRLSAGTTAR

SEQ ID NO: 127833 - protein, 142 aa, Glycine max
  Coding DNA Sequence Number=SeqID_11055
  Gene Ontology: Mol. function=sequence-specific DNA binding; Cellular component=nucleus; Biological process=regulation of transcription, DNA-dependent
  Homolog annotation: Hit_ID=Q9LFY2; Match level="QueryCoverage=81%, HitCoverage=25%, E-value=7e-20, Identity=42%"; Hit description =Homeobox-leucine zipper protein ATHB-54
KHVLPSPKPNFKRENYIKEEDEIFNVDRDAVRYITYRTKDSADAAIVAGLDPTFGITVNSKTVQVLWATYPLAMWREGVGNSRNKGSMSKLVRAEVPLSKHGRGNRLASPIGNTKRSKDSSGSSVLEVSFKGREIVAYDDIL

SEQ ID NO: 127834 - protein, 40 aa, Glycine max
  Coding DNA Sequence Number=SeqID_11056
MAMVSKKLNQAMAVQVLYPELNVSRVKISNQVVEGKLINV

SEQ ID NO: 127835 - protein, 278 aa, Glycine max
  Coding DNA Sequence Number=SeqID_11057
MASRPSLRVSLLGIIILEGQVVVSKKSRSPRDNPFEWYTTPQALTLVALMLKVCYVTLIVYVGGGACCFIMCTPRMTFMEKILKNNAFVSHFISWILHLQEDEEVYSSSGLSSVVGKGVEDVTRSSDDEVIIYVDVEKEVLAEDVVGGIPIMVEFGWVDERGLVTQSKYINPNMVGVLKKVVYSVRGTDLVEVESCSAEERICHFPTVGMGSMISISNVQLHEDYKQKAKFQSKNVTKSSLLFLDGKVSSNLVPASGVLKPTFAPLDPLSENQPLKKS

SEQ ID NO: 127836 - protein, 74 aa, Glycine max
  Coding DNA Sequence Number=SeqID_11058
MSEIRRFGGLGMEERRERKGAAQGFLENVIFIEQDAWRRQPTGNRLHEYCNRLQAICSSVIDYSIHVIDYQNKE

SEQ ID NO: 127837 - protein, 448 aa, Glycine max
  Coding DNA Sequence Number=SeqID_11059
  Homolog annotation: Hit_ID=Q393D8; Match level="QueryCoverage=34%, HitCoverage=28%, E-value=2e-38, Identity=54%"; Hit description =Membrane protein
  Pfam annotation: Domain name=DUF1177; Domain location=143-448; Score =445.2; E_value=8.5e-131; Accession=PF06675.2; Description=Protein of unknown function (DUF1177)
MGYDLKAGFILRGNGADVQQELWGRRIQLIAAMIAFVIAIPVVWYAHNLFFVDNLLPPVARVYAKTIQAGAEPGIAGSLLMWAIPGAIIQLIGGPKRQLGVLLATGLLINNAAAGWAVLVGIALRVLILRVWGERGRSPMEVMAAGFIAGDALAYVDGQQVVDLFAAYPGVQASFKRVSGPKGRTDFVRIDIPGAQGKSRGGSAPTLGIIGRLGGIGARPTRIGMVSDADGAVAAVSSALKLAQMQTKGDVLAGDVIVTTHICPDAPTRPHEPVDFMDSPCDDITMNDNEVVEGVDAILSIDTTKGNRILNHKGYALSPTVKEGYILRVSEDLLRIMEMTSGQPAVTFPITTQDITPYGNGVYHLNSILQPSTATDVPVVGVAICAQSVVPGCGTGASHEVDIAATVRFAVEVAKEFGRETCQFYDPQEYALLLSLYGSLSHLRSRKA

SEQ ID NO: 127838 - protein, 263 aa, Glycine max
  Coding DNA Sequence Number=SeqID_11060
  Homolog annotation: Hit_ID=Q2QN77; Match level="QueryCoverage=96%, HitCoverage=34%, E-value=1e-11, Identity=25%"; Hit description =Expressed protein
MAQLYKEHAETEEYVFSSLSSLSTATRSFLVSNGSQIINRANNNLFSTSIESKEYKLQKEVGQVKDENVFGVPSLPKIISVNDTKEKFNAVIVRSRRSSSSDNVSSGKLIHTQQFDKTFLFSLGISFGMITSIMANKREIVKLRELLKQNENLVQDLQEELEMKDSMTVKELQNENYGSQDTCDHSSYDKELNEFSPEKHVDNSPRIDSKESYHQKVEQSSESMSKIEAELEAELERLGLDMNASSLEGKLSELVEFFHVFTS

SEQ ID NO: 127839 - protein, 150 aa, Glycine max
  Coding DNA Sequence Number=SeqID_11061
  Gene Ontology: Mol. function=metal ion binding; Biological process =cell wall catabolic process
  Homolog annotation: Hit_ID=P0ADE6; Match level="QueryCoverage=95%, HitCoverage=99%, E-value=7e-52, Identity=67%"; Hit description =Protein ygaU
  Pfam annotation: Domain name=BON; Domain location=30-93; Score=42.8; E_value=1.2e-09; Accession=PF04972.7; Description=Transport -associated domain
  Pfam annotation: Domain name=LysM; Domain location=101-149; Score =53.6; E_value=6.6e-13; Accession=PF01476.10; Description=LysM domain
  Pfam module annotation: Pfam domain module=BON::LysM; Domain location= 30-93::101-149
MTGGCMGLFNFVKEAGEKLWDAVSGGDDQSKKLQEHINQLGLPDSDKVKVDVQGDTVKVSGDGISQELKEKILVAAGNVAGITKVEDNVTTSDSAAQAEFYTVKKGDTLSAISKQVYGTPNEYNKIFEANKPMLTHPDKIYPGQVLRIPK

SEQ ID NO: 127840 - protein, 58 aa, Glycine max
  Coding DNA Sequence Number=SeqID_11062
MELTWEQVSIGHRNWGEFYKLFCCKTPSLVHVLASFVADLVMASWMIGWWVMKRANVG

SEQ ID NO: 127841 - protein, 77 aa, Glycine max
  Coding DNA Sequence Number=SeqID_11063
MRKLIKERMENKVVNFVGLNKVVLGIKWMNGMVKGLILKVNLGSRISQFECVKWELWPRDNSGQRWIFWNCGLKEQG

SEQ ID NO: 127842 - protein, 84 aa, Glycine max
  Coding DNA Sequence Number=SeqID_11064
  Subcellular localization annotation: CTP_CleavageSite=42; ConfidenceScore=5.26e-01
MEVSFGFSNVFLSINVGGDSAHFPPMEDAPVSFASLSRKRVGCDSGSVNFKNRRFGSCFLRTRKTKAGLLLLRILHWDEELRPM

SEQ ID NO: 127843 - protein, 134 aa, Glycine max
  Coding DNA Sequence Number=SeqID_11065
  Gene Ontology: Cellular component=chloroplast
MGDKLHRREGNSPDHQLRPLNDRSVIKEMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKW

SEQ ID NO: 127844 - protein, 182 aa, Glycine max
  Coding DNA Sequence Number=SeqID_11066
RLKTRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELAGSPRNALRRSS

SEQ ID NO: 127845 - protein, 74 aa, Glycine max
  Coding DNA Sequence Number=SeqID_11067
  Pfam annotation: Domain name=Gamma-thionin; Domain location=30-74; Score=2.7; E_value=0.028; Accession=PF00304.11; Description=Gamma -thionins family
  Pfam annotation: Domain name=SLR1-BP; Domain location=1-74; Score =2.5; E_value=0.00051; Accession=PF07333.3; Description=S locus -related glycoprotein 1 binding
  Pfam module annotation: Pfam domain module=Gamma-thionin::SLR1-BP; Domain location=30-74::1-74
MKDITFVFIVLLVLSIGIENEGPLKLIEARTCEETLYEFSCVSNKCGTDCRNKHGNFASGDCNAIEDCICRYPC

SEQ ID NO: 127846 - protein, 99 aa, Glycine max
  Coding DNA Sequence Number=SeqID_11068
  Subcellular localization annotation: CTP_CleavageSite=58; ConfidenceScore=5.48e-01
MGTVAALLSFQLKLNCKVRAASASPSSLLLGVGCCFFLLGSSSSRQRQQERVVEDPPTAAKELNEEQQERPEMKLSSHGMKMAKFGRFALECYTLNEDD

SEQ ID NO: 127847 - protein, 171 aa, Glycine max
  Coding DNA Sequence Number=SeqID_11069
MQDTWDKMGLDSKLKLIIETVYFIKKAVIAALAILNPAKGALFGGNIHLTIILCPIPDGACVPEMGYVRCNLNAVFLGLANITSWGFCSETRMELLCWLSDWDQPCLPTSEGKALGLLIALKWLMDCGLAHVEFESDCEVLVTSTIQDFSAVGAIIRQCKYIKNTIMNEIP

SEQ ID NO: 127848 - protein, 336 aa, Glycine max
  Coding DNA Sequence Number=SeqID_11070
  Gene Ontology: Mol. function=zinc ion binding; Cellular component =nucleus; Biological process=regulation of transcription, DNA -dependent
  Homolog annotation: Hit_ID=Q8H344; Match level="QueryCoverage=68%, HitCoverage=27%, E-value=3e-34, Identity=40%"; Hit description =Putative far-red impaired response protein
  Pfam annotation: Domain name=FAR1; Domain location=138-283; Score =13.5; E_value=1.3e-07; Accession=PF03101.5; Description=FAR1 family
  Pfam annotation: Domain name=WRKY; Domain location=173-224; Score= -15.8; E_value=0.062; Accession=PF03106.6; Description=WRKY DNA -binding domain
  Pfam module annotation: Pfam domain module=FAR1::WRKY; Domain location=138-283::173-224
MQDTEPDIKRHPLEDAENECPISPEVVIDMGQESQTQNHSDFSVSDTNKVIDTENECTSPNVCPVDNSHMEINDECQTSNIFHVDKFPTNVSSGQLCETENPCATFVTMTSTDVKNEEEICVAPKIGMEFESEDTAYKCYSEYAVLNGFSIRKDFVNKSRINGAVVSRRYTCHRQGYRPSKNGTYLRKLKQETRTGCLAHMTISRQPNGKFCVINFETEHNHELVTPCTAHMLQSQKRLTFAQAVEANLTKSGLDGVPKLGMGFDSEEHAYEFYNTYAGHVGFSVRKDYVNRSKVDGAVASRRFTCFREGFRHKDKQDTNVKRPRKDTRIGCLAQL

SEQ ID NO: 127849 - protein, 218 aa, Glycine max
  Coding DNA Sequence Number=SeqID_11071
MPRLGSRDNVSDRDRFCMYKVMVGEKVNLPEFIFLYWLQAFKDTFHAKEWKNYVPYEMLFIQIIKNNGVDVSVLEPSISPSQLKGLTFVKIGVAYNFLEYAQKYIKRKATKQSLTESRRKAKIDKTLKRKDALQEEVGIIASRKAMPREEHKKKLAEDANLKTFAVKVSEEIPEDVILESLKILFVEEGQRKTVEEATMVDVDGKPVPKEVIIESIQA

SEQ ID NO: 127850 - protein, 130 aa, Glycine max
  Coding DNA Sequence Number=SeqID_11072
  Subcellular localization annotation: CTP_CleavageSite=58; ConfidenceScore=5.22e-01
MFREEIAIRAPPKWISSDFVTPPQMMSSFNLLLFLPVLFGNFFTKLPKKLITRILRIRRKMNNTTRWCWRTRRFPPSGFSYRNSHQSKTIYELPSQQECDPSRPRQVTLWFYLAPIQANEHRHKRVKDHK

SEQ ID NO: 127851 - protein, 117 aa, Glycine max
  Coding DNA Sequence Number=SeqID_11073
MAPEKSEIVRVSSIHNVGDAKKVFPKDWFILGKWVNFQSLMEEGFIVQCLFDCFGWTPLLEKFNSWHYVLYALFWRAARQDEVSIRGADNGREVIISLKIVVAVIGCPKEDLVFNKD

SEQ ID NO: 127852 - protein, 116 aa, Glycine max
  Coding DNA Sequence Number=SeqID_11074
MRSWVRGQWIPFNADALSQFLGDPLVLEEGQECKFSQRRNRADGFDEEAIAQLLCTLGQDFARTVAGRRVRIMRTSMPPTRHPLDPNKSNRALGFPAMITGLCQSFGVPVTPSKVI

SEQ ID NO: 127853 - protein, 56 aa, Glycine max
  Coding DNA Sequence Number=SeqID_11075
MVTSGETFREKTGVTLPHQIHRTRDGRLLHYNTSHGDTSLNILVGQNPLPVNILCR

SEQ ID NO: 127854 - protein, 267 aa, Glycine max
  Coding DNA Sequence Number=SeqID_11076
  Gene Ontology: Mol. function=zinc ion binding; Cellular component =nucleus; Biological process=regulation of transcription, DNA -dependent
  Homolog annotation: Hit_ID=Q1S0I8; Match level="QueryCoverage=99%, HitCoverage=34%, E-value=2e-69, Identity=47%"; Hit description=FAR1; Zinc finger, SWIM-type
MTIFGAALLYNESVESLKWLFRVFIEAMSGRKPKTILTDLDIITAEAINSISPQTNHRVCVWHVYQDALKQLSHVSVRSGSFVNDLRSCFFDNEEEDYFVNAWNALLDKYDLWQNEWLQQIYGSRDRWAIAYGRQFFCADMVSMLLRENLTGNLKKYLKHGTDILPLLKYLVKVVTDWHYRELEANYDMSQHMPPLMGDIITLKHASAPYTPKIFELFQKEYEACLNLVIKHCTESGSLYNYKVSIYEQEHKDSSIPVHLKEMDKRC

SEQ ID NO: 127855 - protein, 598 aa, Glycine max
  Coding DNA Sequence Number=SeqID_11077
  Homolog annotation: Hit_ID=Q1T3Y0; Match level="QueryCoverage=97%, HitCoverage=99%, E-value=2e-27, Identity=25%"; Hit description =Targeting for Xklp2
MGDSTCLMQQPFCYASGISNEANENNPIHALGQSISFGRFMSESLAWEKWSSFSHNRYVEEAERYSRPGSVAQKKAFFEAHYKKLAAQKAAALLEQANNEAQKNATGQEDEGVIDNDNDTHNSQISPNSEMVVKEEQDAKVLSVTSEQDAVVRLTVSEHDVSVTPESAKVEGAEAVMEKVAVVGSSMKVELQNQVEDVDAQMEESEKLSAIVTPPILTPIVKVSKSEQEVLASVGMKKPPVSSFKLSKFNGTSKLTTTPVKSTATISFKRDNIATPISNKPANGTSKFTTAPIKSTAAISFKRDNIATPMSNKLANGTSKFTTTPVQSTAAISFERDNIVTPMRNKPAILSTADKKRSTPRSVNFTPIRELNRLTASVMRKFESTRAGAGSSKASKDSLTPLRTPTMASKEMQKQSSLTPLTEKKRNKTPLDLSSAPGNHTGGSKWRLLSGENLKKSSMLMKHKKCSCIPNSRWEKTETEIIRKLRQSFCFKARPLPDFYKERKTSTNETKKDPLTHFETPKDGRKSTPSMAADSKTSFPPNRPVLKNSGTKHFQGKSGRTLSHPLTSTSTIIPTHENTSPNIQNGYHTGRNFKYQPC

SEQ ID NO: 127856 - protein, 111 aa, Glycine max
  Coding DNA Sequence Number=SeqID_11078
MEAGFSMVIFSHGIATKDKGEERKPHPQPRNHSLSRSTLSQPLKHKCAGDKGATLCGPLIGDKGTAVVRLHRRIEKGNTAPPCWKSGKNHQNLLHHLACSLPEDKGSVGEI

SEQ ID NO: 127857 - protein, 120 aa, Glycine max
  Coding DNA Sequence Number=SeqID_11079
STLEDPTGGNPEASKSTWHGRDGASSRNDANIPVQINLLAQDVSSLRPSQVPISGMSIYHEKPPDGDIDGGGNVNVLGKVWRFNGYEERRGFNQARASIFAQNIEDCNLMGLDHIGGKFT

SEQ ID NO: 127858 - protein, 164 aa, Glycine max
  Coding DNA Sequence Number=SeqID_11080
  Gene Ontology: Mol. function=RNA-directed DNA polymerase activity; Biological process=RNA-dependent DNA replication
  Homolog annotation: Hit_ID=Q1SLA3; Match level="QueryCoverage=64%, HitCoverage=8%, E-value=8e-15, Identity=47%"; Hit description=RNA -directed DNA polymerase
  Subcellular localization annotation: CTP_CleavageSite=41; ConfidenceScore=5.03e-01
DSSFSHLFFVDDVLLFTKDKPSKVRVMTNILAKFCVGLGMKINMEKSKTFSSKGVLLKRRNKIAFIPKSGLLIIWGGIWAIIWFMGELQCVTFFILKRKFKGDWLLGREDIMHNPMKPWMQLFISKYPGEDVGDMLQHKGSYLTTSLGRAYPSISSGFQLELGN

SEQ ID NO: 127859 - protein, 42 aa, Glycine max
  Coding DNA Sequence Number=SeqID_11081
MVKESLLMHSNEAFKPTRWEMTGQPAIDGGHDVGEGAEALSG

SEQ ID NO: 127860 - protein, 256 aa, Glycine max
  Coding DNA Sequence Number=SeqID_11082
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1T3B5; Match level="QueryCoverage=99%, HitCoverage=21%, E-value=1e-103, Identity=72%"; Hit description =ATPase, E1-E2 type; Peptidase M, neutral zinc metallopeptidases, zinc- binding site
MDIEADNRKVQVYGRNYTFVETRWKKLRVCDIIKVYKDVYFPADLLLLSSSYGDGICYVETMNLDGETNLKLKHALEVTIHLQDEKSLQKYKVVVKCEDRNENLYSFIGTLQYDGKESPLSLQQILLRDSKLKNTDYIYGIVIFTGYDTKVMQNSADPPSKGRKIERKMDKIIYILFSTLVLISFIGSVFFGVETKRNISSGRYRRWYLRPDNTTVFYDPRRATLVVLLHLLAALMLYGSIIPISLYVSIELVKVL

SEQ ID NO: 127861 - protein, 86 aa, Glycine max
  Coding DNA Sequence Number=SeqID_11083
  Homolog annotation: Hit_ID=Q1SCJ0; Match level="QueryCoverage=45%, HitCoverage=8%, E-value=6e-08, Identity=77%"; Hit description=TCP -domain protein
MINANCPQESLHSISNGNLSSVGNLEKEQRRKGYAGEEGSMLMLLEGEIGVEVGGSELGGDEHGGAGTIKEQYAAKAQLEVANGHN

SEQ ID NO: 127862 - protein, 202 aa, Glycine max
  Coding DNA Sequence Number=SeqID_11084
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1T3B5; Match level="QueryCoverage=84%, HitCoverage=15%, E-value=2e-41, Identity=56%"; Hit description =ATPase, E1-E2 type; Peptidase M, neutral zinc metallopeptidases, zinc- binding site
MNFQKIKTTVTEDRDALVDAVVDKMERDLILLGATAVEDRLQKGYRFLNVLKALLGKNQVMDINRRQDGNCSQHRINQISYISLEKQGDKEALSKASLESIKKQIREGISQIKSAKESSNTNKGSSSGFGFMIYGKSLDYSLNKNLERSFFELAINCASFICCQSSPKQKARVGAIGAQFEFLSYKNRSSLYTIIALGVKTF

SEQ ID NO: 127863 - protein, 81 aa, Glycine max
  Coding DNA Sequence Number=SeqID_11085
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1T3B5; Match level="QueryCoverage=78%, HitCoverage=5%, E-value=4e-28, Identity=87%"; Hit description=ATPase, E1-E2 type; Peptidase M, neutral zinc metallopeptidases, zinc- binding site
ICYFFYKNITFGFTLFWFKEYASFSGQAPYNDWYMSFYNVFFTSLPIIALGVFDQDVSAKLCLKILKDQQDLYVTSLPMTI

SEQ ID NO: 127864 - protein, 211 aa, Glycine max
  Coding DNA Sequence Number=SeqID_11086
MQLKLRHTINNEILIYPGYVPVPSVNYRVFHYGLRFSVGNWSFDKADWRNVDMVNKCWAKFPDPPDSSPIDLANNEDLQRDLLSIECAKTLNEALNLHHQKRCSSNNSLSTSKEDKKEENGVSRVNSIDANDDSVSNNISTNQSEESANARKDEMPSSFRFWVIFLWAFSGVGHRRRGTRLKHGRRRRSLHTGFMETNSRDRHSRGVDVPL

SEQ ID NO: 127865 - protein, 129 aa, Glycine max
  Coding DNA Sequence Number=SeqID_11087
  Pfam annotation: Domain name=Transposase_23; Domain location=51-121; Score=-4.1; E_value=0.0032; Accession=PF03017.5; Description =TNP1ENSPM transposase
MASFSQMQSKFQSQMQLQELAPPPEPEVGPSGARVSTKESCVAPSGNDPGTGDSDKCRLYIEENPSCLVALGRLYEGSTTVHNIPLLHGQVNVGVEEVKDAEALVPVPTDDVTLVGQALNTFLAWPTHL

SEQ ID NO: 127866 - protein, 187 aa, Glycine max
  Coding DNA Sequence Number=SeqID_11088
NKDGVDDIVCEKYGISKEKWAQFCQTRRDTSWEDVRKKAQAIQKQNIAPHVLSRGGYEYLEQKLMAEKTKKRLEEVSQSGSTEGVIDPPSPIRRHVKWKVTRTKKTGQMTSEAAKEIAKKIDSLDEQASQGSFIPHGRQDVLTAAVGQPEHPGRVHAAGAGITIKQYFGSAPRTSRSSSFMAPEDLQ

SEQ ID NO: 127867 - protein, 75 aa, Glycine max
  Coding DNA Sequence Number=SeqID_11089
MEAKAQKWWPRGENLQMPWVFAFLNEGGEFWVERNSPSLVFMFPDAGVLAQDTRVPPSCAFRLSRAGHETTIYQS

SEQ ID NO: 127868 - protein, 164 aa, Glycine max
  Coding DNA Sequence Number=SeqID_11090
  Gene Ontology: Mol. function=DNA binding; Cellular component=nucleus; Biological process=regulation of transcription
  Subcellular localization annotation: CTP_CleavageSite=96; ConfidenceScore=5.68e-01
MSLPLLSPIHVSITLPLTSQNPCLPLPCYSPMKPLPSSTPIATSGTPSAMATSRPPTGRRLSTPSPLTAPMPPLPKSPSSDTVYRNDFSGFIAFVVASGFRIQIPTRKNREWERDPVGEVVAGIKVLGDGFVRMEQTKMEMAKEIETMWMEMEMNHTKMILESQ

SEQ ID NO: 127869 - protein, 155 aa, Glycine max
  Coding DNA Sequence Number=SeqID_11091
MGEGEPNQPLRRTLQDYMANIGPRYFDALARPNVQTTNVEIRASLIHLIHQNKFHALDHKDPYAHLTTFIRIYIFFEEFPTMGKPISPLDILLFKWTVVIFSIFFICLSFFDPNTLFSPTVLPPDLTMVSPMAMTVASPWRRDDEDNFCALRHPH

SEQ ID NO: 127870 - protein, 95 aa, Glycine max
  Coding DNA Sequence Number=SeqID_11092
MELQMEGEEDSYHCTQPQTTKRSKKGALLNKIYFLNLRKYQPLPTKAMSFDMHSTSTSNLLAVVRADLLWDQHIQYLTIINLYGTLTTGGENLTK

SEQ ID NO: 127871 - protein, 99 aa, Glycine max
  Coding DNA Sequence Number=SeqID_11093
MAKICHSKVALRHVRSTELETLELRETHRSELLLLFVLSGYPSKSQSTRSGYNAIVRPITSKLCLDTEDGRQRCMKMFRHTTETDMMQKREPRNNMSNS

SEQ ID NO: 127872 - protein, 86 aa, Glycine max
  Coding DNA Sequence Number=SeqID_11094
MCKGCCNSFLGTGNRLHTLIAMAAQLIHDRVVMECLEGVWETLEGNERCRFRGTIRLSATSLVHPEQPARTLQQPVEWILPTPTPY

SEQ ID NO: 127873 - protein, 94 aa, Glycine max
  Coding DNA Sequence Number=SeqID_11095
MRNEITSAIYSLLPLRGDDSYPIAVANVGRGAVGALVPQLLPETESWQRLQTRSPAQGQFIFEFPAQVKAMQYSGDKEEAVPGLRSRPDLRTFE

SEQ ID NO: 127874 - protein, 67 aa, Glycine max
  Coding DNA Sequence Number=SeqID_11096
MESGEVALVSWSAVSARVKMLDGARFALGSLSGKDPIPSDIESVGGISAAISAVGVGGLNASRKAHL

SEQ ID NO: 127875 - protein, 61 aa, Glycine max
  Coding DNA Sequence Number=SeqID_11097
WAKRASNVKRSFSALSAREESGRASISRPRAKCEISALSASVVLSQAQGTIGAKLKSIYSC

SEQ ID NO: 127876 - protein, 91 aa, Glycine max
  Coding DNA Sequence Number=SeqID_11098
MRNGEQHCRNLAFSGRARETHWCLFEERKMRRSHHQRLFEENVRKTKKGSVNFKNKGSRVVYVWGRQAGYFSPKFSGGPGELEAGLGKPGA

SEQ ID NO: 127877 - protein, 75 aa, Glycine max
  Coding DNA Sequence Number=SeqID_11099
MGDLGAAGFVIPVSFSVLGVLGKKWGEEMASPLPFLKSMSVMLAQALCIISFGDIGIHRRRQFFIVHTGKQQCPF

SEQ ID NO: 127878 - protein, 208 aa, Glycine max
  Coding DNA Sequence Number=SeqID_11100
  Gene Ontology: Mol. function=transferase activity; Cellular component= 1-2nm peptidoglycan-based cell wall; Biological process=transport
  Homolog annotation: Hit_ID=Q5KYD5; Match level="QueryCoverage=66%, HitCoverage=29%, E-value=8e-43, Identity=55%"; Hit description =Hypothetical conserved protein
  Pfam annotation: Domain name=PTS_IIB; Domain location=3-86; Score =67.4; E_value=4.5e-17; Accession=PF02302.8; Description=PTS system, LactoseCellobiose specific IIB subunit
MKKVLIVCGNGLGSSFIVEMNVKKIIKELGKEAEVGHTDLTSAKSEQADIIISAKDIADQLSSHSAQPAIRALVQYSGRSAEYRCDGRAGTEKLRYRNRDDHGVRYAGEYCAGAHHAAEIHLPDRAPYAVYVGHAGGDPVGGRRARLLAGADRLADPRHHDGGMSGDSAAVHPQNHQLGRSGAGPLWLHRLPVVSAGWQSGGQRQPVN

SEQ ID NO: 127879 - protein, 288 aa, Glycine max
  Coding DNA Sequence Number=SeqID_11101
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q6CZ92; Match level="QueryCoverage=54%, HitCoverage=90%, E-value=6e-68, Identity=84%"; Hit description=ATP -dependent protease hslV
MAQLFVKLHAAPAVTQRNGDRFFGAVLADDEAVKLADNLAWSHLRHGFGPYALDDITGDIQRFGYDIVRTHLRVLQQRAGGCLGVRPAGTDGNQVIFRLNHVTVTADDQRGVLIGNRQQRFKAAQHPVSTPVFRQFDRGFHQMALMHLQFAFEQFKQGKGICGAASKARDHFVVVKTTHLFNIAFHYGIAERRLAITADHDPAVASYTYYCCHGQTPCCSGKKTPRSGRGVSCNQIWGNPVGFQPPAISDAANCRGRAGRVKAGRAGYSCCGRSCAGASPCCLRCCGL

SEQ ID NO: 127880 - protein, 77 aa, Glycine max
  Coding DNA Sequence Number=SeqID_11102
  Homolog annotation: Hit_ID=P17888; Match level="QueryCoverage=81%, HitCoverage=8%, E-value=7e-25, Identity=82%"; Hit description =Primosomal protein N'
MHIGQMLFQRAFAAGGVAIDARHRYARKQRTELLLQLFRAHADRQQMGRTAARTLMRQRTLAVAVVAAQLTMLLMQR

SEQ ID NO: 127881 - protein, 191 aa, Glycine max
  Coding DNA Sequence Number=SeqID_11103
  Gene Ontology: Mol. function=ATP-dependent helicase activity; Cellular component=alpha DNA polymerase:primase complex; Biological process=DNA replication
  Homolog annotation: Hit_ID=Q7CL19; Match level="QueryCoverage=92%, HitCoverage=24%, E-value=2e-46, Identity=55%"; Hit description =Primosomal protein N'
  Subcellular localization annotation: CTP_CleavageSite=28; ConfidenceScore=5.14e-01
MPVVQVALPVPLPRLFDYLLPADAPQPVAGARVSVPFGNRKMTGIVVSTRATSDLPLAQLKQIDALLDDRSLFSPALWRILNWAAGYYHSPLGEVLSHALPVLLRQGKPAQEAPLWQWVVNEAGREVALESLKRAPKQQQALAALRQRPLYRHQIGEQDFTDAALQALRAKGLCDLREHAPQQHDWRASFA

SEQ ID NO: 127882 - protein, 169 aa, Glycine max
  Coding DNA Sequence Number=SeqID_11104
  Gene Ontology: Mol. function=methylenetetrahydrofolate reductase (NADPH) activity; Cellular component=mitochondrial large ribosomal subunit; Biological process=methionine biosynthetic process
  Homolog annotation: Hit_ID=P71319; Match level="QueryCoverage=98%, HitCoverage=56%, E-value=4e-84, Identity=91%"; Hit description=5,10 -methylenetetrahydrofolate reductase
  Pfam annotation: Domain name=MTHFR; Domain location=1-162; Score =137.8; E_value=3e-38; Accession=PF02219.7; Description =Methylenetetrahydrofolate reductase
MYGSDLVSLLKEVGDFDISVAAYPEVHPEAKSAQADLINLKRKIDAGASRAITQFFFDVESYLRFRDRCVATGIDVEIVPGILPVSNFKQLQRFATMTNVRVPGWMNAMFDGLDDDAETRKMVGANIAMDMVKILSREGVKDFHFYTLNRAEMSYAICHTLGVRPTLAA

SEQ ID NO: 127883 - protein, 563 aa, Glycine max
  Coding DNA Sequence Number=SeqID_11105
  Gene Ontology: Mol. function=oxidoreductase activity, acting on the aldehyde or oxo group of donors, NAD or NADP as acceptor; Cellular component=mitochondrion; Biological process=amino acid biosynthetic process
  Homolog annotation: Hit_ID=Q6DAR1; Match level="QueryCoverage=37%, HitCoverage=64%, E-value=1e-100, Identity=81%"; Hit description=N -acetyl-gamma-glutamyl-phosphate reductase
  Pfam annotation: Domain name=AA_kinase; Domain location=212-449; Score=123.7; E_value=5.3e-34; Accession=PF00696.18; Description =Amino acid kinase family
  Pfam annotation: Domain name=Semialdhyde_dhC; Domain location=59-207; Score=114.9; E_value=2.3e-31; Accession=PF02774.9; Description =Semialdehyde dehydrogenase, dimerisation domain
  Pfam module annotation: Pfam domain module=AA_kinase::Semialdhyde _dhC; Domain location=212-449::59-207
AFRVNDDGFYQQYYGFSHQHQAWLDKAVYGLAEWNHEQIKDAQLVAVPGCYPTAAQLALKPLIKAGLLNPAQWPVINATSGVSGAGRKASVTTSFCEVSLQPYGLFNHRHHPEIVAHLGTPVIFTPHLGNFPRGILETITCRLNAGVSQQDVAAAFHSAYHDKPLVRLYDKGVPALKGVVGLPFCDIGFAVQGEHLIVVAAEDNLLKGASSQALGGVLLDSEEALARLFDALLAYRTQYQRPLIIVHGGGCLVDELMKKLALPVKKKNGLRVTPADQIDIITGALAGTANKTLLAWAKKYGIGAVGLCLGDAGLVNVAQFDEELGHVGNATPGNPQLLNTLLDAGYMPVISSIGITDGGELMNVNADQAATALAATIGADLVLLSDVSGILDGKGQRIAEMTAAKAEQLIAQGIITDGMIVKVHAALDAAPANPFQRRVDWHPDSRIIKDYDMSTQNIKKIVLAYSGGLDTSAIIPWLKENYGGCEVVAFVANIGQDPADLEGVEKKALQSGASECHVVDLREEFISEYVYPVLQTGALYEGTYLLGTSMARPIIAKAQLNWR

SEQ ID NO: 127884 - protein, 700 aa, Glycine max
  Coding DNA Sequence Number=SeqID_11106
  Gene Ontology: Mol. function=argininosuccinate synthase activity; Cellular component=chloroplast; Biological process=amino acid biosynthetic process
  Homolog annotation: Hit_ID=Q7MYD8; Match level="QueryCoverage=57%, HitCoverage=100%, E-value=0.0, Identity=83%"; Hit description =Argininosuccinate synthase
  Pfam annotation: Domain name=Arginosuc_synth; Domain location=101 -492; Score=605.4; E_value=5.2e-179; Accession=PF00764.9; Description= Arginosuccinate synthase
  Pfam annotation: Domain name=Lyase_1; Domain location=505-700; Score =123.8; E_value=5e-34; Accession=PF00206.10; Description=Lyase
  Pfam module annotation: Pfam domain module=Arginosuc_synth::Lyase_1; Domain location=101-492::505-700
MNVNADQAATALAATIGADLVLLSDVSGILDGKGQRIAEMTAAKAEQLIAQGIITDGMIVKVHAALDAAPANPFQRRVDWHPDSRIIKDYDMSTQNIKKIVLAYSGGLDTSAIIPWLKENYGGCEVVAFVANIGQDPADLEGVEKKALQSGASECHVVDLREEFISEYVYPVLQTGALYEGTYLLGTSMARPIIAKAQVELALKVGADALCHGATGKGNDQVRFETTYTALAPQLKVVAPWREWNLRSREALLDYLKERNIPTTASLEKIYSRDENAWHISTEGGVLESPWNAPNKDCWVWTVDPLEAPDQPENVTVSVEKGQVVAVNGEKLSPFQCLEKLNALGAKHGVGRIDIVENRLVGIKSRGCYETPGGTIMVNALRAVEQLVLDRDSFKWREQLGQEMSYVVYDGRWFAPLRQSIQAAAASLAELVNGEVVLQLYKGQATAIQKKSANSLYSEEFATFGEDEVYDHRHAGGFIRLFSLSSRIRALNEQKKSKQMALWGGRFSQAADQRFKQFNDSLRFDYRLAEQDIIGSVAWSKALVTVNVLSSEEQQQLEAALNALLEEVRANPQQILQSDAEDIHSWVEGKLIDKVGALGKKLHTGRSRNDQVATDLKLWCKTQVALLLEATRELQSALVATAEANQDAVMPGYTHLQRAQPVTFAHWCLAYVEMLARDESRLQDTLKRLDVSPLGCGALA

SEQ ID NO: 127885 - protein, 1126 aa, Glycine max
  Coding DNA Sequence Number=SeqID_11107
  Homolog annotation: Hit_ID=UPI00005F94AA; Match level="QueryCoverage =42%, HitCoverage=99%, E-value=0.0, Identity=66%"; Hit description =COG1070: Sugar (pentulose and hexulose) kinases
  Pfam annotation: Domain name=DJ-1_PfpI; Domain location=592-737; Score=-7.0; E_value=0.0071; Accession=PF01965.14; Description=DJ -1PfpI family
  Pfam annotation: Domain name=FGGY_C; Domain location=305-524; Score =294.5; E_value=1.9e-85; Accession=PF02782.6; Description=FGGY family of carbohydrate kinases, C-terminal domain
  Pfam annotation: Domain name=FGGY_N; Domain location=63-302; Score =417.7; E_value=1.7e-122; Accession=PF00370.11; Description=FGGY family of carbohydrate kinases, N-
  Pfam annotation: Domain name=Vicilin_N; Domain location=933-1060; Score=-71.0; E_value=0.055; Accession=PF04702.3; Description=Vicilin N terminal region
  Pfam module annotation: Pfam domain module=DJ-1_PfpI::FGGY_C::FGGY _N::Vicilin_N; Domain location=592-737::305-524::63-302::933-1060
MDTMAPALKSGGTAIAAGMVSSASKILKGEFSLASLAAHDQQQQLNPQHRSGRQEQLENMRSMVIGIDLGTSGVKVALLDAHGQVQATASAPLQVTRPQPLWSEQDPESWWQATDSAMQALAQQHDLRHVSAIGFSGQMHGATLLDAAHQVLRPAILWNDGRSSAQCHELEQRVPSSRQITGNLMMPGFTAPKLLWVQQHEPAIFAQVAKVLLPKDYLRWRMSGDFATDMSDAAGTMWLDVAQRDWSDAMLAACGLNRSHMPQLFEGNQITGTLLPEIAARWGMEPVPLVAGGGDNAAGAVGVGMVEPGQGMLSLGTSGVYFLVSEGYLSNPQRAVHSFCHALPQRWHLMSVMLSAAACLDWAAALTGCDDVPHLLAEAERASVQATPVWFLPYLSGERTPHNNPQAQGAFFGLTHQHGRPELARAVLEGVGFALAEGMDAVHECGVLPNTVMLIGGGARSAYWRQMLADISGLTLDYCHGGEVGPALGAARLAQLAVDPASEWPAPALVQRHQPDAAQHQAYQPRRARFAQLYQQLYVAGFGCASSPIVTPSSPEEPTMPQPVYFLVLPGVMALDLTGPAETLQLAGGHFALHYIGPQASVICSTGMTIADIAPLPATLPDNSLLIVPGVFDSRIWFDTGAAGQARDWLRQQHGAIHTRRITLVCICSGALLSAQAGLLDGVQCTTHHDVLPRLKAAAPAALVKDNRVFVEDAGIWTSAGITAGANGGAGDGGVDAMIAHPEHDWSLGALAERAHRAGIPRAATAGDCAPAPAAGGSGGESGAGRRLLLGTPAAPRPAALGRSAHQMMLVHAFQHHCQQQAAQQGYAKDPRQIEPRPRHIVRPVVQHIFKQHQQAYRRDKHQWATVKIPGVIKRAVNLQHLSGAKCDTDDAGDKTQPGQPADAAPVGIHHANCPSKQRVQQVVNRVAADIQIDRQPVERPQRLADGVRIGDHREDQHQQRHIARRHVFHLNQRRQQVDADNGEEEPQMVEHRLLQQLQQRSAFADRRQPGDVGQRDGAVEQQAQHNAQQMAALCAAFAKEQITGNHEEQRHADARSRVKQIGDVPAGSGDCHRSGNVPGGGVNDDHHQTGDRAGPTTPAAWISELSVNRRITAPACARISGCTMR

SEQ ID NO: 127886 - protein, 564 aa, Glycine max
  Coding DNA Sequence Number=SeqID_11108
  Homolog annotation: Hit_ID=P13024; Match level="QueryCoverage=51%, HitCoverage=100%, E-value=1e-99, Identity=60%"; Hit description =Protein fdhE
  Pfam annotation: Domain name=FdhE; Domain location=6-283; Score =491.3; E_value=1.2e-144; Accession=PF04216.3; Description=Protein involved in formate dehydrogenase formation
  Pfam annotation: Domain name=GST_C; Domain location=404-501; Score =44.8; E_value=2.9e-10; Accession=PF00043.15; Description=Glutathione S-transferase, C-terminal domain
  Pfam annotation: Domain name=GST_N; Domain location=307-380; Score =21.8; E_value=0.0025; Accession=PF02798.10; Description=Glutathione S-transferase, N-terminal domain
  Pfam module annotation: Pfam domain module=FdhE::GST_C::GST_N; Domain location=6-283::404-501::307-380
MSIRIIPQEQLEKSEKNTAEQVPPLLFPRAEKSLQPPCGAAQEIVLYDHPLQIDLHQRLAESAQQGKPPLDIHTYPRDVHWQRLLHSLIAELKPEMSGQALAVLENLEKASSTELETLASALLEGEFAQVSSDKAPFIWAALSIYWAQMAAMIPGKARAEYGEHRQFCPVCASVPVASVVHMDVGQQGLRYLHCNLCESEWYVVRSKCSNCEQTRDLHYWSLDSEQAAVKAESCGDCGTYLKMLYQEKDPALEPMADDLASLVLDARMEQEGFARSSLNPFMVAIHGDQVYSPASSLLPELIIHTEASMKLIGSYTSPFVRKISVILLEKGLVFEFVNHSPWEPDSHVPQYNPLGKVPAFIDDQQLTWFDSSIIAQVIELRGDAPALLPDDALRALQIRQLEKLADGINDAAVMIVREQMRPGDRQSEEVLLRNREKIARGLDALETAAAQGELLNSGTLNLADIATGCTLGYLNFRRVLPNWCVNRPALVKLAETLFERESFARTSAPCHRQPAARSGAAAAAGTIRRRATTFSNINRYRTGTPAGRMKRCAARSSSSKARCA

SEQ ID NO: 127887 - protein, 97 aa, Glycine max
  Coding DNA Sequence Number=SeqID_11109
MSLKRVRHVKDKTCSRFKAKSSSAVVANDKAKQVAAIANRDDKGVIGEVENGPRVGSDPDAVKLDLRVGGVKEEGSANNEEEKEECGKVEDATTHRY

SEQ ID NO: 127888 - protein, 69 aa, Glycine max
  Coding DNA Sequence Number=SeqID_11110
MVLVAVIFIVRAALAFGSRWFMEVGSGETMLVRDGCGGWWFHGWWHVAVHDVGGCTTRCPVAFELSVDV

SEQ ID NO: 127889 - protein, 796 aa, Glycine max
  Coding DNA Sequence Number=SeqID_11111
  Gene Ontology: Mol. function=4 iron, 4 sulfur cluster binding; Cellular component=formate dehydrogenase complex; Biological process= electron transport
  Homolog annotation: Hit_ID=Q663U7; Match level="QueryCoverage=45%, HitCoverage=41%, E-value=1e-167, Identity=73%"; Hit description =Formate dehydrogenase-O, major subunit (Formate dehydrogenase... precursor (EC 1.2.1.2))
  Pfam annotation: Domain name=FdhD-NarQ; Domain location=424-667; Score=414.9; E_value=1.2e-121; Accession=PF02634.6; Description =FdhDNarQ family
MVRMFCAPTECCVQPSAYRNEVEIRFWRAADALDHFRRITADVLLQQIPDAARMVQAVIAFGKAVVAQLVVPAGFVIFAIGFVVAAEQAIVEMVILPHDQAGIGVRLHIFMLDFVILQQPQQHTRQEGNVGAGADRRVKVCHRCRAREARIDNNQFGFVVNFGFHRPAETDRMRLSSVSAHHHNQIGITDVDPVVGHRTATKCWSKTCYRWSVSDACLVVDRQHTERSGRSAQHAGGEPAVYRHAGGVLRDKVGVAIGFHQLRDARKGVIPADALPFVGAWRTVFRIFQTAVAVDKIKQARAFRTERAAAHRMVRIPFDVENGLFGVLCAIAEARGFRRKAEQCCRGSCHTASADLEEFSSADVHGRGSEWLHAGLRQKRPDITTTLMWLLCETREVKAKQQKSNQNVNEIAGLSQTTVWQRHAITEAESDWLAQEVPVALVYNGISHVVMMATPDNLQAFALGFSLSEGIIEQPGEIYGMDVVPGCNGFEVQIELSSRRFMALKAQRRAMAGRTGCGVCGVEQLDQIGKPVQPLPFTQTFDLACLDNGLAQLRDFQPIGNLTGCTHAAAWISPQGELQGGCEDVGRHVALDKLLGQRSQQHWQQGAVLVSSRASYEMVQKSAMCGVEILFAVSAATQLAVEVAERCNLTLVGFSKPGRATVYSHPQRLINARKWKKSSCHKQNKQDIKSILLVRNEGKIGDAIVSTCFLRALFEAGYRVDILARDKYDTAIGSEVVTLLRDNAYDLLIDTAIWQTALYMPKMIADINPKMTLGFNKPGWLKPYDINIQFDHLNNH

SEQ ID NO: 127890 - protein, 858 aa, Glycine max
  Coding DNA Sequence Number=SeqID_11112
  Homolog annotation: Hit_ID=Q6CYX7; Match level="QueryCoverage=35%, HitCoverage=72%, E-value=1e-155, Identity=84%"; Hit description =Putative aminotransferase
  Pfam annotation: Domain name=Aminotran_3; Domain location=585-858; Score=18.6; E_value=1.6e-12; Accession=PF00202.11; Description =Aminotransferase class-III
  Pfam annotation: Domain name=Glyco_transf_9; Domain location=92-331; Score=-51.0; E_value=0.0006; Accession=PF01075.8; Description =Glycosyltransferase family 9 (heptosyltransferase)
  Pfam module annotation: Pfam domain module=Aminotran_3::Glyco_transf _9; Domain location=585-858::92-331
RKWKKSSCHKPNRQDIKSILLVRNEGKIGDAIVSTCFLRALFEAGYRVDILAVKENESLFRHNPYIHNIYLSESFSDCHQRDKYDTAIGSEVVTLLRDNAYDLLIDTAIWQTALYMPKMIADINPKMTLGFNKPGWLKPYDINIQFDHLNNHVKNIYRAVLDYLQVETVGGLNYEIFYPERIDAEIHQSGMFSADEHNILINIYASHADRDLSEQQLNELIGAIVRHNAATNIVVLDHKGALEQASLHPAKLYRVPSLYHAFAAVKKSDCVITPDTAVVHISAAYNKALVGIYQDSLKNNHLWSPGYSNGHQIFSDEFVCKNDGRLVEKISQKIHTLSVERTGLCRAAVANQQIDIADRGVLGTADHAEFAVIRQQQGAAGLLYHGVRDGGFMRMEAAGAGFMLFGRAERQCRLQTVGDDGQAGHGAQLFSQQRGGGAGIEEQRLAGLQMLYRRGGNRTFLSGLCVTAHLQRWLRRALQRHQTAMHAARQPLRLKRNDVAPCRFPRNAQLFDDAFSAELMLRAQQRADAMHDVRRDQAANTPFTFATGVTMVTRSTIMDTNSFRAEHADALDPATRTLTDKRSKVLGESYRQYLWDAAGNKYLDVYNNVASIGHCHPAVIEAVNQQMKMLNTHTRYLHERILDYSEALLATTPEAIDRAMYMCTGSEANDLAIRVARAWSGGTGIIVSQEAYHGTSDLTSGASPALGSGQPLAATTRLVPPPDAYRVDAPDLGAWFADQIQQQIDDMKAHGIKFAGFLADSIFSSDGVLPNPRGFLQQAVDVVHANGGIFIADEVQPGFARTGDAFWGFARHGVVPDVVTTGKPMGNGIPVSGLLAKSDVLAAFSDEIPYFNTFGGNP

SEQ ID NO: 127891 - protein, 158 aa, Glycine max
  Coding DNA Sequence Number=SeqID_11113
  Gene Ontology: Mol. function=transferase activity; Cellular component= 1-2nm peptidoglycan-based cell wall; Biological process=transport
  Homolog annotation: Hit_ID=Q736C0; Match level="QueryCoverage=97%, HitCoverage=36%, E-value=4e-67, Identity=78%"; Hit description=Sugar- specific permease, SgaT/UlaA, putative
MEERNNMAEHNADDTEVRITKGGGREAKVTHQRQQNGGQEGDQQPLDKGTDDRTAPSAGDIAVDASGRAAEEVRHQARHNHAQTEQRAQEHADQPGGEAAQEADDHGVRREREDRRAIQRRFSVWHQFIGDAFERRDDLGNHHAYTGKNDVNTRSKGD

SEQ ID NO: 127892 - protein, 215 aa, Glycine max
  Coding DNA Sequence Number=SeqID_11114
  Gene Ontology: Mol. function=ribulose-phosphate 3-epimerase activity; Cellular component=chloroplast; Biological process=carbohydrate metabolic process
  Homolog annotation: Hit_ID=P32719; Match level="QueryCoverage=98%, HitCoverage=92%, E-value=4e-60, Identity=50%"; Hit description=D -allulose-6-phosphate 3-epimerase
  Pfam annotation: Domain name=Ribul_P_3_epim; Domain location=2-194; Score=230.2; E_value=4.6e-66; Accession=PF00834.9; Description =Ribulose-phosphate 3 epimerase family
MDLTRFREQIEAMNASASFYHVDIMDGSYVKNITLSPFFIENLRKITDVPIDVHLMVNHPEDIIPMCIDAGADIISFHPETANNKIFRLLTQIKEAGRRCGVVLNPATPAESIREYAHLLDKVTVMSVDPGFAGQKFIPETLNKIRQLIAMRETHGYHYLTEIDGSCNARTFKQIAASGVDVFIVGTSGLFNLDDDVAQAWQKMEQIFAQETAAA

SEQ ID NO: 127893 - protein, 411 aa, Glycine max
  Coding DNA Sequence Number=SeqID_11115
  Gene Ontology: Mol. function=protein binding; Cellular component =integral to membrane; Biological process=defense response to fungus
  Homolog annotation: Hit_ID=Q1SWI7; Match level="QueryCoverage=99%, HitCoverage=88%, E-value=1e-104, Identity=33%"; Hit description =Leucine-rich repeat
  Pfam annotation: Domain name=LRR_1; Domain location=117-140; Score =6.1; E_value=20; Accession=PF00560.23; Description=Leucine Rich Repeat
  Pfam annotation: Domain name=LRR_1; Domain location=142-165; Score =8.5; E_value=7.5; Accession=PF00560.23; Description=Leucine Rich Repeat
  Pfam annotation: Domain name=LRR_1; Domain location=16-38; Score=2.2; E_value=1.1e+02; Accession=PF00560.23; Description=Leucine Rich Repeat
  Pfam annotation: Domain name=LRR_1; Domain location=190-213; Score =7.4; E_value=12; Accession=PF00560.23; Description=Leucine Rich Repeat
  Pfam annotation: Domain name=LRR_1; Domain location=215-248; Score =5.2; E_value=30; Accession=PF00560.23; Description=Leucine Rich Repeat
  Pfam annotation: Domain name=LRR_1; Domain location=260-281; Score =3.6; E_value=60; Accession=PF00560.23; Description=Leucine Rich Repeat
  Pfam annotation: Domain name=LRR_1; Domain location=288-309; Score =12.2; E_value=1.5; Accession=PF00560.23; Description=Leucine Rich Repeat
  Pfam annotation: Domain name=LRR_1; Domain location=312-334; Score =7.0; E_value=14; Accession=PF00560.23; Description=Leucine Rich Repeat
  Pfam annotation: Domain name=LRR_1; Domain location=336-358; Score =10.5; E_value=3.1; Accession=PF00560.23; Description=Leucine Rich Repeat
  Pfam annotation: Domain name=LRR_1; Domain location=360-383; Score =11.5; E_value=2; Accession=PF00560.23; Description=Leucine Rich Repeat
  Pfam annotation: Domain name=LRR_1; Domain location=385-407; Score =9.5; E_value=4.7; Accession=PF00560.23; Description=Leucine Rich Repeat
  Pfam annotation: Domain name=LRR_1; Domain location=45-67; Score=2.3; E_value=1e+02; Accession=PF00560.23; Description=Leucine Rich Repeat
  Pfam annotation: Domain name=LRR_1; Domain location=69-91; Score =10.0; E_value=3.9; Accession=PF00560.23; Description=Leucine Rich Repeat
  Pfam annotation: Domain name=LRR_1; Domain location=93-115; Score =7.3; E_value=12; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1; Domain location=117-140::142-165::16-38::190-213::215 -248::260-281::288-309::...
  Pfam module annotation: Domain location=312-334::336-358::360 -383::385-407::45-67::69-91::93-115
NQLEGNIPTSLGNLCNLRVIDLSYLKLNQQVNELLEILAPCISHGLTTLAVQSSRLSGNLTDHIGAFKNIDTLLFSNNSIGGALPRSFGKLSSLRYLDLSMNKFIGNPFESLRSLSKLLSLHIDGNLFHGVVKEDDLANLTSLTEIHASGNNFTLTVGPNWIPNFQLTYLEVTSWQLGPSFPLWIQSQNQLQYVGLSNTGIFGSIPTQMWEALPQVLYLNLSHNHIHGESGTTLKNPISIPVIDLSSNHLCGKLPYLSSDVSQLDLSSNSFSESMNDFLCNDQDEPMQLQFLNLASNNLSGEIPDCWMNWTFLVNVNLQSNHFVGNLPQSMGSLAELQSLQIRNNTLSGIFPTSLKKNNQLISLDLGENNLSGCIPTWVGEKLLKVKILRLRSNSFAGHIPNEICQMSHLQ

SEQ ID NO: 127894 - protein, 35 aa, Glycine max
  Coding DNA Sequence Number=SeqID_11116
NGEYSVVRFNYTFTCKPAAVSNCKPEAAFNHVIHN

SEQ ID NO: 127895 - protein, 211 aa, Glycine max
  Coding DNA Sequence Number=SeqID_11117
  Homolog annotation: Hit_ID=Q53KU9; Match level="QueryCoverage=29%, HitCoverage=7%, E-value=9e-21, Identity=76%"; Hit description =Probable protein kinase [imported]-Arabidopsis thaliana
MEYHQRQALRQSLLLISFGQLLQFSHQLDHYRYNIVKSLASALLYLHEEWDEQVIHRNITSSAVTLEPNMTPRLGSFALAEFLSRNEHGHHVINNTSNMRLWILIQVRSCGFKAVVPKTRQLEVLVVKKVHEFEVKKGVKQHRHSVDEKSDDLDLLETESLVGFMLILESDPIKETYLQPIGSTLAVQENYVASPLVDNPTVAQITNWNET

SEQ ID NO: 127896 - protein, 113 aa, Glycine max
  Coding DNA Sequence Number=SeqID_11118
  Subcellular localization annotation: CTP_CleavageSite=28; ConfidenceScore=5.18e-01
MDASGALSGMSSHLARMYNSSFFQILPRAQSENASNSIKKKSYQSMLLVMSIACLYCFWCAIQIYWTIPRHPAVGEEADLGVLVFLAIYFFLPYGLCIMSMSLKDHDPNQIPL

SEQ ID NO: 127897 - protein, 60 aa, Glycine max
  Coding DNA Sequence Number=SeqID_11119
MNVTFRLSAIPFRLGYALSATFRAEHNSSRLGIALSDISKSVILKIPVVKLWDMGNEPTI

SEQ ID NO: 127898 - protein, 72 aa, Glycine max
  Coding DNA Sequence Number=SeqID_11120
MAKSNSSDININGSPNDEVSFLSKKLNKMLKKKDKYKNFSRKKDKYEKDENSETDVDWVDFYIGYQSTDVES

SEQ ID NO: 127899 - protein, 179 aa, Glycine max
  Coding DNA Sequence Number=SeqID_11121
  Homolog annotation: Hit_ID=UPI0000E4667A; Match level="QueryCoverage =48%, HitCoverage=12%, E-value=1e-07, Identity=37%"; Hit description =PREDICTED: similar to 2 alpha fibrillar collagen, partial
MTTNTIATGNTNMTEEASTKHGGCFGSRERKKSKYLRDPYTNIGDLRKHRTDSKVKQESPTQPIGSIKMSGVTATQPTGSTTMPSVTPTQPIGSTTMPSVTHTQPIGSISMPSVIPTQPVVSMEVPSETPPSLEFMKQRLEMMASTMESSGHTLSPRMRAKLDAGIKNLLERVNARINV

SEQ ID NO: 127900 - protein, 55 aa, Glycine max
  Coding DNA Sequence Number=SeqID_11122
MMTEEYWKQAHTGFHNPVPLISLATVGRTLCAVVEKWSSTPSPHAATKWKKSTNA

SEQ ID NO: 127901 - protein, 425 aa, Glycine max
  Coding DNA Sequence Number=SeqID_11123
  Homolog annotation: Hit_ID=Q1S4N5; Match level="QueryCoverage=39%, HitCoverage=31%, E-value=2e-20, Identity=34%"; Hit description =Peptidase M, neutral zinc metallopeptidases, zinc-binding site
MATVHSFTGNGWSDELPNSGGVNGMSSLSMDMNVESVPSDQIENTSGGKAMVTLYLAEEYRQWEACEEEARSIKDKSFHFQEAWTTHPEFRDLVSQTWNMVLGDAPQKPEGIREKALVFNRETFGNIFRRKELEARIKGVHKILNVNVTSDMVQLEKTLQQEYNEVIGLFIDGTWCTDPQLLQIEAPSFFKNLFNTNEPCFPPCLKLDNISPISIDMLEDLIKLVSKTKVKQVCYNEMIDGFKLNRGLHQEDPLSPYMFLLCMEKLVLLIQAKVSKATCAQVKLVKEVLGLFCKASGLKVNAQKFIFYAFSNLKRQEITKFASILQFYHTTNLGSSYIWRSMMKAYDQLEDGFKFKLRRGKVSLFYEQWFDGDLLCQHLEEVHEMDIHLSINNVWLDNTWHWELVRTPLHAAIKHKLSNIIRRIN

SEQ ID NO: 127902 - protein, 95 aa, Glycine max
  Coding DNA Sequence Number=SeqID_11124
MGLRCRRRRSGGPPMVSSGLGGGVGVWWNGGYGGEVDRFWWFTVKEKGDGRASGGDKEKAKKMIGCFLKRNKCGLRPQGLNGIEWMNVNMNINNG

SEQ ID NO: 127903 - protein, 238 aa, Glycine max
  Coding DNA Sequence Number=SeqID_11125
  Gene Ontology: Mol. function=hydroxymethylglutaryl-CoA lyase activity; Cellular component=mitochondrial inner membrane; Biological process=metabolic process
  Homolog annotation: Hit_ID=Q2PF06; Match level="QueryCoverage=78%, HitCoverage=43%, E-value=7e-55, Identity=59%"; Hit description =Putative hydroxymethylglutaryl-CoA lyase
  Pfam annotation: Domain name=HMGL-like; Domain location=68-238; Score= -36.7; E_value=1.6e-05; Accession=PF00682.9; Description=HMGL-like
MAKRLIPLFNRVLVEKIVPPSKITTGILLPEKSTKISFLENLWLTIYEMLQLLTSIPDYVKIVEVGARDGLQNEKAIIPTNVKVELIKLLVSSGLSVVEATSFVSPKWVPQLADAKDVLAAIQNVEGARFPVLTPNLKGFEAAVAAGAKEVAVFPAASESFSKANLNSSIEDNLARCHDIASAARSLSIPVRGYNFQFILVHLYRNIAPAKVAYVAKSLYEMGCSEISLGDTIGVGTP

SEQ ID NO: 127904 - protein, 95 aa, Glycine max
  Coding DNA Sequence Number=SeqID_11126
MELVVDPCVRILCIKSFLGDGDQATCFMAMKRWSMACVSLDNNGDDNDNHNNSDKNHGNGDVVTEATPTTTIMTIVVVAIKDMVADTMTTIVKEE

SEQ ID NO: 127905 - protein, 136 aa, Glycine max
  Coding DNA Sequence Number=SeqID_11127
  Gene Ontology: Mol. function=chitin binding; Cellular component =extracellular region; Biological process=chitin metabolic process
  Homolog annotation: Hit_ID=UPI0000612705; Match level="QueryCoverage =76%, HitCoverage=86%, E-value=3e-13, Identity=34%"; Hit description =UPI0000612705 related cluster
MSFPSEGSTPSPSEDYTSSPSEGYTPSPLEAYRLLPSEDYTSLPSKGYTSSPSKGYMSSPSEDYTWVHVLVFRGLHVLAFSGLHVLAFRGLHVLAFRGLHALAFRGLHALAFRALHILAFRGLHICTFRELNVLCP

SEQ ID NO: 127906 - protein, 350 aa, Glycine max
  Coding DNA Sequence Number=SeqID_11128
  Gene Ontology: Mol. function=protein binding; Cellular component =integral to membrane; Biological process=defense response to fungus
  Homolog annotation: Hit_ID=Q949G9; Match level="QueryCoverage=94%, HitCoverage=83%, E-value=5e-66, Identity=33%"; Hit description =HcrVf1 protein
  Pfam annotation: Domain name=LRRNT_2; Domain location=27-67; Score =49.3; E_value=1.3e-11; Accession=PF08263.3; Description=Leucine rich repeat N-terminal domain
  Pfam annotation: Domain name=LRR_1; Domain location=116-141; Score =8.2; E_value=8.2; Accession=PF00560.23; Description=Leucine Rich Repeat
  Pfam annotation: Domain name=LRR_1; Domain location=143-165; Score =11.2; E_value=2.3; Accession=PF00560.23; Description=Leucine Rich Repeat
  Pfam annotation: Domain name=LRR_1; Domain location=194-215; Score =10.0; E_value=3.8; Accession=PF00560.23; Description=Leucine Rich Repeat
  Pfam annotation: Domain name=LRR_1; Domain location=220-242; Score =8.7; E_value=6.6; Accession=PF00560.23; Description=Leucine Rich Repeat
  Pfam annotation: Domain name=LRR_1; Domain location=244-269; Score =7.0; E_value=14; Accession=PF00560.23; Description=Leucine Rich Repeat
  Pfam annotation: Domain name=LRR_1; Domain location=271-293; Score =13.2; E_value=0.97; Accession=PF00560.23; Description=Leucine Rich Repeat
  Pfam annotation: Domain name=LRR_1; Domain location=295-317; Score =11.7; E_value=1.8; Accession=PF00560.23; Description=Leucine Rich Repeat
  Pfam annotation: Domain name=LRR_1; Domain location=319-341; Score =14.3; E_value=0.44; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=27-67::116 -141::143-165::194-215::220-242::244-269::271-293::295-317::319-341
MNSSFFYILVFVQLWLFSLPCRESVCIPSERETLLKIKNNLNDPSNRLWSWNHNHTNCCHWYGVLCHNVTSHVLQLHLNTTFSAAFYDGYYHFDEEAYEKSQFGGEISPCLADLKHLNHLNLSGNYFLGAGMAIPSFLGTMTSLTHLDLSLTGFMGKIPSQIGNLSNLVYLDLGGYSVEPMLAENVEWVSSMWKLEYLHLSYANLSKAFHWLHTLQSLPSLTHLDLSGCTLPHYNEPSLLNFSSLQTLHLSFTSFSPAISFVPKWIFKLKKLVSLQLWGNEIQGPIPGGIRNLTLLQNLDLSGNSFSSSIPDCLYGLHRLKFLNLRDNHLHGTISDALGNLTSLVELDLS

SEQ ID NO: 127907 - protein, 156 aa, Glycine max
  Coding DNA Sequence Number=SeqID_11129
MPLTQMDSKEGLLRRTLALSFVCKSPPQARDCPMKDKLAGCRGPEGRTPRIVLNEMATLLVRWSIPAPRDEATSIQGKSEVPELKAREVPPCLIAYQVSAWIPAAFATYDQCSQERDGSMSYNVQAAFLPEGFFRKPGHLPNIPEGWNNMMKKAAK

SEQ ID NO: 127908 - protein, 163 aa, Glycine max
  Coding DNA Sequence Number=SeqID_11130
  Gene Ontology: Mol. function=DNA binding; Biological process =regulation of transcription
  Homolog annotation: Hit_ID=Q9ZQ85; Match level="QueryCoverage=99%, HitCoverage=34%, E-value=7e-24, Identity=45%"; Hit description =Expressed protein
KYRLHTRRPSPSLHTGGPTPQLVVLGGIWVPPEYATTTAAMTNSGDPTLYGPHPTSQVAPPHYCAATQMPQEFYNSALPLSLLPPPHDYTLHHHHFHMYKTAAQTQNSPESDIRSSGDRSESIVDGKSESGKWNGESGEKKGLAALRDQEGEESTGSEITLKF

SEQ ID NO: 127909 - protein, 53 aa, Glycine max
  Coding DNA Sequence Number=SeqID_11131
MAGTLLGTGRPLGYHVNSSKVCMQWDLHPFLMLLVYLSMFVVAYLLGSNHILK

SEQ ID NO: 127910 - protein, 176 aa, Glycine max
  Coding DNA Sequence Number=SeqID_11132
MTVVRVRHCRESEYPPLESDINASLRLTSSFPSTTQLICNCETTDTTLSSRTSNSHREYWVLFSLNKPFSSGMFMVLILVLTLTLSITGIDYRKYLTWVPTEESSHYIVPEIGLDVKFSYASHKVYRIDIYAFGLVAWTGNDVLNTSVEKDLAPLHAPKQEEASSINTKGQSSAFV

SEQ ID NO: 127911 - protein, 139 aa, Glycine max
  Coding DNA Sequence Number=SeqID_11133
  Subcellular localization annotation: CTP_CleavageSite=15; ConfidenceScore=5.01e-01
MAARPGEPRLTPKVTGSPRRAGFFRLKSFEGPSEPGAKKLSKMTLLPLLFGIFRIPDQNVERSLLLCGLGSSSSMDSFASWKMNGSGMEKEERERRRHFKEKMSLEEAHHHRRPWIRAWRKKEMNEGRGREEHEILCSK

SEQ ID NO: 127912 - protein, 145 aa, Glycine max
  Coding DNA Sequence Number=SeqID_11134
MVSQDNAYLHFLDLGGKGLLVDKFSMSPKGSYQFRVDGLRSTFLSSLISKKVFYMDGWLIIYVYCVDFDGWDSFSYRGVCRGHLREMKAKVWILREEVKVFAKRMCALSLTTPNFFLGWNWVKPNRSQEARQVALSPNAKLDNSR

SEQ ID NO: 127913 - protein, 216 aa, Glycine max
  Coding DNA Sequence Number=SeqID_11135
MEEPSKKRKGYSSRSQRHSEAQDTPIPSSISPSSLFSLEEHHTRYTNLFSSCSIIDPKFIDMDLFSDESFECIQAFHNSNLIPFMSLKLHVYSKLVKAFYSNLEIQENTLISEVYRIKMVIDQSLFYDLTQLSSDGVPFEDALDDEWKFDFSVHNAHRLVCTNQADMTRRLLAGSLALESRILHYLIVCILLPRSSNLAQVSEEDLIVMWAFPTGQ

SEQ ID NO: 127914 - protein, 95 aa, Glycine max
  Coding DNA Sequence Number=SeqID_11136
  Gene Ontology: Mol. function=serine carboxypeptidase activity; Cellular component=cellulose and pectin-containing cell wall; Biological process=proteolysis
  Homolog annotation: Hit_ID=Q2R3G8; Match level="QueryCoverage=78%, HitCoverage=15%, E-value=6e-21, Identity=66%"; Hit description =Serine carboxypeptidase family protein, expressed
MTPLYICLQLRLCSLCYSVLHYDHRNLEIAAISILGSLVNSSIRVLVYSGDQDSVIPLLGSRSLVNGLAKQLGLNTTVAYRAWFEGKQTFDMTLM

SEQ ID NO: 127915 - protein, 123 aa, Glycine max
  Coding DNA Sequence Number=SeqID_11137
  Gene Ontology: Mol. function=ATP binding; Cellular component =mitochondrion; Biological process=protein folding
  Homolog annotation: Hit_ID=P34893; Match level="QueryCoverage=66%, HitCoverage=84%, E-value=2e-30, Identity=75%"; Hit description=10 kDa chaperonin
  Pfam annotation: Domain name=Cpn10; Domain location=4-91; Score=88.9; E_value=1.5e-23; Accession=PF00166.12; Description=Chaperonin 10 Kd subunit
MAKRLIPLFNRVLVEKIVPPSKTTAGILLPEKSTKLNSGKVIAVGPGFHSKDGKLIPVAVKEGDTVLLPEYGGTEVKLDNKEYDRECLDFLSVNLPFSNPLKLWDLSVAKLTDEISTSRFKGC

SEQ ID NO: 127916 - protein, 460 aa, Glycine max
  Coding DNA Sequence Number=SeqID_11138
  Gene Ontology: Mol. function=serine carboxypeptidase activity; Cellular component=cellulose and pectin-containing cell wall; Biological process=proteolysis
  Homolog annotation: Hit_ID=Q2R3G8; Match level="QueryCoverage=95%, HitCoverage=94%, E-value=1e-165, Identity=62%"; Hit description =Serine carboxypeptidase family protein, expressed
  Pfam annotation: Domain name=Peptidase_S10; Domain location=38-453; Score=607.4; E_value=1.3e-179; Accession=PF00450.12; Description =Serine carboxypeptidase
MTMLPHPFTMIATIIIVLAQTLVGVNSLPEADKISNLPGQPHVKFQQYSGYFSVDNQNQRALFYYFVEAEKHPTSKPVVLWLNGGPGCSSIGVGALVEHGPFKPDSNVLVKNHFSWNKVANVLYLESPAGVGFSYSSNASFYTLVTDEITARDNLVFLQRWFTEFPEYSNNDFFITGESYAGHYAPQLAQLIVQTKTNFNLKGIAIGNPLMEFDTDLNSKAEFLWSHGLISDSTYDLFTRVCNYSTIRRQTIHGNLSDVCAKINGLVFTEVSNYIDQYDVTLDVCLSSANQQAYELNQMQETQKIDVCVDDKAVTYLNRKDVQKALHAKLVGVSKWSTCSRVLHYDRRNLEIPTISILGALVNSNIRVLVYSGDQDSVIPLLGSRSLVNGLAKELGLNTTVAYRAWFEGKQVAGWTQVYGGMLSYATIRGASHEAPFTQPQRSLVLLKAFLEGKPLPGVK

SEQ ID NO: 127917 - protein, 76 aa, Glycine max
  Coding DNA Sequence Number=SeqID_11139
  Homolog annotation: Hit_ID=Q1SAV4; Match level="QueryCoverage=53%, HitCoverage=10%, E-value=1e-07, Identity=58%"; Hit description =Integrase, catalytic region
MKVDTNSKLQVLVQWEGLLPEETSWKDWDQLKSAYHLEDKVILQVTMDVTKKEQKGGLKERPNRKSTKLGYLKDYL

SEQ ID NO: 127918 - protein, 36 aa, Glycine max
  Coding DNA Sequence Number=SeqID_11140
MKINNEGNVLDLYRSSFAVGAKVEHGPFKPVTTMFL

SEQ ID NO: 127919 - protein, 193 aa, Glycine max
  Coding DNA Sequence Number=SeqID_11141
  Homolog annotation: Hit_ID=Q1SAV4; Match level="QueryCoverage=29%, HitCoverage=21%, E-value=2e-08, Identity=60%"; Hit description =Integrase, catalytic region
MVVVRTRGGEDGGPTWIWPEWGCAPWFWYLVSGGGARRGGDGVVGGDDGCASSDHGLGEKKETRLLGQLSRPLEVVLEVPKFGDKLTLADPNLSMKFLLAIDLPIVPTPEVWRHNGVRGGMMKRFKQRIVEHRVDICTLRGMVLHSLVQSMGGGGYGDLWVAMEVCRGNVDVEIRTDSLFAKQPTKLWWGDEM

SEQ ID NO: 127920 - protein, 73 aa, Glycine max
  Coding DNA Sequence Number=SeqID_11142
MEEFNANNTYEEKLKRPKKHLKIINTYQLKPKVGEEDPKMLGADASSGKRSNLETYGLMGRQLMASKLILYMF

SEQ ID NO: 127921 - protein, 83 aa, Glycine max
  Coding DNA Sequence Number=SeqID_11143
MDLPPLSQRTRGDCSGKDFTLSASGNDSTSEDMNTEVAKIVAIKKIHGWGNMLSSFNRFLLIMGVLHKPHFPFANGVGIPQPS

SEQ ID NO: 127922 - protein, 284 aa, Glycine max
  Coding DNA Sequence Number=SeqID_11144
  Gene Ontology: Mol. function=serine carboxypeptidase activity; Cellular component=cellulose and pectin-containing cell wall; Biological process=proteolysis
  Homolog annotation: Hit_ID=Q93Y09; Match level="QueryCoverage=82%, HitCoverage=56%, E-value=6e-47, Identity=46%"; Hit description =Serine carboxypeptidase II, putative
  Pfam annotation: Domain name=Peptidase_S10; Domain location=5-237; Score=-92.3; E_value=2.6e-08; Accession=PF00450.12; Description =Serine carboxypeptidase
MEVIMYLNLLNSLSRIGNPLLDFDTDMNAVDEYYWSHGIITDYAYKIMTSLCNSSRVLREYFSGQISKDCVLLQLKKSQKCILLQLSLTHSMLLGRNFKKSHNVLQTEEPDQQVDECNLKYSEMYLNRKDVQKALHARLVFESSFTGDNTYREYIKVLVVIINLNEVYTGDQDSVIPCMGTRRLVDRLAKTLGLKTTVPYSSWFVDKQVGGWTQVYGNHLSYATVRGASHGTPVTQGHMAPCLKLARTSVSLSSKETGTYVWWMNQDQDRSQTVSPAWDGRTVV

SEQ ID NO: 127923 - protein, 68 aa, Glycine max
  Coding DNA Sequence Number=SeqID_11145
MDRHQSNVERADMVEQRSNYSMEEIEEVYDKVEEERRNINHILEIKELLVNNENERLGSIYIKVWLGL

SEQ ID NO: 127924 - protein, 413 aa, Glycine max
  Coding DNA Sequence Number=SeqID_11146
  Homolog annotation: Hit_ID=Q10MT6; Match level="QueryCoverage=48%, HitCoverage=38%, E-value=2e-07, Identity=31%"; Hit description =Expressed protein
MMSYLKLSNVYICRKFKRIIEDQVDENADLSSEGNNDKVAVYIARTKGQNPPTILDEHVLCNPPMDEGFPLGNYIPDLDFTTFFEDIDDDGNPIIHNHGGQKFDESQINPTREDNEELASAASITAIKRQKQILINRVVISPKNHTTPHKKNEINEGHGYPSIKETKVELLLKQDLQPPTKKLQNHVRGWKCNKMSYNRPSDTQFSLQRFAKQRQQTECNNDRKIKKDENKFHQRSTVGRPRLHSRGTSNDAAKKEKKHETLKRKVHEGYQAHERGLKLRGTSDDAAKMEEKLETSKRKLHEGYQAHKRGLKLRRTSDDAAKMEEKIETSKRKPYEGNQEHERGLNLRGSSYDASKMEEKLETSKRKLHEGYQAHERERRSTRYFEGYECHLPKGKHSRRSSRPKFSNRRRYN

SEQ ID NO: 127925 - protein, 373 aa, Glycine max
  Coding DNA Sequence Number=SeqID_11147
  Gene Ontology: Mol. function=transposase activity; Biological process= transposition, DNA-mediated
  Homolog annotation: Hit_ID=Q1T4P3; Match level="QueryCoverage=87%, HitCoverage=42%, E-value=9e-25, Identity=28%"; Hit description=IMP dehydrogenase/GMP reductase
MPKGKTTPSDSNHPGRDSLQWNDEMDQMLLNALGEEANKGNRHDGAWTTQAYNNMVEALRSTIGPNITKNHIKNRMKTLKNHFAEAYDLFHSLSGFSWNSITRKFDAEDDVWEELIKGKPHAARWRKMQIKHYDILTELFATDRAKGNVAKTAKERRKQWEKENIDLNNYFEDTEMYVPNVGMFDENQFSPPNFEDASPQNGQTNPSGLNTSRGTKRKRNVVELVEDQYERMNESIMTIAEALKEGNSVSKELHQVAERQVEVAERQVAVIEKQVEIAEKQVTVIQQTRPRHYSESDVWDLLEELRVTDPFRMKVYNHLCDNEHKKRKLFGVPPHMRGEALIQMMTDAGAFTSSAIQVEVQQATGAIVQRCVY

SEQ ID NO: 127926 - protein, 34 aa, Glycine max
  Coding DNA Sequence Number=SeqID_11148
MAKGMSVKRKMVKGTLTIANKRGAPSNLGSPISI

SEQ ID NO: 127927 - protein, 123 aa, Glycine max
  Coding DNA Sequence Number=SeqID_11149
VYEDNDGVIFEGSKKAIQIKRGISFNALKKKIGDKDVAGGSMFHSANSLTSCGNYLSNDETQPATNMSNLHIDEDDDDDDDYLVSNSYVEESLDEDDSVDGISDTDDEVTNIPQPVRIVHPAE

SEQ ID NO: 127928 - protein, 70 aa, Glycine max
  Coding DNA Sequence Number=SeqID_11150
MVTFVLCTIIKKTTKTYVRLKLSIFMKVEKNKTSATKYFKRNITNGKGRKIIDEMDNGKGTFTPSTLRTR

SEQ ID NO: 127929 - protein, 85 aa, Glycine max
  Coding DNA Sequence Number=SeqID_11151
MGGSDFGGSFQQPLMDRKVISIGVSSSEDTCCGASENESTYSKRLKALRCTGGGTSHFRRRARPSATSPIRDPVSVMVILPLFFF

SEQ ID NO: 127930 - protein, 406 aa, Glycine max
  Coding DNA Sequence Number=SeqID_11152
MKVTGKIGWVSLNNVSKKLFEFDSNVFHRFKDHFLKVMATDVVADGIMGDFPLRPLVKQVSPSALSSILANRKQDDGVGPSGRKKSRAPMSLCILRQVVGLKPGAGHPLSLQDAPTAPTVIETPASATIVATIPAPLPPPAIVVQEVTPTTRVGVPTTSASSVLVSSSTAATPLLSVGVATTSAPIMSPPPSLAPPDSTFCCVGGCAAFLVFFPDVSLDHMYTSSNVNSLWGGNYKPEQKTSTGIVSTFDKNLIWSVGVQNATNFAKVFLQRSLTILEENEQRHREALCKVSSLEIEVAKWRANAHMVWRQKRPKLANATIAFAEVEEKKDLAGKVEGIAAKTDKLSKMVANLEAWLKKSESRLEEAELRIAKEREASKELEEELIMHKKEVVEQQHEKGFQKAIR

SEQ ID NO: 127931 - protein, 120 aa, Glycine max
  Coding DNA Sequence Number=SeqID_11153
MHPPTVRKGQSCQIYRLPSLETSDLACKTKSMSTSDNLIEAVWTTLVQAPQTYNSHTYRDYRSQHWTTLIHALGLDKLITLLLVEATTPDIRQSSMLDNLFRLQASSELGGLMYCPRSTK

SEQ ID NO: 127932 - protein, 106 aa, Glycine max
  Coding DNA Sequence Number=SeqID_11154
  Homolog annotation: Hit_ID=Q2HSZ5; Match level="QueryCoverage=99%, HitCoverage=28%, E-value=7e-30, Identity=67%"; Hit description =UBA/TS-N domain, putative
  Pfam annotation: Domain name=UBA; Domain location=64-103; Score=48.0; E_value=3.3e-11; Accession=PF00627.21; Description=UBATS-N domain
MGSPRAPSSARNVVGNLPSYPARQMEASSYAFMILMTLSAFYAAVIFEAGCRNYPAPMQAAVEPTEDSITTLVSMGFDRNSARQALVQARNDVNVATNILLEAQSH

SEQ ID NO: 127933 - protein, 115 aa, Glycine max
  Coding DNA Sequence Number=SeqID_11155
MVYIDWSQGILLERENWNVHQPKQVPTFLKPTFGSFKQYFEDNSEILVKLGNITRKREERKSLQKRTSSEAQQKSPRNMLETDSNKIGDQKVLRCKMSGKLKAAARKHAEETKIG

SEQ ID NO: 127934 - protein, 320 aa, Glycine max
  Coding DNA Sequence Number=SeqID_11156
  Gene Ontology: Mol. function=protein tyrosine/serine/threonine phosphatase activity; Cellular component=intracellular; Biological process=protein amino acid dephosphorylation
  Homolog annotation: Hit_ID=Q2HSZ6; Match level="QueryCoverage=91%, HitCoverage=98%, E-value=1e-109, Identity=60%"; Hit description=Dual specificity protein phosphatase
  Pfam annotation: Domain name=DSPc; Domain location=54-193; Score =30.3; E_value=6.9e-07; Accession=PF00782.11; Description=Dual specificity phosphatase, catalytic domain
DLHSNFQTESNLNFDLNLNFIFNFPVMPYTVRENLSIGNIGDAAEILENGAVQSVTHILSVLSSASISFFSEWKTTLSIPAKEITKVHAADAAAKSALPPEKLLYSLEYAGRDLKLVRMAVPLRDTEKEDLLDYLEACIDFIDRGRKEGSVLVHCFAGVSRSAAVITAYLMRTERLSVEDENHFSGLRIDSSKLGADPGMPVEVSSEAEETTKVGNNRRPTYRCKKCRRLVALQEHVIDHVPGEGERAFEFHKRRGGNPFNKSDEFECSSIFIEPLRKVQWRENCPVHIVMPVWDTSIGQAYNAAVEAGSLQLFNSTKAG

SEQ ID NO: 127935 - protein, 431 aa, Glycine max
  Coding DNA Sequence Number=SeqID_11157
  Gene Ontology: Mol. function=protein serine/threonine kinase activity; Cellular component=flagellin-based flagellum; Biological process=protein amino acid phosphorylation
  Homolog annotation: Hit_ID=Q2HT01; Match level="QueryCoverage=96%, HitCoverage=69%, E-value=0.0, Identity=93%"; Hit description=Protein kinase
  Pfam annotation: Domain name=Pkinase; Domain location=10-239; Score =236.6; E_value=5.2e-68; Accession=PF00069.15; Description=Protein kinase domain
  Pfam annotation: Domain name=Pkinase_Tyr; Domain location=14-237; Score=-60.0; E_value=8.6e-09; Accession=PF07714.7; Description =Protein tyrosine kinase
  Pfam module annotation: Pfam domain module=Pkinase::Pkinase_Tyr; Domain location=10-239::14-237
DESSMDLFFFQSNVMMTTAIAIEDVRREVKILQALTGHKNLVQFYEAYEDNDNVYIVMELCKGGELLDKILSRGGKYSEEDARIVMIQILSVVAFCHLQGVVHRDLKPENFLYISKDENSTLKVIDFGLSDYVKPDERLNDIVGSAYYVAPEVLHRSYGTEADMWSIGVIAYILLCGSRPFWARTESGIFRAVLKADPSFEEAPWPSLSADAKDFVKRLLNKDYRKRLTAAQALSHPWLVNHCDDVKIPFDMIIHKLVKTYICSSSLRKSALGALAKTLTLVQLAYLREQFNMLGPNKSGLISMQNFKTAILRSATDASKDSRVLDYVNMVSSIQYRKLDFEEFCAAAISVHQLEGMESWEQHARRAYEMFEKEGNRPIMIEELASELGLSPSVPIHVVLQDWIRHSDGKLSFLGFVRLLHGVSSRTFQKA

SEQ ID NO: 127936 - protein, 95 aa, Glycine max
  Coding DNA Sequence Number=SeqID_11158
MCKREHKSIKEYAQRWRDLATQVVPPMMEREMITMIVDTLPVFYYEKLVGYMPSSFANLVFASERIEVGLKRGKFDYALPSAPVSKPDKCTGLRK

SEQ ID NO: 127937 - protein, 97 aa, Glycine max
  Coding DNA Sequence Number=SeqID_11159
MTNFERDDKGAHSGILGACGNWYFFYCLHHCPKLEATLARQIQAQFQTSGKQALQYIQLGLSLSSHQKWQQQFEWCHPRVCEPHSSAACLKLHCCYC

SEQ ID NO: 127938 - protein, 686 aa, Glycine max
  Coding DNA Sequence Number=SeqID_11160
  Gene Ontology: Mol. function=nucleoside-triphosphatase activity; Cellular component=integral to membrane; Biological process=transport
  Homolog annotation: Hit_ID=Q1S953; Match level="QueryCoverage=99%, HitCoverage=100%, E-value=0.0, Identity=74%"; Hit description=AAA ATPase
  Pfam annotation: Domain name=ABC2_membrane; Domain location=416-625; Score=161.2; E_value=2.7e-45; Accession=PF01061.14; Description=ABC -2 type transporter
  Pfam annotation: Domain name=ABC_tran; Domain location=120-308; Score= 153.1; E_value=7.5e-43; Accession=PF00005.17; Description=ABC transporter
  Pfam module annotation: Pfam domain module=ABC2_membrane::ABC_tran; Domain location=416-625::120-308
MENKREDEIEDMSMSPPSIGSMQIAGSNGFGHSMEFMSQAYLPNMYTEIDIKVEDSGFDQDPPLPIYLKFEDVEFKVRDSQAAPNNPVKTMMSKVGTQHHVEEDRYKKILKSITGSIGPGEILALMGPSGSGKTTLLRVVGGRLIDNVKGKITYNDVRFNPAVKRRIGFVTQEDVLFPQLTVEETLIFSAFLRLPSNMSKQQKYARVENTVKDLGLERCRHTKIGGGYLKGISGGERKRTNIGYEILVDPSLLLLDEPTSGLDSTSANRLLLTLQGLAKGGRTIITTIHQPSSRIFHMFDKLLLISEGCPIYYGKAKDSMQYFSSLRFIPEIPMNPAEFLLDLATGQVNNISVPQYILKDQESVDSSKAVINYLQLKYKDTLEPKEKEENHGAANTPEHLQLAIQVKRDWTVSWCDQFVILYKRTFRARSKDYFDKLRLVQALGIALLLGLLWWKSSTNTEAQVRDQVGLMFYICIFWTSSCIFGAVYVFPFEKVYLVKERKADMYRLSVYYASSTLCDMVAHVFYPTFFMLILYFMAGFKSTVACFFLTLFAVLLIAITSQGAGELFGAAVMSIQRAGMVASLILMLFLLTGGYYVQHVPKMMHWLKYLSFVYYGFRLLLKVQYSGEQPYECESEGGCRTLQSSPSFDTVNLEGGLTEAWVLVAMALCFRVLAYFCLRRRIDICN

SEQ ID NO: 127939 - protein, 765 aa, Glycine max
  Coding DNA Sequence Number=SeqID_11161
  Homolog annotation: Hit_ID=Q9FLF6; Match level="QueryCoverage=12%, HitCoverage=18%, E-value=5e-11, Identity=39%"; Hit description =Pectin methylesterase-like protein
MSFISDSTMGMDKSDSGGSIQQPLVEQEVIPIGGSSSEGTCHETSNNESSSFERSLLPLSASRAMKMIGGRDVRVYPSNKHSHTIGSPSSPLVVVGYEWFTNLEGSYKMNVQACESDDFPFMRAAPGCPPFFFMYRYLFEVLGLILPLNSFQCALLEHLNEAPLNFIPIVGQWRGLSRLGVPQQCLKSCLKVFHRFNDHFFKVLATDVVANRLPLMFNQDRETRFPFYWQSDPTRFKSFDEDLLTLVERVDKAILEQLSASLDAWAILSLPLADDPLCLIWPLVKQVGPTGGDVPPSVVKPSVREGGQPTVRVYPDDEVIEVTPNVPPSFLAKRKHDDDAGVLMSGLGHPFPASSHDPPSASLAALAIVVAPPPLVPPYVPTQEVSISPPTVAITLIPLVAPTPALPSTIVTSLLNTSVYQPCVFYMAAMAIKEVSKGGTEPRLRIFVLLRGGDDGVVAGVSGVVEDALHHGLRGGEVVGEEGDGRLEELEKGWVGRKLVVGLGERGLAMLREESHVGRERVDLKFVEPLEKRDSPRVDLGFDEPLEKADLGFDKPLERQTHQGRTLGLTSRWRSDQECTHPGFWRDSPRADLRDLGIRVECEVIRSFIGHCLGAFGNSPRMSIPRMAKGQWELKLWRLSGGTDGQFVAYDVGVDAQHARWLPCEQVSAKLSILHMFGSELQLDKFFNRLWAFVNNVITRIHIGYPIMISQTCFIDDQGSDWGPFIHSHDLIVTTSLLLVYLDSYDLSHQGWEFHLTVKLLKSWS

SEQ ID NO: 127940 - protein, 67 aa, Glycine max
  Coding DNA Sequence Number=SeqID_11162
MKEPQSSANARSKLRVDQKMKAESNGWVVKRRQRLQFTGSGRKEIGSHLSTVILGLRSGQVWHCGLP

SEQ ID NO: 127941 - protein, 514 aa, Glycine max
  Coding DNA Sequence Number=SeqID_11163
  Gene Ontology: Mol. function=protein binding
  Homolog annotation: Hit_ID=Q9FG69; Match level="QueryCoverage=98%, HitCoverage=79%, E-value=1e-175, Identity=60%"; Hit description =Arabidopsis thaliana genomic DNA, chromosome 5, P1 clone:MYN21
  Pfam annotation: Domain name=UPF0118; Domain location=66-500; Score= -34.2; E_value=0.0013; Accession=PF01594.7; Description=Domain of unknown function DUF20
LALPLTSSRSSFTTLVEIREASLRTLLRKPKPENENDNTNKRSGFSTVLRLLLSFGVFVAAYERLGAVGSLSLLGLGFVFSSKNMDFSFSLFFPSGAFFTRGVLKRLKTVVAVGLIVGMIVGFLSGVIFFSYKIGGEGKEAVISLKVRVEENNYAERIGVKKWMEENDVAGMVDKYTSQFYETVSDQIDGLAMQYNMTEFVTVIKQFVITAPASASANSSSTNSLMVPSPYTEKLLSLKGRVRNKEWGEIYAELDTLFQELIITREDLVEKAKGYAVKGMDVGQRVLASGTSVLGSGAKFVISILNSIVSGAAEVFNFVSQAMVFFWVLYYLITSESGGATEQVMNMVPMSNSARVRCVEVLDKAISGVLLATAEIAFFQGCLTWLLFRLYKIHFLYVSTVIAFLSPLLPIFPSWLATIPATLQLVLEGRYIVAIFLSVAHLFLMDYGATEILEDVPGHSAYLTGLSIIGGMALFPSALEGAILGPLITTVMIALKDLYAEFVLGEPDDKVVNG

SEQ ID NO: 127942 - protein, 261 aa, Glycine max
  Coding DNA Sequence Number=SeqID_11164
  Gene Ontology: Mol. function=microtubule motor activity; Cellular component=microtubule associated complex; Biological process =microtubule-based movement
  Homolog annotation: Hit_ID=Q9FHD2; Match level="QueryCoverage=50%, HitCoverage=14%, E-value=1e-25, Identity=43%"; Hit description =Kinesin-like protein
MPPLHLISKALVNLILALGWVPHSNQLIGVFPAASSHSLPEPYRRLMTDPNSPIIDFYLIDFEVDMNSKRFAWQRWLHHSSIVNGLWSRKKSTLKKGGIELLLAKIIPFNNFELKQDLEIAKRTHEEHVSELELQATESEAEYEKRIEGLKLHLVDARMQVKELEAFSESRFLKWKNKEDTYQTIELRAAMKSVKDDVIKTKRNYLEEFKYFGIKLKGLAKAVENYHVVIAENRKLYNEVQDLKVRDLLPNNGPQKRYPFL

SEQ ID NO: 127943 - protein, 189 aa, Glycine max
  Coding DNA Sequence Number=SeqID_11165
MRGKGLLLGGRSMLDGVVVENEGVEEAKRWWRRSRPRHRWRATLNRLPTKLNLKKRRVLLKNDLGLCLFCGKDVESEEHLLLTCCVTERIWKHWCSCIGSHVVMPNDLRTHYWQHPSMVRGKLGGMAWTMVSFTIIWMKSWVWLYPKVDGFNYLFAEWVISPVNSFQASDFLQEKQRVFQEGSGIVSPL

SEQ ID NO: 127944 - protein, 235 aa, Glycine max
  Coding DNA Sequence Number=SeqID_11166
  Gene Ontology: Mol. function=zinc ion binding; Cellular component =integral to membrane; Biological process=ubiquitin cycle
  Homolog annotation: Hit_ID=Q1S950; Match level="QueryCoverage=99%, HitCoverage=87%, E-value=1e-88, Identity=58%"; Hit description=Zinc finger, RING-type; RINGv
  Pfam annotation: Domain name=zf-C3HC4; Domain location=189-229; Score= 36.2; E_value=1.1e-07; Accession=PF00097.15; Description=Zinc finger, C3HC4 type (RING finger)
  Subcellular localization annotation: CTP_CleavageSite=23; ConfidenceScore=5.04e-01
MRISRARWFTFLRRVFHYQNGSRSNLGSNPFNSSTWMMLEFIALILQITITTFTLAISKRERPIWPMRIWISGYDIGCVLNLLLLYGRYRQIYLTQGDSLSLSDMEQQRNNEETRMSHLMNKCRTSLELFFAICTLLGYNMNMASSNKGASDDQISQLPSWRHKEAGVKLELGNGSEGSKKLINEDPECCICLAKYKDKEEVRQLPCSHMFHLKCVDQWLKITSCCPLCKQGLER

SEQ ID NO: 127945 - protein, 265 aa, Glycine max
  Coding DNA Sequence Number=SeqID_11167
  Gene Ontology: Mol. function=nucleic acid binding; Cellular component= oxygen evolving complex; Biological process=DNA integration
  Homolog annotation: Hit_ID=Q1SAK3; Match level="QueryCoverage=63%, HitCoverage=13%, E-value=5e-44, Identity=53%"; Hit description =Integrase, catalytic region; Zinc finger, CCHC-type
  Pfam annotation: Domain name=rve; Domain location=124-265; Score =51.5; E_value=2.8e-12; Accession=PF00665.16; Description=Integrase core domain
MNFIIIKKKKDVIFGESVHKHKDYEDLKMSKHNLWVECEEHKKYVSFLNNELLNYQELKGQPQDVFKRHEEIRTLKSTLSKFGNRIDNLNKLLGYYRSSSDKFGNGYDGKQTWPYKLEVKLQTAEKQPCKRSTKIASTGGKRNGLVVVDDYFRWTWVMFLNHKDESFDIIFKFCKCVQDEKRVCITSIRSNHEGKFENDKFQLFCEENGIIHNFSTPKNPQQNGIVESKNRSLQEMDRTMLNDNSTPKHFWAEAMNVACYLQNRI

SEQ ID NO: 127946 - protein, 219 aa, Glycine max
  Coding DNA Sequence Number=SeqID_11168
  Homolog annotation: Hit_ID=Q1SNX2; Match level="QueryCoverage=35%, HitCoverage=19%, E-value=2e-34, Identity=89%"; Hit description =Double-stranded RNA binding
MTHEDLSGEGMGGATVGEGIERDFSGGVFGLTESGAVVRGLEDLAVKFDGGLEPWRVIGTFPNRHVGRQIKAAPLGQLLKLGVTSLNYESPSLTEEEEEEKEEEEEEEEEEEEEEEEVVWCVCVSFFQMAISISPSGGSMPPQQEQQPNKYSFTKPVSLVGPTDADLQRLYKSNEESVERKEVTALIRSSTSSILLFFILFKIEKNWVKQLMRQRGYTD

SEQ ID NO: 127947 - protein, 168 aa, Glycine max
  Coding DNA Sequence Number=SeqID_11169
MHFLAFYIQTFIEIPPFYHEQWAPNYPHEVRFKYNGATYPIRVQQHRGRYFFADGLSEVRADLKIYESIIINFFACDDNTVFDLHFTPPLNQQTCGRPILHSRVHAWRTEITQCILGAPQPLEIPSHARKYLKQCENHLTILRKTAPPLQWDVVTLDRDIKDKSIVRP

SEQ ID NO: 127948 - protein, 211 aa, Glycine max
  Coding DNA Sequence Number=SeqID_11170
  Gene Ontology: Mol. function=nucleic acid binding; Biological process= DNA integration
  Homolog annotation: Hit_ID=Q1SDG1; Match level="QueryCoverage=99%, HitCoverage=19%, E-value=8e-32, Identity=34%"; Hit description =Integrase, catalytic region; Zinc finger, CCHC-type
MEEGFTTNKALLFRGIKYDYWKKLVIAHFESIHIYLWDMVENRDYIPYDDRLNEIPRSHWTEQQKLGFLLNSKAWNVMLCTFSEEEYTKVKRNKLSLLTHKYELFSMEENEDIQCMFRCCQAILSELRSLDRAHDNYDHVEKNLGSLPRKWRPKIAALKALKNLDSMSLEEIVGTLKVHEQELQEDEGLRREKSLALNSQKNKKESSSREK

SEQ ID NO: 127949 - protein, 45 aa, Glycine max
  Coding DNA Sequence Number=SeqID_11171
MWGTEKHANAMEACKSVEIGKKRTGSGDMKSLNVNSCGSNRRVFF

SEQ ID NO: 127950 - protein, 162 aa, Glycine max
  Coding DNA Sequence Number=SeqID_11172
MTHGMGRVIENPKVSCRIRILNPKGGSWEFQTLKVFWLMGERMNGKDGSSLSSSSPTLVKCKCECEPSGEKVLEMLTQEQTSSCRFFQWIGDTGAGNNVFAEGSEFVWYVRENEELKLKVASLMEEPKANAEEIKNLRKKVVAQEEECRASSIQVVQLKSKI

SEQ ID NO: 127951 - protein, 92 aa, Glycine max
  Coding DNA Sequence Number=SeqID_11173
GNQGAPTGVQIGQVNVVEGGTEGAAEGGIEGRGGGIEGKYVQQSVRKALGAQQHQQTKPTNKHTTKKVEPGIGLAATQAKASTSIEDANGQK

SEQ ID NO: 127952 - protein, 47 aa, Glycine max
  Coding DNA Sequence Number=SeqID_11174
MEATKLVVVDNGGKVILAPFEFCPKRRIRLGREVEDLVTLAQRAIRA

SEQ ID NO: 127953 - protein, 46 aa, Glycine max
  Coding DNA Sequence Number=SeqID_11175
MANGERLSDYIEELDLNEEGGALMDSSESIGIGKCSSLKNCKRTSK

SEQ ID NO: 127954 - protein, 85 aa, Glycine max
  Coding DNA Sequence Number=SeqID_11176
MPIPKWGFSNRREVLGFRKLGKGVMRVVMRGELRSIIMDNFVHSHKTIRAGSKYGCAGSKGLDFVATLSLNSSVVNFNQSLKIGL

SEQ ID NO: 127955 - protein, 95 aa, Glycine max
  Coding DNA Sequence Number=SeqID_11177
MKRKERKRKRKRKREKGMCEEINGEVALYNPKRWQRWPSRCYDAQSHLGVLGGALTPTSGVWVYYRGTTIHNCDLCGFLGPDPKSTTPCENSQLL

SEQ ID NO: 127956 - protein, 60 aa, Glycine max
  Coding DNA Sequence Number=SeqID_11178
  Homolog annotation: Hit_ID=Q5IX03; Match level="QueryCoverage=59%, HitCoverage=19%, E-value=1e-07, Identity=76%"; Hit description =Pyruvate kinase
MVTKEQQTHFPCAVSPESMIVSTPCLTAIAMSETFALVGHWIEDSKKIGLEIQENALGIS

SEQ ID NO: 127957 - protein, 79 aa, Glycine max
  Coding DNA Sequence Number=SeqID_11179
MTAYDDHWWSWVVENEVLGFGRHFGEEESEKSSHLGALSAIPSLVGIALSAPFSPSKRSKVVIFKIPTVRCWKNVLESS

SEQ ID NO: 127958 - protein, 150 aa, Glycine max
  Coding DNA Sequence Number=SeqID_11180
MTLQKLKNVTAICNRKYHKGIFANWKVAGCPGKNAGCPNRDARGGLFVVRGGCCGKMVEEINNMYDSYELTIQNKTRGGGEQTRWRRRDTRRKHGGGGEAQRQEAKMLGGCTVAGVYQLLSEGRKWNCTINAGCRRKVKGAGRISLPLSL

SEQ ID NO: 127959 - protein, 1093 aa, Glycine max
  Coding DNA Sequence Number=SeqID_11181
  Gene Ontology: Mol. function=protein serine/threonine kinase activity; Cellular component=integral to membrane; Biological process=protein amino acid phosphorylation
  Homolog annotation: Hit_ID=Q6Z8S8; Match level="QueryCoverage=97%, HitCoverage=97%, E-value=0.0, Identity=59%"; Hit description =Putative receptor protein kinase
  Pfam annotation: Domain name=LRRNT_2; Domain location=34-74; Score =63.8; E_value=5.4e-16; Accession=PF08263.3; Description=Leucine rich repeat N-terminal domain
  Pfam annotation: Domain name=LRR_1; Domain location=102-124; Score =8.9; E_value=6.2; Accession=PF00560.23; Description=Leucine Rich Repeat
  Pfam annotation: Domain name=LRR_1; Domain location=126-148; Score =13.3; E_value=0.87; Accession=PF00560.23; Description=Leucine Rich Repeat
  Pfam annotation: Domain name=LRR_1; Domain location=150-172; Score =10.3; E_value=3.4; Accession=PF00560.23; Description=Leucine Rich Repeat
  Pfam annotation: Domain name=LRR_1; Domain location=174-196; Score =13.2; E_value=0.96; Accession=PF00560.23; Description=Leucine Rich Repeat
  Pfam annotation: Domain name=LRR_1; Domain location=198-221; Score =9.3; E_value=5.3; Accession=PF00560.23; Description=Leucine Rich Repeat
  Pfam annotation: Domain name=LRR_1; Domain location=223-245; Score =8.2; E_value=8.3; Accession=PF00560.23; Description=Leucine Rich Repeat
  Pfam annotation: Domain name=LRR_1; Domain location=247-269; Score =1.9; E_value=1.2e+02; Accession=PF00560.23; Description=Leucine Rich Repeat
  Pfam annotation: Domain name=LRR_1; Domain location=271-293; Score =13.7; E_value=0.69; Accession=PF00560.23; Description=Leucine Rich Repeat
  Pfam annotation: Domain name=LRR_1; Domain location=295-317; Score =10.2; E_value=3.5; Accession=PF00560.23; Description=Leucine Rich Repeat
  Pfam annotation: Domain name=LRR_1; Domain location=319-341; Score =18.1; E_value=0.032; Accession=PF00560.23; Description=Leucine Rich Repeat
  Pfam annotation: Domain name=LRR_1; Domain location=343-365; Score =11.0; E_value=2.5; Accession=PF00560.23; Description=Leucine Rich Repeat
  Pfam annotation: Domain name=LRR_1; Domain location=367-389; Score =10.8; E_value=2.8; Accession=PF00560.23; Description=Leucine Rich Repeat
  Pfam annotation: Domain name=LRR_1; Domain location=391-413; Score =6.1; E_value=20; Accession=PF00560.23; Description=Leucine Rich Repeat
  Pfam annotation: Domain name=LRR_1; Domain location=415-437; Score =16.3; E_value=0.11; Accession=PF00560.23; Description=Leucine Rich Repeat
  Pfam annotation: Domain name=LRR_1; Domain location=439-461; Score =9.4; E_value=5; Accession=PF00560.23; Description=Leucine Rich Repeat
  Pfam annotation: Domain name=LRR_1; Domain location=463-485; Score =14.3; E_value=0.45; Accession=PF00560.23; Description=Leucine Rich Repeat
  Pfam annotation: Domain name=LRR_1; Domain location=487-509; Score =13.2; E_value=0.98; Accession=PF00560.23; Description=Leucine Rich Repeat
  Pfam annotation: Domain name=LRR_1; Domain location=511-530; Score =14.5; E_value=0.39; Accession=PF00560.23; Description=Leucine Rich Repeat
  Pfam annotation: Domain name=LRR_1; Domain location=533-555; Score =8.6; E_value=7; Accession=PF00560.23; Description=Leucine Rich Repeat
  Pfam annotation: Domain name=LRR_1; Domain location=557-580; Score =14.1; E_value=0.52; Accession=PF00560.23; Description=Leucine Rich Repeat
  Pfam annotation: Domain name=LRR_1; Domain location=581-603; Score =12.1; E_value=1.5; Accession=PF00560.23; Description=Leucine Rich Repeat
  Pfam annotation: Domain name=LRR_1; Domain location=605-628; Score =0.9; E_value=1.9e+02; Accession=PF00560.23; Description=Leucine Rich Repeat
  Pfam annotation: Domain name=LRR_1; Domain location=630-651; Score =11.3; E_value=2.2; Accession=PF00560.23; Description=Leucine Rich Repeat
  Pfam annotation: Domain name=LRR_1; Domain location=653-674; Score =9.9; E_value=4; Accession=PF00560.23; Description=Leucine Rich Repeat
  Pfam annotation: Domain name=LRR_1; Domain location=78-100; Score =3.4; E_value=67; Accession=PF00560.23; Description=Leucine Rich Repeat
  Pfam annotation: Domain name=Pkinase; Domain location=768-1043; Score= 115.5; E_value=1.5e-31; Accession=PF00069.15; Description=Protein kinase domain
  Pfam annotation: Domain name=Pkinase_Tyr; Domain location=768-1043; Score=63.0; E_value=2.5e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::Pkinase::Pkinase _Tyr; Domain location=34-74::102-124::126-148::150-172::174-196::198 -221::223-245::247-269::271-293::295-317::319-341::343-365::367 -389::391-413::415-437:...
  Pfam module annotation: Domain location=:439-461::463-485::487 -509::511-530::533-555::557-580::581-603::605-628::630-651::653 -674::78-100::768-1043::768-1043
MSVILRNLSLPPKIFSLTLLLLLNSLLFPCCYSLNEQGQALLAWKNSLNSTSDALASWNPSNPSPCNWFGVQCNLQGEVVEVNLKSVNLQGSLPLNFQPLRSLKTLVLSTTNITGMIPKEIGDYKELIVIDLSGNSLFGEIPEEICRLSKLQTLALHANFLEGNIPSNIGNLSSLVNLTLYDNKVSGEIPKSIGSLTELQVLRVGGNTNLKGEVPWDIGNCTNLLVLGLAETSISGSLPSSIGMLKKIQTIAIYTTQLSGPIPEEIGKCSELQNLYLYQNSISGSIPIQIGELSKLQNLLLWQNNIVGIIPEELGSCTQLEVIDLSENLLTGSIPTSFGKLSNLQGLQLSVNKLSGIIPPEITNCTSLTQLEVDNNAIFGEVPPLIGNLRSLTLFFAWQNKLTGKIPDSLSQCQDLQALDLSYNNLNGPIPKQLFGLRNLTKLLLLSNDLSGFIPPEIGNCTSLYRLRLNHNRLAGTIPSEITNLKNLNFLDVSSNHLIGEIPSTLSRCQNLEFLDLHSNSLIGSIPENLPKNLQLTDLSDNRLTGELSHSIGSLTELTKLNLGKNQLSGSIPAEILSCSKLQLLDLGSNSFSGEIPKEVAQIPSLEIFLNLSCNQFSGEIPTQFSSLRKLGVLDLSHNKLSGNLDALFDLQNLVSLNVSFNDFSGELPNTPFFRKLPLNDLTGNDGLYIVGGVATPADRKEAKGHARLVMKIIISTLLCTSAILVLLTIHVLIRAHVANKALNGNNNWLITLYQKFEFSVDDIVRNLTSSNVIGTGSSGVVYKVTVPNGQILAVKKMWSSAESGAFTSEIQALGSIRHKNIIKLLGWGSSKNMKLLFYEYLPNGSLSSLIHGSGKGKPEWETRYDVMLGVAHALAYLHHDCVPSILHGDVKAMNVLLGPSYQPYLADFGLARIASENGDYTNSEPVQRPYLAGSYGYMAPEHASMQRITEKSDVYSFGVVLLEVLTGRHPLDPTLPGGAHLVPWIRNHLASKGDPYDLLDPKLRGRTDSSVHEMLQTLAVSFLCVSNRAEDRPSMKDTVAMLKEIRPVEASTTGPDVLKGVLSVHTSPAPPMKGVSHGTSNCSFHFSEDSIC

SEQ ID NO: 127960 - protein, 209 aa, Glycine max
  Coding DNA Sequence Number=SeqID_11182
  Gene Ontology: Biological process=regulation of DNA repair
  Homolog annotation: Hit_ID=Q8LBJ2; Match level="QueryCoverage=84%, HitCoverage=43%, E-value=7e-44, Identity=49%"; Hit description =Contains similarity to regulatory protein RecX
  Pfam annotation: Domain name=RecX; Domain location=52-173; Score= -0.6; E_value=0.015; Accession=PF02631.7; Description=RecX family
MEEVGELTIHEGGDSCDQELIQIDKFTSDVEEAAIKLLASRALTALELRKKLLGKRFSPDSVEAVINKFQRRGFINDRLYAETFSQSRWTSSSWGPRRIKQIELSLIPSPPPEKALFKKGVSQADAEKAVEVVFKDNDCAEDHKSVIGLSKHSMDHLYTQASKQWFRSQNVLKETRKSRIVRWLQYRGFDWHVINIILKKLDRQDQNSP

SEQ ID NO: 127961 - protein, 299 aa, Glycine max
  Coding DNA Sequence Number=SeqID_11183
  Homolog annotation: Hit_ID=Q9LUA7; Match level="QueryCoverage=86%, HitCoverage=81%, E-value=2e-57, Identity=42%"; Hit description =Arabidopsis thaliana genomic DNA, chromosome 5, P1 clone:MIF21
  Pfam annotation: Domain name=DUF868; Domain location=32-299; Score =323.3; E_value=4.1e-94; Accession=PF05910.3; Description=Plant protein of unknown function (DUF868)
MTNFLVESVMLAIPEPHSRKKTTCKDNKAMKIDAPQSFVTFVYQTKVVELLRSITVSWCKDPIDHFLSMSVDNTLEENKYTCKIDLGSGQSWGKKGLRSFEIAGARVDIFWDFRRAEFSATSPQPCSGYYVALVYKKEVLLLLGDLEKDAFERTKSKPSLDEATLLCKRDNVYGKKMFCTRAILEDGKIEHDVVIETSLSGPDDPEMWINIDGMLASRIMNLHWRFRGNEIVMVNNFPVQIFWDVHDWLFTNDLGLGPAFFVFKPIFLETTSDFNSIECPERGGGSSKHELLEDNSSTQ

SEQ ID NO: 127962 - protein, 38 aa, Glycine max
  Coding DNA Sequence Number=SeqID_11184
MGNPLVWFPRQTSASTSRPTFPVAFFQFTEKLDSCESK

SEQ ID NO: 127963 - protein, 97 aa, Glycine max
  Coding DNA Sequence Number=SeqID_11185
  Gene Ontology: Mol. function=transferase activity, transferring glycosyl groups; Cellular component=cytoplasm; Biological process =nucleoside metabolic process
  Homolog annotation: Hit_ID=Q1S4Q9; Match level="QueryCoverage=82%, HitCoverage=17%, E-value=1e-31, Identity=85%"; Hit description =Phosphoribosyltransferase; AAA ATPase; Phosphoribulokinase/uridine kinase
MMPPKGSLPMGTKSAVDLMESLSEVHFSGFHMDGLEQRKAGTEQPTTSATDMYKQPFVIGVAGGAASGKTSVCDMIVQQLHDQRVVLVNQIETVGID

SEQ ID NO: 127964 - protein, 511 aa, Glycine max
  Coding DNA Sequence Number=SeqID_11186
  Gene Ontology: Mol. function=fructose-bisphosphate aldolase activity; Cellular component=mitochondrial envelope; Biological process =metabolic process
  Homolog annotation: Hit_ID=P46256; Match level="QueryCoverage=67%, HitCoverage=96%, E-value=1e-171, Identity=88%"; Hit description =Fructose-bisphosphate aldolase, cytoplasmic isozyme 1
  Pfam annotation: Domain name=Glycolytic; Domain location=167-511; Score=876.6; E_value=1.1e-260; Accession=PF00274.9; Description =Fructose-bisphosphate aldolase class-I
MENALRACCKGIKIGKILIHREGDNGQQQLIYEKLPNDISDRHVLLLDPILGTAVQAISLLLKKGVPESNIIFLNLVSAPQGVHVVCKRFPRIKILTSEIEIGLNEDFRVIPGMGEFGDRYFGTDNDDQQDEVPLGQGKDHSLLYPRVITFVRLITGHVVPLHGLDELIKNAKYIATPGKGILAADESTGTIGKRLSSINVENIEANRQALRELLFTAPDALQYLSGVILFEETLYQKTSDGKPFVEVLQENNVIPGIKVDKGVVELAGTNGETTTQGFDSLGARCQQYYKAGARFAKWRAVLKIGPTEPSELSIQQNAQGLARYAIICQENGLVPIVEPEILTDGAHDIAKCAAVTETVLAAVYKALNEQHVLLEGTLLKPNMVTPGSDSPKVPPEVIAEYTVQALRRTVPAAVPGVVFLSGGQSEEEATLNLNAMNKLEVLKPWTLSFSFGRALQQSTLKTWGGKKENVAKAQEAFLARCKANSDATLGKYVGGSGSGLTSESLYVKNY

SEQ ID NO: 127965 - protein, 231 aa, Glycine max
  Coding DNA Sequence Number=SeqID_11187
  Homolog annotation: Hit_ID=Q9FKU2; Match level="QueryCoverage=91%, HitCoverage=74%, E-value=5e-53, Identity=47%"; Hit description =Genomic DNA, chromosome 5, P1 clone:MDA7
  Pfam annotation: Domain name=Hin1; Domain location=73-209; Score =113.8; E_value=5e-31; Accession=PF07320.4; Description=Harpin -induced protein 1 (Hin1)
MLASVEEELGTPKQPRNQHSQQSEAPNSLANTRAIFGQPRLQRTKPIIWCAAILCFIFSLVLIFFGIATLILYLSMKPRNPTFDIPNASLNVVYFDSPQYLNGEFTLLANFSNPNRRIGLRFESLNIELFYSDRLVSSQTIKPFTQRPRETRLQSVNLISSLVFLPQDVGVKLQRQVENNRVNYNARGTFKVRFNIGLVHLSYSLYSTCQIEMTSPPAGDIANGKYQCAKQ

SEQ ID NO: 127966 - protein, 97 aa, Glycine max
  Coding DNA Sequence Number=SeqID_11188
MCCGGRICMLCTCLVLVVIAIGLVFGFGVFKHGFHKIKDTVSFCDSCGGGGRPFIGYAPPPLFYFGRKKTRGHKGPEKKEGKDKATQPKSYIISYNP

SEQ ID NO: 127967 - protein, 67 aa, Glycine max
  Coding DNA Sequence Number=SeqID_11189
MLRLLLVEFSFVLCSAMRVERGFYIAVKDGEWHKIERRVLCVHILRLQIIWQPLCLFHAITKNVPIK

SEQ ID NO: 127968 - protein, 184 aa, Glycine max
  Coding DNA Sequence Number=SeqID_11190
  Gene Ontology: Mol. function=heat shock protein binding; Cellular component=chloroplast thylakoid membrane; Biological process=protein folding
  Homolog annotation: Hit_ID=Q9LTT7; Match level="QueryCoverage=62%, HitCoverage=69%, E-value=1e-18, Identity=47%"; Hit description=DnaJ -like protein
  Pfam annotation: Domain name=DnaJ; Domain location=40-103; Score =88.6; E_value=1.9e-23; Accession=PF00226.21; Description=DnaJ domain
MAGTLNLTPLTGAGRTLRPPFRISIRAFTATAIDSRRAASLYEVLRIKQNASAVEIKSAYRNLAKVYHPDSALRRSESDERDFIEIHDAYETLSDPSARALYDLSLMAARDDNRSFSSLVAAPNGSSGFYYQTQVEVEAPFLGSNERKTIKSQELKLLILNIIRLEFFYFGVGQLSGSCFWVKE

SEQ ID NO: 127969 - protein, 117 aa, Glycine max
  Coding DNA Sequence Number=SeqID_11191
  Homolog annotation: Hit_ID=Q1SYR3; Match level="QueryCoverage=73%, HitCoverage=3%, E-value=1e-13, Identity=44%"; Hit description=RNase H, putative
MAKKGKLDHIKEMLKDIEGGRDYAFANLAELYLVSDMVIPPKYKVSDFDRYKETSCPKNHLKMYCRKMGGYVRDEKLLMHFFQESLTGVAVTCLSSALNDREGDDNNDSRHVTSVLL

SEQ ID NO: 127970 - protein, 128 aa, Glycine max
  Coding DNA Sequence Number=SeqID_11192
MATMMEAMMSMKKIMEVNAVVAAATSVIAEVDLTLPSGLNQINHPTLDMVGQGSKELGSTGAPHFVQVQNKHAFPPYGLPPNYTPPNVARTLDENNSTPILIESQQPQSDHAHISRPMGRHMKYPSTI

SEQ ID NO: 127971 - protein, 450 aa, Glycine max
  Coding DNA Sequence Number=SeqID_11193
  Gene Ontology: Mol. function=cytochrome-c oxidase activity; Cellular component=membrane; Biological process=protein complex assembly
  Homolog annotation: Hit_ID=Q1SHZ0; Match level="QueryCoverage=99%, HitCoverage=100%, E-value=0.0, Identity=71%"; Hit description =Cytochrome oxidase assembly
  Pfam annotation: Domain name=COX15-CtaA; Domain location=90-434; Score=200.3; E_value=4.5e-57; Accession=PF02628.6; Description =Cytochrome oxidase assembly protein
MFGRGMVWSVWKRGKEACKIHKLCLRGTPFSSSSTQPPPFKFLTPPVATHYIHAFRSQLFPKGHHVHVPQMRNFSKMVSAEQKEGLKLLVNGGSRAQKLVGIWLFGSAAWVFSMVVLGGLTRLTRSGLSMTDWKFTGTLPPFSDDEWLQEFDKYKQSPEYKRVNRGMKIEEFKFIYWMEYAHRMWGRALGVMFALPYSYFLHKRYITLRLGLRLSALFALGAGQGLIGWWMEPPSEYSQPRVSSYRLAAHLTSAFAIYCGLFWTALSVVMPEPPAESLTWVRGAAKVRRLALPISVLVGLTAVSGAFVAGNDAGHAFNTFPKMGDTWIPEDIFEMKPLIRNFFENTSTVQLDHRILATATLISVGILWWSTRKLEIHPAVRSVIGGAVGMAALQVTLGISTLLSYVPVSLGTAHQAGALTLLTFMLLLNHTVRRPSLSLLKSLPQVVKAH

SEQ ID NO: 127972 - protein, 415 aa, Glycine max
  Coding DNA Sequence Number=SeqID_11194
  Gene Ontology: Cellular component=integral to membrane; Biological process=peroxisome organization and biogenesis
  Homolog annotation: Hit_ID=Q9FF99; Match level="QueryCoverage=93%, HitCoverage=94%, E-value=1e-141, Identity=55%"; Hit description =Amino acid transporter
  Pfam annotation: Domain name=Aa_trans; Domain location=25-411; Score =353.7; E_value=3.1e-103; Accession=PF01490.8; Description =Transmembrane amino acid transporter protein
  Pfam annotation: Domain name=Trp_Tyr_perm; Domain location=25-400; Score=-269.6; E_value=0.025; Accession=PF03222.4; Description =Tryptophantyrosine permease family
  Pfam module annotation: Pfam domain module=Aa_trans::Trp_Tyr_perm; Domain location=25-411::25-400
MAVQNSLQITRSGSGGYDDDGRAKRTGTLWSAVAHIITAIIGAGVLSLAWSTSQLGWIAGPVCLLFCAIVTYVSSFLLSDCYRTLDPVTVKRNYSYMDAVRVYLGNKRTWLAGSLQYLSLYGVIMSFIPDLHNMAWVSIVAAIMSFTYSSIGLGLGITTVIENGRIMGSLTGVPASNIADKLWLVFQAIGDIAFAYPYTVILLEIQDTLESPPPENKTMKKASMIAILITTFFYLCCGCFGYAAFGNQTPGNLLTGFGFYEPYWLIDFANACIVLHLVGGYQIYSQPIYGAVDRWCSKRYPNSGFVNNFYQLKLPRLPAFQLNMFRICFRTTYVVSTTGLAILFPYFNQVIGVLGALGFWPLAIYFPVEMYFVQRKIEAWSRKWIVLRTFSFICFLVSLVALIGSLEGIISEKLS

SEQ ID NO: 127973 - protein, 482 aa, Glycine max
  Coding DNA Sequence Number=SeqID_11195
  Gene Ontology: Mol. function=nucleic acid binding; Cellular component= spliceosome; Biological process=mRNA processing
  Homolog annotation: Hit_ID=Q1S9K9; Match level="QueryCoverage=97%, HitCoverage=97%, E-value=0.0, Identity=80%"; Hit description=U2 auxiliary factor small subunit
  Pfam annotation: Domain name=RRM_1; Domain location=230-296; Score =64.2; E_value=4.2e-16; Accession=PF00076.12; Description=RNA recognition motif. (a.k.a. RRM, R
  Pfam annotation: Domain name=zf-CCCH; Domain location=158-183; Score =17.3; E_value=0.0068; Accession=PF00642.15; Description=Zinc finger C-x8-C-x5-C-x3-H type (and similar)
  Pfam module annotation: Pfam domain module=RRM_1::zf-CCCH; Domain location=230-296::158-183
MAHRLLRDHEADGWERSDFPIICESCLGDSPYVRMTRAEYDKECKICTRPFTVFRWRPGRDARYKKTEICQTCSKLKNVCQVCLLDLEYGLPVQVRDTALNIDSHDAIPKSDVNREYFAEEHDRRARAGIDYESSYGKVRPNDTILKLQRTTPYYKRNRAHICSFYIRGECTRGAECPYRHEMPETGELSQQNIKDRYYGVNDPVALKLLGKAGEMNTLEAPEDESIKTLYVGGLDARVTEQDLRDHFYAHGEIESIKMVLQRACAFVTYTTREGAEKAAEELSNKLVIKGLRLKLMWGRPQTSKPESDGSDQARQQASVAHSGLLPRAVISQQQNQDQTQGMVYYNNPPGPPPLQQERSYYPSMDPQRMGALVASQDGPPGGPSGSGENKPSSDKQQMQNYTHPMMPPPPGQYHHQYYPPYGYMPPVSPYQQYASPYNAAVAPSQTPAANHPYQHSMQPGSGQAAHAPAESGTSTSGSQQH

SEQ ID NO: 127974 - protein, 179 aa, Glycine max
  Coding DNA Sequence Number=SeqID_11196
  Gene Ontology: Cellular component=integral to membrane
  Homolog annotation: Hit_ID=Q9FF99; Match level="QueryCoverage=79%, HitCoverage=30%, E-value=3e-30, Identity=48%"; Hit description=Amino acid transporter
MDVAAKSESKDNLPLLLTQSADPLKRTGTVWTAVAHIVTGVIGSGVLSLPWSTAQLGWLAGPFSILLIASITLFSSFLLCNTYRHPHPEYGPNRSASYLDVVHLHLGISNGRLSGLLVNISLYGFAIAFVITTAISLRCVDSSLILLLPLLLCHFLFFVLLFIRLCKTRFLHWYSTKEA

SEQ ID NO: 127975 - protein, 126 aa, Glycine max
  Coding DNA Sequence Number=SeqID_11197
  Gene Ontology: Mol. function=structural constituent of ribosome; Cellular component=mitochondrial ribosome; Biological process =translation
  Homolog annotation: Hit_ID=Q658I1; Match level="QueryCoverage=85%, HitCoverage=75%, E-value=5e-44, Identity=78%"; Hit description =Ribosomal protein L29 protein-like
  Pfam annotation: Domain name=MRP-L47; Domain location=20-106; Score =169.4; E_value=9.1e-48; Accession=PF06984.4; Description =Mitochondrial 39-S ribosomal protein L4
  Pfam annotation: Domain name=Ribosomal_L29; Domain location=44-106; Score=-2.5; E_value=0.1; Accession=PF00831.13; Description=Ribosomal L29 protein
  Pfam module annotation: Pfam domain module=MRP-L47::Ribosomal_L29; Domain location=20-106::44-106
MGVGIAKPLECQIKTLCNPLQEFFEADRSHDDDKPVVYGRSWKASELRLKSWDDLHKLWYVLLKDKNMLMTQRQMLNAQNLRFPNPERIPKVRKSMCCIKQVLTERAIEESDPRRSAEMKRMINVL

SEQ ID NO: 127976 - protein, 221 aa, Glycine max
  Coding DNA Sequence Number=SeqID_11198
  Pfam annotation: Domain name=RcbX; Domain location=87-200; Score= -58.0; E_value=0.017; Accession=PF02341.6; Description=RbcX protein
MVGGVSVAVESQSCPRLYVDALPTTPSMSVLCLKRKHLLSLTTSFVQSHSVNTIFNKHCRHKEKTKRLTIVNELGGQYEDTFHDVKKQILNYFTYKAVRTVLQQLYEMNPPQYRWFYKILYVRLLLSKLATASNGSALVRFVATNDPADGKHFIRSLAKEQHQLAERVMITRLHLYGKWIKKCNHAEIYQEISDENLELMRERLMETVIWPSDDTNTEKIG

SEQ ID NO: 127977 - protein, 266 aa, Glycine max
  Coding DNA Sequence Number=SeqID_11199
  Gene Ontology: Mol. function=phosphopyruvate hydratase activity; Cellular component=phosphopyruvate hydratase complex; Biological process=glycolysis
  Homolog annotation: Hit_ID=Q9ZW34; Match level="QueryCoverage=82%, HitCoverage=46%, E-value=1e-94, Identity=79%"; Hit description =Putative enolase 2-phospho-D-glycerate hydroylase
  Pfam annotation: Domain name=Enolase_C; Domain location=145-264; Score=-96.3; E_value=0.072; Accession=PF00113.12; Description =Enolase, C-terminal TIM barrel domain
  Pfam annotation: Domain name=Enolase_N; Domain location=8-137; Score =207.1; E_value=4.1e-59; Accession=PF03952.6; Description=Enolase, N -terminal domain
  Pfam module annotation: Pfam domain module=Enolase_C::Enolase_N; Domain location=145-264::8-137
MRKAVQSVITKIKARQILDSRGIPTVEVDLHTNKGVFRASVPSGNSTSMYEAVELRDGDKGVYLGNGVAKAVKNINDKISEALIGMDPTLQSQIDQAMIDLDKTEKKGELGANAILAVSIAACKADKNIQVPLYKHIADLSGKTSPTLPVPAFTVISGGKHAGSNLAIQEIMILPIGASKFEEALRMGTETYHHLKAVITEKYGAHNCNVGEDGGFAPNISRQAFYWISTAFENSLLLNTTIKPFHFMGSITWNHCTTNFCTILHH

SEQ ID NO: 127978 - protein, 53 aa, Glycine max
  Coding DNA Sequence Number=SeqID_11200
MLQQEEEGSSLKKEETSSAEEEEEEDPFYQNEDDCFAIKVPIKTTCPCDKTVQ

SEQ ID NO: 127979 - protein, 75 aa, Glycine max
  Coding DNA Sequence Number=SeqID_11201
MNGSGMVASDDAYSTCCGAAGVGAADVEGRSAGLALALLAPRIETVRSIKIPTVLPDVGQVNDQAQAIKSEETQV

SEQ ID NO: 127980 - protein, 115 aa, Glycine max
  Coding DNA Sequence Number=SeqID_11202
MVVLTKHEIPSFLSKNTILEKILLIRDRACDLLVKEFGGPFGPANKSSTEPHELIAVATCPFAGGRRVTHGMRVPRKEYAGSHHQRLFEENVGKTEGKPVKKKILSSGVVFTLEE

SEQ ID NO: 127981 - protein, 205 aa, Glycine max
  Coding DNA Sequence Number=SeqID_11203
MELGRQLEGEPWQHSKPYQTEQLLLRKPKQWVLSVLVTMLLFVTKERDKKPGEALNKTRTCHSSEDKEEGPKEENLESSREETLEKEKTGPTNAISDKKEALTEKKKGTQELEQLRLKQGLKRAQREMARLLELDTRLLGMDRALQGAPNLGLPEEKTAAAAGDGGGRWQRRKQSERDCTCSDTMLKIKGYIVEGFEIHIVLEKC

SEQ ID NO: 127982 - protein, 77 aa, Glycine max
  Coding DNA Sequence Number=SeqID_11204
  Gene Ontology: Mol. function=DNA binding; Biological process=DNA integration
  Homolog annotation: Hit_ID=Q0KIG7; Match level="QueryCoverage=84%, HitCoverage=10%, E-value=2e-10, Identity=50%"; Hit description =Integrase core domain containing protein
MADQGEPYSDPIRYRRLVGKLIYLTITRPDISFAVSVAILSLGRARSKTLLLGLVQKQNMELWPQPLALHIASNPVF

SEQ ID NO: 127983 - protein, 266 aa, Glycine max
  Coding DNA Sequence Number=SeqID_11205
  Gene Ontology: Mol. function=RNA-directed DNA polymerase activity; Biological process=RNA-dependent DNA replication
  Homolog annotation: Hit_ID=Q1S7C5; Match level="QueryCoverage=23%, HitCoverage=5%, E-value=1e-19, Identity=73%"; Hit description =Integrase, catalytic region
MRQSQSKDDPNSNQFDHRRKGFMKTKTMHLMKSLGYQSSFEPVNETICIFLYPENPFTANILPINDTKSQIVAKLLANRLKKVMSFIIDEGQSAFIEGRHLLQSAVIANEVVDEARRSQKPCIVFKVDFEKAYNSMVSVNCGMSKICICIGTEALNGLVREVVKRKLYSGFHVGSNRVEQPTTQGRISPKNSGLQPHKEKLIMFVPNMILIGDFISIAIFNRSILRRSLRINDVAFKMMTTEAYFGGSPPMTVVVVGRKEESMQKP

SEQ ID NO: 127984 - protein, 102 aa, Glycine max
  Coding DNA Sequence Number=SeqID_11206
MDLDCPMTEKYRKVIQGVASLTCMAYSLTIGTPRAITFSTANSVSRAREKTTEPLNPKFTAKQLLYMHGKPDQLSKQLQNDDLRAETELEAEEHNLGIAMKF

SEQ ID NO: 127985 - protein, 411 aa, Glycine max
  Coding DNA Sequence Number=SeqID_11207
  Gene Ontology: Mol. function=DNA polymerase processivity factor activity; Cellular component=PCNA complex; Biological process =regulation of DNA replication
  Homolog annotation: Hit_ID=Q9MAY3; Match level="QueryCoverage=63%, HitCoverage=92%, E-value=2e-50, Identity=54%"; Hit description =Proliferating cell nuclear antigen
  Pfam annotation: Domain name=PCNA_C; Domain location=146-274; Score =150.2; E_value=5.5e-42; Accession=PF02747.6; Description =Proliferating cell nuclear antigen, C-terminal domain
  Pfam annotation: Domain name=PCNA_N; Domain location=1-114; Score= -41.1; E_value=0.0078; Accession=PF00705.9; Description=Proliferating cell nuclear antigen, N-
  Pfam module annotation: Pfam domain module=PCNA_C::PCNA_N; Domain location=146-274::1-114
MVEARRVQGSVLKHMVEAINEMSVNCANFNFSRAGFSLLAMDPTQTAMAEIFLRSDTSAAPSPSASTSTTWPRSSVPPPKMTPSPSKPTMAPTSPSSSSKALIERKLACCSKDSCAVVCVIAQDLISHFMMNLVDIDTKPVLIHSEAQYYHAIVKMPSAKFSRICTDLSIFGDTVSIEVTEEGVGFSTKRDIGTSIIFCRHNTSVHKADEEATAIEMTQTVSLNFGLTFLNSFTKATPLSNTVTIFLSNQLHLPVVFQYQIGEKEEGVKFSTKGEGDILWCRYKEVKLILFEVTKVSCELERRTSDPMMTLRALEGALVVTFIFIHVTDKGTLMFSTIGDFGISTVLRKHEPFEVTLIKMTQPVSLKFEMRCVDMLRKATLLSDTLTIDQLVKGAAGGCDLARTVFAGVHV

SEQ ID NO: 127986 - protein, 473 aa, Glycine max
  Coding DNA Sequence Number=SeqID_11208
  Gene Ontology: Mol. function=peroxidase activity; Biological process =protein folding
  Homolog annotation: Hit_ID=Q338Y6; Match level="QueryCoverage=83%, HitCoverage=91%, E-value=3e-41, Identity=28%"; Hit description =Expressed protein
  Pfam annotation: Domain name=DUF641; Domain location=68-187; Score =42.3; E_value=1.7e-09; Accession=PF04859.3; Description=Plant protein of unknown function (DUF641)
MTRKVSNFSDLIQRVTTSCFLHPFDDHRSDVGDREEEYHSGSLGNRHEDEDANEEGYYGEEKMVMGLKVSREEKKLKKMRALMEEVFEAVSAMKSAYVSLQEAHCPWDPERLREADVAVVAQLKKLALLRDRFHGSVSSVEEGKGRRRGGGHAPYETLLMKEDLLLQNLKEKLQCAATLSTHQNKAQPYTKRNLASNSHIQAAGFVAAPSPPELLEATMAQVKEASKSFTSLLFSLMHDAQWDMDAAVRSMGAASATTTDKYYNNKNTCSVTTTSTTVSTLHAKYALESYIYKKMFQGFDHESFYMDNSTLSSLLNPAQFRRDCFSQYCHMKSVDPSELIGGVLATCNFGKFCSKKYLSIVHPKMEESLFGDLEQHSVVSEGKHPRTRFYKEFLGVAKGVWLLHLVAFWFDPVPSKFEASAGAEFHPRYMESVLKFAGGTVPPRKIVGFSVSPGFKLGNGSVLKARVYLMARN

SEQ ID NO: 127987 - protein, 73 aa, Glycine max
  Coding DNA Sequence Number=SeqID_11209
  Homolog annotation: Hit_ID=Q14EY5; Match level="QueryCoverage=44%, HitCoverage=8%, E-value=3e-11, Identity=93%"; Hit description=NADH dehydrogenase subunit B
MNLGTFACIVSFGLRTGTDNIRDYAGLYTKDPYLALSLALCLLSLGGLPPLSASTIPGISMNPIIEIAQDTLF

SEQ ID NO: 127988 - protein, 48 aa, Glycine max
  Coding DNA Sequence Number=SeqID_11210
  Homolog annotation: Hit_ID=Q9SCU2; Match level="QueryCoverage=79%, HitCoverage=29%, E-value=3e-08, Identity=58%"; Hit description=LS1 -like protein
MPCLYISTNINLDGVNIDPIFSQATTAVSTIIGKPEKLMKFGLNSQDV

SEQ ID NO: 127989 - protein, 315 aa, Glycine max
  Coding DNA Sequence Number=SeqID_11211
  Gene Ontology: Mol. function=ATPase activity, coupled to transmembrane movement of substances; Cellular component=integral to membrane; Biological process=proteolysis
  Homolog annotation: Hit_ID=Q7WN51; Match level="QueryCoverage=99%, HitCoverage=47%, E-value=1e-147, Identity=85%"; Hit description =Probable ABC transporter
  Pfam annotation: Domain name=ABC_tran; Domain location=178-313; Score= 7.9; E_value=3.5e-08; Accession=PF00005.17; Description=ABC transporter
MASFQASSQRNATLVEALTGLEAVKTLNAQGAIQRNWERSTEFIAQTGGKLKLISSSTVGFVQAVQQLVSIAVVIIGVYLAQDSALSMGGIIAASMIAGRCLAPLGQVAGLLMQYQNARTSLGSIDNYMKLPIERPAEAEFLHRPVFHGGLEFRDVSFTYPGSTQPVLKKVSFKLKPGEKVGIIGRIGSGKTTLEKLALALFQPTEGAVLLDGVDVRQIDPADVRRAIGHVPQDPLLFYGSLKHNLAMGAPYADDASILAAANMAGVTEFANLHPNGFYMLIGERGESLSGGQRQARPSCAAAWAKPAPTRPSCW

SEQ ID NO: 127990 - protein, 86 aa, Glycine max
  Coding DNA Sequence Number=SeqID_11212
  Gene Ontology: Mol. function=nucleic acid binding
VPEDAVRLSLFSFSLDGEAKRWLHSFKGNNLKTWEEVVEKFLKKYFSESKTAEGKAAISSFHQFPDEPLSEALERFYGLFKYIMKF

SEQ ID NO: 127991 - protein, 57 aa, Glycine max
  Coding DNA Sequence Number=SeqID_11213
MVYATLMLKDGAKKWWKEEDKSQMCSPSTQPARSTRSLSLLALSAPTLAKLKFSNST

SEQ ID NO: 127992 - protein, 110 aa, Glycine max
  Coding DNA Sequence Number=SeqID_11214
MEDCLEGPHLGNHETQLQTRKWRTHEQRWAITFMGLPKRVRMEDCLEGPHLGNHETQFQTRKWRTHEQRWAITFMGLRKRVRMEDFLEGPHLGNHETQLQTRKWRTHEQR

SEQ ID NO: 127993 - protein, 128 aa, Glycine max
  Coding DNA Sequence Number=SeqID_11215
MCSATDYKTKSIGGCPSQPLNIHGITLKGKQDENWEQLFTPMIGQWNKQVDFRVDGYPRQEEQERITEPVSHGPASEHQFPAQEFHILQSSVEPQGKGRRRVVVEAEEYSQQISERGHGMYYTPPTFS

SEQ ID NO: 127994 - protein, 100 aa, Glycine max
  Coding DNA Sequence Number=SeqID_11216
  Homolog annotation: Hit_ID=Q1SFS3; Match level="QueryCoverage=91%, HitCoverage=18%, E-value=2e-07, Identity=29%"; Hit description =Lambda repressor-like, DNA-binding
MAEVSIEAIASLAQYYDQPWRCFTFRDFQLSPTVEEFKEILGCPLRGRKPYLFSGFYPSLARISKMVQISTQELDHRKQVENGVVGVPRKCLEVKAKVLA

SEQ ID NO: 127995 - protein, 113 aa, Glycine max
  Coding DNA Sequence Number=SeqID_11217
MTKNERRTMKNGEESSRYRLQKRLRSGKRGRWLPPSSPRRAGLLPPEGTAFCWNTLEGLKCCGTLRIARQCSLSTFGMSRNFTDYLTMGVKYLKAVRQRLQAIKQWSPDEIRV

SEQ ID NO: 127996 - protein, 711 aa, Glycine max
  Coding DNA Sequence Number=SeqID_11218
  Homolog annotation: Hit_ID=Q01G74; Match level="QueryCoverage=93%, HitCoverage=51%, E-value=1e-43, Identity=42%"; Hit description =Homology to unknown gene
MGKVWILMVFVLVGVVGIVEGARKHPSSGRRIHTLFSVECQNYFDWQTVGLMNSYRKAKHPGPITRLLSCTDEEKNKYKGMHLAPTFEVPSMSRHPKTGDCVECGLVCVVCCGVRSMTLALVLVVQLYVAIAAVDLFLGMSRGRISLCGTTVVIAILTCEVENKFSDVNNIQFFLIHKTIELVLITSYSAEYPAINKPAGVVHWLKHSKEAKNVDWVVILDADMIIRGPIIPWELGAEKGRPVAAYYGYLIGCDNILAKLHTKHPELCDKVGGLLAFHIDDLRVFAPLWLSKTEEVREDTVHWATNITGDIYGKGWISEMYGYSFGAAEVGLRHKINDNLMIYPGYVPREGIEPILLHYGLPFSVGNWSFNKLAHHDDGIVYECNQLFPEPPYPKEVRQLELDPNRRRGLFLSLECINIINEGLLLQHAANGCPKPTWSKYLSFLKSKAYAELTQPKYVNPATLQMMEDIKEEHVDDGAGKPHPKIHTIFSTECTPYFDWQTVGLMHSFRRSGQPGNITRLLSCSDEDLRQYKGHDLAPTHYVPSMSRHPLTGDWYPAINKPAAVLHWLNHVNIDAEFIVILDADMILRGPITPWEFKAARSHPVSTPYDYLIGCDNELAKLHTSHPEACDKVGGVIIMHIDDLRKFAMLWLHKTEEVRADRAHYARNITGDIYESGWISEMYGYSFGAAEYSIRDITSFSSRPGLCNLFN

SEQ ID NO: 127997 - protein, 130 aa, Glycine max
  Coding DNA Sequence Number=SeqID_11219
MARRHPMEVCSCEGYCSSVKRACTKSVRCKCMGVHVAADGDTIVTSGLLETSDSGHRGAARIPLSSEPGLQKTVGLVTRHTGNRDCLAQQKDVRESTLVVVSRHRQWRDVDQWKVVQIRRLLARKFTEKA

SEQ ID NO: 127998 - protein, 79 aa, Glycine max
  Coding DNA Sequence Number=SeqID_11220
MHLVAIEYIPYLPNGQFFSIHTLPYPSSLCTVRKLEVAIRVFSDVDEEGKMMKEFIHLKFSRQQFGNRDHWDAIEGWRI

SEQ ID NO: 127999 - protein, 95 aa, Glycine max
  Coding DNA Sequence Number=SeqID_11221
MDRGECELKKIDHLGDVDEEAGVVAANDGLEKATLHDEGVKSRGVIRNDISNGNECLPTHGAQCHLADGVVGKVVARERVKCCSAGSGYEGEKEV

SEQ ID NO: 128000 - protein, 90 aa, Glycine max
  Coding DNA Sequence Number=SeqID_11222
MANENCMPTITNEDAMQDMINAACGFSTMCGNEAPIPSLTKHRDSNKRDEDKEECKVCKTSRWQQNDKQVESGHGSTPTKPPTKLPTKIL

SEQ ID NO: 128001 - protein, 92 aa, Glycine max
  Coding DNA Sequence Number=SeqID_11223
MVIPKFKVPDFDKYKGTTCPKNHLKMCCRKMGAYTIDEELLIHFFQESLTGVAATWYTNLEPSRVHSWKDLMVAFVRQCQYNSDIAPDRMQL

SEQ ID NO: 128002 - protein, 687 aa, Glycine max
  Coding DNA Sequence Number=SeqID_11224
  Gene Ontology: Mol. function=binding; Cellular component =mitochondrion; Biological process=positive regulation of transcription, DNA-dependent
  Homolog annotation: Hit_ID=Q2QLK4; Match level="QueryCoverage=97%, HitCoverage=69%, E-value=6e-32, Identity=24%"; Hit description =Pentatricopeptide, putative, expressed
  Pfam annotation: Domain name=PPR; Domain location=163-197; Score =13.7; E_value=0.18; Accession=PF01535.11; Description=PPR repeat
  Pfam annotation: Domain name=PPR; Domain location=198-232; Score =34.8; E_value=2.9e-07; Accession=PF01535.11; Description=PPR repeat
  Pfam annotation: Domain name=PPR; Domain location=233-267; Score =29.6; E_value=1.1e-05; Accession=PF01535.11; Description=PPR repeat
  Pfam annotation: Domain name=PPR; Domain location=268-302; Score =15.7; E_value=0.1; Accession=PF01535.11; Description=PPR repeat
  Pfam annotation: Domain name=PPR; Domain location=314-348; Score =17.6; E_value=0.045; Accession=PF01535.11; Description=PPR repeat
  Pfam annotation: Domain name=PPR; Domain location=349-383; Score =19.3; E_value=0.014; Accession=PF01535.11; Description=PPR repeat
  Pfam annotation: Domain name=PPR; Domain location=384-418; Score =25.5; E_value=0.00019; Accession=PF01535.11; Description=PPR repeat
  Pfam annotation: Domain name=PPR; Domain location=419-452; Score=2.1; E_value=4.2; Accession=PF01535.11; Description=PPR repeat
  Pfam module annotation: Pfam domain module=PPR::PPR::PPR::PPR::PPR::PP R::PPR::PPR; Domain location=163-197::198-232::233-267::268-302::314 -348::349-383::384-418::419-452
MRIMRCYCHDSRGSKEWTEEIEYLDESGGVIYKGKGVRSVEPGVDDHVMVGEVKKPFVNALAVAKIVEVVKRWKWGPELETQLDKLQFVPNMTHIAQALKVVGDVDACFSLFRWAKRQAWYVPSDDCYVMLFDGLNQKRDFEGIQLLFDEMVGDSADGVSLFAACNGVIRYLAKAEKLEVSFYCFKKILDVGCKVDTETYNSLITLFLNKGLPYKAFEMYESMEKAGCSLDGSTYELMIPNLAKSGRLDAAFKLFQEMKVRGFRLGLNVFASLVDSMGKAGRLDSAMKVYMEMRETALRLWDEMRMAGFRPNFGLYTLIIESHAKSGKLEIAMSTFLDIEIAGFLPTPSTYACLLEMHAASGQIDPAMKLYNSMTNVGLRPGLSTYTVLLTLLANKKLVDVAAKILLEMKAMGYSVDVTASDILMVYIKEGSVDLALRWLRFMGSSGIRTNNFIMRQLFESCMKSGLYESAKPLLETYVNSAAKVDLILYTSILAHLVRCQEEKNERHLMSILSATKHKAHSFMCGLFTGPEHRGQPVLSFVREFFQGIDYELEEGAAKYFVNVLLNYLVLMGQINRARCVWKVAYENKLFPKTIVFDQHIAWSLDVRNLSVGAALIAVVHTLHRFRKRMLYYGIVPRRIKLVTGATLKIVIAQMLSSVESPFEVSKVVLRASGDSVMEWFKKPIVQ

SEQ ID NO: 128003 - protein, 107 aa, Glycine max
  Coding DNA Sequence Number=SeqID_11225
MTSLHHPLQLLNLHQQDQMPRALKLQSLCYIAYSRDRLIRQALKSVVFHLLAKPICWLSERPLSVTLMGQAQGRLWKKMSCTGSLSAPLHLSKCTNSVHQLSKKGTH

SEQ ID NO: 128004 - protein, 296 aa, Glycine max
  Coding DNA Sequence Number=SeqID_11226
  Gene Ontology: Mol. function=DNA binding; Cellular component=nucleus; Biological process=regulation of transcription, DNA-dependent
  Homolog annotation: Hit_ID=Q9LY95; Match level="QueryCoverage=98%, HitCoverage=99%, E-value=2e-55, Identity=44%"; Hit description=MYB40- putative transcription factor
  Pfam annotation: Domain name=Myb_DNA-binding; Domain location=14-61; Score=41.0; E_value=4.2e-09; Accession=PF00249.21; Description=Myb -like DNA-binding domain
  Pfam annotation: Domain name=Myb_DNA-binding; Domain location=67-135; Score=18.7; E_value=0.021; Accession=PF00249.21; Description=Myb-like DNA-binding domain
  Pfam module annotation: Pfam domain module=Myb_DNA-binding::Myb_DNA -binding; Domain location=14-61::67-135
MGRQPCCDKVGLKRGPWTIEEDRKLVNFIINNGIHCWRTVPKLAGLLRCGKSCRLRWINYLRPDLKRGGFTEMEEDQIMQLHSCLGNRGIAVLKGYQCILISSDTMKHIFRWSKIASHFPGRTDNEIKNHWNTKIKKRLKLLGLDPLTLKPAEQKEKSGDDIKNIELQPNTSKGSEQGVENKSLDMHGTREVAKTEGKIEENEVTWDDTTGIFNNYEMLCSQLDLGSWVSQETKSSTSSYCSSSFSLDDSSNHSVGESSYLQENSLQQWVDDLDSILSWDNFNSLEKDFLFLDNRQ

SEQ ID NO: 128005 - protein, 349 aa, Glycine max
  Coding DNA Sequence Number=SeqID_11227
  Gene Ontology: Mol. function=glyceraldehyde-3-phosphate dehydrogenase (phosphorylating) activity; Cellular component=cytoplasm; Biological process=glucose metabolic process
  Homolog annotation: Hit_ID=P25858; Match level="QueryCoverage=98%, HitCoverage=95%, E-value=1e-148, Identity=77%"; Hit description =Glyceraldehyde-3-phosphate dehydrogenase, cytosolic
  Pfam annotation: Domain name=Gp_dh_C; Domain location=149-329; Score =350.8; E_value=2.2e-102; Accession=PF02800.10; Description =Glyceraldehyde 3-phosphate dehydrogen
  Pfam annotation: Domain name=Gp_dh_N; Domain location=1-144; Score =276.0; E_value=7.3e-80; Accession=PF00044.14; Description =Glyceraldehyde 3-phosphate dehydrogen
  Pfam module annotation: Pfam domain module=Gp_dh_C::Gp_dh_N; Domain location=149-329::1-144
FGRIGRLVARVALQRDDVELVAVNDPFITTDYMTYMFKYDTVHGKFKNCEIKIKDSKTLLLGSSPVTVFGIRNPEEIPWGEAGADYVVESTGVFTDKDKAAAHLKGGAKKVIISAPSKDAPMFVVGVNEKEYKSDITVVSNASCTTNCLAPLAKVIHDKFGILEGLMSTVHSMTATQKTVDGPSMKDWRGGRAASCNIIPSSTGAAKAVGKVLPSLNNKLTGMSFRVPTVDVSVVDLTVRLEKGASYDEIKAAVKEASEGSMKGILGYTEDDVVSTDFVGDNSMSFSINKALVWCSLPCDPLYAGRSSIFDAKAGISLNNNFVKLVSWYDNEWGYSTRVVDLIRHMASV

SEQ ID NO: 128006 - protein, 93 aa, Glycine max
  Coding DNA Sequence Number=SeqID_11228
MFSSNKRWWRLHAYSFRGTRIPKGKGYNVKGISLSSNMISKFPTERKRLQCERYFSQLKHDIQIPNGENTKNWAANIVLKQRGFWEKREETKL

SEQ ID NO: 128007 - protein, 177 aa, Glycine max
  Coding DNA Sequence Number=SeqID_11229
  Gene Ontology: Mol. function=carboxylesterase activity; Biological process=metabolic process
  Homolog annotation: Hit_ID=Q0ZPV1; Match level="QueryCoverage=58%, HitCoverage=25%, E-value=8e-49, Identity=87%"; Hit description=CXE carboxylesterase
WKLFLPEKEFSLDHPAANPLAPDHSPPLKKMPPTLTVVADHDWMRDRAIAYSEELRKVNVDAPVYEYKDAVHEFATLDVLLKSPQAQVCAEDIAIWVKKYISLRGPAVLLVDWFHVPSTSTTTAGGGGDSNNAHVDDDDDGQDDDYSDGSNSNNDDHVNNNSNHDSNNNNIHVDSDD

SEQ ID NO: 128008 - protein, 149 aa, Glycine max
  Coding DNA Sequence Number=SeqID_11230
MRVELETKDEVQEMAKIKQKDTKLQASRRYNTKVQPRAFQPSDLVLRVQGEARKDPQAGKLGLNREGPFRAIASCSLSASAPDRASSIKCVKRDVFTMNRCLMLEGYSLLNNAHAFYDVSLSYQVQESYQFPLLNDPENTCICVIKGKT

SEQ ID NO: 128009 - protein, 40 aa, Glycine max
  Coding DNA Sequence Number=SeqID_11231
  Homolog annotation: Hit_ID=Q2QUR1; Match level="QueryCoverage=92%, HitCoverage=8%, E-value=7e-12, Identity=91%"; Hit description =Esterase, putative, expressed
MVDTRCVLLGVSCGANIADHVARKAVEAGKLLDPVKVVAQ

SEQ ID NO: 128010 - protein, 119 aa, Glycine max
  Coding DNA Sequence Number=SeqID_11232
  Gene Ontology: Mol. function=RNA-directed DNA polymerase activity; Biological process=RNA-dependent DNA replication
MGEERHKAVKEEVDKLLHANFIREVKFSTLLANGVPHIHIPSAQHRQVGRWSVQILGAKLHVRLLRIQPDQNASFSRRRKIEFITEDANFCYKFMPFGLKIAGATYQRLMDRVFKQQIG

SEQ ID NO: 128011 - protein, 322 aa, Glycine max
  Coding DNA Sequence Number=SeqID_11233
  Gene Ontology: Mol. function=RNA-directed DNA polymerase activity; Biological process=RNA-dependent DNA replication
MVSTRSGLRPRGSCQTSSGDEKSTHTLPEHTQGELHPRCTGSTIDDLSLSHIHRPTSQTVHRHPFVDHIMEANIPLGWKPLNLEQYDGTTDPTESIDNFDTLVERFSSQYATGKSHHMTSIALASLRQVDEESRKKFMDRFGRTVVQIQNLNLEIVYAKNHPIAWTNYANEPRATSKWKKCPDSGIKSAKSDRSATSAKQTPRPTCTSLTKGSIQPGGTHLATLDETSEAEVRCNQVLQRSLPPITFMDRDFKGINFGQGKLSRSFTIRYLRVDTNTSYFALIDRKTLNELGAIVSMPHLTMKFLTLIEEIATAKANQKQAC

SEQ ID NO: 128012 - protein, 44 aa, Glycine max
  Coding DNA Sequence Number=SeqID_11234
MVELVSGMIRWLRDVMFYVPQQRWMNPCASWMILSFGEVIEDFD

SEQ ID NO: 128013 - protein, 186 aa, Glycine max
  Coding DNA Sequence Number=SeqID_11235
  Gene Ontology: Mol. function=hydrolase activity; Biological process =metabolic process
  Homolog annotation: Hit_ID=Q9LK21; Match level="QueryCoverage=99%, HitCoverage=44%, E-value=6e-51, Identity=56%"; Hit description =Arabidopsis thaliana genomic DNA, chromosome 3, TAC clone:K17E12
MPSVAVKLYSVFFKFLLKHRLQNRIQAPPEDSDSFGVTTRPDESVAPANPSFSDGVATKDIHIDPLTSLSIRIFLPDSALEPNSKPSSKPEPGSANPKTASLSRLRRNSYEPAIFLPREEERRNSVGDVGAYRGYAPAPSGEGRRKKLPVVLQFHGGGWVTGSNDSVANDVFCRRIARLCEAVVVA

SEQ ID NO: 128014 - protein, 65 aa, Glycine max
  Coding DNA Sequence Number=SeqID_11236
MTDLVSAEDDAFRLTDSKKVLKVRTTTWVSPRVTASMTELVRVADKSEALAPTYPPMRNSDLRSS

SEQ ID NO: 128015 - protein, 93 aa, Glycine max
  Coding DNA Sequence Number=SeqID_11237
MARSVSASCPYSRDLYGRELKGFLVIIPKVVISLLMVSRVPSGVANCRNLPFGGTATQGSQVRLPRKEYARSRHQRLFEENVGKTRRDVAYEL

SEQ ID NO: 128016 - protein, 56 aa, Glycine max
  Coding DNA Sequence Number=SeqID_11238
MQQGQADILIARFPDPNYGVKMSLSLRFFKGSIRHAMAVAKLEKMQRQDETNKKQA

SEQ ID NO: 128017 - protein, 109 aa, Glycine max
  Coding DNA Sequence Number=SeqID_11239
MSLVVGDMYWSHHGDTLLRVFHSPWVACTGVVMLEEGLTKGGPWVVRALENNSLLVDSSPTSTGIMAFVPYALRLVKSSSQGPEDDFVSCLCLSVSLRMFDRGDQVLDA

SEQ ID NO: 128018 - protein, 931 aa, Glycine max
  Coding DNA Sequence Number=SeqID_11240
  Homolog annotation: Hit_ID=Q5JJM4; Match level="QueryCoverage=19%, HitCoverage=22%, E-value=1e-08, Identity=33%"; Hit description =Peptidylprolyl cis-trans isomerase-like protein
MGTGNSDFGGPIQPPLVEREEVWRFVASLDGELIPVTMIIPPSTSRGARRSDSRDVRFSPHNRRNHSVGSPLSPLVVTGYEWVRDNVLKYRSSIISTVSFTALEHQLKLANPKDFNKITIQACNSDDFPFLRAHVQEVVRVRLKRVLPLQGPFFQDPTRFKSFDEDLSTLVEKVNKAILEQFPASLDAWAILSLPLADDPLAILDDIMSDFAWRPLVKQMGLASGTVPPFMSILLLKKGDIVVAPIPLTPPSLPAQEVFVSPPTVVTMPVSLAIPVVALASTIGTPLLNVGVTATSALERPPLFSSASPVPTLTILASVLPSSSSRPSVSLDYIYTSCDIDLMWSIGYKPKQRTLTGFVSFFDENLIRSIRVQNETNSTKVFLRRSLVILEENGQRHQEALSKVASLEAKISMWRATARTVSRMERPKVANAIVAFAKVIKSNRQLSSKVGDVLAKLLRTRLDVDNMFGRCKDLLKEKFDLVSKVESTAVEKEELAKVFANLKAQLKESESKLEESKLRALKEREVGFFTKDLNLGLFYPFKDVKDGELLDEEEIVVAAEDDGEEQGLRANFDSHLVEGLVDQFGGSKLTKGMPWAFVRMVIKGGPWVFYVSTKIEFRNRKAYQGANLRFVEPLGMQDSLRDELGFDEPLEKRDSPRTDFGFDKPFEKRDLPRMDLGENLGFDEPLKKQDSLRADFRVDLGFDEPLETRDSPRANLGFDKPLEKRDLPRMDLGFDEPFEKVDLGFDEHLEKQDLPRMDLGFDEPFEKWDSPRADLGFDEPLEKRDSPRADLGFDEILEKRPGTRSPSVDLGFDEPMEKQDSSRADLGFDEPSLATILNGPSQLGPRFPTQRSFLASPRTRHTRSPVISPEYTREFLLPLTLGLVESGISTRRARHKGQQPLIEGCPCSYVSSGAMRNSYLRSSLQSEKVCV

SEQ ID NO: 128019 - protein, 133 aa, Glycine max
  Coding DNA Sequence Number=SeqID_11241
MALYRKSHFGAVEARPSELNLNPEVMSSPRQAGARPSKLYVHSPHGERTRGAQAMEVVKSGAQSVCKLLASSTPPSEVEGPLSLECLLDDDFEMPGLFGADQLGEQVCCSVTLPGYEVHLKAIKVLMRVFAVC

SEQ ID NO: 128020 - protein, 47 aa, Glycine max
  Coding DNA Sequence Number=SeqID_11242
MKEPQASSPWSFGVPEKLSKVNESEVTPWVLHKAVMRAGKPSLKESC

SEQ ID NO: 128021 - protein, 100 aa, Glycine max
  Coding DNA Sequence Number=SeqID_11243
MCGIFNSVFYQANGIELTKLSLNHDHNLLFNLYDDAEPLFNAPQSNKPPYKNKTVNHISTKITFLTVKLQVSLLVTTFAIKENVQHGKKEVFNPVMNKII

SEQ ID NO: 128022 - protein, 164 aa, Glycine max
  Coding DNA Sequence Number=SeqID_11244
MASQKRKAPTSASQARYDRSRFTSQEAWDRYSDIVIGRKILAERNVMIYHTEFDEFKYKGFELSADGLPLKILQKNLTTLAQTWSVLSFSNLASTSHTSDITLDRARLGFPALITALCKTQGVTSDSLTFESLSPTINLAYVKKNCWNLDDPSVTFRGPQKTKG

SEQ ID NO: 128023 - protein, 63 aa, Glycine max
  Coding DNA Sequence Number=SeqID_11245
MVVGGGLELSRGVLRLRPYRVLTIGERGHGGECGQGGLHDLVRQTMDNPSTAKDDVYMLLRQG

SEQ ID NO: 128024 - protein, 137 aa, Glycine max
  Coding DNA Sequence Number=SeqID_11246
MKFPTLIEEIVTVKADQKQARQCYAKSLKVAPYPPTREPSRPHLTTGGSSQVMSVNKGSSIRILIVYKASLGGHDGVFDVDSHDDTVNKGPKPIEELAKLQLESKPGKCTQLNRDLTSHEYRRIVDVLHRNIDLFTW

SEQ ID NO: 128025 - protein, 148 aa, Glycine max
  Coding DNA Sequence Number=SeqID_11247
MAIMMEAMMSRKKMMEVNAVVVSATSVITEVDSIPPSGLNQIIHPTSYTVGQGGKELGSMGTPHFVQVQNKHSFLSYGLPPNYTQPNVTHTLDENVNNSTPILIESQQPQSDHAHIPQPMEETHEIPHHNLANFEPCLEYTTEGQAVG

SEQ ID NO: 128026 - protein, 198 aa, Glycine max
  Coding DNA Sequence Number=SeqID_11248
MWRGDNVHSTFSCQSKQKVGGLRNLWSQLFLQQSQGVVESVAGLYQDVHRAALVNEDLRYHEIGDHDGNNHGIVLVDRVDALEVSFGEGGSGGGSFMGTSVLKASSRIMVQLAVRGVYHSYMGPLGRASCILRVEVFDKGVEAVNGPWRESSIPCQCFPFEGRWENVTQNYIVIGVEIFLGEECIQMFIWIGSSIIML

SEQ ID NO: 128027 - protein, 206 aa, Glycine max
  Coding DNA Sequence Number=SeqID_11249
  Gene Ontology: Mol. function=acyltransferase activity; Cellular component=integral to membrane
  Homolog annotation: Hit_ID=Q1SWP9; Match level="QueryCoverage=63%, HitCoverage=29%, E-value=6e-48, Identity=76%"; Hit description =Chalcone and stilbene synthases, N-terminal
  Subcellular localization annotation: CTP_CleavageSite=21; ConfidenceScore=5.37e-01
MSPPPSSLPSPLYPWSNSPTRRSAARTWYTHLNALSSAPLTFVGEKNRGPTNAEKAIGYEHGLVVPEVPILGYVLGTDDDGVGVGVNLKHVFCEVNDVDDDADAAAHAAKVEAFHVTAEHVLVNDHGGEERGGVEEATVDDKDVDVFGVDKGEARRREIVLKKEGWSETKGSSLEEREEWSEGTKGKSLEARGERKKSHIFLSDLV

SEQ ID NO: 128028 - protein, 528 aa, Glycine max
  Coding DNA Sequence Number=SeqID_11250
  Gene Ontology: Mol. function=protein phosphatase type 2A regulator activity; Cellular component=protein phosphatase type 2A complex; Biological process=signal transduction
  Homolog annotation: Hit_ID=Q32SG1; Match level="QueryCoverage=94%, HitCoverage=98%, E-value=0.0, Identity=69%"; Hit description=Protein phosphatase 2A regulatory subunit B'
  Pfam annotation: Domain name=B56; Domain location=102-498; Score =980.5; E_value=6.1e-292; Accession=PF01603.10; Description=Protein phosphatase 2A regulatory B subunit (B56 family)
MAKTEVMLKRAMIKQILNRLPRKPSKSGESREGGAILTPSSTPSTSARSSDAAGYHYANATASPLSGTADSVPGLNHGDRIVQAMNSKLNLNGSFPVMAYEALPSFRDVPNPEKQNLFIRKLQMCCVLFDFTDPTKNIKEKEIKRQTLVELVDYVSSANGKFTDVMMQEIVKMVSINLFRTFISPPRENKVLEAFDVDEEEPSMDPAWPYLQIVYELLLRFVMSTETDAKLAKRYIDHSFVLRLLDLFDSEDPRERDYLKTVLHRVYGKFMVHRPFIRKAINNIFYRFIFETEKHNGIAELLEILGSIINGFALPLKEEHKLFLVRALIPLHKPKCIPMYHQQLSYCITQFVEKDCKLADTVIRGLLKYWPITNSSKEVMFIGELEEVLEATQPAEFQRCMVAERALFLWNNDHIETLIKQNHKIILPIVLPALEHNARNHWNQAVQSLTINVRKIFVDTDPEFYEECMIKVRENEAQEKDMKSKREARWKRLEEMGGMKATTNEAVLVSPRTASHTPSGKASRAQLE

SEQ ID NO: 128029 - protein, 91 aa, Glycine max
  Coding DNA Sequence Number=SeqID_11251
IVPARHPVDLKKANSVLELPALITGLCQFYGVLVTPSKFIRPPINRAFIKKYCAPRQAQGEAPQQPGEGRQRATDPPPPPLEFTSAHPQKG

SEQ ID NO: 128030 - protein, 133 aa, Glycine max
  Coding DNA Sequence Number=SeqID_11252
MRDHGSIGLFFGSSVFGGKFGSECFGFFLFCFCLVRGEKVTGAQDFGRGWKFSSWVELYGELGFWLKAYRTAEHDICRGVGLASGSGIKECVPHYFHDMRATMMIQKFFAKLVMHAPMWTLNHQVLWSCDTRA

SEQ ID NO: 128031 - protein, 76 aa, Glycine max
  Coding DNA Sequence Number=SeqID_11253
MALRKLSAKRSRNDAAAEGTSAAPEFDSHRFRSTEHQQRFEAIKGWSFHRERRVQLRDNEYTDFHEEIAHRRWTSL

SEQ ID NO: 128032 - protein, 103 aa, Glycine max
  Coding DNA Sequence Number=SeqID_11254
MGGYSSDKDSVKDTVCKKYDISKEKWTHFCQSRRDPSWEDVQKKAQVIQKQNTAPQVLSRGGYEYLENKLMEEKKKKQLEKVAQSGSTDTMIDPSSPIRRHVK

SEQ ID NO: 128033 - protein, 81 aa, Glycine max
  Coding DNA Sequence Number=SeqID_11255
  Homolog annotation: Hit_ID=Q86AI8; Match level="QueryCoverage=96%, HitCoverage=25%, E-value=7e-09, Identity=36%"; Hit description =Similar to Homo sapiens (Human). Mucin 2
  Subcellular localization annotation: CTP_CleavageSite=58; ConfidenceScore=5.75e-01
MCSPLKARTSSPLKVRACNPLKVRTCSPLKVRACSPLMARTCRPLKVRTCNPLKVRACSSLKVRACNPLKERACSPLMEID

SEQ ID NO: 128034 - protein, 43 aa, Glycine max
  Coding DNA Sequence Number=SeqID_11256
MELWVGFYRGKVMFWLAMTSYSNRLKQQEITKQLRQACDLQEN

SEQ ID NO: 128035 - protein, 171 aa, Glycine max
  Coding DNA Sequence Number=SeqID_11257
MAINSFIAQKKAKPLKRKQGECSQMKGTFYPELVKVFCTCAKVDMEGNLYSTANGIEMVIGAAVWKAIAGIDMGRVCKFEESANGYNKMARYRDFTKASNEITERHLKKLGMAYVDHEWIMIGEQLTVANVDQMEEEAEEEAQQEPTHQWNPSESIMIQRMDAILHLHQEH

SEQ ID NO: 128036 - protein, 109 aa, Glycine max
  Coding DNA Sequence Number=SeqID_11258
MLKSFKQQEQMSVLELYIEKDVAGGSMFHSANSLTSCGNYLSNDETQPTTNMSNLHIDEDDDDDDDDYLVSNSYIEESLDEDDSVDGVSDTDDEVTNIPQPVRIVHPAE

SEQ ID NO: 128037 - protein, 60 aa, Glycine max
  Coding DNA Sequence Number=SeqID_11259
MAAHLEELRLTLEVIGSPKRAGSFSLKSSESPSEPEASLDQNNERSFVLCGKWCQTMQFG

SEQ ID NO: 128038 - protein, 122 aa, Glycine max
  Coding DNA Sequence Number=SeqID_11260
MASTDTSIIARSQIFPYILTFTLICDFDDEKECKVSRDIILFDNNIVAVGTTSDNVSSIEENIDEASLLSSESESQHDHRSTSTPYDHTDPSIGPNTSMCVQRCRCHVCIERTNISNYKCNR

SEQ ID NO: 128039 - protein, 123 aa, Glycine max
  Coding DNA Sequence Number=SeqID_11261
MEDCTRGSALVNHEAWIQTLSWRMHERKRTSWGSEKKARMEDCTRGSSLVNHEAWLQTLWWRMHERNAIHGAPNKRRGWSIALEGPHLSIIKHGSKLFGGGCMNENAIHGAPRKKKGEDGGLH

SEQ ID NO: 128040 - protein, 414 aa, Glycine max
  Coding DNA Sequence Number=SeqID_11262
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=100%, E-value=3e-42, Identity=29%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=38; ConfidenceScore=5.11e-01
MTGPLNESISCFSHKGGPLGTSTLAFRALHVLAFRGLQASVFRGLHVLALRGLHALAFRGLHVLDFKGLHILTFKELHVLAFRGLRVLAFRGLHILAIRGLHAFAFRGQHVLTFIGLHGYTTSPSEDYASSPSEGYTPSPSMGYMHSPSEDYTSSPSEDYTSSPSEGCTPSPSTGYKHSPSEDYMSFRGLHALTLPSENCTSSPLEDYTSLPSEDCTSSPSEDYKSSPSEDYKSSPSEDCTSTPSEDYMSSPSEDCTSSPSEGYTPSASEDYTSSPSEGCMPSHSVGYTSLTFRGLRALAFRGLQAFAFRGLHALTFRGLHALTFRGLHVLTFRGLHALAFIGLHALTFRGLRVLAFRGLHVLSFRGLHALAFRGLHVLAFRGLYALTFRGLHVLTFRGLHALAFTGLHVLAFK

SEQ ID NO: 128041 - protein, 161 aa, Glycine max
  Coding DNA Sequence Number=SeqID_11263
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q1T009; Match level="QueryCoverage=99%, HitCoverage=57%, E-value=2e-80, Identity=90%"; Hit description =Protein phosphatase 2C
  Pfam annotation: Domain name=PP2C; Domain location=1-121; Score= -35.8; E_value=0.00072; Accession=PF00481.12; Description=Protein phosphatase 2C
MSKDQKPDCISERLRIEKLGGVVYDGYLNGQLSISRALGDWHMKGSKGSACPLSAEPKLQEINLTEDDEFLIMGCHDLWDVMSNQCAATMARKELMIHNDPQRCSRELVREALKRNSCDNLTVIVICFSPDPPSRIETPPSRVRRSISAEGLNLLKDVLDC

SEQ ID NO: 128042 - protein, 48 aa, Glycine max
  Coding DNA Sequence Number=SeqID_11264
MGGSNSNQAHLGLPGSSPEGTGTNLASLGELDFPPFFVRSSSFFGLQP

SEQ ID NO: 128043 - protein, 122 aa, Glycine max
  Coding DNA Sequence Number=SeqID_11265
TIQDLLVQQGLDQALEDERPASINEIKWTKIQWRVVSMIRLVLTPEIKTCVEGDNTEGLTGEVREYLYVKVANQSSLFEDGVALLFLASLPRSFKALIQTLLVRRSTLKLDEVTTALEKMRE

SEQ ID NO: 128044 - protein, 77 aa, Glycine max
  Coding DNA Sequence Number=SeqID_11266
MAIHDDCRHAAQRRNDDDVTLNNNLRCNSKLFEAGEQLGRTKYQLDYSNCPTTPVNSHAEAGSYPCHALVGRKLHLI

SEQ ID NO: 128045 - protein, 47 aa, Glycine max
  Coding DNA Sequence Number=SeqID_11267
MASVETSAMARSQILPGIIPFEEHIAAVGATSNNMLSKRKALDEGSL

SEQ ID NO: 128046 - protein, 83 aa, Glycine max
  Coding DNA Sequence Number=SeqID_11268
MTKARQNGVQKENEGGACHPARPGELGCFLQKAPASGELPARPNIMSGEGEILIARRQWNEGFDLFSFPLMSVNLIRATRGKA

SEQ ID NO: 128047 - protein, 62 aa, Glycine max
  Coding DNA Sequence Number=SeqID_11269
MTRVMSKMTATTTKSISLKPLGRDSTVRRYLAEEIPISSDNGIGKHAPKKAEWRAQKPAMAI

SEQ ID NO: 128048 - protein, 127 aa, Glycine max
  Coding DNA Sequence Number=SeqID_11270
  Homolog annotation: Hit_ID=Q5ZBZ3; Match level="QueryCoverage=84%, HitCoverage=16%, E-value=9e-17, Identity=41%"; Hit description =Putative dymeclin
MAQRLTDGYIFWFFPFLHSANIVLFPFSYLINSSSEGSRNPIADSSLQVLLVLIHYHKCLVSEGYSVLKNQVSASSDSLPKENTYFSNNPYCRALERATDCEYLEGNAHSDQLVKLPFAPLFDTLGM

SEQ ID NO: 128049 - protein, 405 aa, Glycine max
  Coding DNA Sequence Number=SeqID_11271
  Gene Ontology: Mol. function=transporter activity; Cellular component= membrane; Biological process=oligopeptide transport
  Homolog annotation: Hit_ID=Q7XAC3; Match level="QueryCoverage=48%, HitCoverage=40%, E-value=2e-66, Identity=61%"; Hit description =Peptide transporter 1
  Pfam annotation: Domain name=PPR; Domain location=60-94; Score=42.6; E_value=1.4e-09; Accession=PF01535.11; Description=PPR repeat
  Pfam annotation: Domain name=PPR; Domain location=95-129; Score=49.2; E_value=1.4e-11; Accession=PF01535.11; Description=PPR repeat
  Pfam annotation: Domain name=PTR2; Domain location=92-376; Score= -51.3; E_value=0.0005; Accession=PF00854.12; Description=POT family
  Pfam module annotation: Pfam domain module=PPR::PPR::PTR2; Domain location=60-94::95-129::92-376
DMKRRGIKPDVITFTVLLDGSLKEYSGKRFSPHGKRKTTPLYVSTILRDMEQMKINPDVVCYTVLMDGHMKTDNFQQAVSLFDKMIESGLEPDTVTYTALVSGLCNRGHVEKAVTLLNEMSSKGMTPDVHIISALKRGIIKARKDDEGSEQFTEDGSVNFRGEPILKKDTRTAAIAAERPPSATGTSLAEQFRVAAGAAAIAAARVLERCLDRVAIVSDYESKSGDYSNPWRLCTMTQVEELKILICVFPIWATGIIFAAAYAQMSTLIIVSIIRTFTGKERGLSMLQRMGIRLFISVLCMLSAAVVEIMHLQLTKELDLGYKHVAVPLSVLQQIPQYFFLGAAVVFTFVGQLEFLYDQSPDTMKTLGTAMTLLNFSLGNYLSSFILTMVTSPHKVESLVGFLIT

SEQ ID NO: 128050 - protein, 342 aa, Glycine max
  Coding DNA Sequence Number=SeqID_11272
  Gene Ontology: Mol. function=protein serine/threonine kinase activity; Cellular component=mitochondrion; Biological process =protein amino acid phosphorylation
  Homolog annotation: Hit_ID=Q1SQR9; Match level="QueryCoverage=99%, HitCoverage=86%, E-value=1e-126, Identity=29%"; Hit description =Tetratricopeptide-like helical
  Pfam annotation: Domain name=PPR; Domain location=116-150; Score =14.2; E_value=0.15; Accession=PF01535.11; Description=PPR repeat
  Pfam annotation: Domain name=PPR; Domain location=151-185; Score =40.3; E_value=6.4e-09; Accession=PF01535.11; Description=PPR repeat
  Pfam annotation: Domain name=PPR; Domain location=186-220; Score =49.0; E_value=1.6e-11; Accession=PF01535.11; Description=PPR repeat
  Pfam annotation: Domain name=PPR; Domain location=221-255; Score =35.5; E_value=1.9e-07; Accession=PF01535.11; Description=PPR repeat
  Pfam annotation: Domain name=PPR; Domain location=287-321; Score =17.0; E_value=0.069; Accession=PF01535.11; Description=PPR repeat
  Pfam annotation: Domain name=PPR; Domain location=46-80; Score=44.6; E_value=3.4e-10; Accession=PF01535.11; Description=PPR repeat
  Pfam annotation: Domain name=PPR; Domain location=81-115; Score=39.0; E_value=1.7e-08; Accession=PF01535.11; Description=PPR repeat
  Pfam module annotation: Pfam domain module=PPR::PPR::PPR::PPR::PPR::PP R::PPR; Domain location=116-150::151-185::186-220::221-255::287 -321::46-80::81-115
MEKVGVIPHSYCFAAYIEGLCNNHRSDLGFEVLQAFRKGNAPLEVYAYTAVVRGFCNEMKLDEALGVFDDMERQGVVPDVYVYSSLIHGYCKSHNLLRALALHDEMISRGVKTNCVVVSYILHCLGEMGMTLEVVDQFKELKESGMFLDGVAYNIVFDALCMLGKVEDAVEMVEEMKSKRLGLDVKHYTTLINGYCLQGDLVTAFNMFKEMKEKGLKPDIVTYNVLAAGLSRNGHARETVKLLDFMESQGMKPNSTTHKMIIEGLCSGGKVLEAEAYFNSLEDKNIEIYSAMLNGYCETDLVKKSYEVFLKLLNQGDMAKEASCFKLLSTLCMTGDIAKAVK

SEQ ID NO: 128051 - protein, 247 aa, Glycine max
  Coding DNA Sequence Number=SeqID_11273
  Gene Ontology: Mol. function=transporter activity; Cellular component= integral to membrane; Biological process=transport
  Homolog annotation: Hit_ID=P49173; Match level="QueryCoverage=96%, HitCoverage=94%, E-value=1e-77, Identity=57%"; Hit description =Probable aquaporin NIP-type
  Pfam annotation: Domain name=MIP; Domain location=17-218; Score =198.7; E_value=1.3e-56; Accession=PF00230.10; Description=Major intrinsic protein
MEENGGNIHADSTFCGSPAVVQVIQKVIAELIGTYFLIFAGCCSVIINNAEETKGRITFPGICLVWGFSVTILVYSLAHVSGAHFNPAVPLYFIAQVLGSFLASGTLYLLFEVNEKTYFGTIPSGSYIQSLVFEILTSFLLMFVVCAVSTDNRAIGKLGGIAVGMTIIVNVFIAGPISGASMNPARSLGPALVMWVYNGIWIYVVGPFVGAILGATCYNLIRYTDKPLREIGASSKIFKTSACTSAT

SEQ ID NO: 128052 - protein, 124 aa, Glycine max
  Coding DNA Sequence Number=SeqID_11274
LEECFEEVKEGKGKRRVVVVDEVPEREDFDDGGVGGDGMGETSVVEGLENVEGGERRGRCERGVGVGECGRGKWVPKDAQGGILFVNGFEGKLESAKPHEHGEKNNMRWWSWRLLHPAKFEFCY

SEQ ID NO: 128053 - protein, 50 aa, Glycine max
  Coding DNA Sequence Number=SeqID_11275
MRPRRYRIATVINFYIVLRSIFFVRHPAKGSSGEGRRPKWRRIKPPRGEG

SEQ ID NO: 128054 - protein, 488 aa, Glycine max
  Coding DNA Sequence Number=SeqID_11276
  Gene Ontology: Mol. function=chitin binding; Cellular component =extracellular region; Biological process=chitin metabolic process
  Homolog annotation: Hit_ID=UPI00006A17C7; Match level="QueryCoverage =99%, HitCoverage=99%, E-value=7e-30, Identity=28%"; Hit description =UPI00006A17C7 related cluster
RATCPYLQRTARRRLQRTTRPCLQRTACPRLQKATRPCCHRIARPRLLRTTCLHLQRTVRPRLQRTAFLAFIGLHTLAFKGLHTLAFKGLHALAFRGLHTAACPCPQRASCPRLLKAARPRHRRATRPRLRRATRLRLRRAAHPHFPRAARPCLQRIARPRLQRATCPCLQRVASPRLEGYMPSLSEGYTPSQSEGYTPSPSEGYMPSPLEGITPLPLEDWTSLPSVDCKSLPSKDCTSSNSKGYTSSPSEDCTSSPSEGNTPSSSEDNTSSSLKGCTSSPSEGCMPSPSEGRTPSPSEGRTSSPSEGHTSWPSEGRMSSPSEGRTSSLSEGRTPSPSEGCTPLPSKGCTSSPFKGGTSLLLALRGLHILTFRGLHILAFRGLHVLDFKGLHALTFRGLHALAYRKLHALAFRGLHVVAFRWLQAGTFRGLNILAFRGPHVLTFRGLHALPFGGVHILTFREPHIFAFRGLHVLALRGFHALAFMGLH

SEQ ID NO: 128055 - protein, 91 aa, Glycine max
  Coding DNA Sequence Number=SeqID_11277
MGHATLPPLSCYSCLNVRPPSARKWPRGNLPQRDPGRIKWPKELVPLLSMIVTALGALNTSSASRPSRDGHFSGSDTSISGTMSIPISRRR

SEQ ID NO: 128056 - protein, 155 aa, Glycine max
  Coding DNA Sequence Number=SeqID_11278
  Homolog annotation: Hit_ID=Q9AVH2; Match level="QueryCoverage=19%, HitCoverage=10%, E-value=3e-10, Identity=96%"; Hit description =Putative senescence-associated protein
MTEGCDEGFCLANLPGDAFSLWGNFFEAKKQMMADAKFAGLLGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFNQAR

SEQ ID NO: 128057 - protein, 146 aa, Glycine max
  Coding DNA Sequence Number=SeqID_11279
MEYEKIHASPNDCVEEMSSKIILMMPKNQESSKFQRIKSQASFKNQDQDLRFKNNQDQDSSKASRLKIQESREDSIKIKFLNVLIFKFKQEESHLLMTVATYPSVGGRRETHGCVFQERNTRGVATNVYLRKTLEKLEKTWSTNFK

SEQ ID NO: 128058 - protein, 155 aa, Glycine max
  Coding DNA Sequence Number=SeqID_11280
  Gene Ontology: Mol. function=nucleic acid binding; Cellular component= chromatin; Biological process=DNA integration
MDENGKVIRNKARLVAKGYSQQQGFETKTFPQHVFKLNKALYGLKQAPRDWYEKLMYTEFEMSMMGELKFFLGLQIKQTPQGIYIHQTKYVKELLKKFNMSDAKEMKTLMNPTTYLGLDEESTKVDGTQYKAMVVLTHWQVHQIVPSSKVKWKSE

SEQ ID NO: 128059 - protein, 107 aa, Glycine max
  Coding DNA Sequence Number=SeqID_11281
MDTRITQLEEDELNCHHQKGGECRSKDFDFGVLMMPYDHDVLMSYGNTLLKINSRQQSENTRYNIKKMSSILGREFQIEIAKGLAKKFKLKSLFQEIYSLVIDYQKM

SEQ ID NO: 128060 - protein, 50 aa, Glycine max
  Coding DNA Sequence Number=SeqID_11282
MQIEDLKMLAQKSTLSAKSQMEKSDHEGAVSTRLPPYSLSTAITLSAKVA

SEQ ID NO: 128061 - protein, 132 aa, Glycine max
  Coding DNA Sequence Number=SeqID_11283
  Subcellular localization annotation: CTP_CleavageSite=49; ConfidenceScore=5.25e-01
MGPKSTLRLMGTLGPSLASLAQSFWSLLSNALGGHVEFVNKKRISSKVLAMNVMLSYNTIFKDTRCLGEVNTYQVGWEENYDSHVTRALYRENIDKAGDQKTIIYNLMCEKAKIWANILNKVFSIKQVPKQP

SEQ ID NO: 128062 - protein, 87 aa, Glycine max
  Coding DNA Sequence Number=SeqID_11284
MARKDKYGHLLPLSKTQCLHAFMGFTAWTSTSGQLDGFATFQKEMSRKFKVGENGLFWDILLPLGPPGPIRRLRVAEGKALGPPRQA

SEQ ID NO: 128063 - protein, 241 aa, Glycine max
  Coding DNA Sequence Number=SeqID_11285
  Gene Ontology: Mol. function=calcium ion binding; Cellular component =membrane; Biological process=homophilic cell adhesion
  Homolog annotation: Hit_ID=Q2N2B2; Match level="QueryCoverage=54%, HitCoverage=30%, E-value=2e-09, Identity=37%"; Hit description=RPGR ORF15 isoform
MRTLSPMKDKDFEPSKGEDFESSEGKEFESSKARTLRPIKARTLSPLKARTLSPQMARTFSPLKARTLSPLKDFESYEGEDFESCEGENFESSNGEDFKPSKGEDFEPCKGENFESFDGEDFESSEGDNFESSNGEGFKPSKGEDFEPFEGMKFESSDGEDFEPSKGEDFESSEGKEFKSSKARTLRPMKARTLSPLKVRTLSPQMARTLSPLKARTLSPLKVRTLSPLMVRTLSPLRQGL

SEQ ID NO: 128064 - protein, 177 aa, Glycine max
  Coding DNA Sequence Number=SeqID_11286
  Gene Ontology: Mol. function=peroxidase activity
  Homolog annotation: Hit_ID=Q0HEF1; Match level="QueryCoverage=99%, HitCoverage=98%, E-value=3e-51, Identity=56%"; Hit description =Alkylhydroperoxidase like protein, AhpD family
  Pfam annotation: Domain name=CMD; Domain location=41-124; Score=57.6; E_value=4.1e-14; Accession=PF02627.10; Description=Carboxymuconolacton e decarboxylase family
MARIQTINRETASAEVNATLDAVKAKLGKVPNLIATLAQAPVALNAYLSLSEAASKGRLSAKQRESLALAIGQANSCQYCLSAHSLIAKGAGLNSEAIQSARQASAEDALTDALLKLAVKIVQQRGLLSDEDFAEAYLAGVDDGLVLEVITSVALNTLTNYTNHIAQTDIDFPVVTL

SEQ ID NO: 128065 - protein, 253 aa, Glycine max
  Coding DNA Sequence Number=SeqID_11287
  Gene Ontology: Mol. function=epoxide hydrolase activity; Cellular component=mitochondrion; Biological process=aromatic compound metabolic process
  Homolog annotation: Hit_ID=Q3JAB5; Match level="QueryCoverage=97%, HitCoverage=94%, E-value=1e-59, Identity=46%"; Hit description =Alpha/beta hydrolase fold hydrolases or acyltransferases
  Pfam annotation: Domain name=Abhydrolase_1; Domain location=42-250; Score=60.2; E_value=6.6e-15; Accession=PF00561.10; Description =alphabeta hydrolase fold
  Pfam annotation: Domain name=PGAP1; Domain location=12-184; Score= -34.1; E_value=2.2e-06; Accession=PF07819.3; Description=PGAP1-like protein
  Pfam annotation: Domain name=Thioesterase; Domain location=16-252; Score=-21.9; E_value=0.0013; Accession=PF00975.10; Description =Thioesterase domain
  Pfam module annotation: Pfam domain module=Abhydrolase_1::PGAP1::Thioe sterase; Domain location=42-250::12-184::16-252
MQLHYQVHAQNQGEGPPLVLLHGLFGSADNWGSIAKHFSQHYQVISVDLRNHGRSPHSASQTYPEMADDLSALCDALGLAQIHLLGHSLGGKVAMQFATQYPQKVRKLIIVDMAMRAYQDRYTQLMDHMLAVNLSQMASRSEVDKALADAIPNVRVRQFLLTNLVNHEGQLQWRINLPALKANYATLIAAVAVHFDPPSLFIRGERSDYVQDSDITELQQHFVQSEFVTLPTDHWVHAEQPQLFIQAVEDFLS

SEQ ID NO: 128066 - protein, 82 aa, Glycine max
  Coding DNA Sequence Number=SeqID_11288
MECSICGVKIKSVGPVERAVARTNVDAKGTNGIGAAAEEGEALEDGGASDLLPFALRGPLKVTERTQSLMGQGIRVDSPGFT

SEQ ID NO: 128067 - protein, 47 aa, Glycine max
  Coding DNA Sequence Number=SeqID_11289
MLRLAPPSHLGRILLHAKCAEASLSGGCALSPIAKLSSTVTCLHFMT

SEQ ID NO: 128068 - protein, 632 aa, Glycine max
  Coding DNA Sequence Number=SeqID_11290
  Gene Ontology: Mol. function=RNA-directed DNA polymerase activity; Cellular component=chromatin; Biological process=chromatin assembly or disassembly
  Pfam annotation: Domain name=RnaseH; Domain location=272-391; Score= -31.9; E_value=0.054; Accession=PF00075.14; Description=RNase H
  Pfam annotation: Domain name=rve; Domain location=525-632; Score=8.5; E_value=0.0012; Accession=PF00665.16; Description=Integrase core domain
  Pfam annotation: Domain name=zf-H2C2; Domain location=466-507; Score =8.4; E_value=0.028; Accession=PF09337.1; Description=His(2)-Cys(2) zinc finger
  Pfam module annotation: Pfam domain module=RVT_1::RnaseH::rve::zf -H2C2; Domain location=12-181::272-391::525-632::466-507
MLATGVIQPSHSPFSSRILLVKKKDGTWRCCVDYRALNAVTVKDRFPMPTIDELLDDLGSASWFSKLDLRQGFHQIRMAEEDAHKTAFRTHQGHYEFLVMPFGLCNAPSTFQSAMNDALQPFLRRFVAVFFDDILVYSPDLSSHVSHLEAVLSILAERAFLLKQSKCSFAQRKLNYLGHIISSQGVAPDPDKITTMLEWPLPTCPTSLRGFLGLTGFYRKFVKGYAAIAAPLNSLLRKDNFSWSPEALQAFRQLQQAMTTALVLANPNFLIPFVLETDTSGTSMGAVLLQEGHLIAYYSKALCPRLQRASAYVRELHAITAAVRKWRHYLLGHSFIILTDHKSLKDLMSQTIQTPEQQTYLSKLLGFDYTIKYKPGPANVVADALSRIPPSEATCLTLTVPHFLFLQNLRQALLSDPQYAALLQDIRDHPTAHPDVVLHQDLLFQNGRIWLPFPSPFTQVLLEEFHSSPLGGHTGVAKTFHRLSQNFDWPHLREDVRRYVAQCATCQQTKYETKKSAGLLQPLPVPTHVWEDISLDFVTGLPLSQGYTVILVVVDRFSKAAHFGALPTHHTAYKVAVLFLDMVCRHHGFPRSLLSDRDPIFVSNFWRELFRLSGTKLRMSTAYHPQTDGQTE

SEQ ID NO: 128069 - protein, 257 aa, Glycine max
  Coding DNA Sequence Number=SeqID_11291
  Gene Ontology: Mol. function=metal ion binding; Cellular component =endoplasmic reticulum; Biological process=ubiquitin cycle
  Homolog annotation: Hit_ID=Q9FM98; Match level="QueryCoverage=58%, HitCoverage=41%, E-value=5e-23, Identity=38%"; Hit description =Arabidopsis thaliana genomic DNA, chromosome 5, P1 clone:MCD7
  Pfam annotation: Domain name=zf-C3HC4; Domain location=117-157; Score= 47.6; E_value=4.3e-11; Accession=PF00097.15; Description=Zinc finger, C3HC4 type (RING finger)
MASETEVLNIISSVFERFERNMSLFLPFIFGFSDATSGRDSDDPDHETAHTEGSLRQRIILVNPLTQGMVVIDGGLSLEALFRELANGKGGRPPASKESIEALPSVEIGEDNEDLECVVCLEEFGVGGVAKEMPCKHRFHVNCIEKWLGMHGSCPVCRYEMPVEEIDWGKKREEEVGERRSGGGGEVWVSFPFNRSSRRGQDLDQAQAVAGDSNDDDSSSTHGGAAEEIRDLYHFRTERKDERFMKVSLIFWSKLIQ

SEQ ID NO: 128070 - protein, 53 aa, Glycine max
  Coding DNA Sequence Number=SeqID_11292
MAASPDIIFDILNSKEASLCALNGICFAGKHIKLEPGLPKIATWLLLPLIFYF

SEQ ID NO: 128071 - protein, 284 aa, Glycine max
  Coding DNA Sequence Number=SeqID_11293
  Gene Ontology: Mol. function=sequence-specific DNA binding; Cellular component=nucleus; Biological process=regulation of transcription
  Homolog annotation: Hit_ID=Q1SZ89; Match level="QueryCoverage=59%, HitCoverage=58%, E-value=9e-37, Identity=49%"; Hit description=WRKY DNA-binding domain, putative
  Pfam annotation: Domain name=WRKY; Domain location=2-63; Score=100.5; E_value=5.1e-27; Accession=PF03106.6; Description=WRKY DNA -binding domain
MVKDGYQWKKYGQKKVTKDNPSPRAYFECSLAPSCSNLKKVQRSIQDKSILVATYEGKHNHGVFHDLLKPSSSIPETSIMINNLPITNMPNDKDTLNIDLALCNSDQTDIRLCDDVKQQNHRGSKSKIEEYVTPLVKDPDFIMPLAEAVAHSLKSQTYKQEEREKGIDMIVVSEKSAGNDANKCLSNTSDANTEGSIWGYFTCREEAAKAARHTVKKTMKLARGTCDRTWVASEVRRRRRRTPPNTPHTETQGFARLGLFFVGAVANEDGAECGEEEGEEEDHE

SEQ ID NO: 128072 - protein, 55 aa, Glycine max
  Coding DNA Sequence Number=SeqID_11294
MEDVQMTVAEDTPRPSPKIHLKKKALKLKHLKRKDLSFDLDKGVRINVSCERHMT

SEQ ID NO: 128073 - protein, 104 aa, Glycine max
  Coding DNA Sequence Number=SeqID_11295
  Subcellular localization annotation: CTP_CleavageSite=47; ConfidenceScore=5.53e-01
MAQVNVPMLLQFKNSALFGIQPNSFVCFQTQSKSITKKPLVIEARARANTRKESAKIRNRRMQKKEAAHRVGEALVKACVDLNISEISSYDHNGLHSSYGFLPR

SEQ ID NO: 128074 - protein, 650 aa, Glycine max
  Coding DNA Sequence Number=SeqID_11296
  Gene Ontology: Mol. function=galactosyltransferase activity; Cellular component=membrane; Biological process=protein amino acid glycosylation
  Homolog annotation: Hit_ID=Q67X53; Match level="QueryCoverage=99%, HitCoverage=99%, E-value=0.0, Identity=58%"; Hit description =Putative beta-1,3-galactosyltransferase
  Pfam annotation: Domain name=Gal-bind_lectin; Domain location=165 -358; Score=148.1; E_value=2.4e-41; Accession=PF00337.12; Description= Galactoside-binding lectin
  Pfam annotation: Domain name=Galactosyl_T; Domain location=401-607; Score=67.3; E_value=4.9e-17; Accession=PF01762.12; Description =Galactosyltransferase
  Pfam module annotation: Pfam domain module=Gal-bind_lectin::Galactosyl _T; Domain location=165-358::401-607
MKKLYGGVLIASLFTLFMLMILRYGVMKNPIGEGYLTIPVLINGTNPLLWINPTVPDAIKKHPDGHSQVISSDILVSSLFTGSNFSKEEQQALQTWNQLNHLIDNVQGLPNAAEAIKEAASVWNSLISSIEEQKQGHGNDSSRAKEKQCPHFLNNMNSTELGNSSYKLQLPCGLTQGSSITIIGIPNGLLGNFRIDLTGEPLPGEPDPPIVLHYNVRLHGDKITEDPVIVQNSWTQAHDWGEEDRCPSPTPEKFDKVDDLEQCNKIVGKNISQRHPAGMHSHTSRQSSTMDEQSVNRKYFPFKQGYPFVATLRVGSEGIQMTVDGKHITSFAFRETLEPWLVSEIKISGDLKLISILASGLPTSEDSEHIIDLESLKSSPISAQTPLDLFIGVFSTANNFKRRMAVRRTWMQYNAVRSNTTAVRFFVGLHKSTVVNEELWREARTYGDVQLMPFVDYYSLITWKSLAICIFGTQVSAKFVMKTDDDAFVRVDEVLDSLHRINADHGLLYGLINLDSRPHRNTDSKWYISPEISVESVRLFVQEWSEGTYPPWAHGPGYVVSHDIARTVSKKFRENHLKMFKLEDVAMGIWIADMKKEGLEVRYENEVRVYPEGCKDGYVVAHYQGPREMLCLWQKLQVDKRAKCCGDSRK

SEQ ID NO: 128075 - protein, 106 aa, Glycine max
  Coding DNA Sequence Number=SeqID_11297
MDQVWGWLSCLQGLCQQKSEGVDRPQWSTFSDVNYSGSLSSTFGSKYTCSIMDIPFFFNFFLFMSKFLIQKKFVMKEKALATEGEKENLMTDYVLRDWRGDAGWTS

SEQ ID NO: 128076 - protein, 150 aa, Glycine max
  Coding DNA Sequence Number=SeqID_11298
  Homolog annotation: Hit_ID=Q10LS9; Match level="QueryCoverage=27%, HitCoverage=3%, E-value=7e-09, Identity=63%"; Hit description =Insulinase containing protein, expressed
MRKDIDRPMAREECCIVGSAHPALLDYLEVAIKRQGSASESEDDNERNDVVEEETDDDDNAFFDTHDWYNSSYKWTNSLQLPFRLRPSKNCCLGCKIDLIHLLREDTPPEWIFKEIQNIGNIDFRFVEEQPPHDYSVELAVLVPISVEND

SEQ ID NO: 128077 - protein, 82 aa, Glycine max
  Coding DNA Sequence Number=SeqID_11299
  Subcellular localization annotation: CTP_CleavageSite=36; ConfidenceScore=5.21e-01
VRACSPLKGWTYSPLKMRVRACSPTKARACCPQKVRACSPLKYPRVARACIPLKVRTCSPLKERVLVPKGPPDAILSHKGIG

SEQ ID NO: 128078 - protein, 56 aa, Glycine max
  Coding DNA Sequence Number=SeqID_11300
LDKRKAQLGGSLVSFKFPVIITGDGLRPRLWSEMIGQATLPLFPCYWYPKVRLPSA

SEQ ID NO: 128079 - protein, 113 aa, Glycine max
  Coding DNA Sequence Number=SeqID_11301
  Gene Ontology: Mol. function=actin binding; Cellular component=F -actin capping protein complex; Biological process=actin cytoskeleton organization and biogenesis
  Homolog annotation: Hit_ID=Q9M9G7; Match level="QueryCoverage=70%, HitCoverage=50%, E-value=2e-25, Identity=50%"; Hit description =Probable F-actin capping protein subunit beta
  Pfam annotation: Domain name=F_actin_cap_B; Domain location=2-112; Score=-144.0; E_value=0.0096; Accession=PF01115.8; Description=F -actin capping protein, beta subunit
MMLARSLPQHTSSLRTSLSLSATLTHHTYLSLKYYEGGISSVYMWEDDNEDGSKTGQGRRGYLEEGAWDAIHVIEISMKLSVADGHLCNMGRMIEEMESKLRNSLDQVIVSKE

SEQ ID NO: 128080 - protein, 138 aa, Glycine max
  Coding DNA Sequence Number=SeqID_11302
MGVVKYMTIDELKRPSIPSEMLKFFNHFSFPHKRHPTRKISMQQGQTYILVATFPDPNYGVKTKKLGTLGKGFERKKEKGITIFQGYTKNKACNTQVFLLSGKEAVLTHYMTYRRLQRSDRGNLSFEPLHQISRRSNG

SEQ ID NO: 128081 - protein, 88 aa, Glycine max
  Coding DNA Sequence Number=SeqID_11303
  Homolog annotation: Hit_ID=Q9AUR4; Match level="QueryCoverage=48%, HitCoverage=34%, E-value=7e-07, Identity=55%"; Hit description =Putative RNA polymerase I subunit
  Pfam annotation: Domain name=TFIIS_C; Domain location=48-86; Score =6.4; E_value=0.025; Accession=PF01096.9; Description=Transcription factor S-II (TFIIS)
MSTEVVKNSWKKRAKESVMISKGEVQLDRAKVFTKSAVLMNLESRVNKKCEKCGHGEAIYYTRLMRSADKGQTTFYTCIGYGHPSQEN

SEQ ID NO: 128082 - protein, 100 aa, Glycine max
  Coding DNA Sequence Number=SeqID_11304
AKRSSCAKRTVWAQRASAVKRSFSALCETRESGRSQESWSRAKARDQLAKQDVCLFPGSAHEWCQAQIHLLALSTRVAISSIRDNAQEAAKRSSCAEKPR

SEQ ID NO: 128083 - protein, 317 aa, Glycine max
  Coding DNA Sequence Number=SeqID_11305
MTTLAQTWSVLSFFNLIPTSHTSDVTLDRAKLIYDIIMKMDMNVGYLISHQISLIAQHDTSRLGFPALITALCKARGVQSNSRSLESLSLTINFAYIKKNCWNLDDPTITFKGPRKAKGKRSEAPSTSAPETPAPSSSTTPLPPILTLVIPPTPTQIPFPAPFSPGPLDFTFTPQMLHSMLQSIHRGQSIIMQSLQGLGLPSIMSIEEFEAQVAWRGDQPSSSRRGGASAAQEPDIEEPPAPTPAPAEEETTPDQTPQPSPAPAHIPEDVAPVAEPEQLIQDSSTTPTLDLNEDQPQEEQDFKFLHSKHFSLFSVIL

SEQ ID NO: 128084 - protein, 128 aa, Glycine max
  Coding DNA Sequence Number=SeqID_11306
  Gene Ontology: Mol. function=protein transporter activity; Cellular component=nuclear pore; Biological process=protein import into nucleus, docking
  Homolog annotation: Hit_ID=Q84NP8; Match level="QueryCoverage=99%, HitCoverage=12%, E-value=7e-47, Identity=72%"; Hit description =Putative Ran binding protein 11-like
  Pfam annotation: Domain name=IBN_N; Domain location=29-104; Score =67.1; E_value=5.6e-17; Accession=PF03810.9; Description=Importin -beta N-terminal domain
MALSASDVAAMYSLLSNSMSADHRLRGPAEDALAQSESRPGFCSCLLEVITAKDLASQTDVRMMATVYFKNSVNRYWRHRRDSSGISNEEKMHLRQKLLMYSREENDQIALMLAVLISKIARIDYPKE

SEQ ID NO: 128085 - protein, 315 aa, Glycine max
  Coding DNA Sequence Number=SeqID_11307
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=7e-25, Identity=27%"; Hit description= UPI00006A17C9 related cluster
GLHVLPFRGLHVLAFRERHVLAFEGLHVVTIIGPHALTFRELQVLAFRGLDVLALMTKGAHLKRATRHHLQRTTRPHLGYSYPYLQRTTRPRLHRATRPRLQRTTRPHIGATCPRIQRTTCPRLRRTTPPRLLRGLHALAFMGLHYLAFVGIHALTFRGPHVLPFIGLHALTFRGLCVLTLRGLYPLTFRGLDPLSFVRLQALTFRGVHIFGFIWLNALCFLGLHALAFRRLHVLGFGGLHVLTFRGLDVFGFRELHVLTIRGLHDLIFRGLHVLVLRGLHALAFVGLHALTFRGLHVLEFIGCTPSPSEDYASS

SEQ ID NO: 128086 - protein, 232 aa, Glycine max
  Coding DNA Sequence Number=SeqID_11308
  Gene Ontology: Mol. function=transition metal ion binding; Cellular component=cytoplasm; Biological process=electron transport
  Pfam annotation: Domain name=Transposase_21; Domain location=96-191; Score=-110.6; E_value=3.6e-05; Accession=PF02992.5; Description =Transposase family tnp2
ADENPRAFSCISCPIFLESLSHGSGDGSPPWKDCISRLPEENMLPKSYYEAKKILCSMGFEYQKIHACPNDCILYRDEFEEIHKCPKCGVSLYKVKDDECSSDESIKKHPRTKPGNDINVYLSPLIEDLKKLWEEGIDVFDENQNETFKLHAMKNACDSVIYMLLNNKGKTKDGLDTRQVLGDIGIRNQLHPRFDGIGGDGTPLPGGDNRLLIDVITAQMQNNSKLEESIAW

SEQ ID NO: 128087 - protein, 455 aa, Glycine max
  Coding DNA Sequence Number=SeqID_11309
MVFPWTTWVKPKEAGGGGHLMDQLINLKSHGVHSFAQGKLMGEHQIDSNSRLRGLESSEEFKERGKQLREKHNPNRKESKALMADKAKEMTSSAHHTKSFRYAVPFGPVYCMHLLLAISLLLAITYPIGCYDTLVLHLESKELRFRLRVIFHSFDQKIWRLLWTNISELKNMLCKILNEEVDSHASQQDKNSMEESGSECREAKASSWTRKMKLPNFDRNIKGGTDLKDSSFECDSDPLQFLKSENKQETKNDEAKLARETMIEKVMEEEVDSSIKREKHKENRVTDVVGTSMVLESWNVNLLGEPLALNFVATMDDNSTMEPRSPPSSPPPPKPPDLSLHEVASGFIVDPPWRDTKEEYPVSVNDSILKDEKEKGGSFGILQRRWKEIEASHMEVQFNQNFLPSRSPPEPPNSTPHAGTAGYSQLSYKKCKCLPAIGENLRRFQCAFPVFKFQP

SEQ ID NO: 128088 - protein, 878 aa, Glycine max
  Coding DNA Sequence Number=SeqID_11310
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q6H7M3; Match level="QueryCoverage=98%, HitCoverage=85%, E-value=0.0, Identity=59%"; Hit description =Putative copper-transporting P-type ATPase
  Pfam annotation: Domain name=E1-E2_ATPase; Domain location=399-639; Score=289.6; E_value=6.1e-84; Accession=PF00122.10; Description=E1 -E2 ATPase
  Pfam annotation: Domain name=HMA; Domain location=121-185; Score =52.8; E_value=1.1e-12; Accession=PF00403.16; Description=Heavy-metal- associated domain
  Pfam annotation: Domain name=HMA; Domain location=196-266; Score =20.7; E_value=0.0054; Accession=PF00403.16; Description=Heavy-metal -associated domain
  Pfam annotation: Domain name=HMA; Domain location=26-111; Score=36.7; E_value=7.9e-08; Accession=PF00403.16; Description=Heavy-metal -associated domain
  Pfam annotation: Domain name=Hydrolase; Domain location=643-876; Score=23.9; E_value=0.00051; Accession=PF00702.16; Description =haloacid dehalogenase-like hydrolase
  Pfam module annotation: Pfam domain module=E1-E2_ATPase::HMA::HMA::HMA ::Hydrolase; Domain location=399-639::121-185::196-266::26-111::643 -876
MEANGIGELKIPLLQTPEDGAVRTVYFQLSDIKCASCVNSVESVVKNLDGVKSIAVSPLDGRAAIKFDPKFVTLEKLLSGETKRNSKLSLDEAKVKQIKESIEESGFRVNELHEQDIAVCRVRIKGMACTSCSESVENALQIVEGVKKAIVGLALEEAKVHFDPNLTNVDKIIEAIDDAGFGADLISSGNDANKVHLKLEGVDSAEDVNAVMSSLELAVGVNHVEMDLSEHKVTVSYDPDITGPRSLIYCVQEEASCGSKKYQATLYSPSGQRERDKVNEIRMYRDQFLFSCLFSVPVFVFAMVLPMLPPYGNWLNYKVHNMLTLGLFLRCILSTPVQFIVGKRFYVGSYHSLKRKSANMDVLVALGTNAAYFYSLYILIKALTSDTFEGQDFFETSSMLISFILLGKYLEIVAKGKTSDALGKLTQLVPDKAYLVAIDTDGNIITETEIDTQLIQKNDIIKIVPGSKIPVDGIVIKGQSYANESMITGEARPVDKSPGDKVISGTINENGCILVKATHVGSDTALSQIVQLVQAAQLAKAPVQKLADHISRVFVPIVVVVALITWLGWFIPGEAGIYPKHWIPKAMDAFELALQFAISVLVVACPCALGLATPTAVMVASGMGASQGVLIKGGDALEKAHKVKIVVFDKTGTLTVGKPEVVSAVLFSEFSMEELCDMTIAVEPLCICKDKAAYNIPPPYLRIAKSLWASSEHPIAKAVAAHAKRLRQKFGSCTEEVPDVDDFEVHMGAGVSGKVGDRTVVVGNRRLMHACNVPICSKVEKYISENEILARTCILVSIDGKIAGAFSVTDPVKPEAKRVISFLHSMGISSIIVTGDNCATATAIANEVGIDEVFAEIDPVGKADKVKDLQSVRNQELK

SEQ ID NO: 128089 - protein, 224 aa, Glycine max
  Coding DNA Sequence Number=SeqID_11311
  Homolog annotation: Hit_ID=Q2R1R7; Match level="QueryCoverage=48%, HitCoverage=6%, E-value=2e-15, Identity=41%"; Hit description=AT hook motif-containing protein, putative
MVGKPPKFAQLHIYDTKNEIENRIGGTRWKNNLDSQLVSKLKEMFDEYNVFAKSFRMAKESYDNFQMENLNLQLISGMKKDGRIYNLLKISNVVAVIIGDASQPINRDIILEKQSGSTISHPSLSLSWLSPRPFPTSRRPRANSKPKRKKGTYVRQDGCATAIVVSANTLCATRCSHDCYNGNNKGSWGEGNRRSYDKFDKAVRCVRLIERSHRGWSWICRETI

SEQ ID NO: 128090 - protein, 168 aa, Glycine max
  Coding DNA Sequence Number=SeqID_11312
  Gene Ontology: Mol. function=protein kinase activity; Biological process=protein amino acid phosphorylation
  Homolog annotation: Hit_ID=Q1SM26; Match level="QueryCoverage=61%, HitCoverage=25%, E-value=2e-24, Identity=53%"; Hit description =Nucleic acid-binding, OB-fold
  Pfam annotation: Domain name=DUF889; Domain location=11-168; Score= -40.9; E_value=1e-08; Accession=PF05970.5; Description=Eukaryotic protein of unknown function (DUF889)
MGVKFLKAVKQRLHAIKQWSPDEIRGYTLIVITQWQNCTFQFVIPVPTLENSTFEFDILITKFVDPIESIVTHTYSNIQYNYNNEDFLKSRAILASDIETIDQINEYVLNIVPGDEKEYLSYDSIDMTDFVESQGYQAITPEFIHSLKTSGLPNHKIKLKTSTPIMLI

SEQ ID NO: 128091 - protein, 130 aa, Glycine max
  Coding DNA Sequence Number=SeqID_11313
  Homolog annotation: Hit_ID=Q5N7G7; Match level="QueryCoverage=37%, HitCoverage=22%, E-value=1e-09, Identity=66%"; Hit description =Prolyl 4-hydroxylase alpha subunit-like
  Pfam annotation: Domain name=DUF584; Domain location=7-128; Score =96.8; E_value=6.7e-26; Accession=PF04520.4; Description=Protein of unknown function, DUF584
MREVYYNFVEVVIYFTRPSLGRMIPRSSNSSSASSSNEYTVLQQSAPVNILDWFDGDGVANYGGGSDEDGEENDESDSKLPPHEFIARRLERSQISSFSVLEGAGRTLKGRDLSKVRNVVLPKIGFLETL

SEQ ID NO: 128092 - protein, 157 aa, Glycine max
  Coding DNA Sequence Number=SeqID_11314
MWVSREWFLADFRWEEKEKSDFRKEDKEKREGKVFERTGPSVGALVPGLIWRVDTCLGVSCKEVDEFVEPPSMDECCLVSSVVTLTSVRIAGMCGAHAILLYMCHSWSGHVTESWCVATHDGPEGHFLLWFLLGGYSLWYLQQGVLFFRKGEGFASY

SEQ ID NO: 128093 - protein, 88 aa, Glycine max
  Coding DNA Sequence Number=SeqID_11315
MTGRDDGDPTLWLCRMWGDALTSPPSLLLFTPPEAEEGRIIVSRTSSDEDMTKSKGKDPLGGPMTRARARKAKHHPFGRPNGGWLDGC

SEQ ID NO: 128094 - protein, 213 aa, Glycine max
  Coding DNA Sequence Number=SeqID_11316
  Gene Ontology: Mol. function=phosphoinositide phospholipase C activity; Biological process=intracellular signaling cascade
  Homolog annotation: Hit_ID=Q9FF41; Match level="QueryCoverage=94%, HitCoverage=40%, E-value=3e-16, Identity=33%"; Hit description =Arabidopsis thaliana genomic DNA, chromosome 5, P1 clone:MXA21
FKHVTVETDRLQKKKGKVDSTVQNLNFKILRAKSKLEPVSAAEEKARFIVMSKNRITIFSTVLLVLAMLRNSGGGHHLRYMEGMFRANGGCGYVKKPDILLNVGPNNEKLKTLTESTMRERALTAQHSSMITISKFEYEYLTNHAASVEEIIDKKVAAVEAWIEALKASVYTKEKMLLRRVSSSEELDKLANKTQEEFIQKLPESHVYKEHQT

SEQ ID NO: 128095 - protein, 102 aa, Glycine max
  Coding DNA Sequence Number=SeqID_11317
MQWRFQSQKRCKDKMKLTRNKRRTMGFVLYRNRKPSWKIPLRLKGSSRCGISMENNDGLWWPMVAMGDGENAWDVRNGFGRKKGEEMTFFLSYTKAKAEMLK

SEQ ID NO: 128096 - protein, 462 aa, Glycine max
  Coding DNA Sequence Number=SeqID_11318
  Gene Ontology: Mol. function=carbamoyl-phosphate synthase activity; Cellular component=chloroplast; Biological process=nitrogen compound metabolic process
  Homolog annotation: Hit_ID=Q1SUP5; Match level="QueryCoverage=98%, HitCoverage=99%, E-value=0.0, Identity=80%"; Hit description =Carbamoyl-phosphate synthase, GATase region
  Pfam annotation: Domain name=CPSase_sm_chain; Domain location=51-198; Score=291.7; E_value=1.4e-84; Accession=PF00988.13; Description =Carbamoyl-phosphate synthase small chain, CPSase domain
  Pfam annotation: Domain name=GATase; Domain location=238-439; Score =211.2; E_value=2.4e-60; Accession=PF00117.18; Description=Glutamine amidotransferase class-I
  Pfam annotation: Domain name=Peptidase_C26; Domain location=237-421; Score=-100.0; E_value=0.0085; Accession=PF07722.3; Description =Peptidase C26
  Pfam module annotation: Pfam domain module=CPSase_sm_chain::GATase::Pe ptidase_C26; Domain location=51-198::238-439::237-421
  Subcellular localization annotation: CTP_CleavageSite=37; ConfidenceScore=5.60e-01
MATKALSFALSLNDLTNNHFSSNTPHTAAKVSVFTVKCSSSGGGERPWKNSDARLVLEDGSIWKAKSFGASGTQVGEVVFNTSLTGYQEILTDPSYAGQFVLMTNPHIGNTGINFDDEESIQCFLAGLVIRSLSISTSNWRCKKDLGDYLAERNIMGIYDVDTRAITRRLRQDGSLIGVLTTDNSRTDEELLHMSKSWDIVGKDLISGVSCKTPHEWVDKTKQQWEFSKVPGETFHVVAYDFGIKHNILRRLASYGCKITVVPCTWPASETLKMKPNGVIFSNGPGDPSAVPYAIETVKNIIGKVPVFGICMGHQLLGQALGGKTFKMKFGHHGGNHPVRNLRSGHVEISAQFQFHVPVVATHGIIGGENEHNKFYNHNYAVDPATLPEGVEVTHINLNDGSCAGLAFPAQQLMSLQYHPEASPGPHDSDYIFREFIELMKQGKNRTKGRLHQLSTAHALDA

SEQ ID NO: 128097 - protein, 264 aa, Glycine max
  Coding DNA Sequence Number=SeqID_11319
  Gene Ontology: Mol. function=zinc ion binding; Cellular component =integral to membrane; Biological process=ubiquitin cycle
  Homolog annotation: Hit_ID=Q1SN88; Match level="QueryCoverage=83%, HitCoverage=90%, E-value=1e-75, Identity=70%"; Hit description=Zinc finger, RING-type; RINGv
  Pfam annotation: Domain name=zf-C3HC4; Domain location=142-186; Score= 28.5; E_value=2.4e-05; Accession=PF00097.15; Description=Zinc finger, C3HC4 type (RING finger)
MYSVASTSLTSPLLHDLENFHYSRRLLLHSPYLNQSAKPPRSSHDSSTETYLGDGNFDANVVMVLSVLLCALICSLGLNSIIRCALRCSNFVVSDSVATNNNNNNPPAARVANTGVKKKALKTFTTVSYSAELNLPSLDSECVICLSEFTSGEKVRILPKCNHGFHIRCIDKWLSSHSSCPKCRQCLIETCQKIVGCSTQQASSSQQHVLAVPETIVTIIAPLEPEVDEWNGMDPSQPYLVKTSQPPTTQSIIVNVVVNDDECI

SEQ ID NO: 128098 - protein, 132 aa, Glycine max
  Coding DNA Sequence Number=SeqID_11320
  Gene Ontology: Mol. function=protein serine/threonine kinase activity; Biological process=protein amino acid phosphorylation
  Homolog annotation: Hit_ID=Q1S7W7; Match level="QueryCoverage=70%, HitCoverage=31%, E-value=7e-28, Identity=70%"; Hit description =Protein kinase
MECEGKLARRVVGVRNHCYLLKSKIGEGSFSAVWRAEQRPPTGDDVAVKQVFLSKLNPRLKACLDCEINFLSSVNHPNIIRLLHFFQCEPNCVMLGLVSKLHSHGIIQRLETRGRDIGVYAFPDIELSSVHF

SEQ ID NO: 128099 - protein, 128 aa, Glycine max
  Coding DNA Sequence Number=SeqID_11321
MKNHYAPHNISLRHFIEHKMHAHSSFPLQIAFKLTILCSEFQNWGRGDRIQHKPDGGGGREASMSSMTCCGVFYRRDEGGGFLREQAVAVRSRCLFVVIGEGKMYVAAKMSAKEKRQRETPRVVAEQG

SEQ ID NO: 128100 - protein, 659 aa, Glycine max
  Coding DNA Sequence Number=SeqID_11322
  Gene Ontology: Mol. function=protein serine/threonine kinase activity; Cellular component=cytoplasm; Biological process=protein amino acid phosphorylation
  Homolog annotation: Hit_ID=Q1SQC9; Match level="QueryCoverage=99%, HitCoverage=96%, E-value=0.0, Identity=69%"; Hit description=Protein kinase
  Pfam annotation: Domain name=Pkinase; Domain location=33-293; Score =189.7; E_value=7e-54; Accession=PF00069.15; Description=Protein kinase domain
  Pfam annotation: Domain name=Pkinase_Tyr; Domain location=33-292; Score=36.8; E_value=9.9e-15; Accession=PF07714.7; Description =Protein tyrosine kinase
  Pfam module annotation: Pfam domain module=Pkinase::Pkinase_Tyr; Domain location=33-293::33-292
MSLMETESSEEGAGLLEPPDPNVLEIDPTNRYMRYNEVIGQGAFKTVYPFYKAFDEIIGLEVAWSQVQIDEVLQTPGGLERLYSEVHLLKSLKHDSIVTFYNSWIDDKHRTLNLITELFTSGSLRKYSKKHKKVDIKAVKGWAKQILMGLNYLHSHNPPIIHRDLKCDNIFINGHRGEVKIGDLGLATLLKQTTAKSVIGTPEFMAPELYDEHYNELADIYSFGMCMLELVTSEYPYSECRNSAQIYKKVSSGIKPAALSKLKDPEVKSFIEKCLVPASQRLSAKELLKDNFLQVNGSLKNRRLPLPDIVLPKYGTFENRCLMSEGPASTRIRSISMDLGDATELPLTTLLYNSVDSIDNALPSPCVEIRRLKEGDIFFLKGEQNDEKSVSLVLRIADQNGRARNIHFIFYINSDTAISVSSEMVEQLELAEQNVKFIAELIDLLLTTLLPDWKPCVAIDHLVSSNGKLTHSSKQKDSELAKYRQSSEDSSQIVAEIVGLSTSPGRPAEVENIDNVICDKFLSHANIGLRRELKTDDLYFEKHRSYASATSDFNDKHFSTVSFMSAKSGFTDFDLPKVNSQCSLASEFGATFDYSSFPCVESNGTMKFSSHPINASCFFQPGDELRIELERIEQQYQDEMEDLLKRKNHDIMETRRRHS

SEQ ID NO: 128101 - protein, 105 aa, Glycine max
  Coding DNA Sequence Number=SeqID_11323
MATASLFSNDNPIRRKPTLSDSTNRTQNPNNGDHLVNTDSGEEKKRKRNKEKTPTLAIDTVVSVIKASKKSENKMKHDSNKGKDLNVDVYAIGKRKRKRDKVEKD

SEQ ID NO: 128102 - protein, 79 aa, Glycine max
  Coding DNA Sequence Number=SeqID_11324
  Gene Ontology: Mol. function=protein serine/threonine kinase activity; Biological process=protein amino acid phosphorylation
  Homolog annotation: Hit_ID=Q1S7W7; Match level="QueryCoverage=55%, HitCoverage=15%, E-value=2e-15, Identity=84%"; Hit description =Protein kinase
MAPEALKFQRYDDKADMWSVGTILFELLNGYPPFNGRNNVQLSKKKIDGNVTAISGFEVCTIFHSSCLQNYLRNYQIHQ

SEQ ID NO: 128103 - protein, 200 aa, Glycine max
  Coding DNA Sequence Number=SeqID_11325
  Homolog annotation: Hit_ID=Q1SN98; Match level="QueryCoverage=99%, HitCoverage=37%, E-value=5e-78, Identity=71%"; Hit description=TLDc
  Pfam annotation: Domain name=TLD; Domain location=65-192; Score=18.8; E_value=4.2e-07; Accession=PF07534.6; Description=TLD
MAASDGVELPSSNSSSGGDISSTAAYDYILTQGRAWAISITQKSTVKEEISRAFISNGGGMDDNLLYRSSTHGRGLGRFWSHVEGYRGPLLILIAASSGDAHEGNSIDRKWVVGALTDQGLENKDIFYGNSGCLYSIGPVFHVFPPTGKEKNFVYSHLHPTGKVYQPHPKPVGVAFGGTPGNENIYRRRFCKSECSPSRY

SEQ ID NO: 128104 - protein, 96 aa, Glycine max
  Coding DNA Sequence Number=SeqID_11326
  Homolog annotation: Hit_ID=Q1SN98; Match level="QueryCoverage=59%, HitCoverage=10%, E-value=3e-23, Identity=86%"; Hit description=TLDc
MRIWVPRFGLKEVEARGRDKRDWDGRRWSSAGNEVPPGLGGKVGKEVQNSYKKREELFTEQRRNVDLKTFASWEDSPEKMMMDMISDPNAVRREDH

SEQ ID NO: 128105 - protein, 81 aa, Glycine max
  Coding DNA Sequence Number=SeqID_11327
MKTGDEVFGSDYNYVLRKMRWKWHETWAIKCKTLIVREEPVGGKKKQWGKNKRGSVKGIRMLLQMLEAESRKAFLGQALMG

SEQ ID NO: 128106 - protein, 80 aa, Glycine max
  Coding DNA Sequence Number=SeqID_11328
MSASYLLLKIYVLILPELDAPLFVERPSFDGLKALLVLGAPKTVAIKLEGGTGKTQVCVLYGILGCAPVALPASLVQGMR

SEQ ID NO: 128107 - protein, 94 aa, Glycine max
  Coding DNA Sequence Number=SeqID_11329
MIRGDTLRLSAPFCHPEAAGPMTSRDQIWSFCTLVSSRGGGPDDTRKYPSDRTLDSMQRLTQSSAPFVPPGTTSHLHAEISWSPATLVNREERN

SEQ ID NO: 128108 - protein, 262 aa, Glycine max
  Coding DNA Sequence Number=SeqID_11330
MAAGPQLPLLQEKLVDIVVELSRGGLPHAQDTPYRLARKYYAESPTRMRELTALLMERLGDQMQGRCGSDLCHLTWQPGADFHTLPVADITSPAQLQHFFFNETGALKQGRYAQPRAMVDVAACGDGTQLTLYGDDMRFNAFTDYLDALLADPADPVAAPIVTQPQTLHRLSQFNATDDAKLLAHDVIALFRHAAAAHPQQAALHADGQIYSYGEIDRASDQFACWLLEHSGAASSVVAVSMDKSATLLIVLLGILKSNKTY

SEQ ID NO: 128109 - protein, 213 aa, Glycine max
  Coding DNA Sequence Number=SeqID_11331
  Gene Ontology: Mol. function=arylformamidase activity
  Homolog annotation: Hit_ID=Q6W755; Match level="QueryCoverage=95%, HitCoverage=75%, E-value=3e-25, Identity=43%"; Hit description=N -formylkynurenine (Aryl-) formamidase
MAGSATPSVSAWCHTATARTPNASAIFFPETHNVADLPLEPFIAATLIRVRPQRADGTTESYNASAASEDWLITRAALDDALAPLSGDYLQALVIAVETPSDFRAAACAPYFSHQALARIVELGVQHLLVDIPSIDRLYDGGRMDNHRRFWGLDAPDRPHSGRKYASVTELIQVPAHAAAGHYFLTIQLPDLSGDALPSRPVLFSFSTGKVTS

SEQ ID NO: 128110 - protein, 121 aa, Glycine max
  Coding DNA Sequence Number=SeqID_11332
MDASLNEAHLMQDGDVTGIARGQTRDDVDFLDTVDQDGNGSDLLWGRIGDDVILHTHPHSPKQGGGDGSGQRWCGTTTMVQQCCLVVRDDQERIYTCEKMEEEKEKDRGEGFGGEGDMTTE

SEQ ID NO: 128111 - protein, 45 aa, Glycine max
  Coding DNA Sequence Number=SeqID_11333
MVGRFAQNITTILSDVGSLPANELTVSDLLFCVIRHQDEFTTIGT

SEQ ID NO: 128112 - protein, 408 aa, Glycine max
  Coding DNA Sequence Number=SeqID_11334
  Gene Ontology: Mol. function=protein phosphatase type 2A regulator activity; Cellular component=protein phosphatase type 2A complex; Biological process=signal transduction
  Homolog annotation: Hit_ID=Q1SHY8; Match level="QueryCoverage=100%, HitCoverage=59%, E-value=1e-105, Identity=51%"; Hit description=WD40- like
  Pfam annotation: Domain name=WD40; Domain location=216-254; Score =40.2; E_value=7e-09; Accession=PF00400.22; Description=WD domain, G -beta repeat
  Pfam annotation: Domain name=WD40; Domain location=303-340; Score =40.8; E_value=4.7e-09; Accession=PF00400.22; Description=WD domain, G-beta repeat
  Pfam annotation: Domain name=WD40; Domain location=344-382; Score =36.6; E_value=8.4e-08; Accession=PF00400.22; Description=WD domain, G-beta repeat
  Pfam module annotation: Pfam domain module=WD40::WD40::WD40; Domain location=216-254::303-340::344-382
MLISDEGDSDVFFDSVDCFSPTRDSVLTEQEFGYEIWVNEPVSVMERREKFLQEMGLGDGSSKVCSQENNVMSSDDSSERLGLERIRDSGAVSNASCSCILPDDDQVSELVLSGSEATSEAQGLFDEHKGCPKDESCFEGKVYEVSCTDQEVRHRKAEVREKYMGEKEKKNWWKHFISSKKGGGGKVRSKLNSSTNKTRRINVRQNKKRWMELSALYIGQEIRAHKGLIWTMKFSPNGQYLASGGEDGVIRIWRVKTLNTSSICFNAEDSAANKVKHDFSSSQKKHSSQSFVVLPSKIFKIEESPLHEFSGHASDVLDLAWSNSDTLLSSSSDKTVRLWKIGCSQCLSVFHHKDYVTCIQFNPVDENYFISGSIDGKVRIWGIHEERVVDWADIRDVISAISYRPDGK

SEQ ID NO: 128113 - protein, 239 aa, Glycine max
  Coding DNA Sequence Number=SeqID_11335
  Gene Ontology: Mol. function=protein phosphatase type 2A regulator activity; Cellular component=protein phosphatase type 2A complex; Biological process=signal transduction
  Homolog annotation: Hit_ID=Q1SHY8; Match level="QueryCoverage=99%, HitCoverage=37%, E-value=5e-89, Identity=69%"; Hit description=WD40 -like
KHFQLETKIHVNGKKSTSGNKITGIQFSQKNHQRVMITSEDSRVRILEGTEFVQTYKGLPRSGSQMSGSFTSGGEHIVSVGGDSRVYIWNFNDLGNASSKQTKSKYSCEHFGSEGVTVALPWSCMSAEEQSGSSNDFAHHSSSQHQLEASHGVRESERFSFGSWFSIDGSCRGSVTWPEETLPRWDLPLVEVEFDHQKLCTKDPSHEKHVSETWGLSIVAAGCDGTIKTFHNFGLPIRL

SEQ ID NO: 128114 - protein, 86 aa, Glycine max
  Coding DNA Sequence Number=SeqID_11336
  Subcellular localization annotation: CTP_CleavageSite=20; ConfidenceScore=5.03e-01
MASQQNTSEVVITSQQNASKVMTASQQNAGMATSQSREGEDRREAEGLSTPYKTKWNTVCYHPPTSICHPTTFVPVMTHTLISLLN

SEQ ID NO: 128115 - protein, 83 aa, Glycine max
  Coding DNA Sequence Number=SeqID_11337
MTNAMMKINKKAEEMFNIVHVMDQPYGEVSRPLLVFSSSPSSKAGLNQKLTLNDTPCITKFLTQSLLKFYTEYKVTCSSLVSN

SEQ ID NO: 128116 - protein, 154 aa, Glycine max
  Coding DNA Sequence Number=SeqID_11338
MDLKTGLQQPIALIDEAGCCFFPEIYAASGDEPYNLSKQVFIDFFGRDVSLLLLAQPQQKICDTNQHLISHPYQKYQCDDLRKDTDTSVKDTEKMLVACNTFHGHAPPFVGKILPLQQPPFICQNPEFQHLTEACETLVVEIDVLMLDHVPQAQ

SEQ ID NO: 128117 - protein, 163 aa, Glycine max
  Coding DNA Sequence Number=SeqID_11339
MRVKSYCRLNLLRALIINFERLDILRDSIRHPSEKLLSFEFAQSFSLHFRASRYITGLNETSEASTFNFERFDILRDSIGHPSKKLLSFEFAQSFGIPFRASRYITGLNQTSKASIINFERLDILRDSVRHPSKKLLSFEFARSFSLQFRASRHITGLNQTSE

SEQ ID NO: 128118 - protein, 412 aa, Glycine max
  Coding DNA Sequence Number=SeqID_11340
  Gene Ontology: Mol. function=RNA-directed DNA polymerase activity; Biological process=RNA-dependent DNA replication
  Pfam annotation: Domain name=RnaseH; Domain location=176-302; Score= -24.8; E_value=0.012; Accession=PF00075.14; Description=RNase H
MVKKSIGKWRMCVDYTNLNKAFPEDAYPLPNTDRLVDRAYRFRLHKFLDAYSSYNEIKMYLPDQEKTTFITDGANFCYKHIRDLVEIFVELKKHNMRLNPEKYTFGIGGAEELPSPIFLHFPSSSPFNFVILRVVAWYIDISEFGLKFKPRGPIKAQCVVDFMAELPPKPSSGDIGDWWMLYVDGAYNPKGSRAGITLERSRDISLKQSLFDFKTSYNQVEYEALIVGIKLEKEVEVKKISMDVLGLFPAAKWQAKFLLVTINYFTKHGFLFAIVIDNGTQFTKKGEQGHLDKDEEIVGKAKGLWVEELPSILWAYHFTQLSTTKETSFRLTYGTGAMIPVKVRDHAQIQDEAFKRRVTRKHKSKLKKREFLVGDLVWKMRGEARKDHVEGKLDPNWEGLFRIIATLQNCAY

SEQ ID NO: 128119 - protein, 253 aa, Glycine max
  Coding DNA Sequence Number=SeqID_11341
MVELVTAHDVHQDIMWGVVVGWLMLTTHKLIVHKSPQALSLMKTKELDDKASYVVKMTWEHFWVRELYGDGLRMSSSGFDEDKSLVVRWKSMLEKEILDMGEESKSFSDSIASLPLSDEEEFQNLMKGPEIFYGVNVIVVDIVSGDINTGLVDSNREGSKVDVFEPFRKMDEAIGGGSINVENLTTENRDVEVLQSHYIDKLTTNSDVANNNVEKLTTSLISPTPLISNQGPLRRANHVIITRNLPPLWNVDI

SEQ ID NO: 128120 - protein, 145 aa, Glycine max
  Coding DNA Sequence Number=SeqID_11342
MDFVGVDNNLDFIEVFLYRSSTIVRHWRTIYVELKIKFKASLEEMRKLVKALNEKNSLIKKIEIIDAFIMGHEDGFKKALRQIALFTPEMDMKNFDVLKDVKDGEAVREFEIGSYEEASNSEMTSNAGDVEATSNFALTSNHPTT

SEQ ID NO: 128121 - protein, 274 aa, Glycine max
  Coding DNA Sequence Number=SeqID_11343
  Gene Ontology: Mol. function=RNA-directed DNA polymerase activity; Biological process=RNA-dependent DNA replication
MDALRHRATGFIQIEKLSEFHDKVRGNQKKSDSHKEKLKFVKEKDFKRQPQQPKYETYTLLTESRARILEKAFHKEILGCIPIARPTAPNNAYIIETLVILQKKCIVLKDKIEELVHKGCLNDFVKGNNYNRGDYRGGGRGGCKGSFRGGYVKDTSYSVLLGIPTLNKLGTILSTLYLATKFPSSTREIVIVKVDQTDACECYVKSCKIEPYNIIDDQPQLKTLLRISKSERSHMNAPKSQCQLFAWSMSDMPGTDPNFILHKLAVFPNVKLVA

SEQ ID NO: 128122 - protein, 298 aa, Glycine max
  Coding DNA Sequence Number=SeqID_11344
  Gene Ontology: Mol. function=methyltransferase activity; Biological process=metabolic process
  Homolog annotation: Hit_ID=Q00TN0; Match level="QueryCoverage=81%, HitCoverage=23%, E-value=5e-48, Identity=41%"; Hit description =Homology to unknown gene
MGGFTRILHSGNPDNLMNEIPTVVVDPLPAGLDRGYIVLNRPWAFVQWLEKTKIEEEYVLMAEPDHIFLRPLPNLAFGGHPAAFPFFYIRPDQNEKTIRKFYPEELGPVTNVDPIGNSPVIIRKDLIAKIAPTWMNISLKMKEDPETDKAFGWVLEIRGIGTDNLIHYANGFFLVEPRYAYAVASAVHGVRHILRKDFMLQPPWDLETNKKYILHYTYGCDYNMKGELTYGKIGEWRFDKRSHLRGPPPKNLPLPPPGVPESVIFPNDLLEARTFKMPVNFLVSLIYLIYFLHFHWRK

SEQ ID NO: 128123 - protein, 166 aa, Glycine max
  Coding DNA Sequence Number=SeqID_11345
MTFLGETNSQTIVNSTLAFIFPNGSIVHNDNGVYFQTSTPIPFRLPNVCDFQTLKTKIHNTLQLTEEQYLDEIYYRQPFTDTGDHLRFQCMQLKNDDDVNTMLMCNHQFSCVGPIELLCTIGRTPDGKNSKKFDIPSGCTMNELKDLVKQVAPQGIPPYGIHETQT

SEQ ID NO: 128124 - protein, 138 aa, Glycine max
  Coding DNA Sequence Number=SeqID_11346
  Gene Ontology: Mol. function=nucleic acid binding; Biological process= DNA recombination
  Homolog annotation: Hit_ID=Q7CHC7; Match level="QueryCoverage=99%, HitCoverage=23%, E-value=7e-75, Identity=90%"; Hit description =Putative ATP-dependent helicase
MAAARGDVVLRAAVRAALEPEAVIALFAVAVVVFQPALTAAAVVLDDVAILGALAPEQVGEAAGRAEHLHRLAVAVRLADADLRREQIVRVAGVVEDQAILLAGRQPQTAADDLLIQADGLGRAQNSDQIDVRRVEAG

SEQ ID NO: 128125 - protein, 196 aa, Glycine max
  Coding DNA Sequence Number=SeqID_11347
  Gene Ontology: Mol. function=transporter activity; Cellular component= integral to membrane; Biological process=transport
  Homolog annotation: Hit_ID=Q66CU7; Match level="QueryCoverage=100%, HitCoverage=57%, E-value=5e-92, Identity=80%"; Hit description=ABC oligo-dipeptide/nickel transporter, permease subunit precursor
MAGHDNAIRHAHGARGADVVKIAGAQEFGAHHTHQAHPAEQDGDAEQPPEIGLDDARQQNDQKQRRHARPHFDKALPPQIETPAVIPLRRADAHADQAGKQRQRQAEQHRDAKTVQHPGQHVAAVAVGAQQVVTRRRRGEGHFGGEVDGVVTEADRRPYRPAVPFDLPLHERILIVGFGIQFAAEGGFAVANHKRQ

SEQ ID NO: 128126 - protein, 236 aa, Glycine max
  Coding DNA Sequence Number=SeqID_11348
  Gene Ontology: Mol. function=aminoacyl-tRNA ligase activity; Cellular component=membrane; Biological process=translation
  Homolog annotation: Hit_ID=Q6D2H7; Match level="QueryCoverage=98%, HitCoverage=28%, E-value=3e-88, Identity=67%"; Hit description =Putative mechanosensitive ion channel protein
TVTAVAILVSLIVGYVTLARFLSYEVIWCGILFGSFYFLSHLINDGCESLFSTNNATGKRLQTSLNIDERYLQQAATLLSAVGKTLLVAFVALALLNGTFASSTPIELIQKVIEFWGGKGLESLNIVPAHMVNAILCLVVGIYVLRSVRRWLDKEFLPKTTMDIGMRVSLVTLFSNIGYVLIILLTLSIMGLQWNKLAWIVSALSVGIGFGLQEIVKNFISGLILLTERPVKVGDL

SEQ ID NO: 128127 - protein, 158 aa, Glycine max
  Coding DNA Sequence Number=SeqID_11349
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=2e-25, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHILTFRGLHVLPFRGLHVLAFIGLHALAFRGLHVLTFRGLHVLAFIGLHALAFRGLHVFTFRGLHTLDFRGLHLFTLKGLHAPDLRGLHVLAFIGLHALAFRGLHALAFRGLHVLTFRGLHTLTFRGLHVLAFRGLHVLAFRGLHICAFRELKVLCP

SEQ ID NO: 128128 - protein, 137 aa, Glycine max
  Coding DNA Sequence Number=SeqID_11350
MVSYIHKSNLKAIFTNLGKNTIEAFHRALGGRTFGYQQQGNGGNVACPIISEHNLCLRPSPTTPQFKETKHKFAPNCLTELGKLCTIQSIKGINGKLETKGILGCLPAALPTCSELGMGRRSIDHGPSLYSCPSLST

SEQ ID NO: 128129 - protein, 223 aa, Glycine max
  Coding DNA Sequence Number=SeqID_11351
  Homolog annotation: Hit_ID=Q8H897; Match level="QueryCoverage=87%, HitCoverage=20%, E-value=2e-08, Identity=24%"; Hit description =Putative retroelement
  Pfam annotation: Domain name=Transposase_23; Domain location=138-208; Score=8.7; E_value=0.00013; Accession=PF03017.5; Description =TNP1ENSPM transposase
MACTKKIGQMTSEAPKEITEKIDLLEEQASQRSFVSYGRQDVLIVAIGRPEHPGRVRAVRAGVTIKQYFESNPQTSHTSSSMAPEELEQLTQQIRDQLEESIKEKGLALPLEPKVGPSTAHVSIKESCVNPSGNDPDTSDSDKCGLYIEENIPHLVALGRVYEGSITIHNIPLLHDQVKVSVEEVKDADAPVPVPTDEVNLMGHSLNTFLAWLRHLAKRLSEQ

SEQ ID NO: 128130 - protein, 313 aa, Glycine max
  Coding DNA Sequence Number=SeqID_11352
  Gene Ontology: Mol. function=sodium:dicarboxylate symporter activity; Cellular component=membrane; Biological process=dicarboxylic acid transport
  Homolog annotation: Hit_ID=Q5PH74; Match level="QueryCoverage=96%, HitCoverage=67%, E-value=1e-114, Identity=72%"; Hit description =Putative transporter
  Pfam annotation: Domain name=Acyl_transf_3; Domain location=31-277; Score=-80.2; E_value=0.091; Accession=PF01757.12; Description =Acyltransferase family
  Pfam annotation: Domain name=SDF; Domain location=1-297; Score=67.7; E_value=3.7e-17; Accession=PF00375.9; Description=Sodium:dicarboxylat e symporter family
  Pfam module annotation: Pfam domain module=Acyl_transf_3::SDF; Domain location=31-277::1-297
MQSTLTAEDVSKTAAVSLPQLVTSLIPTNIFLDLTGARSVSVIGIVIFTLLAGVALLKVKKEAPEEGQKLSSGINAIQIWVMKMVRIVIALTPYGVLALMAKVFSTYQLAQFTSLLGFIAACYLAVAIMFIVHAILLIVSGHHPLRYFKTVWPVLTFAFVSRSSAASIPLAITAQEKFGVPNTIANIAASFGSSMGQNGCAGIYPAIMVAMIAPTLGIDPLSFSFLASLLPAIALGSIGVAGVGGGGTFAALIVLSTLNFPVALVGIFIAIEPIVDMARTALNVNGSMMSGVLASRLLKHQSAKSHHVASISE

SEQ ID NO: 128131 - protein, 91 aa, Glycine max
  Coding DNA Sequence Number=SeqID_11353
YPELRRYEFLIGGYVGARASLLSTTPLFVAMTQELRPMWSSAPFPEMSAFSDGDFSSLTSYPELRRSEFLIGGYVGARASLLSTAPQDLSY

SEQ ID NO: 128132 - protein, 69 aa, Glycine max
  Coding DNA Sequence Number=SeqID_11354
MLAIERKRKRERERERGVKRLKRVRKDKEERNKREWLQSKVDSGCGNSNPQDRTGVELYRSCIDIYALD

SEQ ID NO: 128133 - protein, 136 aa, Glycine max
  Coding DNA Sequence Number=SeqID_11355
  Gene Ontology: Mol. function=copper ion binding; Cellular component =chloroplast; Biological process=protein localization
  Homolog annotation: Hit_ID=P93009; Match level="QueryCoverage=91%, HitCoverage=77%, E-value=3e-40, Identity=65%"; Hit description =Protein CutA, chloroplast precursor
  Pfam annotation: Domain name=CutA1; Domain location=60-136; Score =108.6; E_value=1.9e-29; Accession=PF03091.6; Description=CutA1 divalent ion tolerance protein
  Subcellular localization annotation: CTP_CleavageSite=63; ConfidenceScore=5.05e-01
MASIICSSSTLRRRLPLVGAFCMLSLGLSNLYTPLKTGSKLGIRTQSCIRMEGSNTTVPSIVVYVTVPNKDAGKKLAESIVKEKLAACVNRVPGIESVYQWEGKIQTDSEELLIIKTRQSLLEALTEHVKANHEYE

SEQ ID NO: 128134 - protein, 328 aa, Glycine max
  Coding DNA Sequence Number=SeqID_11356
  Gene Ontology: Mol. function=protein domain specific binding; Cellular component=nucleus; Biological process=oocyte microtubule cytoskeleton polarization (sensu Insecta)
  Homolog annotation: Hit_ID=P48349; Match level="QueryCoverage=73%, HitCoverage=97%, E-value=1e-112, Identity=85%"; Hit description=14-3- 3-like protein GF14 lambda
  Pfam annotation: Domain name=14-3-3; Domain location=9-247; Score =480.7; E_value=1.7e-141; Accession=PF00244.10; Description=14-3-3 protein
MAGAEGLNREQYVYLAKLSEQAERYEEMVEFMQKVVVGWTPASELTVEERNLLSVAYKNVIGSLRAAWRIVSSIEQKEEGRKNDDHVSLVKHYRSKVENELTQVCASILNLLDSNLVPSVFASESKVFYLKMKGDYHRYLAEFKVGDERKTAAEDTMLSYKAAQDIASGDLPPTHPIRLGLALNFSVFYYEILNQSDKACAMAKQAFEEAIAELDTLGEESYKDSTLIMQLLRDNLTLWTSDVQFDQYQNLKMTCKCNADSVALAQFIEQERIFKFLSGLNPEYDHIRVRVQILNKEKLPSLLEVFYTVSDEETRISSMLDDGSSNKG

SEQ ID NO: 128135 - protein, 214 aa, Glycine max
  Coding DNA Sequence Number=SeqID_11357
  Gene Ontology: Mol. function=oxidoreductase activity; Cellular component=membrane; Biological process=metabolic process
  Homolog annotation: Hit_ID=Q76KV8; Match level="QueryCoverage=91%, HitCoverage=70%, E-value=4e-59, Identity=60%"; Hit description=Short- chain alcohol dehydrogenase A
  Pfam annotation: Domain name=adh_short; Domain location=6-134; Score=- 1.3; E_value=6.7e-06; Accession=PF00106.15; Description=short chain dehydrogenase
MRMIYHYYNLVVMCSYVRCDVTDEDQVKNLVDSTVNAHGQLDIMFSNAGILSPSDQTILDLDFSAYDRLLAVNARGTAACVKHAARSMVERRVRGSIVCTASVSASHGGLRRTDYVMSKHAVKGLMRAASAQLGAHGVRVNCVSPSGLTTPLTRAAHAAMETKELQKQYAQSSRLKGVFLTPKHVADAVLFLACGDSEFVTGHDLVVDGCFDGV

SEQ ID NO: 128136 - protein, 73 aa, Glycine max
  Coding DNA Sequence Number=SeqID_11358
  Subcellular localization annotation: CTP_CleavageSite=18; ConfidenceScore=5.38e-01
MDRLTTMMSALLSAQNSQAAAVAVEQPLVSTTPLSTVTSPPLFLPPGCSWGMPPPVCGSPQPAVSEVPPPFAQ

SEQ ID NO: 128137 - protein, 292 aa, Glycine max
  Coding DNA Sequence Number=SeqID_11359
  Gene Ontology: Mol. function=RNA-directed DNA polymerase activity; Biological process=RNA-dependent DNA replication
VRTPRRTPDVLPPWFRHDLTCAFHQGAPGHDVENCYVLKNEVQKLVRANLLSFKDQNPNVQANPLPNHGPAVNMIQDCDEDGVILNVQHVRTPLVPIHIKMCEAALFDHDHAACEVCPVNVKGCPKVQEDIQRLIDNRELIITRKDKEVCVITPEFQRLEISYNSGESTTTPLVISLPGPMPYASLKAVPYKYSATMLEGGQEVPLPSLTPAISVDNIASDSKVLRNGRVIPTLFAKKVNDPAVKQVTVNGPGTRKEVGQSNGTSKNSDHDEILKLIQKSEYKVVDQLLQLP

SEQ ID NO: 128138 - protein, 68 aa, Glycine max
  Coding DNA Sequence Number=SeqID_11360
  Gene Ontology: Mol. function=heat shock protein binding; Biological process=protein folding
  Homolog annotation: Hit_ID=Q6D262; Match level="QueryCoverage=99%, HitCoverage=39%, E-value=3e-26, Identity=82%"; Hit description=Co -chaperone protein hscB
  Pfam annotation: Domain name=DnaJ; Domain location=2-68; Score=29.0; E_value=6.8e-06; Accession=PF00226.21; Description=DnaJ domain
MDYFTLFGLPVRYTVDGSLLASRFQDLQRQFHPDRFANQPERERLMALQQAATINEAYQALKHPLKRA

SEQ ID NO: 128139 - protein, 145 aa, Glycine max
  Coding DNA Sequence Number=SeqID_11361
MEVRDKVELLPYKDLDELVQLCIRVEQQLKRKPSAKSNGFHSYPRKDQAHGILGAAPSKPKEDKGHIASQCPTKKTMIMRGQDIYSSQEETTSCPSSSGSEDEVRGEESSEEVYPYEEGDLLMPKPYKLQWLNEQGEMMVNQQVK

SEQ ID NO: 128140 - protein, 56 aa, Glycine max
  Coding DNA Sequence Number=SeqID_11362
MTVFHFFNYAILTFGPHAVFYFATPLSEYDTLRTSIKAVVVYLATTLVKVGEYTEF

SEQ ID NO: 128141 - protein, 139 aa, Glycine max
  Coding DNA Sequence Number=SeqID_11363
MEKSKGKVEEENTMGESHVALSRHHCGRVPRSLCVAICIGDTLLSPSYVAYIATGIGGTLLSPPLSPMGMAVCNGIGGSYTCWTRHGETRDEFKDLGSNERYPTNDTNTNTYDDSHLEEIAKVVEEDIQDCSGMFLKLK

SEQ ID NO: 128142 - protein, 52 aa, Glycine max
  Coding DNA Sequence Number=SeqID_11364
MVHDISVKVKLEVTGTSTALNVFGSRRRSDKWVYDPNLVGSWYLTHATKNAS

SEQ ID NO: 128143 - protein, 73 aa, Glycine max
  Coding DNA Sequence Number=SeqID_11365
MWDKGTKTTNSNIGHDPCSPKLASGSPGRDGRLRDGFQGSALREIMEEKKKEEKTKSRHCRIVLHSMFFVCHS

SEQ ID NO: 128144 - protein, 53 aa, Glycine max
  Coding DNA Sequence Number=SeqID_11366
MTKARQKGVRKENEGGACHPARPGELGYFLLKAPPSGELPGSPSIIIVMLVTI

SEQ ID NO: 128145 - protein, 51 aa, Glycine max
  Coding DNA Sequence Number=SeqID_11367
MRRGAKRKTKQGQEAKHDAAEDNKPKAQPRAKQAKTSKPQSEPYFLFQFER

SEQ ID NO: 128146 - protein, 161 aa, Glycine max
  Coding DNA Sequence Number=SeqID_11368
MPNASRGPQYQSPPRTLHFVRGGGPSIVLENERIEHMEQRLCAIEGGKSYVFANMVELCLVPDVVIPPKFKVSNFDKYKGTSCPMNHLKMYCRKMEAYGKDEKLLMHFIHESLVGEAITWWRDLAAQIVPLMMERGMITMIVDTLPVFYYEKMFYHLGLLD

SEQ ID NO: 128147 - protein, 102 aa, Glycine max
  Coding DNA Sequence Number=SeqID_11369
MHHQKRKTLDEAFHCYQVSWGPSMTTDRPPLPMANTIPGIGPNISKKSHLVQGKLTQASWLLKDEGIPWPRQARCWPGLAQAWKHPKNGHFSPFPCGFCSRI

SEQ ID NO: 128148 - protein, 150 aa, Glycine max
  Coding DNA Sequence Number=SeqID_11370
MDNEEGVQEQMKADLLALKDQMASITEAMLKLQKTIEDNATAAASNTAREAEPVLPPIINLGQDRNTTGFNRRYNPQAYPYGLPPDFTPHTTPDDLSQAPTFEGQLPPRADYPLQEDDEGDAHLGPLLPLKDPTAPTKHSLPCPVSIHVR

SEQ ID NO: 128149 - protein, 342 aa, Glycine max
  Coding DNA Sequence Number=SeqID_11371
  Gene Ontology: Mol. function=hydrolase activity
  Homolog annotation: Hit_ID=Q2X918; Match level="QueryCoverage=99%, HitCoverage=50%, E-value=1e-135, Identity=69%"; Hit description=Twin- arginine translocation pathway signal precursor
  Pfam annotation: Domain name=Amidohydro_3; Domain location=1-226; Score=81.6; E_value=2.4e-21; Accession=PF07969.2; Description =Amidohydrolase family
MLKPGQGTDFYRHNGAGEMLVFSAADFEDFLQPRPDLPPGTEDELERVVRHLVEHRWPFRLHATYDESISRMLDVFEKVNRDIPFNGLHWLFDHAETITERNIERVKALGGGIAVQHRMAFQGEYFAERYGIEATKHTPPVAKMLAAELPVGLGTDATRVASYNPWTALYWLVSGRTVGGMAMYDDSARLDRETALMLWTQGSAWFSTEQGKKGQIKVGQLADVAVLSQDYFSVPEEQIKGIESVMTVVDGKVVYAAGSFSPLAPPPLPVLPEWSPVTQVPGHYRSAPPSAAAKVGVLSQAHQCCGPCGVHAHQHDIARRSSIPVSDENAFWGAFGCSCFSF

SEQ ID NO: 128150 - protein, 72 aa, Glycine max
  Coding DNA Sequence Number=SeqID_11372
  Gene Ontology: Mol. function=oxidoreductase activity; Biological process=electron transport
  Homolog annotation: Hit_ID=UPI00005FA6A9; Match level="QueryCoverage =93%, HitCoverage=18%, E-value=3e-27, Identity=82%"; Hit description =COG0673: Predicted dehydrogenases and related proteins
RSTPDYAAFASSAGHGIGFNDQKTVEIRDLVNGIAAGDRMWPDFEEGWKVSCVLDAIAASAEQRRWLEINRD

SEQ ID NO: 128151 - protein, 111 aa, Glycine max
  Coding DNA Sequence Number=SeqID_11373
  Subcellular localization annotation: CTP_CleavageSite=41; ConfidenceScore=5.50e-01
MIGVVVNACLSQSKSSLHRSSKSNSTSFCSRLDSGKATFVEAKLHGESKVVTKKLKDQSKNNSSESRTIQEFKKRIKKNSRLKKKVYRQESRFKVQDLKNQDQDSRLKIQE

SEQ ID NO: 128152 - protein, 182 aa, Glycine max
  Coding DNA Sequence Number=SeqID_11374
  Gene Ontology: Mol. function=potassium ion transporter activity; Cellular component=integral to membrane; Biological process =potassium ion transport
  Homolog annotation: Hit_ID=Q8W4I4; Match level="QueryCoverage=96%, HitCoverage=22%, E-value=8e-74, Identity=75%"; Hit description =Potassium transporter 6
  Pfam annotation: Domain name=K_trans; Domain location=23-182; Score= -415.7; E_value=4.3e-06; Accession=PF02705.7; Description=K+ potassium transporter
MDLEGGTTRRNSVKRESWRTVVTLAYQSLGVVYGDLSISPLYVFRSTFAEDIKHTESNEEVFGVLSLVFWTITLVPLLKYVFVVLKADDNGEGGTFALYSLLCRHARVSSLPNCQVADEELSEYRKDSRGAAPESSFAARLRSTFEKHKVLQRVLLVLALIGTCMVIGDGIFTPAISGEIKE

SEQ ID NO: 128153 - protein, 71 aa, Glycine max
  Coding DNA Sequence Number=SeqID_11375
MEECNIGDDNVGSTDSFVVMDVGCDNGDSYDNINGNWSGNYKDGGISDDNNGDSNNNIGGDSHAYSHGGDS

SEQ ID NO: 128154 - protein, 152 aa, Glycine max
  Coding DNA Sequence Number=SeqID_11376
MSILTLGSKKEEKENFQSKKKRRKISNQRKKRKQGNSQSKSGRKKKGKKENSQPKNGRKKHRDFSSLTSYPELRRSEFLIRGYVGAKASLLSTTLLSVTMTQELVACGDTLRLSAPRHSVTPSVIDEQRPMWSSAPFPEMYASSGGDFFKSH

SEQ ID NO: 128155 - protein, 97 aa, Glycine max
  Coding DNA Sequence Number=SeqID_11377
  Homolog annotation: Hit_ID=Q86AI8; Match level="QueryCoverage=81%, HitCoverage=28%, E-value=4e-09, Identity=38%"; Hit description =Similar to Homo sapiens (Human). Mucin 2
  Subcellular localization annotation: CTP_CleavageSite=83; ConfidenceScore=5.87e-01
MARTSSPLKVRACSPFKARMCSPLKVRACSPLMVRTCSPLKARSSSSLMARMCCPLKVRACSPLMARACSPLMARTCSHLKVRAYSPGVHPYEKARD

SEQ ID NO: 128156 - protein, 115 aa, Glycine max
  Coding DNA Sequence Number=SeqID_11378
MEEFEAQVDWPGDQPSSSGGGGAFAAQESVTEEPLAPALALAEDEDELTPPKPSYFDAGTHMVQEEETTPDQTPQPSLAPPHIPEDVALVAKPEQLIQDSSATPSLDLNEDQPQE

SEQ ID NO: 128157 - protein, 134 aa, Glycine max
  Coding DNA Sequence Number=SeqID_11379
  Subcellular localization annotation: CTP_CleavageSite=71; ConfidenceScore=5.37e-01
GYHMVTRTFGQPVANRPVDARRLTSSSAPFVVLSREGYLMVTRTFRQPGANELVDARGLTSSSAPFVVLPRANAHVDARRLTLFAAPFVVLTREVNGYAGLPYGYPHLWSTRGKRARWRAETNIIFYTFCRPDP

SEQ ID NO: 128158 - protein, 298 aa, Glycine max
  Coding DNA Sequence Number=SeqID_11380
  Gene Ontology: Mol. function=RNA-directed DNA polymerase activity; Cellular component=chromatin; Biological process=chromatin assembly or disassembly
  Pfam annotation: Domain name=RnaseH; Domain location=59-174; Score= -21.7; E_value=0.006; Accession=PF00075.14; Description=RNase H
  Pfam annotation: Domain name=zf-H2C2; Domain location=219-260; Score =4.9; E_value=0.081; Accession=PF09337.1; Description=His(2)-Cys(2) zinc finger
  Pfam module annotation: Pfam domain module=RnaseH::zf-H2C2; Domain location=59-174::219-260
LTGYYRKFIKDYGKIAKPLTELTKKKNFVWGKEALVAFKLLKQIMTTPPVLGLPDFSVPFEVECDAVGRGIGAVLMQKRQPIAFFSKALSDGNLTKSVYEKELMALVLAIQHWRHYLLGKPFVVYTDHKSLKHFLQQRVTSPDQQCWLAKLLGYQFEVKYKPGLENKAADALSRCHGDMELAVMLSYPTWLDGEQLLQEGRLVLSSDFPSIPVLLKEFHETPMGGHSGFLRTYRRLAANLYWPGMQKRVRDFVRACDTCQRQKYAATAPGGLLQPLPIPNAIWEDLSLNFITGLPKSK

SEQ ID NO: 128159 - protein, 132 aa, Glycine max
  Coding DNA Sequence Number=SeqID_11381
MGNPWDQSSWKVTFSLDNVGFATFGAPRPIEEFKWRRGWLEWEKMVDEFYALVNNANAKHQGDKRRCKKLMMNSLSEADRLSEPHPLSEAASLLSRWETLEEDKLEIYALSVQPARPTRMLSLLALSAPKLT

SEQ ID NO: 128160 - protein, 257 aa, Glycine max
  Coding DNA Sequence Number=SeqID_11382
MDTILGLTILYTTCANWYTCQNSRTVAPPELRVACAQVSHHRDLGLVPFSCLALQVFSKVEAFPLLDGDGIEGQRALWIEIKGGKRAKRKIWKTGVLAVIWLLIDFVKRLLLGHHLASPVEVVVYAVDGADQKPDDDVKNMPFYLWEILFVELNGIKWDEFVHFADPAIGQMAHPCQIRRRSINITPKIGDDIVSLESLTFASHLVNWSKAENGVSTTTKVIKKPSFKDGADVTTVLECWLSKTVVTSVSSLKVDLF

SEQ ID NO: 128161 - protein, 98 aa, Glycine max
  Coding DNA Sequence Number=SeqID_11383
  Subcellular localization annotation: CTP_CleavageSite=56; ConfidenceScore=5.08e-01
MTIVATCPFAGMQGEAHGCAFQRRKDARSRHQCLFVGNVGKTEGNWSTNARFLLLRTVYRRGNQTYVVLSLTRITRFSFYLKGDHLKALDLKSDPSTW

SEQ ID NO: 128162 - protein, 100 aa, Glycine max
  Coding DNA Sequence Number=SeqID_11384
  Gene Ontology: Mol. function=transporter activity; Cellular component= membrane; Biological process=oligopeptide transport
  Homolog annotation: Hit_ID=Q6J933; Match level="QueryCoverage=84%, HitCoverage=30%, E-value=3e-16, Identity=44%"; Hit description =Nitrate transporter
MFYSTESLDKMKSIGNSLQYLVVAFSIYVGTLLVNVVHQLTRKHGGIDWLNDDINAGRLDYYYFLMAGLALINLVYILFCVKHYRYKVNVEEKVVEKLEP

SEQ ID NO: 128163 - protein, 197 aa, Glycine max
  Coding DNA Sequence Number=SeqID_11385
  Gene Ontology: Mol. function=nucleic acid binding; Biological process= DNA integration
MRDEPVELTDSSTSEEIVLYERWKRSNRLSIMFIKAHIYASICGSIPESQKVKDFMKAINEQFESFEKALASTLMYKLSSMRLIGVVGVKKLIMKMRDQATQLKLLQVEISESFMEEGRLAQEIGEGALIVTQYKGKRGRKEKNHIPPIAKIKKESRFLIPCKASQARGSQMKVNGSSTLGIGSVHMWRLLAHVDLI

SEQ ID NO: 128164 - protein, 366 aa, Glycine max
  Coding DNA Sequence Number=SeqID_11386
  Gene Ontology: Mol. function=nucleoside-triphosphatase activity; Cellular component=membrane
  Homolog annotation: Hit_ID=UPI0000162C59; Match level="QueryCoverage =91%, HitCoverage=36%, E-value=2e-61, Identity=41%"; Hit description =ATP binding / ATPase/ nucleoside-triphosphatase/ nucleotide binding
MDDMDMDIPLPEELEFLESNSHFAEQQEEEDRHYYFPDLDPTAEIHESNSQQSPPPPDLAAPSAEPESSGHKRSCPPSPSPPEEEKRAKVRVAVEEDSSAAAADEDWLRYSPPPVPEGEPAVEEMAFEKEKTLSRYASEIDGECMPITAPSGNRVYAKLNRFQGEERVTKLDYNGYSTELSSEPVNVILERLEQEAFAKALEASSEGQSVLDVPEAQMVHERLWVDKYAPKSFTELLSDEQTNREVLLWLKQWDSIVFGSEIRSTSDDVLSALKRHSSIVHNQKPLNSKFPRMSRGPRWSNGRRYKNSRSMDESGSSKSIQDIWNAKSRNIGPPEPKLPPEHFALMFSDYLIVYGEKYLSSLQIIF

SEQ ID NO: 128165 - protein, 142 aa, Glycine max
  Coding DNA Sequence Number=SeqID_11387
  Gene Ontology: Mol. function=nucleic acid binding; Biological process= DNA integration
MVRSNKGGKFYGKYTENGQALGPFAKFLQEHDVDLTLRRSNRIKKPAIPSDYQVYLQESQYDFGVENDPELFLQAINSCNSKLWYDTMKDELESMANNKVWDLVELPNRIKPIGCKWVFKTKKDSLGSIKRHKARLVGKGFA

SEQ ID NO: 128166 - protein, 38 aa, Glycine max
  Coding DNA Sequence Number=SeqID_11388
MVMQVQWRVEAPEEEFGHNDGDAVIRLDNVAPVYHAIT

SEQ ID NO: 128167 - protein, 52 aa, Glycine max
  Coding DNA Sequence Number=SeqID_11389
MWISCGGGCTHSYEVWERIHDYFQKQAIAIACQLCTQFRATTLASKSMRKFL

SEQ ID NO: 128168 - protein, 102 aa, Glycine max
  Coding DNA Sequence Number=SeqID_11390
MFSYGGDTESAGKLNSEGGSFEVGVEGGKRYWKKIEGEDGRHGKTVTMDVPIADTKRNRSIILARKRKTRKRQAAHLLEQNQAPMAQVTMFISSMQQLNLIP

SEQ ID NO: 128169 - protein, 74 aa, Glycine max
  Coding DNA Sequence Number=SeqID_11391
MNSARQSIHRAPNKMMEDARTALDNQFVGLRTQWWRMHEWQSIHGLRIRFDGGGCTNSARQSIRGAPDSMVEDA

SEQ ID NO: 128170 - protein, 233 aa, Glycine max
  Coding DNA Sequence Number=SeqID_11392
APAQEPVATQTHSLAPSIQAEVADAVPATARLHEAEATPAPVQLEPDVPAPLAAAEAAAPRVSEHEPPYAPPPVEALAVPPSSATAQQEPEAPPAPLLPTQPEHPDHALYQQVRTGVATLDAKHGRTFDESSERMTASLLVLAKDNDLDRVDHVLLSNATADKPAGHTLSSTPSAAKRISASSLTSWSSSWKISACSRISRSVPPAWAEWVRHARNHSQQPALLVPLLANRRY

SEQ ID NO: 128171 - protein, 103 aa, Glycine max
  Coding DNA Sequence Number=SeqID_11393
  Homolog annotation: Hit_ID=Q5PJQ7; Match level="QueryCoverage=84%, HitCoverage=54%, E-value=8e-08, Identity=35%"; Hit description =Putative membrane protein
MTLVMVDGKEDREHYFFDTEAFYLRRGPVPTAVPLSQITSLTRTSDVIYARYVWQVCFNRASGKKCVTFTNNLSLFNRDFLLFLEAVRKANPLATVERASLFF

SEQ ID NO: 128172 - protein, 76 aa, Glycine max
  Coding DNA Sequence Number=SeqID_11394
  Homolog annotation: Hit_ID=Q9LHQ7; Match level="QueryCoverage=48%, HitCoverage=10%, E-value=8e-08, Identity=76%"; Hit description=mRNA cap guanine-N7 methyltransferase 1 (EC 2.1.1.56) (mRNA (guanine- N(7)-)-methyltransferase 1)
MEIAELNFQHGKNLFDSIVGVEVPIYFSKVLKKVVYNFLEDEITKILKVADHYSARSNQTLKEREASPIIHLKETQ

SEQ ID NO: 128173 - protein, 100 aa, Glycine max
  Coding DNA Sequence Number=SeqID_11395
  Homolog annotation: Hit_ID=Q1SMF0; Match level="QueryCoverage=69%, HitCoverage=13%, E-value=4e-07, Identity=43%"; Hit description =Tetratricopeptide-like helical
MDEDQWMYDNIMSQEVDMDYENEQECGVNEPHVDCLDAFNTSQVFGTRDDVLQWARSPHKNGFVAVIMRSDTHTGSRGRSSFVLIGCERSGRYKCRKKEF

SEQ ID NO: 128174 - protein, 327 aa, Glycine max
  Coding DNA Sequence Number=SeqID_11396
  Gene Ontology: Mol. function=nucleoside-triphosphatase activity; Cellular component=membrane
  Homolog annotation: Hit_ID=UPI0000162C59; Match level="QueryCoverage =97%, HitCoverage=30%, E-value=2e-56, Identity=41%"; Hit description =ATP binding / ATPase/ nucleoside-triphosphatase/ nucleotide binding
MGILMCSGDSNLILDGIHENVLRLNYHDPVMQKTVECFNNLGVYDLMHQYIMHTQQLPLYVYLPLVAITVHHIVSQVQKPTIEWPKSHQRYRTMMMEKMDILNTWHHKIPPYIARNLSASSFVEDLISPLLHILSPPTIRPVAFQLLSDKEKNDLAQLVSTMVSYTITYKTVKSDMLPQTQRCEVADGLALSLVPPISDFINFKDYTSNHNVLSVAMKQVLVHEVEKHKILQVSNDKTGAFTNGGHEVIETGTNNIPLANTNHATAVDMKTNENQANVLSQQLNANPTAVSPNLNSDKSSIAADCGKLLNMGNVKKPSRTSSSFFDR

SEQ ID NO: 128175 - protein, 140 aa, Glycine max
  Coding DNA Sequence Number=SeqID_11397
  Homolog annotation: Hit_ID=Q1SP02; Match level="QueryCoverage=83%, HitCoverage=26%, E-value=1e-10, Identity=34%"; Hit description=IMP dehydrogenase/GMP reductase
MIDEGYDKTSSHALTIPDVCWMPYGDHRVVRAFDLISCFQGELRWGPIVVTHRPERVVRQFGYVQTIPPPPIGPTLSFEDMDDRWMHYLDHLAAVGQICVEHDQCATDYMDWFFGISHPFITPTQAVDPPKHPPIPQHET

SEQ ID NO: 128176 - protein, 162 aa, Glycine max
  Coding DNA Sequence Number=SeqID_11398
MWVSLKALWETNGWRPRLDGEVNVWSHNLELAKSLVGHPYASQLTKDEKTIIVDMTKSMVKPRNILLTLTLCLDGAIKELKFPIPLFHYQPLTHASKLSSAFPLSATLSSPLSHSVTLFPSQPLSHVLPLSATLSSPLNHSLTFLSSLPLSHTVDARTDLAL

SEQ ID NO: 128177 - protein, 155 aa, Glycine max
  Coding DNA Sequence Number=SeqID_11399
MEAMKEQMTIMMEAMMSMRKMMEVNTTTVVAVSTAIEVDPAHPSGLNQVNHSVSDIVGQRGEALGSTGDPHFVQVRSKHSFPPYGLPPNYTPPNVAYTPDENVDNFTLIPIESQQPQFDHAHVSQPMRETHEVPCHTLVDFEPHLGYATEGQAIG

SEQ ID NO: 128178 - protein, 261 aa, Glycine max
  Coding DNA Sequence Number=SeqID_11400
MKLEPSLDDEAGLPDMQRQCPPTPTPLPTTLNWTPNTHRSTMLGRGKDSAEALRRASDASKKSDKGIREFNDTRLDVRFKDAKVEFEANIRRRRKGGKVIRKKREKSCHRKLPMMARNDHRKIYGRRLKEFEADFDSDYDNVVLQIILRSLEHSIAKQFTKELCYCHDEDYNLIVDVISEELVNLKLKHGSNDVVDDENTESVNVSIEDPIVAKPKGCDPNMHSSARTFKWNIKCHNCGGYMVTIDIHRANTQGSQPVGQM

SEQ ID NO: 128179 - protein, 349 aa, Glycine max
  Coding DNA Sequence Number=SeqID_11401
  Gene Ontology: Mol. function=protein kinase activity; Biological process=protein amino acid phosphorylation
  Homolog annotation: Hit_ID=Q2QZ78; Match level="QueryCoverage=85%, HitCoverage=60%, E-value=2e-59, Identity=39%"; Hit description=AT hook motif-containing protein, putative
  Pfam annotation: Domain name=DUF889; Domain location=133-345; Score =196.4; E_value=7e-56; Accession=PF05970.5; Description=Eukaryotic protein of unknown function (DUF889)
MNVVNRQAGGMFFMYGYGGTGKTFMWKTLTSALRSKGDIILTVASSGIASLLLPNDKIAHLKFAIPVPALDNSTCNIDQGTEQAKLLKATKLIIWDEAPMAHKYCFEALDKTLNDIMCMSNFDCVLFGGKVVVFGGDFRQILSIIPRGSRSSILYATINASYLCDYCTVLKLTKNINSIRIVDYKLHRSYEVIVSHTYPDIQHKYKDEEFLKSRANLASTNEVVDQINDYILNIIPGEEKEYFNYDSIDMRDAATSECYEAVTSEFLQSLKTSGISNHKISLKIDTPIMLIRNLDQAKGLCNGTRIIVYRMTNHVIEAWIILGQKHRKFGVYSTNVFITISISMAFQDD

SEQ ID NO: 128180 - protein, 214 aa, Glycine max
  Coding DNA Sequence Number=SeqID_11402
MGSKIYPKVHENPKAFFSSSSPILLEPLAHGSGMICPLRCHKEMHDVIKEQAREDGQLGPWQLAQVSWNSPRRAGFLTLKSFGGPGEPEASLGELRSRKLNENTLLPLLLDPDTSVYPTQVMSLIDKHLLFLIERESTEGRCLQDVVNYPNAYTVHEIYHDKQVQRQLHKDHQLKNAKMIIVQPAPPVVLIEWITKQKEDLKCQGFRGSKNDAP

SEQ ID NO: 128181 - protein, 94 aa, Glycine max
  Coding DNA Sequence Number=SeqID_11403
MPLKDSTETKTGCQERRGGRMGSWSDLGFLIWDPGEEDQAGPCEQLDALSPFNPLSEMWQKEKESMDRPHRLHPVGTTRSPQGRLRHPGVADRP

SEQ ID NO: 128182 - protein, 112 aa, Glycine max
  Coding DNA Sequence Number=SeqID_11404
MGLSSSFFRNLLKEASQGGEFRAPPSLSLSLSFPPLKHPLQASYPRHSLGGEAPSSMAYSLVDGASSPLVLCLMLHLHGEKSPLKDIIEAQRSSLHRSSTSRLPSITLSLSI

SEQ ID NO: 128183 - protein, 66 aa, Glycine max
  Coding DNA Sequence Number=SeqID_11405
  Gene Ontology: Mol. function=Rab GTPase activator activity; Cellular component=intracellular; Biological process=regulation of Rab GTPase activity
  Homolog annotation: Hit_ID=Q6K986; Match level="QueryCoverage=88%, HitCoverage=13%, E-value=2e-21, Identity=79%"; Hit description =Putative GTPase activating protein
MGVQSQLATLSQIMKTVDPKLHHHLEDLDGGEYLFAFRMLMVLFRREFSFADTLYLWEVRTIPMTI

SEQ ID NO: 128184 - protein, 111 aa, Glycine max
  Coding DNA Sequence Number=SeqID_11406
  Gene Ontology: Mol. function=ribonuclease H activity; Biological process=DNA integration
NAFDKKVRPHKLNEGDLVLKKISHAVKDNRGKWAPNYEGPFVVKRAFSGGALVLTNIDGEELPSPGQNRLRQRSDVETKLKGHDRWIVVPCPTLDKRKALPQASPVSFKFP

SEQ ID NO: 128185 - protein, 83 aa, Glycine max
  Coding DNA Sequence Number=SeqID_11407
MKDKCNHPGKSQVYGYEEQVKKSGGKIDRQNNCKDGGRSEFPSSRENVLNLEARSSGRDFYKHNPLNYFKDAVLKRMQCYKIK

SEQ ID NO: 128186 - protein, 127 aa, Glycine max
  Coding DNA Sequence Number=SeqID_11408
MNMNTKIDKLASEMKSSDKVIVNILWVVSDVVIEDLKCRSHSLALRNGSTPHSHSPHYLILDYEIRQLDHTTGNRAHTDGEVPELLLFSSFPLFPTTKHECSLAEENGDRVTNSPKLNPKNLRSLGQ

SEQ ID NO: 128187 - protein, 51 aa, Glycine max
  Coding DNA Sequence Number=SeqID_11409
MSPAVCKVGVDVLKVPLYKLCFHLKRKSGTYILLCLCSVSNSKTFVGGCEN

SEQ ID NO: 128188 - protein, 102 aa, Glycine max
  Coding DNA Sequence Number=SeqID_11410
MISSGSISGRTHTFLLHTPNSYDHNVCPTHLKVERVHRNLSGANIQVRTITHTHTHNQDPIIVEGGESGSKGEGLVLDLVGDNRGLIGGHYVVVLGEDKGGG

SEQ ID NO: 128189 - protein, 116 aa, Glycine max
  Coding DNA Sequence Number=SeqID_11411
  Homolog annotation: Hit_ID=UPI00005DC1F3; Match level="QueryCoverage =81%, HitCoverage=9%, E-value=8e-09, Identity=46%"; Hit description =EMB1427; tubulin binding
MQRTECMLVISPRKGFTIGSINLSMQPHVSNWWQLHLIKSIETAVPKSPPTLNAFACFALACLKGLQNIALKEEASTSNVDGVTTPTLLGLANSLSRFLLTLTIFSCTIPVYLCLV

SEQ ID NO: 128190 - protein, 229 aa, Glycine max
  Coding DNA Sequence Number=SeqID_11412
  Gene Ontology: Mol. function=protein serine/threonine kinase activity; Biological process=protein amino acid phosphorylation
  Homolog annotation: Hit_ID=Q40543; Match level="QueryCoverage=30%, HitCoverage=16%, E-value=2e-19, Identity=69%"; Hit description =Protein-serine/threonine kinase
MGKDYISTHTPGFERIILWVSFLYRIPTSSNFVESLKWPYLTNYLNQLRSHQNKDGFASVSGILKYSYKEIQKATQNFTNALGEGSFGTFYKAMMPTGEVVAMKMLGPNSKQGEKEFQTEAVPPVVHRDLKSANILLDHSMRAKVLICNFQVRREGRNKRITATKLEEGKSKPTAAAKQYEGCEAQSSNNRSLKNQGKLPNKKRDITKHAQPPKKRDASLVAKLEEECS

SEQ ID NO: 128191 - protein, 66 aa, Glycine max
  Coding DNA Sequence Number=SeqID_11413
METPEESAKKSSKVRLDGGESQTEKTNHKNHNPVATSITNKTSKTLISWVAEGTPIRIDFDRIHRR

SEQ ID NO: 128192 - protein, 92 aa, Glycine max
  Coding DNA Sequence Number=SeqID_11414
MARIPDKIKSIDGSKETLKLAVRITDLWFVGTPNKSEQVEMVFVDSEFLSYLNERGNDGLMVIILTHARVKDAQDNFWRCIFPHLQEVIQLQ

SEQ ID NO: 128193 - protein, 205 aa, Glycine max
  Coding DNA Sequence Number=SeqID_11415
  Gene Ontology: Mol. function=transcription regulator activity; Cellular component=nucleus; Biological process=regulation of transcription
  Pfam annotation: Domain name=HLH; Domain location=37-80; Score=15.2; E_value=0.0035; Accession=PF00010.16; Description=Helix-loop-helix DNA-binding domain
MEYEDEDWLCVTMDEFSLATENGCNRKRNFDDDTKEYKSKNLETERRRREKLSSRLLMLRSIMNKAMIVEDAITYIEKLQDKVQSLSQELHQMEATSEETAETKIVEIDAAEDMKNWGIQFLQEEVIVEEINENKLWVKIIVEKKRGRFSRLMEALNNFGIELIDTNLTTTKGAFLITSFIKGKNGERLEIHQTKNLLQDIINDI

SEQ ID NO: 128194 - protein, 102 aa, Glycine max
  Coding DNA Sequence Number=SeqID_11416
MEYQDEDQLCFTMEEFSVVATENVSSRQRMSRKRNYDDDTRVYKSKNLEIEGRRREKLSASLLMLRGTIIVDAITYIEKLQYEVQRLSQELHQLEANSEKTA

SEQ ID NO: 128195 - protein, 94 aa, Glycine max
  Coding DNA Sequence Number=SeqID_11417
  Pfam annotation: Domain name=DUF1723; Domain location=15-64; Score =15.6; E_value=0.0073; Accession=PF08330.1; Description=Protein of unknown function (DUF1723)
MANKLLNHEKNILPITSTDLLVSILGFWPMTINGLVLPEAMVGPTLHDVAAILNLPIYGEELPPLYKTCCSTTANTFSIKFTKDDFVLDQVASE

SEQ ID NO: 128196 - protein, 333 aa, Glycine max
  Coding DNA Sequence Number=SeqID_11418
  Gene Ontology: Mol. function=RNA-directed DNA polymerase activity; Cellular component=riboflavin synthase complex; Biological process =RNA-dependent DNA replication
MVCAMTIIAQRQHHEVRQRLEKLVREQHDGGGARAMVAAAKYVDWLSNIVPIIKKNDKVEVYMDFIKLNLAILKDEYAMPIADMLVDFAVSNGILTFMDDYSSHNQIFIAKEDVHKIAFRTMEVYIHDIVFKLATFDQHLLNLEHAFKRMRLHGLKMNREKCAFGITTLANFLAQYSWEDPLDPFDRQITYMGVKPWIMSFDESKMRSAIGGEYESLVMGLKILLAKYGKSIKILGDSQLKQEVNELAQHASKYKELQVEELEYDWLNMVVQDTTTTNKDGRHKLIDYLEQLLAKQASHSNSLLGVDLYRRMANDLLLKCASTNRIPETITAD

SEQ ID NO: 128197 - protein, 175 aa, Glycine max
  Coding DNA Sequence Number=SeqID_11419
MPSLSTHGAQWAERMGTSRQRGTLNTSVKLANSILIRRKPSILDDTVQPLEKQEICPRHSSLAISIGSCQYSPFEELAAIANPNIINKIERKASKANITAQFAFIEEKRHADLELQARTSAQVKLQDQLTTIQKKISTLQPVLGEAVTRVNNYNDKRVEFYEQGNQLIRISPTRF

SEQ ID NO: 128198 - protein, 85 aa, Glycine max
  Coding DNA Sequence Number=SeqID_11420
MCKRDNESFKEYAQRWRNLAAQVAPPMMEREMITMIVDTLSVFYYEKMVGYMPSSFANLEFAGERIEVGLRKGKFDYAALKKPML

SEQ ID NO: 128199 - protein, 159 aa, Glycine max
  Coding DNA Sequence Number=SeqID_11421
  Gene Ontology: Mol. function=DNA binding
  Homolog annotation: Hit_ID=Q1SP03; Match level="QueryCoverage=83%, HitCoverage=23%, E-value=2e-12, Identity=34%"; Hit description=IMP dehydrogenase/GMP reductase
MGTNQTGKRFYQVKIKGLDITSIKELGQLMGPLQMQAFRKTYGKILDLTIAEISTEAIASLTQYYDQPLRCFTFGDFQLVPTVEEFEEILGCPLGGRKPYLFSGFLPSLSKIAVVVKDSARGLDRVKQTRNGIVGLPRKYLEGKARDMANQEEWVPFMD

SEQ ID NO: 128200 - protein, 75 aa, Glycine max
  Coding DNA Sequence Number=SeqID_11422
  Homolog annotation: Hit_ID=Q1SLE1; Match level="QueryCoverage=90%, HitCoverage=11%, E-value=3e-11, Identity=55%"; Hit description =Myosin II heavy chain-like
MAEVPGDGGATLSVSGSFKEGRGSARRRGGGGGVRPPSMDADEFMNLLHGSDPVKVELNRLENEVRGKKNAARSE

SEQ ID NO: 128201 - protein, 345 aa, Glycine max
  Coding DNA Sequence Number=SeqID_11423
  Gene Ontology: Mol. function=protein serine/threonine kinase activity
  Homolog annotation: Hit_ID=Q1T6P2; Match level="QueryCoverage=43%, HitCoverage=37%, E-value=4e-12, Identity=32%"; Hit description =Stress protein DDR48 , related
MAYYSSAYSGSENYGEYNFNSYALNYDYAQIPSYMAYTSYEYNQNQPYYGYDSSLYYAPNYPAETYQTQTTSYSATTYSDPKSVVYVPNNGMSQLVISYSKAEFNVPEFDDYDPTPYGGGYDIDQTYGKALPPSDKICYPRSGSSPITEPQPLFSGPIVPLPTIEEGIEEKPITPQNGAIIQTKTEEKPQSQDSGKDHPKEVEDNNFDTESEGSDDHEDDNYSESGIDEGYNGGQGYDEHEKQVVPVVPQYPSGYGLEAMDICESLFGYWPCLDRMKKKRECCCEEVSYRGNNCQENMWQGTADYLFGSPNPYGGSGYGGDVVYGYQRHHPMQAQYKQIDYTDGS

SEQ ID NO: 128202 - protein, 54 aa, Glycine max
  Coding DNA Sequence Number=SeqID_11424
MDRQEQFKLLFVGQLEFSTWIVGSPHLALSAFRSRAGRTMHAGLVLLLDHALCA

SEQ ID NO: 128203 - protein, 68 aa, Glycine max
  Coding DNA Sequence Number=SeqID_11425
  Gene Ontology: Mol. function=electron transporter, transferring electrons within the cyclic electron transport pathway of photosynthesis activity; Cellular component=integral to membrane; Biological process=...
  Gene Ontology: Biological process=photosynthetic electron transport in cytochrome b6/f
  Homolog annotation: Hit_ID=Q6EW21; Match level="QueryCoverage=98%, HitCoverage=61%, E-value=2e-10, Identity=46%"; Hit description =Cytochrome b6-f complex subunit 4
  Subcellular localization annotation: CTP_CleavageSite=52; ConfidenceScore=5.05e-01
MVVATCRQNGFWNLLTFFKKGIVNTETLKRTPNNLLGVANESTTGPQSWMVLGSGTAKPTILGHAGSS

SEQ ID NO: 128204 - protein, 71 aa, Glycine max
  Coding DNA Sequence Number=SeqID_11426
MDDWRIPEIPQDTLYVPETIKDKHSFDYVIKMVENNIPLGQDIGKEFHLLSKNPIYEHSKKYKYLHIGCVL

SEQ ID NO: 128205 - protein, 325 aa, Glycine max
  Coding DNA Sequence Number=SeqID_11427
  Gene Ontology: Mol. function=transcription regulator activity; Cellular component=nucleus; Biological process=regulation of transcription
  Homolog annotation: Hit_ID=Q9LHQ8; Match level="QueryCoverage=68%, HitCoverage=42%, E-value=8e-48, Identity=50%"; Hit description =Arabidopsis thaliana genomic DNA, chromosome 3, BAC clone: F3H11
  Pfam annotation: Domain name=HLH; Domain location=214-252; Score=6.7; E_value=0.028; Accession=PF00010.16; Description=Helix-loop-helix DNA- binding domain
GSGFDSVLQEETGIGGGSQVSTVDALKPMNQEFSLDQQSLNSVVTSTGSLSGGFPVVSASYGYPSTLIQSLYEPEPQPQQQNSLFTNPSMSYSSSSANYGICSNELSPTWSKVSSLPKPSMPKQQLSGLHFSNNTAFWNSSAEALNDIRAGVFTSSQAQYQTAKFEEKPNCPNTLLNKLKREESPDAAKKNSPEPAFKRQRIETPSPLPTFKVRKEKLGDRITALQQLVSPFGKTDTASVLHEAIEYIKFLHDQVSVLSTPYMKNNGAPIQHQQDCDNLKDSEGAKQDLRSRGLCLVPISSTFPVANETSVDFWTSTFGGALIGR

SEQ ID NO: 128206 - protein, 825 aa, Glycine max
  Coding DNA Sequence Number=SeqID_11428
  Gene Ontology: Mol. function=protein serine/threonine kinase activity; Cellular component=membrane; Biological process=protein amino acid phosphorylation
  Homolog annotation: Hit_ID=Q9S971; Match level="QueryCoverage=94%, HitCoverage=94%, E-value=0.0, Identity=48%"; Hit description=ARK3 product/receptor-like serine/threonine protein kinase ARK3
  Pfam annotation: Domain name=B_lectin; Domain location=74-184; Score =144.1; E_value=3.8e-40; Accession=PF01453.15; Description=D-mannose binding lectin
  Pfam annotation: Domain name=PAN_2; Domain location=331-405; Score =82.2; E_value=1.7e-21; Accession=PF08276.2; Description=PAN-like domain
  Pfam annotation: Domain name=Pkinase; Domain location=507-778; Score =169.3; E_value=1e-47; Accession=PF00069.15; Description=Protein kinase domain
  Pfam annotation: Domain name=Pkinase_Tyr; Domain location=507-778; Score=175.4; E_value=1.4e-49; Accession=PF07714.7; Description =Protein tyrosine kinase
  Pfam annotation: Domain name=S_locus_glycop; Domain location=198-322; Score=162.7; E_value=9.7e-46; Accession=PF00954.11; Description=S -locus glycoprotein family
  Pfam module annotation: Pfam domain module=B_lectin::PAN _2::Pkinase::Pkinase_Tyr::S_locus_glycop; Domain location=74-184::331- 405::507-778::507-778::198-322
MERTEFTLLFLVTCCYLLSLFPTALEAEDAITPPQTISGYQTLVSPSQNFELGFFSPGNSTHIYLGIWYKHIPKQTVIWVANRDKPLVNSGGSLTFSNNGKLILLSHTGSVVWSSNSSGPARNPVAHLLDSGNFVLKDYGNEGHLWESFDYPSDTLIPGMKLGWNFKTGLNRHLTSWKSSSNPSSGEYTYGVDPRGIPQLFLHKGNKKVFRSGPWYGQQFKGDPVLSANPVFKPIFVFDSDEVSYSYETKDTIVSRFVLSQSGLIQHFSWNDHHSSWFSEFSVQGDRCDDYGLCGAYGSCNIKSSPVCKCLKGFDPKLPQEWEKNEWSGGCVRKNSQVFSNGDTFKQFTGMKLPDAAEFHTNYTISSDHCEAECSMNCSCVAYAKLDVNASGKGCIVWFGDLFDIREVSVNGEDFYVRVPASEVGKKIKGPNVDGNKRKKLILFPVTAFVSSTIIVSALWLIIKKCRRKRAKETDSQFSVGRARSERNEFKLPLFEIAIIEAATENFSLYNKIGEGGFGHVYKGQLPSGQEIAVKRLSENSGQGLQEFKNEVILISQLQHRNLVKLLGCCIHGEDKMLVYEYMPNRSLDSLLFDETKRSVLSWQKRLDIIIGIARGLLYLHRDSRLRIIHRDLKASNVLLDGEMNPKISDFGMARMFGGDQTEAKTKRIVGTYGYMSPEYAIDGHFSFKSDVYSFGVLLLELLSGKKNKGFIHPDHKLNLLGHAWKLWNEDRALELMDALLENQFPTSEALRCIQVGLSCIQQHPEDRPTMSSVLLMFDSESVLVPQPGRPGLYSERFFSGTNSSSRGGLNSGSNDITVTLVEGR

SEQ ID NO: 128207 - protein, 44 aa, Glycine max
  Coding DNA Sequence Number=SeqID_11429
MAYAADALTPTSSINDGQELISAGQNFSLGFFTPGISKSRYVGI

SEQ ID NO: 128208 - protein, 442 aa, Glycine max
  Coding DNA Sequence Number=SeqID_11430
  Gene Ontology: Mol. function=protein serine/threonine kinase activity; Cellular component=membrane; Biological process=protein amino acid phosphorylation
  Homolog annotation: Hit_ID=Q70I30; Match level="QueryCoverage=84%, HitCoverage=61%, E-value=8e-65, Identity=36%"; Hit description=S -receptor kinase-like protein 1
  Pfam annotation: Domain name=PAN_2; Domain location=99-165; Score =86.6; E_value=7.6e-23; Accession=PF08276.2; Description=PAN-like domain
  Pfam annotation: Domain name=Pkinase; Domain location=197-441; Score=- 74.6; E_value=0.00041; Accession=PF00069.15; Description=Protein kinase domain
  Pfam annotation: Domain name=Pkinase_Tyr; Domain location=197-372; Score=-57.8; E_value=6.4e-09; Accession=PF07714.7; Description =Protein tyrosine kinase
  Pfam annotation: Domain name=S_locus_glycop; Domain location=1-82; Score=12.9; E_value=4.2e-06; Accession=PF00954.11; Description=S -locus glycoprotein family
  Pfam module annotation: Pfam domain module=PAN_2::Pkinase::Pkinase _Tyr::S_locus_glycop; Domain location=99-165::197-441::197-372::1-82
TEALYWDEPGDRLSRFVMKDDGMLQRYIWDNKVLKWIEMYEARKDFCDDYGACGVNGICNIKDVPVYCDCLKGFKPKSQEEWNSFNRSGGCIRRTPLNCTQGDRFQKLSAIKLPKLLQFWTNNSMNLEECKVECLKNCSCTAYANSAMNEGPHGCFLWFGDLIDIRKLINEEAGQLDLYIKLAASEIDTILAATNNFSTANKIGEGGFGPVYRGKLADGQEIAVKRLSKTSKQGISEFMNEVGLVAKLQHRNLVSILGGCTQGDERIGYMSPEYAANGLLSLKSDVFSFGVIVLEILSGIRNNNFYHSDHERNLLVQAWRLWKEGRAVEFMDANLDLATIRSELLRCLQVGLLCVQKLPKDRPTMSSVVFMLSNESITLAQPKKPEFIEEGLEFPGEPDLDERKSIVVVPQGFVFLDIPVLKDLPSTLRISGTPMLFSAHFK

SEQ ID NO: 128209 - protein, 423 aa, Glycine max
  Coding DNA Sequence Number=SeqID_11431
  Gene Ontology: Mol. function=sugar binding; Cellular component =membrane; Biological process=protein amino acid phosphorylation
  Homolog annotation: Hit_ID=Q40100; Match level="QueryCoverage=96%, HitCoverage=97%, E-value=1e-83, Identity=37%"; Hit description =Secreted glycoprotein 3
  Pfam annotation: Domain name=B_lectin; Domain location=76-166; Score =96.5; E_value=8.1e-26; Accession=PF01453.15; Description=D-mannose binding lectin
  Pfam annotation: Domain name=PAN_2; Domain location=322-388; Score =79.2; E_value=1.3e-20; Accession=PF08276.2; Description=PAN-like domain
  Pfam annotation: Domain name=S_locus_glycop; Domain location=180-305; Score=79.9; E_value=7.7e-21; Accession=PF00954.11; Description=S -locus glycoprotein family
  Pfam module annotation: Pfam domain module=B_lectin::PAN_2::S_locus _glycop; Domain location=76-166::322-388::180-305
MKRGMRMNKVVTIIFALVCQPILQKASYAGAALTQTSSITDGQELISARQIFSLGFFTPRRSSSRYIGIWYKNVKPQTVVWVANRDNPLNDISGNLTIAADGNIVLFDGAGNLVLMDAKHCDSDTYIWQSFDYPTDTMLPGMKLGWDKTSDLNRCLTSWKTAKDPSPGSFTYSFLHIEFPEFLIRQGMDITFRSGIWDGTRFNSDDWLFNEITAFRPHISVSSNEVVYWDEPGDRLSRFVMRGDGLLQRYIWDNKTLMWIEMYEIRKDFCDNYGVCGVNGVCNIEDVPVYCDCLKGFIPCSQEEWDSFNRSGGCIRRTPLNCTQDDGFQKLSWVKLPMPLQFCTNNSMSIEECRVECLKNCSCTAYANSAMNGGPHGCLLWFGDLIDIRQLINEKGEQLDLYVRLAASEIGMHGFCFNMACNV

SEQ ID NO: 128210 - protein, 84 aa, Glycine max
  Coding DNA Sequence Number=SeqID_11432
  Gene Ontology: Mol. function=nucleic acid binding; Biological process= DNA integration
MLDQYERNPGIEHWKATKKVLRCLQGVVSWRSAKQSMFVTSTMEVDFEATIQALWLWNFTSRFGIANNIAELLRIYCDNSATIF

SEQ ID NO: 128211 - protein, 127 aa, Glycine max
  Coding DNA Sequence Number=SeqID_11433
MVNPRKIYQSPFPRWYNPNATCAYQSGVPGNFIEQCVAVKHKIGDVLTSRRFILEALREAGMIRLDGDKGDSCLMHPRASHVSQRALSRASEGEAHGCTFQRRKDARSRHQRLFVGNVGKTKGNRSK

SEQ ID NO: 128212 - protein, 373 aa, Glycine max
  Coding DNA Sequence Number=SeqID_11434
  Gene Ontology: Mol. function=NADH kinase activity; Cellular component= chloroplast; Biological process=metabolic process
  Homolog annotation: Hit_ID=Q56YN3; Match level="QueryCoverage=96%, HitCoverage=95%, E-value=1e-108, Identity=69%"; Hit description =NAD(H) kinase 1
  Pfam annotation: Domain name=NAD_kinase; Domain location=47-342; Score=82.9; E_value=1e-21; Accession=PF01513.11; Description=ATP-NAD kinase
GNTSMPCSQAENGFVNSFSLFPEKVVQELLQSPVQGSDDHLIEFSEALRTVAKALRLVAEGKASAQAEAAEWKRKYELERDRNLKFEHAEKSCIEHQAEHEDVRTNNPAKQPVLCNEANGQSEKCCSRNGICSHEVLRDGTPGSDSKMVKKAASMFKGPVPPIVPFSLGSLGFMTPFCILQPGPISITLRHRLQCHVIRDAAKNEYETEEPILVLNEVTIDRGISSFLTNLECYCDNSFVTCVQGDGLILSTTSGSTAYSLAAGGSMVHPQVPGILFTPICPHSLSFRPLIFPEHVTLRVQVPFNSRSPAWASFDGKDRKQLAPGDALVCSMAPWPVPTACLDDSTNDFLRSIHEGLHWNLRKTQSFDGPRET

SEQ ID NO: 128213 - protein, 387 aa, Glycine max
  Coding DNA Sequence Number=SeqID_11435
  Gene Ontology: Mol. function=DNA binding; Biological process=DNA integration
  Homolog annotation: Hit_ID=Q1S785; Match level="QueryCoverage=52%, HitCoverage=30%, E-value=3e-36, Identity=40%"; Hit description =Integrase, catalytic region
MTLKDLDSMSLEELFDTLKVHEQELQQDEGLKKEKSLALSSQKIKKVSSSIEQNLPSNEEKANLCLMAETTSQESELDQEDEVNIDDPESLIKAYHELLSISSILAKAYKNLRKDFKKMSKDHKELEKTLQDKVDASLDESTQICDAHETFKEKESKLCLENETIAKEKCTPLKNFQELENTLKDNLGKFDSKSDNGTLLGYSKTSKAFKVYNSRTSVVEKVIHEKFNENEPEKDLSELDNSILDLRLDNGIKEKVSSSQSFEVGVSTQHLDNPQEETRESNRRIMRRNHLKSQTIELLKGKKAIGAKWIFYKKLDENCKVMRNKARLVAKGNMKLYQRDAKSAFLNGLMQEEVYVEQPPGLESDTFPHHILKLDKALYGLKQDPRA

SEQ ID NO: 128214 - protein, 89 aa, Glycine max
  Coding DNA Sequence Number=SeqID_11436
  Gene Ontology: Mol. function=RNA-directed DNA polymerase activity; Biological process=DNA integration
MKTPVHPTTYLGLDEESTKLNAFLEIGTSNLGLWFKRREDFRLMSFCGADYAGDKVERKSTSGSYHFIGGNLVTWICKKQGSIVLSVTP

SEQ ID NO: 128215 - protein, 112 aa, Glycine max
  Coding DNA Sequence Number=SeqID_11437
MDDFLGSFQKSMCVRKKYAKKSCVGWWDHSLIMEADKCHSVRAANKSKIWDVIDVAPRGACRPWIFFINGVLCFLKIIVAEWRRKKDDWRRHFKEKMSQAQAHHHRKPWIRA

SEQ ID NO: 128216 - protein, 850 aa, Glycine max
  Coding DNA Sequence Number=SeqID_11438
  Gene Ontology: Mol. function=protein serine/threonine kinase activity; Cellular component=membrane; Biological process=protein amino acid phosphorylation
  Homolog annotation: Hit_ID=Q40096; Match level="QueryCoverage=97%, HitCoverage=97%, E-value=0.0, Identity=54%"; Hit description =Receptor protein kinase
  Pfam annotation: Domain name=B_lectin; Domain location=70-188; Score =144.4; E_value=3e-40; Accession=PF01453.15; Description=D-mannose binding lectin
  Pfam annotation: Domain name=PAN_2; Domain location=345-410; Score =122.6; E_value=1.1e-33; Accession=PF08276.2; Description=PAN-like domain
  Pfam annotation: Domain name=Pkinase; Domain location=531-802; Score =161.4; E_value=2.3e-45; Accession=PF00069.15; Description=Protein kinase domain
  Pfam annotation: Domain name=Pkinase_Tyr; Domain location=531-802; Score=145.0; E_value=2e-40; Accession=PF07714.7; Description=Protein tyrosine kinase
  Pfam annotation: Domain name=S_locus_glycop; Domain location=202-328; Score=205.2; E_value=1.5e-58; Accession=PF00954.11; Description=S -locus glycoprotein family
  Pfam module annotation: Pfam domain module=B_lectin::PAN _2::Pkinase::Pkinase_Tyr::S_locus_glycop; Domain location=70-188::345- 410::531-802::531-802::202-328
  Subcellular localization annotation: CTP_CleavageSite=24; ConfidenceScore=5.45e-01
MPGFLFFLFCFFLASSQHITISFSADTLTSTQILLTNQTLISPSQVFALGFFPGTNSTWYLGTWYNNINDRTIVWVANRDNPLENSNGFLTIAENGNIVLTNPSMKKYPVWSSNATTKANNNNRVLQLLDTGNLVLREANITDPTKYLWQSFDYPTDTLLPGMKMGWNLDTGVEKHLTSWKATGSDPSSGDYSFKIDTRGIPEIFLRDDQNITYRSGPWNGERFSGVPEMQPNTDTITFDFSYDKDGVYYLFSIGSRSILSRLVLTSGGELQRLTWVPSRNTWTKFWYARKDQCDGYRECGPYGLCDSNASPVCTCVGGFRPRNLQAWNLRDGSDGCVRNTDLDCGRDKFLHLENVKLPETTYVFANRTMNLRECEDLCRKNCSCTAYANIEITNGGSGCVTWTGELIDMRLYPAGGQDLYVRLAASDVDDIGSGGGSHKKNHIGEVVGITISAAVIILGLVVIFWKKRKLLSISNVKAGPRGSFQRSRDLLTTVQRKFSTNRKNSGERNMDDIELPMFDFNTITMATDNFSEANKLGQGGFGIVYRGRLMEGQDIAVKRLSKSSMQGVEEFKNEIKLIVRLQHRNLVRLFGCCIEMHERLLVYEYMENRSLDSILFDKAKKPILDWKRRFNIICGIARGLLYLHHDSRFRIIHRDLKASNILLDSEMNPKISDFGMARLFGSNQTEANTSRVVGTYGYMSPEYAMDGNFSVKSDVFSFGVLVLEIITGKKNRGFYYSNEDMNLLGNAWRQWRDGSALELIDSSTGDSYSPSEVLRCIHVGLLCVQERAEDRPTMSSVLLMLSSESVLMPQPRNPGFSIGKNPAETDSSSSKKDESWSVNQVTVTLLDAR

SEQ ID NO: 128217 - protein, 343 aa, Glycine max
  Coding DNA Sequence Number=SeqID_11439
  Gene Ontology: Mol. function=protein serine/threonine kinase activity; Cellular component=membrane; Biological process=protein amino acid phosphorylation
  Homolog annotation: Hit_ID=Q7XJ40; Match level="QueryCoverage=75%, HitCoverage=37%, E-value=2e-69, Identity=47%"; Hit description =Receptor-like protein kinase ARK1
  Pfam annotation: Domain name=Pkinase; Domain location=9-220; Score =26.4; E_value=3.9e-10; Accession=PF00069.15; Description=Protein kinase domain
  Pfam annotation: Domain name=Pkinase_Tyr; Domain location=9-220; Score=0.5; E_value=1.7e-12; Accession=PF07714.7; Description=Protein tyrosine kinase
  Pfam module annotation: Pfam domain module=Pkinase::Pkinase_Tyr; Domain location=9-220::9-220
IILAATNNFSIENKIGEGGFGPVYRGKLSSRQEIAVKRLSKTSKQGISEFMNEVGLVAKFQHRNLDSNLTIIHRDLKTSNILLDKEFNPKISDFGLAHIFEGDHSTVTTKRIVGTVGYMSPEYAVNGLLSLKSDVFSFGVIVLEILSGIKNNNFNHPDDSNLLGQAWRLWIEGRAVEFMDVNLNLAAIPSEILRCLHVGLLCVQKLPKDRPTMSSVVFMLSNESITLAQPKQPGFFEEVLQSQGCNNKESFSNNSLTITQLEAEQERSRLTNCDLQHNFFTAKAPSRYPPPLFHVLVLIVMKQRSAHHDDGETQNSIKIKKNETQIDSEKTRQKVVRRNCVCK

SEQ ID NO: 128218 - protein, 367 aa, Glycine max
  Coding DNA Sequence Number=SeqID_11440
  Gene Ontology: Mol. function=protein serine/threonine kinase activity; Cellular component=membrane; Biological process=protein amino acid phosphorylation
  Homolog annotation: Hit_ID=Q2HTU4; Match level="QueryCoverage=86%, HitCoverage=37%, E-value=1e-105, Identity=59%"; Hit description =Protein kinase; S-locus glycoprotein; Curculin-like (Mannose -binding) lectin; Apple-like
  Pfam annotation: Domain name=B_lectin; Domain location=75-184; Score =93.2; E_value=8e-25; Accession=PF01453.15; Description=D-mannose binding lectin
  Pfam annotation: Domain name=S_locus_glycop; Domain location=198-329; Score=132.4; E_value=1.3e-36; Accession=PF00954.11; Description=S -locus glycoprotein family
  Pfam module annotation: Pfam domain module=B_lectin::S_locus_glycop; Domain location=75-184::198-329
  Subcellular localization annotation: CTP_CleavageSite=21; ConfidenceScore=5.05e-01
MAAAMMISFYLFLFSFHNLFSLAASSKIRITQGVTIRDKEHETLVSEELNFAMGFFSFDNSSSRYVGIWYDNIPGSEVIWVANRDKPINGTVGAITIANDGNLVVLDGAMNHVWSTNVSIDDNNKNSSATLRDDGNLVLTCERKEVWQSFENPTDTYMPGMKVSVGGLSTSHVFTSWKSATDPSKGNYTMGVDPEGLPQIVVWEGEKRRWRSGYWDGRMFQGLSIAASYLYGFTLNGDGKGGRYFIYNPLNGTDKVRFQIGWDGYEREFRWNEDEKSWNEIQKGPFHECDVYNKCGSFAACDVLTLSPEDLVPVCTCIRGFEPKHKDQWDKGNWSGGCTRMTPLKAQRINVTSRDWRQVLERMGPWI

SEQ ID NO: 128219 - protein, 823 aa, Glycine max
  Coding DNA Sequence Number=SeqID_11441
  Gene Ontology: Mol. function=protein serine/threonine kinase activity; Cellular component=membrane; Biological process=protein amino acid phosphorylation
  Homolog annotation: Hit_ID=Q1SF47; Match level="QueryCoverage=95%, HitCoverage=94%, E-value=0.0, Identity=52%"; Hit description=Protein kinase; EGF-like, subtype 2; S-locus glycoprotein; Curculin- like (Mannose-binding) lectin; Apple-like
  Pfam annotation: Domain name=B_lectin; Domain location=71-181; Score =101.3; E_value=3e-27; Accession=PF01453.15; Description=D-mannose binding lectin
  Pfam annotation: Domain name=PAN_1; Domain location=336-415; Score =3.9; E_value=0.065; Accession=PF00024.16; Description=PAN domain
  Pfam annotation: Domain name=PAN_2; Domain location=336-400; Score =90.8; E_value=4e-24; Accession=PF08276.2; Description=PAN-like domain
  Pfam annotation: Domain name=Pkinase; Domain location=505-776; Score =150.1; E_value=5.9e-42; Accession=PF00069.15; Description=Protein kinase domain
  Pfam annotation: Domain name=Pkinase_Tyr; Domain location=505-776; Score=143.9; E_value=4.3e-40; Accession=PF07714.7; Description =Protein tyrosine kinase
  Pfam annotation: Domain name=RIO1; Domain location=518-662; Score= -95.8; E_value=0.065; Accession=PF01163.12; Description=RIO1 family
  Pfam annotation: Domain name=S_locus_glycop; Domain location=195-319; Score=107.8; E_value=3.1e-29; Accession=PF00954.11; Description=S -locus glycoprotein family
  Pfam module annotation: Pfam domain module=B_lectin::PAN_1::PAN _2::Pkinase::Pkinase_Tyr::RIO1::S_locus_glycop; Domain location=71 -181::336-415::336-400::505-776::505-776::518-662::195-319
MGFSTGGNTLPVFLILSNFYMNWVTALDIITVSRLMKDPETVTSNDGAFKLGFFSPGNTSNRYVGIWYLSESNVIWVANRGQPLEDSSGVVTISDDRNLVVLNGRKQVVWSSNVSNIESNSTAQLLNTGNLVLLDNITGKTIWESFKHPSNTFTPNMIISTNQVTGEKVKVTSWKSLSDPAIGTFSGSLERLSVPEVFVWNQTQPCSGPWNGQVFIGLATMYTSAYLNGFSVERENSVTVQITYTLPNDSFFGTIFLSPEGRMVYTSWINRQLVGKRVIQQSNCDIYGFCGAYGSCDSNKLPIICSCLRGFEPRNREEWNRQNWTSGCVRREALQCKRSGASKEDGFVKLQMSKVPDFAHQSSVSVDTCRTECLNNCSCTAYAYDAAIGCMSWSGELIDIVRFSRGGVDLYIRQAHSELDVGRNMTSIIIVTVIVGTLLVATCAYFLWTWTSKSSARMESQPSLVLRETPPENRNAGLSGDLNQVKIQDLPVFNFENIATATNYFNLANKLGQGGFGSVYKGVLQDGQEVAVKRLSRTSRQGTEEFMNEVTVISKLQHRNLVRLLGCCIEGEEKMLIFEYMPNKSLDFYLFDPVKKVVLDWQKRFNIIEGISRGSLYLHRDSRLRIIHRDLKPSNILLDGELNPKISDFGMAKIFGGSEDEANTRRVVGTYGYMSPEYAMEGLFSEKSDVFSFGVLLLEIISGRKNSSFRNHELSLSLLGYAWKLWNEEEIVSLVDPEIFSPDNVYHTLRCIHIGLLCVQELAKERPTMATVVSMLNSEIVNFPPPQQPAFIQRQIELRGESSQQSHNSNSINNVTVTNLQGR

SEQ ID NO: 128220 - protein, 57 aa, Glycine max
  Coding DNA Sequence Number=SeqID_11442
  Subcellular localization annotation: CTP_CleavageSite=49; ConfidenceScore=5.38e-01
SSNAVYGLFECRDTSSTTNTLAMCHLWSPSSTTSVSPLAATHCSLTTVSSSMTMRPL

SEQ ID NO: 128221 - protein, 1501 aa, Glycine max
  Coding DNA Sequence Number=SeqID_11443
  Gene Ontology: Mol. function=protein serine/threonine kinase activity; Cellular component=membrane; Biological process=protein amino acid phosphorylation
  Homolog annotation: Hit_ID=Q1SF47; Match level="QueryCoverage=97%, HitCoverage=98%, E-value=0.0, Identity=50%"; Hit description=Protein kinase; EGF-like, subtype 2; S-locus glycoprotein; Curculin- like (Mannose-binding) lectin; Apple-like
  Pfam annotation: Domain name=B_lectin; Domain location=47-159; Score =112.4; E_value=1.3e-30; Accession=PF01453.15; Description=D-mannose binding lectin
  Pfam annotation: Domain name=B_lectin; Domain location=804-915; Score= 107.3; E_value=4.5e-29; Accession=PF01453.15; Description=D-mannose binding lectin
  Pfam annotation: Domain name=PAN_1; Domain location=329-397; Score =7.2; E_value=0.03; Accession=PF00024.16; Description=PAN domain
  Pfam annotation: Domain name=PAN_2; Domain location=1071-1139; Score =77.7; E_value=3.6e-20; Accession=PF08276.2; Description=PAN-like domain
  Pfam annotation: Domain name=PAN_2; Domain location=316-383; Score =89.1; E_value=1.3e-23; Accession=PF08276.2; Description=PAN-like domain
  Pfam annotation: Domain name=Pkinase; Domain location=1244-1454; Score=54.5; E_value=3.6e-13; Accession=PF00069.15; Description =Protein kinase domain
  Pfam annotation: Domain name=Pkinase; Domain location=438-687; Score =31.8; E_value=1.9e-10; Accession=PF00069.15; Description=Protein kinase domain
  Pfam annotation: Domain name=Pkinase_Tyr; Domain location=1244-1454; Score=46.8; E_value=2.4e-15; Accession=PF07714.7; Description =Protein tyrosine kinase
  Pfam annotation: Domain name=Pkinase_Tyr; Domain location=438-682; Score=22.0; E_value=8e-14; Accession=PF07714.7; Description=Protein tyrosine kinase
  Pfam annotation: Domain name=S_locus_glycop; Domain location=173-299; Score=101.6; E_value=2.4e-27; Accession=PF00954.11; Description=S -locus glycoprotein family
  Pfam annotation: Domain name=S_locus_glycop; Domain location=929 -1054; Score=123.8; E_value=4.8e-34; Accession=PF00954.11; Description=S-locus glycoprotein family
  Pfam module annotation: Pfam domain module=B_lectin::B_lectin::PAN _1::PAN_2::PAN_2::Pkinase::Pkinase::Pkinase_Tyr::Pkinase_Tyr::S_locus_ glycop::S_locus_glycop; Domain location=47-159::804-915::329 -397::1071-1139::...
  Pfam module annotation: Domain location=316-383::1244-1454::438 -687::1244-1454::438-682::173-299::929-1054
  Subcellular localization annotation: CTP_CleavageSite=79; ConfidenceScore=5.28e-01
SANNTITSGQYITDPHTLISPNSVFKLGFFSPQNSSNRYLGIWYLSDSNVIWVANRNQPLKTSSSGTVQISEDGNLVVLDSNKRVVWSSNVTHNIATNSTAKLLETGNLVLIDDATGESMWESFRHPCHALVPKMKLSITQKTYEKVRITSWRSPSDPSLGYYSATLERPNIPEVFYWINETQPYYRTGPWNGQIFIGSPQMSRGYLYGWNMMNDEDDGTVYLSYNLPSQSYFAVMTLNPQGHPTIEWWRDRKLVWREVLQGNSCDRYGHCGAFGSCNWQSSPICNCLSGYKPKYVEEWNRKNWTSGCVRSEPLQCGEQTNGSEVSKDGFLRLENMKVSDFVQRLDCLEDECRAQCLENCSCVAYAYDNGIGCMVWSGDLIDIQKFSSGGIDLYIRVPPSESELVGITIGMVALAGCVCLSRKWTAKSIELVNATNNFHSANELGKGGFGSVYKGQLKDGHEIAVKRLSKTSGQGLEECMNEVLVISRLQHRNLVRLLGCCIEQEENMLVYEYMPNKSLDVILFDPAKKQDLDWPKRFNIIEGISRELNPKISDFGMAKIFGGNDMQANTRRVVGTFGYMPPEYAFQGLVSEKLDVFGFGVLLLEIISGRKISSCFDHDQSLSLLGFAWKLWNEKDIQSLIDPEISNPNNVNDIVRCIHIGLLCSQELAKERPLMATVVSMLNSEIVDLPPPLNPAFIKRQIVSCADSSQQNHITQSINNVTVTGIQDTVTVLSTNIMGFLNALLIVFPIIFLGLTSATDTLTSSQSIRDSETVVTSNDSVFKLGFFSPQNSTHRYVGIWYLSDSNVIWIANRNKPLLDSSGVLKISKDGNLVLVDGKNHVIWSSNVSNTATITSTAQLSRSGNLVLKDDSTGQTLWESFKHPCDSAVPTMRISANRITGEKIRFVSRKSASDPSTGYFSASLERLDAPEVFLWINGTRPYWRTGPWNGRIFIGTPLMSTGYLYGWNVGYEGNETVYLTYSFADPSSFGILTLIPQGKLKLVRYYNRKHTLTLDLGISDCDVYGTCGAFGSCNGQNSPICSCLSGYEPRNQEEWSRQNWTSGCVRKVPLKCERFKNGSEDEQEDQFLKLETMKVPDFAERLDVEEGQCGTQCLQNCSCLAYAYDAGIGCLYWTRDLIDLQKFQTAGVDLYIRLARSEFQSSNAQEHTNKTRGKRLIIGITVATAGTIIFAICAYLAIRRFNSWKGTAKDSENQSQRVTEVQKPAKLDELPLFDFEVVANATDNFHLANTLGKGGFGPVYKGLLPDGQEIAVKRLAKASGQGLEEFMNEVGVISKLQHRNLVKLLGCCVEGDEKMLIYEFMPNKSLDAFIFDPLRQKLLDWTKRFNIIEGVARGLLYLHRDSRLKIIHRDLKASNILLDAEMNPKISDFGLARIYKGEDEAWNLWNEDNISFLVDPEISASGSENHIFRCIHIAFLCVQEVAKTRPTMTTVLSMLNSEISHLPPPRQVGFVQKQSSSSLESSSQENQFNSNNHVTLTEMQGR

SEQ ID NO: 128222 - protein, 294 aa, Glycine max
  Coding DNA Sequence Number=SeqID_11444
  Gene Ontology: Mol. function=cysteine-type peptidase activity; Cellular component=cellular_component; Biological process=ubiquitin cycle
  Homolog annotation: Hit_ID=Q8LG98; Match level="QueryCoverage=98%, HitCoverage=94%, E-value=1e-107, Identity=66%"; Hit description =Ubiquitin thioesterase otubain-like protein
MQSKEAVVEDGEIKSVTAVGSEIDGWTNFGDDDIMQQQYTIQSEEAKKEPLSSLAAEYKSGSPILLEKIKVLDEQYAAIRRTRGDGNCFFRSFMFSYLEHVMKCQDQAEVDRIQANVEKSRKALQTLGYADLTFEDFFALFLEQLESVIQGKETSISHEELVLRSRDQSVSDYVVMFFRFVTSAAIQKRTEFFEPFILGLTNTTVEQFCKSSVEPMGEESDHVHITALSDALGIPVRVVYLDRSSSDTGGVSVNHHDFMPVAGDLPNASCSSEKNIPFITLLYRPGHYDILYPK

SEQ ID NO: 128223 - protein, 95 aa, Glycine max
  Coding DNA Sequence Number=SeqID_11445
MEGKSDGLVDEKLTISGTDEGVTLSWKVRGTSCSVTNEVVDALMEWNNASWIGKRLRHLLCWFPSDKSSRGYIRHKSAKGSCRISKKRRNKGVKS

SEQ ID NO: 128224 - protein, 185 aa, Glycine max
  Coding DNA Sequence Number=SeqID_11446
  Homolog annotation: Hit_ID=O64568; Match level="QueryCoverage=54%, HitCoverage=98%, E-value=9e-33, Identity=68%"; Hit description =Expressed protein
  Pfam annotation: Domain name=DUF872; Domain location=68-185; Score =67.2; E_value=5.2e-17; Accession=PF05915.3; Description=Eukaryotic protein of unknown function (DUF872)
  Subcellular localization annotation: CTP_CleavageSite=71; ConfidenceScore=5.38e-01
MTKFFRFNPPRSVKDSLSNELGLDPESQSSNNLRFNTKLSLKQQAKAESSLPSSTTTVPTLFFFFLIETTSSVLRKQTTETATMYVDHAFSISDEDVMMGTSYTVNNKPPIKEIALAVSLLVCGVLGIVIGSLMAYNHVGGDTAHGIFFAILGFILFIPGFYYTRIAYYAYKGYKGFSFSNIPPV

SEQ ID NO: 128225 - protein, 131 aa, Glycine max
  Coding DNA Sequence Number=SeqID_11447
  Gene Ontology: Mol. function=protein disulfide oxidoreductase activity; Cellular component=cytoplasm; Biological process=cell redox homeostasis
  Homolog annotation: Hit_ID=Q8S3L1; Match level="QueryCoverage=61%, HitCoverage=58%, E-value=2e-29, Identity=75%"; Hit description =Glutaredoxin
  Pfam annotation: Domain name=Glutaredoxin; Domain location=44-102; Score=53.0; E_value=9.9e-13; Accession=PF00462.14; Description =Glutaredoxin
MGKYKHKINTEHRVRSNPHLAHRICRDDIGPTLNSKKETMRNSNEIKYKYCRRAKAVFKELNQVPHVVELDEREDGSKIQDIMVNIVGRRTVPQVFINGKHLGGSDDTVEAYESGHLHKLLGIEKKDHDDL

SEQ ID NO: 128226 - protein, 93 aa, Glycine max
  Coding DNA Sequence Number=SeqID_11448
  Subcellular localization annotation: CTP_CleavageSite=52; ConfidenceScore=5.04e-01
MVRLASNHLLAFSLQTRSACNRRISDSRKVFKKKVGGGGRREFVHIAGKALSLSQRKKIIIGSPLSFPTSYSFPIPSPFIPFCIFILVMTMKG

SEQ ID NO: 128227 - protein, 130 aa, Glycine max
  Coding DNA Sequence Number=SeqID_11449
  Homolog annotation: Hit_ID=Q2HTU7; Match level="QueryCoverage=96%, HitCoverage=60%, E-value=7e-41, Identity=57%"; Hit description =Uncharacterized Cys-rich domain
MKLAGFGSCYIQAIVYFLLAIGAFVTSIAYTITRTHYFLYLAVAFIIAVGAYLGFYRTRMRKKFNIKESRTLEMNNVQNGTWHGRGDTICIGGFRDESKALCELRPPSVVSIMPNDENCMEKSTDVSNGS

SEQ ID NO: 128228 - protein, 71 aa, Glycine max
  Coding DNA Sequence Number=SeqID_11450
MPKRANTLPKADHFKCYRCHRNRGHSMEECNALKDKIKELIMLGHLKEFVHQPHSYKPEGRNRLEPGQGRD

SEQ ID NO: 128229 - protein, 203 aa, Glycine max
  Coding DNA Sequence Number=SeqID_11451
MTLPPSLSEPPSLSDSFSPLNPALAMDSLQATYKDEEDEEDEPQPQPPPTTADSPEAPPATTSTPSDTPTEPPNDARSEPEPSEDLSEDEAASDGSKKSPKSGREEGDASDEDPPPKKQKQLSSLTEATKEDLVAPQDGTNNAAATPATNGAAPKKSKKKNNNVWATKSTRKGKKKTNRNNNNNNSNNNNNHNHHANGEDKRA

SEQ ID NO: 128230 - protein, 86 aa, Glycine max
  Coding DNA Sequence Number=SeqID_11452
  Homolog annotation: Hit_ID=Q2RAM1; Match level="QueryCoverage=60%, HitCoverage=12%, E-value=8e-18, Identity=69%"; Hit description=SPRY domain containing protein, expressed
MRKFSYASIIFTQDLHGGRYYPAASMFTLPNEPNCTVKFNFGPDFECFPEDFNERPIPRPMSEVPYLGFDNKVENEESNEKKSQKE

SEQ ID NO: 128231 - protein, 52 aa, Glycine max
  Coding DNA Sequence Number=SeqID_11453
MSITTGSLSTAAIKATLIEKYRWSEHATTARARIKEISSILTRLWKKKTIGK

SEQ ID NO: 128232 - protein, 236 aa, Glycine max
  Coding DNA Sequence Number=SeqID_11454
  Gene Ontology: Mol. function=nucleoside-triphosphatase activity; Cellular component=integral to membrane; Biological process=transport
  Homolog annotation: Hit_ID=Q8RWI9; Match level="QueryCoverage=94%, HitCoverage=31%, E-value=2e-94, Identity=74%"; Hit description=White- brown complex homolog protein 15
  Pfam annotation: Domain name=ABC_tran; Domain location=1-160; Score =56.3; E_value=1e-13; Accession=PF00005.17; Description=ABC transporter
MSGNVLLNGKKRRLDYGVVAYVTQEDIVLGTLTVRETISYSANLRLPSSMTKEEVNGIIEGTIMEMGLQDCGDRLIGNWHLRGISGGEKKRLSIALEILTRPSLLFLDEPTSGLDSASAYFVAQTLRNLGHDGKTVISSIHQPSSEVFALFDDLFLLSGGQTIYFGPAKKAVEIIIHLFAQFFAKAGFPCPSRRNPSDHFLRCINSDFDAVTTTMMACQRVHDPQKIIEAQKVAYM

SEQ ID NO: 128233 - protein, 105 aa, Glycine max
  Coding DNA Sequence Number=SeqID_11455
  Gene Ontology: Mol. function=nucleoside-triphosphatase activity; Cellular component=membrane
  Homolog annotation: Hit_ID=Q9C8K2; Match level="QueryCoverage=50%, HitCoverage=7%, E-value=6e-19, Identity=83%"; Hit description=White -brown complex homolog protein 12
MEIEQATTNEKGVTDYGDAEMISDNNKRGMYLVWEDLTVVVPNFGNGHTRRLLDGLSGFAEPNRIMAIMGPSGSGKSTLLDALAGLSPYLSPLLGSTYENNGEWK

SEQ ID NO: 128234 - protein, 603 aa, Glycine max
  Coding DNA Sequence Number=SeqID_11456
  Gene Ontology: Mol. function=receptor activity
  Homolog annotation: Hit_ID=Q2QXR0; Match level="QueryCoverage=89%, HitCoverage=93%, E-value=4e-28, Identity=36%"; Hit description =Expressed protein
  Pfam annotation: Domain name=DUF668; Domain location=433-522; Score =197.4; E_value=3.5e-56; Accession=PF05003.3; Description=Protein of unknown function (DUF668)
MVAEAWIVKMGNQVSSNLKHALLLETLTKRKQSHKRSDTKETIGILSFEVANVMSKTVHLHRSLSESEISKLRNEILGSEGVRNLVSSDEGYLLELALAEKLEELNRVASVVSRLGKKCSEPALQGFEHVYGDIVGGFIDVKELGFLVKHMEGMVRKMDRYVTVTRNLYSEMEVLNELEQAVKKFQHNQHEESRRAFEQKLMWQKQDVRHLKDVSLWNQNFDKVVELLARTVCTIYARISVIFGESALRKNALGLGGGSPGTQNELGFVSGHVNVPRSSEKLKRNQSKRNGFHLGSVGRMAVAERRGTTSRPQIDLRRGELVPIRPEDFGFPCGTSPGRLFMECLSLSSSVSKFDDVDDGYAVNREDHHSSCRSVGIGNNSMKRDHTCHSGILSHSQSGVPFTGDLRQAKSGVQCCSTLGPKSRLAIYAPPSTLGGCALALHYANVIIVIEKLLRYPHIVGEEARDDLYQMLPTSLRLSLKAKLKSYVKNLAIYDAPLAHDWKENLDGIFKWLAPLAHNMIRWQSERNFEQHQIVSRTNVLLLQTLYFADREKTEESICKILVGLNYICRYEHQQNALLDCASSFDFEDCVEWQLQCGDSFLN

SEQ ID NO: 128235 - protein, 259 aa, Glycine max
  Coding DNA Sequence Number=SeqID_11457
  Gene Ontology: Mol. function=sulfotransferase activity; Cellular component=nucleus; Biological process=regulation of progression through cell cycle
  Homolog annotation: Hit_ID=Q9ZR04; Match level="QueryCoverage=91%, HitCoverage=83%, E-value=3e-49, Identity=43%"; Hit description =Putative D-type cyclin
  Pfam annotation: Domain name=Cyclin_C; Domain location=145-259; Score= 9.6; E_value=0.0069; Accession=PF02984.9; Description=Cyclin, C -terminal domain
  Pfam annotation: Domain name=Cyclin_N; Domain location=18-143; Score =77.8; E_value=3.4e-20; Accession=PF00134.13; Description=Cyclin, N -terminal domain
  Pfam module annotation: Pfam domain module=Cyclin_C::Cyclin_N; Domain location=145-259::18-143
MEFDLEDPLVSLEEEQTFTISELFASESEHVPSPNCLSSTHFHVFCGEAISLILQVQVSCKLDQFVAYLAINYLHRFMSCQEIPQGKPWFLRLLVISCLSLASKMKNTTLSILDMQKEGCYFKAQSIQRMELLILGALKWRMRSITPFSFLHFFISLAEIKDQSLKQTLKNRASEIIFNAQNGIKFLEYKPSTIAATSLIFASHELFPQQYSTLRASITACEYLDEETLSKCFDLMQDMMRMEAKELMSDTSFLSTETL

SEQ ID NO: 128236 - protein, 45 aa, Glycine max
  Coding DNA Sequence Number=SeqID_11458
MPETSRIITQHQDLVLGATMHQAKVPGISSYCQAWKCQLSNGLCS

SEQ ID NO: 128237 - protein, 71 aa, Glycine max
  Coding DNA Sequence Number=SeqID_11459
  Subcellular localization annotation: CTP_CleavageSite=51; ConfidenceScore=5.14e-01
MEIFRKKLLSETFRMTFFQKLFVSTSGRHKFFFRKKVLPEKFRKEVFRKVSGRRIAEGQFRHFIVCWVPQQ

SEQ ID NO: 128238 - protein, 717 aa, Glycine max
  Coding DNA Sequence Number=SeqID_11460
  Gene Ontology: Mol. function=protein serine/threonine kinase activity; Biological process=protein amino acid phosphorylation
  Homolog annotation: Hit_ID=Q1SD79; Match level="QueryCoverage=93%, HitCoverage=95%, E-value=1e-167, Identity=46%"; Hit description =Tyrosine protein kinase, active site
MAVISASTVSGTSGLSKFLPISRRVLKGLKEYGRKMVDLELFTQYIEEWVLENLNGDSADGMQSFRSPFTTDELCKLDLALEGVPFQQLIRMPFFTDVSDEVIEDQYLATEDFLHAIIIGLWRTFWHKSGPLPLCVSCPSHIGSRFSSVEKAISRGRLREMRGLALISKTATDSKFKWDHMVEFALFKSEVFLDNDSRLSASTICEALFYGFHVLVSRSLSKIISINSDSVFLLVLDSKCGAVMKFSGDLGKLDLLNSSDPYLSVAEWIKTYAEICVTPVEPIWNRLGNPNWGDIGTLQVLLATFYSIAQWNGPPRKSVASLISDHSLRLQKRRTECCIIETENALVPYHGTTDHQTGEIVELDQNELFSHNRASRLKLKCGDILALDDPQQGQKSFQIHESLVGGNYYLYSAVCLDHPSELLTLYVGAHPSRLEPSLEDMSLWYQVQRQTKVLNILRNQGILSKYLPEIVASGRILHSGPCKKESPGGRCDHPWCGTPVLVTSPIGEPLSPMVANEGSFSADEATRLCRDCLAALRSAAMANVQHGDICPENIIRVVERQGVRNQAIYVPISWGRAVLEDRDSPAINLQFSSSHALQHGKLCPSSDAESIIYILYFICGGTMSLQDSIESALQWRERSWAKRSIQQHIGQVSALLKAFADYVASLCGTPYPVDYDIWLKRLNKAVEVSADKGKMIEEVPITLRLEDAAESSGASGP

SEQ ID NO: 128239 - protein, 126 aa, Glycine max
  Coding DNA Sequence Number=SeqID_11461
MKIRTKGSNFRIAISRMKSKEVVIIKPKVIPENGRHIKRPTRRETTTTWNDTESENDQCGTRSQQGIITNDTGKQTSWEHEALLRIQRDIVVVGASKKKRKGKQKQNKAGTKVKNIQQEQRQDGKL

SEQ ID NO: 128240 - protein, 194 aa, Glycine max
  Coding DNA Sequence Number=SeqID_11462
  Gene Ontology: Mol. function=ribonuclease H activity; Cellular component=nucleus; Biological process=RNA-dependent DNA replication
  Pfam annotation: Domain name=RnaseH; Domain location=37-162; Score= -19.5; E_value=0.0038; Accession=PF00075.14; Description=RNase H
MTCQKLVQSPIRQLIRYFHKEPIPVAWKKPRIGWTKLNFDGSCKCLSGKASIGGVVRNHNAEFLLGYAESIGQANSTIAELTALRKGLELVLENGWNDIWLEGDAKTLVEIIVKRRKVRCTEVQRHINHINTILPEFNNFFVSHIYREGNRAADKFAQMGHHLDQPRIWRHPPDELLAQLLEDAQGKTVLRRKG

SEQ ID NO: 128241 - protein, 179 aa, Glycine max
  Coding DNA Sequence Number=SeqID_11463
  Gene Ontology: Mol. function=metal ion binding
  Homolog annotation: Hit_ID=Q2HTV0; Match level="QueryCoverage=85%, HitCoverage=17%, E-value=8e-21, Identity=33%"; Hit description=Zinc finger, RING-type; Transcription factor jumonji, jmjC; Zinc finger, C2H2-type
  Pfam annotation: Domain name=WRC; Domain location=14-59; Score=59.2; E_value=1.3e-14; Accession=PF08879.1; Description=WRC
MGKKSNPAEGEEAVPEHLRCSRTDGRQWRCRRRVKENLKLCEIHYVQARRRQHKKTLKLKRKRQNDAVEAQIGAKRDRKSREALVNRRNQLELIRMVLQREVEKKKKKESQLNLNLNLHLYSNHELKKELPNGVMAIASNVASSRYFRSKNADSGSVSCAVWTKHEQGEEEEVSLVSEK

SEQ ID NO: 128242 - protein, 67 aa, Glycine max
  Coding DNA Sequence Number=SeqID_11464
MEASKEIFTSVPRINSSTFNTGLVQKQLVSTKSTIHQVLRQHYFKASLHPEWQKLGHYTNPLIGLKS

SEQ ID NO: 128243 - protein, 636 aa, Glycine max
  Coding DNA Sequence Number=SeqID_11465
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q9LT02; Match level="QueryCoverage=99%, HitCoverage=49%, E-value=0.0, Identity=67%"; Hit description =Putative cation-transporting ATPase
  Pfam annotation: Domain name=Hydrolase; Domain location=156-555; Score=15.8; E_value=0.0024; Accession=PF00702.16; Description =haloacid dehalogenase-like hydrolase
MEETLSAKRDKNHVLFGGTKILQHTPDKSFPLKTPDGGCLAVILRTGFETSQGKLMRTILFSTERVTANSWESGFFILFLVVFALIAAGYVLVKGLEDPTRSKYKLILSCSLIVTSVIPPELPMELSIAVNTSLIALARRGIFCTEPFRIPFAGKVDICCFDKTGTLTSDDMEFSGVVGLNGTTDLESDTSKVPVRTVEILASCHALVFVENKLVGDPLEKAALRGIDWSYKSDDKAVPKKGTGQPVQIVHRYHFASHLKRMAVVVRIQEEFFAFVKGAPEVIQDRLIDIPPSYVETYKKYTRQGSRVLALAYKSLDDMTVSEARSLDRDIVESRLTFAGFVVFNCPIRSDSATVLSELKESSHDLALSLVRCGIEDDVSLMWGRGRPIKACCSSTLDQFNPVKVMITGDQALTACHVASQVHIISKPTLILGPTRNGEGYNWVSPDETENIHYSFRQVFVECIIGFSEKEVESLSETHDLCIGGDCIEMLQQTSAHLRVIPYVKVFARVAPEQKELIMTTFKTVGRLTLMCGDGTNDVGALKQAHVGIALLNALPPTQSGNSSSDSSKEEGSKSGKQKKSKPASEGTSKAKVASKSDSTSHSSGNRHQAAVEMQRQKLKKMMDELNEEGDGRAPI

SEQ ID NO: 128244 - protein, 290 aa, Glycine max
  Coding DNA Sequence Number=SeqID_11466
  Gene Ontology: Mol. function=metal ion binding; Cellular component =nucleus; Biological process=regulation of transcription, DNA -dependent
  Homolog annotation: Hit_ID=Q2HTV0; Match level="QueryCoverage=99%, HitCoverage=22%, E-value=3e-97, Identity=64%"; Hit description=Zinc finger, RING-type; Transcription factor jumonji, jmjC; Zinc finger, C2H2-type
  Pfam annotation: Domain name=JmjC; Domain location=132-236; Score =6.2; E_value=0.00019; Accession=PF02373.13; Description=JmjC domain
MAYSMDIPLSTDQLAKISKLLKKHKTLCQKVSSKTTSEHSEDREQNGMHSIVKEGTDFLRRVNRTSSISTEAKTISNQKLDTNISDDEECGSDSETEKAQSSLPSHRRVLSTERSPDHNPRNPFENSNSDKGKKFTENSAAHWDVFRRQDVPKLLEYLKRHSDEFSYTSECHEKMVHPILDQSFFLDNTHKMRLKEEFKIEPWTFEQHVGEAVIIPSGCPYQIRNPKCCVHVELEFVSPENVSECIQLIDEVRLLPEDHKAKVEKLEVKKMALYSMSTAIKEIRELTCKT

SEQ ID NO: 128245 - protein, 619 aa, Glycine max
  Coding DNA Sequence Number=SeqID_11467
  Gene Ontology: Mol. function=kinase activity; Cellular component =mitochondrion; Biological process=protein amino acid phosphorylation
  Homolog annotation: Hit_ID=Q2HTV1; Match level="QueryCoverage=99%, HitCoverage=98%, E-value=0.0, Identity=80%"; Hit description=Protein kinase-like
  Pfam annotation: Domain name=ABC1; Domain location=264-390; Score =133.3; E_value=6.8e-37; Accession=PF03109.7; Description=ABC1 family
RAAQSVCRINSRYLEVSKNGPVVSVGPNIHHCRLYMQYKFPSEACSSFLWHGTREGFRKRGSFRNFSVTSASNTVTHHSQIAWKRLYRKYCSSGDGTFPPTVNMIAQAVSLALARSYLLVPGILAFTCGELALAQQNWADAERYPSQNGLYMRAQDGYNYMFTFAFIIVEGLILLMRALYLAILFSPSIVMAPFADCFGPNFRKLWLHVVHRTLEKSGPAFIKWGQWAATRPDLFPRDLCTKLSELHTKAPEHSFCYTKKTIERAFGRKISEIFDNFEELPVASGSIAQVHRASLKCRYPGQQAKPLLVAVKVRHPGVGESIRRDFAIINLAAKISKFIPALNWLRLDESVQQFAVFMMSQVDLAREAAHLSRFIYNFRRWKDVSFPKPVYPLVHPAVLVETYEKGESVSYYVDDLQGHERVKSALAHIGTHALLKMLLVDNFIHADMHPGNILVRVSQNKSRKRLFKSKPHVVFLDVGMTAELSGSDRVNLLEFFKAVARRDGRTAAECALNLSNQQNCPNPEAFIEEVEESFTFWGTPEGDIVHPAECMEQLLEKVRRHRVNIDGNVCTVMVTTLVLEGWQRKLDPGYNVMQTLQTLLLRADWAKSLSYTIDGLMAP

SEQ ID NO: 128246 - protein, 68 aa, Glycine max
  Coding DNA Sequence Number=SeqID_11468
MVKMKGGMKGGENKRDSCQYNRKNEKWNTGEDMCRRRSSNTGRINRHGKISEWEEKDKMFLIMKPNFR

SEQ ID NO: 128247 - protein, 68 aa, Glycine max
  Coding DNA Sequence Number=SeqID_11469
MNNLPMNHANMNSILVLNGANFKDGKENMQIVLGWMDQDLALRIEKPHSPTDSSPSGNFIRSGITQIA

SEQ ID NO: 128248 - protein, 235 aa, Glycine max
  Coding DNA Sequence Number=SeqID_11470
  Gene Ontology: Mol. function=inositol or phosphatidylinositol phosphatase activity; Cellular component=mitochondrion; Biological process=sulfur metabolic process
  Homolog annotation: Hit_ID=Q9M0Y6; Match level="QueryCoverage=95%, HitCoverage=55%, E-value=2e-52, Identity=51%"; Hit description =Putative PAP-specific phosphatase, mitochondrial precursor (3'(2') ,5'- bisphosphate ...
  Homolog annotation: Hit description=nucleotidase) (EC 3.1.3.7) (3'(2'),5-bisphosphonucleoside 3'(2')-phosphohydrolase)
  Subcellular localization annotation: CTP_CleavageSite=14; ConfidenceScore=5.25e-01
MAIDILRSPVSAVRFFNGAATRSRCCSSTFRFNQNAKHYKELEAAVDVVRRACRLCLNVKSSLFSTDEKVLEKNDQTPVTVADFGVQALISLELNKLFPSIPLVAEEDSAFLLSRNLADTVLNEVTDTLSSTCKPLTQDDVLEAIDRGGKDAFVFGSKPATYWVLNPIDGPHGFLKAGKALYVVGLALVVEGEIVVGVMGCPNWEEDLSEKSSTEIEEGWDSLGGSGTVMIAHNG

SEQ ID NO: 128249 - protein, 282 aa, Glycine max
  Coding DNA Sequence Number=SeqID_11471
  Gene Ontology: Mol. function=binding
  Homolog annotation: Hit_ID=Q9FHV2; Match level="QueryCoverage=94%, HitCoverage=32%, E-value=5e-46, Identity=39%"; Hit description =Arabidopsis thaliana genomic DNA, chromosome 5, P1 clone:MJG14
MSTTKHDAIAIRGYELRIIRCTLTSSQPSDSRHERESLDGLINDLLNSIERGNYAEALTSEPSSSLVFRLNGHDSLPLDAADRVYSELVHRAESFIRDAAAAAEQRRRAILVMCIAVAAFLGFTQSNFTGPLKGAELPKCPLGLDGSDEWDNWARNQLMSAGSDLLGKFSNLQYIVFAKMLLMRMKDLSVEIGSLSWWLARVLLLQQRVLDERSSSLSDLLHVFMGEALQQFSTSELVQGYWEDHLRHGESSAIVSVLHLEAGIMEYLYGRVDSCRLVAMDS

SEQ ID NO: 128250 - protein, 341 aa, Glycine max
  Coding DNA Sequence Number=SeqID_11472
  Gene Ontology: Mol. function=structural molecule activity
  Homolog annotation: Hit_ID=Q2HTV7; Match level="QueryCoverage=50%, HitCoverage=65%, E-value=4e-68, Identity=75%"; Hit description=Major sperm protein
  Pfam annotation: Domain name=Motile_Sperm; Domain location=157-264; Score=65.4; E_value=1.9e-16; Accession=PF00635.16; Description=MSP (Major sperm protein) domain
MSLRYMSRVIYQGGMRMLQGMKEQLGSNKCDSTIKSLNLRDSSSKQNRFLSSGTSFKPPNNDNKLKQAEDSLRTVMKATPRRIEVKCSGAENKGERTFLTLEEAGLVEISGLSTHERFLCRLTISSLNLLRVISEQEGCPIEELNAAKICDWFLKDKLKREQNLGSAPGKQAKSAVRIKNTSKSNVAFKFQTNAPKSCFMRPPGGILAPGESIIATVFKFIEHPLNNEKPQKTGVKFKITSLKVKGPIDYVPEMFDELKDQVTVEQILQVVFLDPERSCPALEKLKLQLAEADAAVVEARKRAPEDAGPKILGEGLVIDEWKERRERYLAKQQGEVVVDSI

SEQ ID NO: 128251 - protein, 359 aa, Glycine max
  Coding DNA Sequence Number=SeqID_11473
  Gene Ontology: Mol. function=binding; Cellular component=thylakoid; Biological process=photosynthesis
  Homolog annotation: Hit_ID=Q84NS6; Match level="QueryCoverage=96%, HitCoverage=37%, E-value=6e-94, Identity=48%"; Hit description =Tetratricopeptide repeat (TPR)-containing protein-like protein
  Pfam annotation: Domain name=TPR_1; Domain location=29-62; Score=2.5; E_value=2.7; Accession=PF00515.18; Description=Tetratricopeptide repeat
  Pfam annotation: Domain name=TPR_1; Domain location=63-96; Score =39.3; E_value=1.3e-08; Accession=PF00515.18; Description =Tetratricopeptide repeat
  Pfam annotation: Domain name=TPR_1; Domain location=97-130; Score =22.1; E_value=0.002; Accession=PF00515.18; Description =Tetratricopeptide repeat
  Pfam annotation: Domain name=TPR_2; Domain location=29-62; Score =10.3; E_value=2.1; Accession=PF07719.7; Description=Tetratricopeptide repeat
  Pfam annotation: Domain name=TPR_2; Domain location=63-96; Score =39.5; E_value=1.1e-08; Accession=PF07719.7; Description =Tetratricopeptide repeat
  Pfam annotation: Domain name=TPR_2; Domain location=97-130; Score =21.0; E_value=0.0042; Accession=PF07719.7; Description =Tetratricopeptide repeat
  Pfam module annotation: Pfam domain module=TPR_1::TPR_1::TPR_1::TPR _2::TPR_2::TPR_2; Domain location=29-62::63-96::97-130::29-62::63 -96::97-130
MKVWCSLGDTTANDACYEKALEVSNNRSARAKRSLARSAYNRGDYETSKILWESAMSMNSMYPDGWFALGAAALKARDIEKALDAFTRAVQLDPENGEAWNNIACLHMIKKKSKEAFIAFKEALKFKRNSWQLWENYSHVAVDTGNISQALEGVQMILDMSNNKRVDCELLERITREVEKKLSTSNVPQLVTDDNKPKTDQLCIVDSGSKYQEQVSGVSIAGRSRETEQLLLLLGKVLQQIIKSGSGCGPEIWGLYAKWHRINGDLMMCSEALLKQVRSLQGSDTWKDRDRFKKFAKASLELCQVYVEIFSSAGSIKQLTTAEMHLKNAQSFTDTEEFRDLQACYDEVKIKLQSNSMAN

SEQ ID NO: 128252 - protein, 586 aa, Glycine max
  Coding DNA Sequence Number=SeqID_11474
  Gene Ontology: Mol. function=oxidoreductase activity; Cellular component=mitochondrion; Biological process=electron transport
  Homolog annotation: Hit_ID=Q2HTY1; Match level="QueryCoverage=99%, HitCoverage=100%, E-value=0.0, Identity=81%"; Hit description=FAD -dependent pyridine nucleotide-disulphide oxidoreductase; Calcium- binding EF-hand
  Pfam annotation: Domain name=Pyr_redox; Domain location=228-335; Score=75.8; E_value=1.4e-19; Accession=PF00070.17; Description =Pyridine nucleotide-disulphide oxidor
  Pfam annotation: Domain name=Pyr_redox_2; Domain location=53-382; Score=99.9; E_value=7.5e-27; Accession=PF07992.4; Description =Pyridine nucleotide-disulphide oxidor
  Pfam annotation: Domain name=efhand; Domain location=388-416; Score =25.6; E_value=0.00017; Accession=PF00036.22; Description=EF hand
  Pfam module annotation: Pfam domain module=Pyr_redox::Pyr_redox _2::efhand; Domain location=228-335::53-382::388-416
MSSITFFHRLSSAFRDNQSHLKLVLLCTAVSGGGLWAYGESVAPEEAVTEKKKVVVLGTGWAATSFMKNLNNPKYEIQVVSPRNYFAFTPLLPSVTCGTVEARSIVEPVRNIFKVYVFDLMWEFQKKVDVQFSEAECFKIDAENRKVYCRSSVNNNLDGKEEFVVDYDYLIVAVGANVNTFNTPGVTENCHFLKEVEDAQKIRRTVIDCFERANLPDVSEDEKKRILHFAIVGGGPTGVEFAASLHDFVNEDLVRLYPGIKDLVKITLLEAGNHILGMFDKRITAFAEDKFRRDGIDVKTGSMVVKVSEKEISTKELKNGEIKTIPYGMAVWSTGIGTRPFIKDFMAQIGQASRRALATDEWLRVEGCNNVYALGDCATINQRKVMEDIVAIFKKADKDNSGTLTVIQFQEVMKDICERYPQVELYLKNKQMGNIADLLKEAKGDDKKESIELNIEELKTALSKVDSQMKFLPATAQVASQQGTYLAKCFNRMEECEKNPEGPLRFRGEGHHRFKPFRYKHLGQFAPLGGEQTAAQLPGDWVSIGHSSQWLWYSVYASKQVSWRTRALVVSDWTRRFIFGRDSSSI

SEQ ID NO: 128253 - protein, 585 aa, Glycine max
  Coding DNA Sequence Number=SeqID_11475
  Gene Ontology: Mol. function=nucleic acid binding; Cellular component= heterogeneous nuclear ribonucleoprotein complex; Biological process =regulation of transcription, DNA-dependent
  Homolog annotation: Hit_ID=UPI000065D56E; Match level="QueryCoverage =51%, HitCoverage=51%, E-value=1e-49, Identity=37%"; Hit description =Homolog of Homo sapiens "HNRPUL1 protein
MASNKRHFAEKDDDPHSLSKKAKESESESESESVASPSSLQVLLNPADCDLEGFAYYWSGARAKVGITRGRYCFACKVVSAQTVNMEDTAPEQQHICCLGISRGDNAFGVGDTIVCCVDLESKPLASIGFSKTGKLLGAATQFDVARLGVADSSPGNLQWTSALFPHVLLKNVVGRNIVIGPSFSEPRDCEVIMMVGLPASGKTTWAEKWVKDHPEKRYVLLGTNSILDQMKFLLKVNVTLVPGLLWRNNYGERFDLLMDRATRIFNVLLSRAANIPRNYIIDQTNVYKSARKPKLEPFADYQKFAVVVFPKPEELKIRYDKRFTEMGKEVPPDAVNKMIANYVLPKSNDMPCSDEFFYQVFSNLVYFIGLHLPGSYSPITLPIYGTPGQVSQVNANDHVTELNGSMNSFSGVYPGSQIPHVARAPTSCEPYSNKESSCFARDIAGYNQTYGAILTGDIRNYNNSVVGGPYRPNIVENNMVSRDAFPDAYMSGMNEPSPIASARAISFDFSTCKEPYPGAYRSGMNESSPVARARAMSFDYPREVSSHFYRDSLSPYGTPTTRPTYGSSPINTPYSGRYASQRPR

SEQ ID NO: 128254 - protein, 333 aa, Glycine max
  Coding DNA Sequence Number=SeqID_11476
  Homolog annotation: Hit_ID=Q1S7C5; Match level="QueryCoverage=44%, HitCoverage=17%, E-value=3e-14, Identity=29%"; Hit description =Integrase, catalytic region
AYETSSFLLVSAVVMYLPKSQADKKKSLLGGSPDSSEAQVTSKVVDESEDDDSNDDGPVEWASYWKPNITINLVADFTQLKPKLLFMASALILTMVSPPSSPPPQQLCRRVEPAIHSHHLEGYIANPKIPQKYASIEDHNANKVNGEFTVWYEQDQFLLAWLQSTIFGNILPRMFVNELTSIGETIFNSEHLDLILDGLPDDESSISLVTSHFHPFTVDEVETLLLARESMNTNSQAQVNLTTLTSSEDNSANDYSGNRFFSGRGGWNLGRSNCDGRGSGRGSGRSRLEENYVPTLPPPASLASTQSTSASNAQTSLQVQYAQPIQYVLASPQ

SEQ ID NO: 128255 - protein, 143 aa, Glycine max
  Coding DNA Sequence Number=SeqID_11477
  Gene Ontology: Mol. function=aminoacyl-tRNA ligase activity; Biological process=tRNA aminoacylation for protein translation
  Homolog annotation: Hit_ID=Q67WM1; Match level="QueryCoverage=85%, HitCoverage=51%, E-value=5e-17, Identity=39%"; Hit description =Isoleucyl-tRNA synthetase-like
MKASMKKLNFGEEAGLCFHESYIRDAIGSQLLPNSLMPAHAVVLGEERFHGIASLSFGITLTKPALMFNKKAILSLFTGDAKGAHDLQTYLLSRDHLKLKSEFQDGNGKKIVDSIEQLPAVEVVLGEHIFFTVGDHYLAAKSD

SEQ ID NO: 128256 - protein, 154 aa, Glycine max
  Coding DNA Sequence Number=SeqID_11478
  Gene Ontology: Mol. function=calpain activity; Cellular component =intracellular; Biological process=proteolysis
  Homolog annotation: Hit_ID=Q1SPD3; Match level="QueryCoverage=96%, HitCoverage=34%, E-value=6e-17, Identity=43%"; Hit description =Cyclin-like F-box; F-box protein interaction domain
  Pfam annotation: Domain name=F-box; Domain location=1-48; Score=33.2; E_value=9.3e-07; Accession=PF00646.23; Description=F-box domain
MYGPVLCEELLMEILSWVPVMVMMRLRCVSKSWNSLIFNPTFIKLHLERSSRNTDILLTFRAFHDKETGDICLVYWRALHPPFTMLFGTDSINSRIYESWMSAMAWFACVILALDIHISFLFGTRPQGSSPKLLLGYLALPKSFITCLGLVTMI

SEQ ID NO: 128257 - protein, 643 aa, Glycine max
  Coding DNA Sequence Number=SeqID_11479
  Gene Ontology: Mol. function=isoleucine-tRNA ligase activity; Cellular component=soluble fraction; Biological process=tRNA aminoacylation for protein translation
  Homolog annotation: Hit_ID=Q9SV89; Match level="QueryCoverage=96%, HitCoverage=49%, E-value=0.0, Identity=74%"; Hit description =Isoleucine-tRNA ligase-like protein
  Pfam annotation: Domain name=Anticodon_1; Domain location=347-505; Score=133.9; E_value=4.4e-37; Accession=PF08264.3; Description =Anticodon-binding domain
  Pfam annotation: Domain name=tRNA-synt_1; Domain location=3-292; Score=-13.6; E_value=1.7e-17; Accession=PF00133.12; Description=tRNA synthetases class I (I, L, M and V)
  Pfam annotation: Domain name=tRNA-synt_1g; Domain location=44-316; Score=-277.4; E_value=0.0053; Accession=PF09334.1; Description=tRNA synthetases class I (M)
  Pfam module annotation: Pfam domain module=Anticodon_1::tRNA-synt _1::tRNA-synt_1g; Domain location=347-505::3-292::44-316
  Subcellular localization annotation: CTP_CleavageSite=57; ConfidenceScore=5.09e-01
MCLFKKFFLKFFTVFSEVPLLAKGRLVKSGAFTHSYPFCWRSQTPLIYRAVPSWFVRVESLKEKLLENNKKTYWVPDFVKGRIQYQDNIILMRETDKRFHNWLENARDWAISRSRFWGTPLPLWISEDEEEVVVIDSVAKLEELSGVKVFDLHRHNIDHITIKSDSGRVLRRVDDVFDCWFESGSMPYAYIHYPFENVELFEKNFPGHFVAEGLDQTRGWFYTLMVLATALFGKPAFRNLICNGLVLAEDGKKMSKSLKNYPSPMEVINDYGADALRLYLINSPVVRAEPLRFKKEGVYGVVRDVFLPWYNAYRFLVQNAKRLEVEGLAPFVPFDHATLLNSTNVLDQWINSATQSLIHFVRQEMDGYRLYTVVPYLLKFLDNLTNIYVRFNRKRLKGRSGEEDCRIALSTLYNYYQKMMVLLLSCKVMAPFTPFFTEVLYQNMRKVSNGSEESIHYCSFPTEEGRRGERIEQSVSRMMTIIDLARNIRERHNKPLKTPLREMVIVHPDADFLDDINGKLKEYVLEELNVRSLVPCNDTLKYASLRAEPEFSVLGKRLGKSMGIVAKEIKAMSQENILAFENAGEVVIANQCLKLTDIKVLRDFKRPDGMTEKEVDAAGDGDVLVILDLRPDESLFEAGAARE

SEQ ID NO: 128258 - protein, 438 aa, Glycine max
  Coding DNA Sequence Number=SeqID_11480
  Gene Ontology: Mol. function=structural constituent of ribosome; Cellular component=ribonucleoprotein complex; Biological process =translation
  Homolog annotation: Hit_ID=Q7XAM9; Match level="QueryCoverage=47%, HitCoverage=50%, E-value=1e-86, Identity=74%"; Hit description =Putative 30S ribosomal protein S9
  Pfam annotation: Domain name=Ribosomal_S9; Domain location=318-438; Score=163.3; E_value=6.4e-46; Accession=PF00380.9; Description =Ribosomal protein S9S16
  Subcellular localization annotation: CTP_CleavageSite=55; ConfidenceScore=5.25e-01
MLSRLIPKPSHLRRFLSIPLKPSHTAVNPFFTVVVPKHFSTNRGGGNDGDGKDPFSSRVWKDFRETEEKLDAFFEEEEECGSLAGMNDDGSSGGRRREERGWLQEEEQGWLQEKGLDDADEDAIFKGIDEESGDAGGGGFDESNFGVRAGEDFKPWSMKGEEDDKKDVFDFKEDVGHEGNFTALDINPKVDVEQLEKEEQALTAVVKVFTVPGSDMLVLLAKSILRMFLLDLYQGPKRAFGDLIAASGITDEMLDSLIALKDFDGVHGLPPLSVIEDMRYEKNTRKSTRGEMERLKQEEAAKARVKQVDDKGRAYGTGRRKCSVARVWVQPGNGQFTVNDKEFDVYFPMLEHRATLLRPFSETKTLGLWDVDCTVKGGGVSGQVGAIRLGISKALQNWEPDLRPALRNAGFLTRDSRVVERKKPGKAKARKSFQWVKR

SEQ ID NO: 128259 - protein, 231 aa, Glycine max
  Coding DNA Sequence Number=SeqID_11481
MHLQLGETSQPVWVEFSATLNQIKDNDQEKNSLILMKSGVVSDDGQRGYFCTKNGTLVEIDVAESPRWTNHGQPAGANVAAIAAVASKRKVVYTISSAGDLYEYDRKSKPSWKKHIWQEKKAKVSPLMPSKGCILHGLSGDHSESLFLLTKRYLIIVQEGTLVERRLHQRKWKWVVHGSPEHQTLTSITPPLQDESWETFISLFFTSSAGSVFEYQMPKQLGQSSNCAKSI

SEQ ID NO: 128260 - protein, 511 aa, Glycine max
  Coding DNA Sequence Number=SeqID_11482
TLNSLMKTGTALNNQFPEAWGSHEHPLHAKAARGIAGLPLQVGRILFALDDGRLAELHLAGLGGENSGPSVPQNFRRKASTKYVWTILDVPESEGWNAEYCTEERGPRNCMTGTKDESNDSGISSVTGRRKQSQAQNYYLPLGTGGEPNRSSEEYNLPDDWISNNFRLRLLYEGKSFFLITNDGWVFEYVCIENVWVWLRHDSSSTMNGIVGSYNGSLFMADTFGSLFLREWSDNEIAWRNCTAMRKGRSIVAGQPWDRLPGKARRATTEDSIFFVSKNGRLLQFMVYMRKFKWKDCKNPQNVKVASIVDQELFRENIVFVIGRNGRLYQYNKVTDLWHEHYQSQHLILSQFPGTVIRPSTKSLSGSLFMLSREGGLVEYQWTTWYGWNWVEHGTPYKGVKLVGSPGPSFEGNQLLLIGSDGKVYLRYLDKDAWKWKDCSFPSMGNKIVETHSGGINEEKPVRIDENCASGLSKDQDNLADLNLNCEPKVASTRPIPFSEGSVIFELRDGR

SEQ ID NO: 128261 - protein, 470 aa, Glycine max
  Coding DNA Sequence Number=SeqID_11483
MANTILDQGGCTNLWPFRVDELRDSKQLVKKLSIPQDTKQFVFALRDPHTQSIIYILSSLNLSERSASDAMCLIKEIKPDAVLVQAAVSPFSELQSEEDSVPVPTSSFGVIKRCFLDKIGRDMYESVACNFVLREIFGTSFHGPLLAAKRAAEDVGSSFLVIESPSSWGGSHFRSLINSLVPKQHAASWAPSALKRFSLDKELRMMLAKALSGSLDPLLLSSGANAGSVLEKGNEEIQPSSSYETPGFARSIYALLEDLYSIFGDLPSLGKALAHVQKMLLDVNRGEGLRPSNRKGAAKSDNIEFSEILADDKLHTLFAQAIRSQTDKFKTIVAVVDAIALAGLRKHWDTPLPVEVKELVGELITNSEVKGVMMNHSEKKWLLTDKPMVAVGAGATAVFGASSLTKVVPASTLVKVITFKIPTSLKISLSQMQKVLAFAFGHYKVVAPGIATSGAKTSGIMKAAVSAEKI

SEQ ID NO: 128262 - protein, 218 aa, Glycine max
  Coding DNA Sequence Number=SeqID_11484
  Gene Ontology: Mol. function=hydroxymethylbilane synthase activity; Cellular component=chloroplast; Biological process=tetrapyrrole biosynthetic process
  Homolog annotation: Hit_ID=Q43082; Match level="QueryCoverage=84%, HitCoverage=49%, E-value=2e-74, Identity=79%"; Hit description =Porphobilinogen deaminase, chloroplast precursor
  Pfam annotation: Domain name=Porphobil_deam; Domain location=42-216; Score=222.6; E_value=8.5e-64; Accession=PF01379.11; Description =Porphobilinogen deaminase, dipyromethane cofactor binding domain
METLCSALVFPSFRIRTSAFSKCGIRASIAVEQQTSQTKVALLRIGTRGSPLALAQAYETRDKLMASHAELAEEGAIQIVIIKTTGDKILSQPLADIGGKGLFTKEIDEALINGDIDIAVHSMKDVPTYLPDKTILPCNLPREDVRDAFISLSAASLADLPSGSIVGTASLRRKSQILHRYPSLNVVSNMVIGLNTIRAMSVNCKVIDSVMIESLLLG

SEQ ID NO: 128263 - protein, 58 aa, Glycine max
  Coding DNA Sequence Number=SeqID_11485
MVLLRGMLDTEYSSMHRAMPVRIEEYLICRLVALPQRFCNRKWEVKGDKRNADSMGKN

SEQ ID NO: 128264 - protein, 77 aa, Glycine max
  Coding DNA Sequence Number=SeqID_11486
MSECISKNLSGSRIQLWAIGIGIILVAVGGFVDFIIEPNSKFVINLIQNSCSSTQECAHLLVFIPEKVVSLEKPTKR

SEQ ID NO: 128265 - protein, 91 aa, Glycine max
  Coding DNA Sequence Number=SeqID_11487
MTKIVLKVTISPNIILNTVNVKDQIYYEVSMSFAVRWKDENFHKKLKIGDNGLVTCVRAFECEGASWEEFRKIFRSPKQVGNKLLSSDPSN

SEQ ID NO: 128266 - protein, 41 aa, Glycine max
  Coding DNA Sequence Number=SeqID_11488
MEDKKTSLMGEIEHEDTTLEEDVSPNTSPGGGGMVQWWVWG

SEQ ID NO: 128267 - protein, 659 aa, Glycine max
  Coding DNA Sequence Number=SeqID_11489
  Gene Ontology: Mol. function=heat shock protein binding
  Homolog annotation: Hit_ID=UPI0000016B45; Match level="QueryCoverage =15%, HitCoverage=19%, E-value=1e-09, Identity=40%"; Hit description =Homolog of Homo sapiens "DnaJ homolog subfamily C member 7
  Pfam annotation: Domain name=TPR_1; Domain location=255-288; Score =11.2; E_value=0.25; Accession=PF00515.18; Description=Tetratricopepti de repeat
  Pfam annotation: Domain name=TPR_1; Domain location=298-331; Score =30.0; E_value=8.3e-06; Accession=PF00515.18; Description =Tetratricopeptide repeat
  Pfam annotation: Domain name=TPR_1; Domain location=332-365; Score =6.9; E_value=0.81; Accession=PF00515.18; Description=Tetratricopeptid e repeat
  Pfam annotation: Domain name=TPR_1; Domain location=438-471; Score =8.2; E_value=0.57; Accession=PF00515.18; Description=Tetratricopeptid e repeat
  Pfam annotation: Domain name=TPR_1; Domain location=582-615; Score =8.9; E_value=0.47; Accession=PF00515.18; Description=Tetratricopeptid e repeat
  Pfam annotation: Domain name=TPR_1; Domain location=620-653; Score =34.9; E_value=2.9e-07; Accession=PF00515.18; Description =Tetratricopeptide repeat
  Pfam annotation: Domain name=TPR_2; Domain location=255-288; Score =10.6; E_value=1.9; Accession=PF07719.7; Description=Tetratricopeptide repeat
  Pfam annotation: Domain name=TPR_2; Domain location=298-331; Score =17.9; E_value=0.037; Accession=PF07719.7; Description=Tetratricopepti de repeat
  Pfam annotation: Domain name=TPR_2; Domain location=332-365; Score =13.9; E_value=0.6; Accession=PF07719.7; Description=Tetratricopeptide repeat
  Pfam annotation: Domain name=TPR_2; Domain location=438-471; Score =9.9; E_value=2.3; Accession=PF07719.7; Description=Tetratricopeptide repeat
  Pfam annotation: Domain name=TPR_2; Domain location=582-615; Score =13.6; E_value=0.74; Accession=PF07719.7; Description=Tetratricopeptid e repeat
  Pfam annotation: Domain name=TPR_2; Domain location=620-653; Score =22.6; E_value=0.0014; Accession=PF07719.7; Description =Tetratricopeptide repeat
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2; Domain location=255-288::298-331::332-365::438-471::582-615::620-653::255 -288::298-331::...
  Pfam module annotation: Domain location=332-365::438-471::582 -615::620-653
MDVSPYQEKLSENERSREDSLASNESFSVDNNNIVNDSEPTSFIDPIDEDLIAAAKSLDINGGDVAHRDTKEESSEDQMRENSCVEDPKDESISGVETESFKSANDEVDITSDVTGVSAETGAHDSDRMLHLESALSSRNVNGSGFTFAAASSTEAQSCSPKRLHKKKNVGHDSYNYTPNIKVPYSSTSVAFSPFSGTSSLFTPGQSLKPKVSSPPPKTSDSDENQEKEIKEAEEACERWRLRTLPTLQPLFKILNMLYIRGNQAYKKGDLSTAENCYKQGLSCISKEASRSCLRALLLCYSNLAATHMSLGRMRDALEDCKMAAEIDQNFLKVQLRAANCYLALGEVEGASQYFKRCLQSGTNVCVDRKIAVEASDGLQKAQLEVLYGDCDKMVFESWKVSDVINHSAQLLQRRTASYAERALEHINEALIISSYSEKLLEMKAEALLMLCRYEEVIQLCDKTLDSAEKNACPLDAGCKVTDLDNSQLSKGFYFRIWRCSMMLKAYIHLGKFEEGLSLLEQQEEKVSAINKSGSKVLDSLTPLAAIIREPLHHKVTVLMHMLVFICRNIFKGVKTAPYYRMGFTKTLGNAAFQAGRHAEAVEYYTSALSCNVESRPFAAVCYCNRAAAYKALGQITDAIADCSLAIALDGNYLKDKNT

SEQ ID NO: 128268 - protein, 82 aa, Glycine max
  Coding DNA Sequence Number=SeqID_11490
  Homolog annotation: Hit_ID=Q2QY08; Match level="QueryCoverage=65%, HitCoverage=13%, E-value=3e-16, Identity=74%"; Hit description =Saccharopine dehydrogenase family protein, expressed
MTNAMCTFFRSVGIATAAFALAILEGSTQPGVWFPEEAQGIPIEAREVLLKRASQGTFNFIMNRSPWMVETNPKEFGLGIYL

SEQ ID NO: 128269 - protein, 877 aa, Glycine max
  Coding DNA Sequence Number=SeqID_11491
  Gene Ontology: Mol. function=binding; Cellular component=clathrin coat of trans-Golgi network vesicle; Biological process =intracellular protein transport
  Homolog annotation: Hit_ID=Q9M650; Match level="QueryCoverage=99%, HitCoverage=100%, E-value=0.0, Identity=75%"; Hit description=Beta -adaptin-like protein B
  Pfam annotation: Domain name=Adaptin_N; Domain location=13-500; Score= 567.3; E_value=1.5e-167; Accession=PF01602.10; Description=Adaptin N terminal region
  Pfam annotation: Domain name=Alpha_adaptinC2; Domain location=648 -756; Score=-2.2; E_value=0.0068; Accession=PF02883.10; Description =Adaptin C-terminal domain
  Pfam annotation: Domain name=B2-adapt-app_C; Domain location=765-877; Score=125.8; E_value=1.2e-34; Accession=PF09066.1; Description=Beta2 -adaptin appendage, C-terminal s
  Pfam annotation: Domain name=HEAT; Domain location=118-154; Score =29.5; E_value=1.2e-05; Accession=PF02985.12; Description=HEAT repeat
  Pfam annotation: Domain name=HEAT; Domain location=156-193; Score =18.1; E_value=0.032; Accession=PF02985.12; Description=HEAT repeat
  Pfam module annotation: Pfam domain module=Adaptin_N::Alpha _adaptinC2::B2-adapt-app_C::HEAT::HEAT; Domain location=13-500::648 -756::765-877::118-154::156-193
MSRNDSKYFSTTKKGEIPELKEELNSQYKDKRKDAVKKVIAAMTVGKDVSSLFTDVVNCMQTENLELKKLVYLYLINYAKSQPDLAILAVNTFVKDSQDPNPLIRALAVRTMGCIRVDKITEYLCDPLQRCLKDDDPYVRKTAAICVAKLYDINAELVEDRGFLDSLKDLISDNNPMVVANAVAALAEIQENSSRPIFELTSSTLSKLLTALNECTEWGQVFILDALSRYKAADAREAENIVERVTPRLQHANCAVVLSAVKMILQQMELITSTDVARNLCKKMAPPLVTLLSAEPEIQYVALRNINLIVQRRPTILAHEIKVLLEFKEYATEVDVDFVRKAVRAIGRCAIKLERAAERCISVLLELIKIKVNYVVQEAIIVIKDIFRRYPNTYESIIATLCENLDTLDEPEAKASMIWVIGEYAERIDNADELLESFLESFPEEPAQVQLQLLTATVKLFLKKPTEGPQQMIQVVLNNATVETDNPDLEIVHTYIGVSSQLTLSSLMYLAYLLQAAKDVVLAEKPVITDDSNQLDPSLLDELLVNIATLSSVYHKPPDAFVTRTHSSAQKTEDDDYPEGSETGYSESPGNPANGPASPPSASYSAPASVAPASPPPTAPVPDLLGDLMGTDNSSIVPLDEPATSTGPPLSIVLPTSVGHGFQISAQLTRQDGQIFYSMLFENNTHVPLDGFMIQFNKNTFGLAAAGPLQVPQLQPGTSTRTLLPMVMFQNMSQGPPSSLLQVAVKNNQQPVWYFNDKFSFHVLFTEDGRMERSAFLETWRSLPDSNEVSKDFPDIVIGGVEATLDRLAASNVFFIAKRKNANQDVFYFSAKIPRGIPLLIELTTMAGNPGVKCAIKTPSPEMSAFFFEAIETLLRS

SEQ ID NO: 128270 - protein, 320 aa, Glycine max
  Coding DNA Sequence Number=SeqID_11492
  Homolog annotation: Hit_ID=Q2QY08; Match level="QueryCoverage=50%, HitCoverage=33%, E-value=5e-42, Identity=56%"; Hit description =Saccharopine dehydrogenase family protein, expressed
  Pfam annotation: Domain name=Saccharop_dh; Domain location=43-320; Score=-82.4; E_value=0.0033; Accession=PF03435.8; Description =Saccharopine dehydrogenase
  Subcellular localization annotation: CTP_CleavageSite=18; ConfidenceScore=5.21e-01
MAPLSLPLNLKWTPLSVKATATATTTSKVPEVPLPEKIRNSRILVLGGTGRVGGSTAIALSNLCPDLQILVAGRNREKGEVLTAKLGGNSEFARVDIDDVNSLETALKSKIALATSHRCSLSCAYELKIDHECCYFHAAGPFQQAERCSVLEAAINTQTAYLDVCDDTSYAWRAKSFMNRALDANVPAITTGGIYPGISNGAYLSIRIVLLFPNRNQNYYENHLITKLGEVVIYVERESFCICCILVANTSYNFVTVMAAELVRAANESEDKPERLRSCKIIENPLISYYGQIRFYYYTAGTGGAGPTILATSFLLLGEE

SEQ ID NO: 128271 - protein, 93 aa, Glycine max
  Coding DNA Sequence Number=SeqID_11493
METLLTPLEATLVPFARVLKDLKAPKIFGTTDFHNKAQSWKSSLFHYLDFLLVSHRKKLWDQQKKNRTRCCRGHLIMRSYANQYVKLPQIKPS

SEQ ID NO: 128272 - protein, 201 aa, Glycine max
  Coding DNA Sequence Number=SeqID_11494
  Gene Ontology: Mol. function=transferase activity; Cellular component= integral to membrane; Biological process=glycolysis
  Homolog annotation: Hit_ID=Q6Q8A0; Match level="QueryCoverage=88%, HitCoverage=39%, E-value=2e-67, Identity=66%"; Hit description =Hexokinase 6
  Pfam annotation: Domain name=Hexokinase_1; Domain location=32-201; Score=98.2; E_value=2.4e-26; Accession=PF00349.11; Description =Hexokinase
  Subcellular localization annotation: CTP_CleavageSite=17; ConfidenceScore=5.10e-01
VMVGVAVGLAAVACAVAAVAVGQRMRSRGNWKRVARVLKEVEEGCETSVGRLRQVVDAMAVEMHAGLASEGGSKLKMLLTYVHNLPNGTEKGTYYALDLGGTNFRVLRVHLHGQQSSVLEHEVERQPIPQNLMTSTSEDLFDFIASSLKEFIEKEGDGSELSPDRRRELGFTFSFPVGIDVPACLQEALTRKGLDVRVAAL

SEQ ID NO: 128273 - protein, 514 aa, Glycine max
  Coding DNA Sequence Number=SeqID_11495
  Gene Ontology: Mol. function=zinc ion binding
  Homolog annotation: Hit_ID=Q53PX0; Match level="QueryCoverage=83%, HitCoverage=22%, E-value=2e-25, Identity=23%"; Hit description =Expressed protein
  Pfam annotation: Domain name=PHD; Domain location=387-436; Score =14.8; E_value=0.0019; Accession=PF00628.19; Description=PHD-finger
MLLNARHSALTIFVRELRKKVRELYSNIRWHDIENNYSLYVLDKESRKSVRLFKKSIVRRKCTEGGSVKFLIDFGKRRAIPDVVIKHGSLLEQSASERKKYWLEESYVPLHLLKNFEEKRIVRKSTDKKLGKILEIGRVNKKIPQQRGFSYLFTRLERSDCHQCRHCNKDVAMRDAVRCLHCKGYFHKRHARKSGGKRTTGSSYSCHRCQDGLHAKTNTNKRKVDSKLQKIQAKKRKTVPSVCKPVNLKGNKKALSNNKIRQARSRNSKNIPSSIPLRRSTRKAKSLYMQSQLNGGHKKGKKNVGRKKGKQGKTKKVIPQKSKETTGQYKKSEVTTARKKRTKICNSYWLNGLQLSRKPNDERVMLFKEKKRVASSKDFSGSLDHPKCCLCCGNECTLNYIACEICGDWFHGDAFGLNVENARQLIGFKCHVCLDRTAPICPHLKVNALSCTESNAAIECGEELSNPVSLQPLSEVNVTLFPGAKLLKNYLKNLVLLHCECDRNNSHRLRLCTE

SEQ ID NO: 128274 - protein, 189 aa, Glycine max
  Coding DNA Sequence Number=SeqID_11496
  Gene Ontology: Mol. function=small conjugating protein ligase activity; Cellular component=cytosol; Biological process=protein modification process
  Homolog annotation: Hit_ID=Q9C6Q4; Match level="QueryCoverage=89%, HitCoverage=94%, E-value=6e-70, Identity=75%"; Hit description =Cyclin-specific ubiquitin carrier protein, putative
  Pfam annotation: Domain name=RWD; Domain location=36-150; Score=-4.7; E_value=0.1; Accession=PF05773.12; Description=RWD domain
  Pfam annotation: Domain name=UEV; Domain location=41-154; Score= -41.8; E_value=0.086; Accession=PF05743.3; Description=UEV domain
  Pfam annotation: Domain name=UQ_con; Domain location=40-177; Score =228.5; E_value=1.5e-65; Accession=PF00179.16; Description=Ubiquitin -conjugating enzyme
  Pfam module annotation: Pfam domain module=RWD::UEV::UQ_con; Domain location=36-150::41-154::40-177
  Subcellular localization annotation: CTP_CleavageSite=57; ConfidenceScore=5.11e-01
MAATNNIHGNTESAQSNIAPPTKQPLHPSKTVDSQSVLKRLQSELMALMMSGDSGISAFPEEDNIFFWKGTITGSKDTVFEGTEYKLSLSFPNDYPFKPPKVKFETTCFHPNFDVHGNICLDILQDKWSSAYDVRTILLSIQSLLGEPNISSPLNQQAAQLWSNQEGEKKEGSIESASEKRKDEAVICF

SEQ ID NO: 128275 - protein, 1156 aa, Glycine max
  Coding DNA Sequence Number=SeqID_11497
  Gene Ontology: Mol. function=zinc ion binding; Biological process =proteolysis
  Homolog annotation: Hit_ID=Q53PX0; Match level="QueryCoverage=63%, HitCoverage=47%, E-value=5e-68, Identity=26%"; Hit description =Expressed protein
  Pfam annotation: Domain name=PHD; Domain location=643-688; Score =49.4; E_value=1.2e-11; Accession=PF00628.19; Description=PHD-finger
RKEVKGVGFISGTVKSYDPSSGFFEIVYEDGDSEELESSEVASLLQFQPESVKAKPRVGRKPKKRRRVEQKPDAGSRSGNVSENLVEDGSDFRGDLDGNVSSAGGGDLDLGCAGIDRAIDVDVGNGGNSIVNVNGSVKENGGGEDIGFEDSLNKSVDANGSCVKDALDLNARLNLNEDFNLNDACTLPLDTEDGFNRRDCIDLNLDVNNEDDVGVNVGYLGCSGGEVLQRECNFDLNVEACEEGRETRCDDDGNGHSEVGDALFSRMGQLQKEEEVNVNNSSEENEGVNGNLNHVSDAVKLEGIHVSAAHAAKDGSLCLVEENGGDDGKDVAAIDSHQISNAISVRDSDSVEAQRVDWPSEGGVAVIHELQDDPGSPCKQGNGRRKRRKVSDNPQATPETVLRRSSRRASARKRVSSTILVEVTDDPLMSLETSALTGEKPLISNSQKYEQCSDPLPKLQFPPSSTNLNLDGVPDLVAALKSEIPSILFDSIHVSILQTLRKNLEYLSNEGCQSASNCLRNLSWDFLDLVTWPIFMAEYLLIHGSGFKTGFDLKHLMFKTDYYKQPVTAKVEILQYLCNDMIESEAIRSELNRRSLVTETDVGFDQNMYFDTGKKKRAVMDVSGGSCLTEENVDDTTDWNSDECCLCKMDGSLICCDGCPAAFHSRCVGIASDHLPEGDWYCPECVIGKHMAWMKSRRSLRGADLLGMDLDGRLYFNSCGYLSNSSEAGSLFNYYHRNDLHVVIEALKSMDPLYEGILMTIYKHWDISANLSVGDSVFNRANDQRKLDENSTIDSCMHLVQEFPKAGNRLDSTTTIESPCVASDGSADTTQTRTGIDNVQINGLNDSNRCDESLNQPGIPERCHPVGDCSLTSSSLDVGRKINLRSVGSSITPSMDNKDTSEVPRGIDYINYYSFARTASFVAQELMCKSPEKMNKIFAMSEEEVMSDQAKVITKKSTNFCWPSIQNLNAAAHKEKCGWCFTCKGENEDRDCLFNSVVKPVWEVPNNILVGLQPRKIQNGRLRDIICLIFSLELESNLCLLALSADWLKHVDSVATMGSATHIVVSSSRTSSRHGIGRKRARNSDIETSSSSNTASGLGMYWWRGGRLSRKLFNCKALPHSLVTKAARQGILYPENSDFARRSRFVAWRAAVEMST

SEQ ID NO: 128276 - protein, 71 aa, Glycine max
  Coding DNA Sequence Number=SeqID_11498
MRLLSKMHVICCMPINRKDMGFGKVLNLTKYSKEVLVAIYEGVESDSPSVWVKALSDLVMDSGVGYVFITV

SEQ ID NO: 128277 - protein, 110 aa, Glycine max
  Coding DNA Sequence Number=SeqID_11499
  Homolog annotation: Hit_ID=Q7XYW1; Match level="QueryCoverage=94%, HitCoverage=95%, E-value=2e-14, Identity=37%"; Hit description=Seed specific protein Bn15D18B
  Pfam annotation: Domain name=Tryp_alpha_amyl; Domain location=30-104; Score=16.8; E_value=0.0018; Accession=PF00234.12; Description =Protease inhibitorseed storageLTP f
MASGGTYLSLAMLVVAGSLIYNTKEVSGQCGGSLSDLIAQCSQYVQKSGPKIPPSATCCAALRKFNVPCACKLVTKEAASLVSIPKVVFVGRSCGLNLPPGMQCGVHFNQ

SEQ ID NO: 128278 - protein, 105 aa, Glycine max
  Coding DNA Sequence Number=SeqID_11500
MSHSKVAVLRCVDGFSNAQNQAEVQQFSSFHNLVFDVVTFEEQSHERSGEAVRATEFTLIHMLTTTFWLVMISSVELRREKLSMLSSRGETWFSSSKKNDIIIIF

SEQ ID NO: 128279 - protein, 369 aa, Glycine max
  Coding DNA Sequence Number=SeqID_11501
  Gene Ontology: Mol. function=4-aminobutyrate transaminase activity; Cellular component=cytosol; Biological process=amino acid metabolic process
  Homolog annotation: Hit_ID=Q84P52; Match level="QueryCoverage=99%, HitCoverage=68%, E-value=1e-179, Identity=82%"; Hit description =Gamma-aminobutyrate transaminase subunit isozyme 3
  Pfam annotation: Domain name=Aminotran_3; Domain location=1-287; Score=137.1; E_value=4.9e-38; Accession=PF00202.11; Description =Aminotransferase class-III
MGKAFFVNSGSEANDTQVKLVWYYNNALGRPDKKKFIARAKSYHGSTLIAASLSGLPALHQKFDLPAPFVLHTDCPHYWRYHLPGETEEEFSTRLAKNLEQLILKEGPETIAAFIAEPVMGAGGVIVPPSTYFEKVQAVVKKYDILFIADEVICAFGRLGTMFGCDKYNIKPDLVSLAKALSSAYLPIGAVLVSPEISDVIHAQSNKLGSFSHGFTYSGHPAACAVAIEALKIYNMIMPLLRRERNIVDQVNKIAPRFQDGIKAFSDSPIIGEIRGTGLILGTEFTDNKSPNDPFPPEWGNLMYTTGVGAYFGAQCEKHGMLVRVAGDNIMMSPPYIISQGEVDELISIYGKALKETEKKVQELKSQRK

SEQ ID NO: 128280 - protein, 136 aa, Glycine max
  Coding DNA Sequence Number=SeqID_11502
  Gene Ontology: Mol. function=4-aminobutyrate transaminase activity
  Homolog annotation: Hit_ID=Q84P52; Match level="QueryCoverage=62%, HitCoverage=15%, E-value=3e-25, Identity=65%"; Hit description=Gamma- aminobutyrate transaminase subunit isozyme 3
MSAPFKLFPSGCLEYLTASSLAYAAVSRSAQENLLQAPLLSRSNSTEASLAKDTSSNDVKNGQGFKGHSMLAPFTAGWQTTDLHPLVIEKSEGSYVYDINGKKYLDALAGLWATSLAIHQIMPKLPGDPSPSLYLV

SEQ ID NO: 128281 - protein, 814 aa, Glycine max
  Coding DNA Sequence Number=SeqID_11503
  Gene Ontology: Mol. function=zinc ion binding
  Homolog annotation: Hit_ID=Q653B5; Match level="QueryCoverage=87%, HitCoverage=96%, E-value=1e-130, Identity=42%"; Hit description=DHHC- type zinc finger domain-containing protein-like
  Pfam annotation: Domain name=zf-DHHC; Domain location=249-312; Score =103.6; E_value=5.7e-28; Accession=PF01529.11; Description=DHHC zinc finger domain
MEICGMTSFPILIFNSYSLSLAKIAMLIFCLTLSLAKILCFQCLSPKLNQNYIIRKNHAIKDNLLKVLGLAFWSSNTCICPIVHVLNSSDVVAITVFCLLVIAFYAFLAPFIGGGHIWEYTFIAVYSPVALIVFILYVRCTAINPADPGIMSKFDPRVGNKFNSAHNLSGKHLGSEHEHVAAREQYSPSSAASKRSMTNISKKSSVEDLDRLDSSRKENNQNSCNAIGGIFCILFSHEDCRKQEATADEQGGGEDALFCTLCNAEVRKFSKHCRSCDKCVDGFDHHCRWLNNCVGHKNYSSFIALMAFSLAWLVIEAGVGVAVFVRFFVNKRGMESEIIDRLGNGFSRPPFAAVVVVCTVVSILACVPLGELFFFHMILIRKGITTYEYVVAMRAMSEAPAGASVDEDLPNILFSPTGSATTGLSGGSSLGLQYKGAWCTPPRVFVDYQDEVVPHLEPGMLPSTVDPDAAGIAERGQKMPKRPVRISAWKLAKLDSQEAVRAAAKARASSSVLRPVDNHRLPDVELSSSGNMSIRSSLSTETGTNKEIKAELRLSPVRNSIAPSQGSRDEYETGTQSMSSFSSPSHVQEAVTLSPLPQSHNLGGFRAGTSIPSLVPERPLTCKATLSNFRNPISNSSLGFDGRTAMPKGIGNDPLLLSTSNTSILRDVKRTSVVWDQEAGRYVSVPLLPSEARNRSSMRIELPNVNAETSSIGRKPVIPQQELSSSAPKSPGQHKQNLMYTGDSIFYGGPFLSAAVKDGLRNERHLTSTDAQDGSISVNLPQEPRYKRDSLSNQLPVFVPGGFENNLQPRSGMN

SEQ ID NO: 128282 - protein, 942 aa, Glycine max
  Coding DNA Sequence Number=SeqID_11504
  Gene Ontology: Mol. function=DNA-directed RNA polymerase activity; Cellular component=membrane; Biological process=signal transduction
  Homolog annotation: Hit_ID=Q8S8J6; Match level="QueryCoverage=98%, HitCoverage=100%, E-value=1e-133, Identity=30%"; Hit description =Putative myosin heavy chain
  Pfam annotation: Domain name=M; Domain location=218-238; Score=5.8; E_ value=22; Accession=PF02370.7; Description=M protein repeat
  Pfam annotation: Domain name=M; Domain location=274-294; Score=8.0; E_ value=11; Accession=PF02370.7; Description=M protein repeat
  Pfam annotation: Domain name=M; Domain location=404-424; Score=5.4; E_ value=24; Accession=PF02370.7; Description=M protein repeat
  Pfam annotation: Domain name=M; Domain location=425-445; Score=0.4; E_ value=1.1e+02; Accession=PF02370.7; Description=M protein repeat
  Pfam annotation: Domain name=M; Domain location=537-557; Score=3.3; E_ value=46; Accession=PF02370.7; Description=M protein repeat
  Pfam annotation: Domain name=M; Domain location=57-77; Score=0.6; E _value=1.1e+02; Accession=PF02370.7; Description=M protein repeat
  Pfam annotation: Domain name=M; Domain location=598-620; Score=0.3; E_ value=1.2e+02; Accession=PF02370.7; Description=M protein repeat
  Pfam annotation: Domain name=M; Domain location=681-701; Score=2.8; E_ value=54; Accession=PF02370.7; Description=M protein repeat
  Pfam annotation: Domain name=M; Domain location=730-750; Score=0.9; E_ value=96; Accession=PF02370.7; Description=M protein repeat
  Pfam annotation: Domain name=Pox_A_type_inc; Domain location=106-128; Score=12.5; E_value=1.2; Accession=PF04508.3; Description=Viral A -type inclusion protein repeat
  Pfam annotation: Domain name=Pox_A_type_inc; Domain location=213-233; Score=7.7; E_value=6.1; Accession=PF04508.3; Description=Viral A-type inclusion protein repeat
  Pfam annotation: Domain name=Pox_A_type_inc; Domain location=277-299; Score=2.1; E_value=40; Accession=PF04508.3; Description=Viral A-type inclusion protein repeat
  Pfam annotation: Domain name=Pox_A_type_inc; Domain location=397-419; Score=8.9; E_value=4.1; Accession=PF04508.3; Description=Viral A-type inclusion protein repeat
  Pfam annotation: Domain name=Pox_A_type_inc; Domain location=468-489; Score=4.1; E_value=21; Accession=PF04508.3; Description=Viral A-type inclusion protein repeat
  Pfam annotation: Domain name=Pox_A_type_inc; Domain location=621-643; Score=7.7; E_value=6.1; Accession=PF04508.3; Description=Viral A-type inclusion protein repeat
  Pfam annotation: Domain name=Pox_A_type_inc; Domain location=828-850; Score=9.0; E_value=3.9; Accession=PF04508.3; Description=Viral A-type inclusion protein repeat
  Pfam annotation: Domain name=Spectrin; Domain location=218-312; Score= 1.4; E_value=0.033; Accession=PF00435.11; Description=Spectrin repeat
  Pfam annotation: Domain name=Tropomyosin; Domain location=99-310; Score=-120.2; E_value=0.098; Accession=PF00261.10; Description =Tropomyosin
  Pfam module annotation: Pfam domain module=M::M::M::M::M::M::M::M::M:: Pox_A_type_inc::Pox_A_type_inc::Pox_A_type_inc::Pox_A_type_inc::Pox_A_ type_inc::Pox_A_type_inc::Pox_A_type_inc::Spectrin::Tropomyosin; Domain location=...
  Pfam module annotation: Domain location=218-238::274-294::404 -424::425-445::537-557::57-77::598-620::681-701::730-750::106 -128::213-233::277-299::397-419::468-489::621-643::828-850::218 -312::99-310
EKLKLSGENFLRTDSLLSQALSNNAELEQKVKSLEDLHNESGAAAATATQRSLELEGHIQTSTAAAEEAKSQLRELETRFIAAEQRNVELEQQLNLVQLKTSDAEREVAELSEQISNLNAKLEEAKEEKSLLNSQLQEYTEKVALLESDLNQSSLRSSQLEEELKNVNEKCAEHEDRASMNHERSRELEDLIQSSHSKLEDSDKKVSELELLLEAEKYRIQELEQQISTLEEKRGASEGQANKYLDDVSNLTSELEAIQARASTLETTLQAANERGKELEDSLNAVTEEKKNLEDASISLNEKLAEKENLLEILRDDLNLTQDKLQSTESDLREAELRESEIIEKLKASEENLVVRGRDIEETAARHSELQLLHESLTRDSEQKFQEAIEKFNNKDSEVQSLLEKIKILEEQIAKAGEQSTSVKNEFEESLSKLASLESENEDLKRKILEAESKSSQSFSENELLVGTNIQLKTKIDELEESLNHALSEKEAAAQELVSHKNSITELNDLQSKSSEIQCANEALILKVESQLQEALQRHTEKESETKELNEKLNTLEGQIKLFEEHAREAVATSGTHKAELEQSLIKLKHLEIVIEELQNKSLHHEKETAGLNEENSKLNQEIASYESKLSDLQEKLSAALVEKEETDKELLTLKDAMEKLGTKHSAEVQTLNSQISSLVDEKNLLNDTNQDLKKELQSLIFDLEEKLKEQQKIEGSLRSEVETLKIEIAEKSALRSQLQEIEGKLTKAESRLNEEVGSVQAAASQREAELSSKLEDYAQKFNDRNVLNDKVAALEKELQLARDGNVNQEGAESQKLELEAALKNSLEELETKKNDISLLQKQVTDLEQKLRVAGDKSSVKGDESVDQKEGLEVKSRDIGSSLSIPSKRKSKKKSEVTSGQTSSSSETHVQTGHDSPVINFKFILGVALVSIVFGIILGKRY

SEQ ID NO: 128283 - protein, 445 aa, Glycine max
  Coding DNA Sequence Number=SeqID_11505
  Gene Ontology: Mol. function=transcription factor activity; Cellular component=nucleus; Biological process=regulation of transcription
  Homolog annotation: Hit_ID=Q9FHZ1; Match level="QueryCoverage=80%, HitCoverage=88%, E-value=1e-136, Identity=69%"; Hit description =SCARECROW gene regulator-like protein
  Pfam annotation: Domain name=GRAS; Domain location=45-342; Score =392.0; E_value=8.9e-115; Accession=PF03514.5; Description=GRAS family transcription factor
  Subcellular localization annotation: CTP_CleavageSite=16; ConfidenceScore=5.04e-01
MLQSLVPRSPRTSNPNAMKTKRPVDASDLSPADEPSFKRTNFSADRTAAEAVEEQAFDPEPHGGESTGLKLLGLLLQCAECIAMDNLDFANDLLPEIAELSSPYGTSPERVGAYFAQALQARVLSSCIGSYSPLTAKSVALTQSQRIFNAFQSYNSVSPLVKFSHFTANQAIFQSLDGEDSVHIIDLDIMQGLQWPGLFHILASRSKKIRSVRITGFGSSSELLDSTGRRLADFASSLGLPFEFFPVEGKIGSVTELSQLGVRPNEAIVVHWMHHCLYDITGSDLGTLRLLTQLRPKLITTVEQDLSHAGSFLARFVEALHYYSALFDALGDGLGEDSLERHTVEQHLLGCEIRNIVAVGGPKRTGEVKVERWGEELKRAGFGPVWLRGNPAAQANLLLGMFPWRGYTLLQENASLKLAWKDFSLLIASAWQPQYKNICFIHSSH

SEQ ID NO: 128284 - protein, 67 aa, Glycine max
  Coding DNA Sequence Number=SeqID_11506
MEENSQSGYISYFAGKTVYKRVVILPSEFGIHAGISFQPSTHAKGYSLNFKFELTLENQNFDNIFKY

SEQ ID NO: 128285 - protein, 272 aa, Glycine max
  Coding DNA Sequence Number=SeqID_11507
MGTRGCINYNPILAIRQLGYPMRGAPSKESITPFIARGFSDPNTRVLQGVRKAWDTVRRKDKELRGSSNGIIGGYHKGMRVRTQGLDWLPKLKAVRDEEAEALEESEEVQALKAELERARVVKEKFKSIAIKVQREYDELRDVNMATAKALERETKRARKEEHDRNKFQGALFDSNSELKLRRDERDQSQVKGMILKDELKDCLRSKRNLSQQLSETEGNMWAIIDEYKEKLNLAVTHEQRLEDEYAKQSAEREAMERPPKKFMGSSAIAST

SEQ ID NO: 128286 - protein, 177 aa, Glycine max
  Coding DNA Sequence Number=SeqID_11508
MGDVEEVQEQMKANMSTLKDQMASMMEAMLGMKRLIESNATTVVAASNTAEVDPVLSSTANPVHQLAPDIMGRGRDTLGNTNSPHLGYNRSAYPYGLPPNFTPPAMHENMDHTAPPTFEGQPPQPTGGAREDPWERAQGDDDSYPLFTTEGPTPNALPQPNIMGSLNLARCNHYSSP

SEQ ID NO: 128287 - protein, 132 aa, Glycine max
  Coding DNA Sequence Number=SeqID_11509
  Gene Ontology: Cellular component=nucleolus
  Homolog annotation: Hit_ID=Q8S348; Match level="QueryCoverage=96%, HitCoverage=91%, E-value=4e-21, Identity=40%"; Hit description=Auxin- induced SAUR-like protein
  Pfam annotation: Domain name=Auxin_inducible; Domain location=5-93; Score=35.2; E_value=6.6e-09; Accession=PF02519.5; Description=Auxin responsive protein
MAWKWQKEVTNYQMKRILWPKTQENVAKAEKKGHFVVYSSDKRRFVLPLLYLNNKIFRELFKLAEEEFGLSSNVPLTLPCEATLIEYVITLIQRNVTKDLEEAVLMFVATSRCQSHVDLHRERTNQHLLCSY

SEQ ID NO: 128288 - protein, 126 aa, Glycine max
  Coding DNA Sequence Number=SeqID_11510
  Gene Ontology: Cellular component=nucleolus
  Homolog annotation: Hit_ID=Q651Q9; Match level="QueryCoverage=62%, HitCoverage=62%, E-value=7e-14, Identity=45%"; Hit description =Putative auxin induced protein
  Pfam annotation: Domain name=Auxin_inducible; Domain location=10-83; Score=2.5; E_value=2.1e-05; Accession=PF02519.5; Description=Auxin responsive protein
MTLQAQFPVMWFVYDATWHMHHISTTPPNKGHLLVYIPLKYLSTNVFRELLNWYEEEFGLPSNGPITLPCDSVLLDYVILLFREHVPEQVEKALITSMVACHHEASSSSSSLALRQSNEPMIIYGF

SEQ ID NO: 128289 - protein, 120 aa, Glycine max
  Coding DNA Sequence Number=SeqID_11511
MTNAQPACVGVEAVGLVGCWDPITSFPLILLCLFLFKTKQNLHMEVHSCTHGLCNLISKAKEILNELEGLLGDVTNAIQTTDGNLLALSDLDFDVELNEQVEAIISGIQPGLTMVVGPPD

SEQ ID NO: 128290 - protein, 134 aa, Glycine max
  Coding DNA Sequence Number=SeqID_11512
  Homolog annotation: Hit_ID=Q1RXP4; Match level="QueryCoverage=70%, HitCoverage=6%, E-value=1e-18, Identity=55%"; Hit description=AAA ATPase
MTKVYGTGLYDFWRHRVAEYPVAAAPAESKEVVPKTGGGGGVPSSITLSEIQRDQLTKIAEANWLKSSDAGRPKKDFDPELVRKIYETELLVKEGSEPVEYPPPPPPSAVKYDTSITSCAARVFLLLTPSETCT

SEQ ID NO: 128291 - protein, 61 aa, Glycine max
  Coding DNA Sequence Number=SeqID_11513
MPSSSRPPGCARNCPPPHSKCQNPGRSVHFAPHEYTQHPTYERGPKQVPKTLEGQCTSPST

SEQ ID NO: 128292 - protein, 221 aa, Glycine max
  Coding DNA Sequence Number=SeqID_11514
  Gene Ontology: Mol. function=DNA binding
  Homolog annotation: Hit_ID=Q1SFS3; Match level="QueryCoverage=88%, HitCoverage=36%, E-value=5e-19, Identity=31%"; Hit description =Lambda repressor-like, DNA-binding
MAEVSTEAIASLTQYYDQPLRCFTFGDFQLTLTVEEFEEILGCSLGGRKPYLLLGFYPSLARISKIVKISAQELDRGKQVENGAVGVPRKGLEAKARTLASQDEWALFMDVLTLLIFEVVLFPNVDGLVDLAAIDVFLAFHDRKESLVVAILADLYDTFDQRCEKNSARIVCCTPVLYVLVGFTPFLPRGETHLSTRRPPLMHREEGGKLGSTLSKQRRTV

SEQ ID NO: 128293 - protein, 91 aa, Glycine max
  Coding DNA Sequence Number=SeqID_11515
MLRNLTDYVIIPFLPSGTLRNFTDCALTLPFNFRHVTELHGLCYNTFLLASCMSRNFTYCLTMGAKYLEVVKRGSHPNNGWFPDEIRDSKA

SEQ ID NO: 128294 - protein, 58 aa, Glycine max
  Coding DNA Sequence Number=SeqID_11516
QKNVYTDNHSDISARQRDSKVSMTDLVSAEDDAFRLTNSKKVYTDDHSGISARQRDSK

SEQ ID NO: 128295 - protein, 111 aa, Glycine max
  Coding DNA Sequence Number=SeqID_11517
IPRFPALVTGLCQSYRVPVPPARGHARKTLSGPEEVRQVLELPALITNLCQFYEVPVAPSKPGDGRQRATDAPPSPLEFTSAHPQKGYSVAYDPWPTNRRPSPKSKGRKVL

SEQ ID NO: 128296 - protein, 503 aa, Glycine max
  Coding DNA Sequence Number=SeqID_11518
  Gene Ontology: Mol. function=5'-3' exonuclease activity; Biological process=DNA recombination
  Homolog annotation: Hit_ID=Q1GZK5; Match level="QueryCoverage=76%, HitCoverage=68%, E-value=1e-148, Identity=69%"; Hit description =Single-stranded-DNA-specific exonuclease RecJ
  Pfam annotation: Domain name=DHH; Domain location=140-303; Score =173.2; E_value=6.3e-49; Accession=PF01368.10; Description=DHH family
MATMWADKKITNAVWVADQWQSVDWADIADAIQTGQVSELNVVLPFAERSVHIQYKKQFRWQFWRKAYTLETLLQQLETTLSTISNFETLLAQGLPPLLARLLAARAVSADDWVLQEMPHLLKPDALTGATQMAQLLADAIAQQKRILIIGDYDADGATATSVAMRGLLMMGAQVDFLVPNRFEYGYGLTPEIVALAATQQPDVILTVDNGIASIDGVIAAKALGMQVLITDHHLPAEQTPAADCIVNPNQRGCDFPSKHLAGVGVMFYVLIALRAELKQRGMLAEDRVHLGSLLDLVALGTVADLVKLDANNRILVRQGLKRIRQGQACPGILAILKLAGRDPEQVNAQDLGFYVGPRLNAAGRLDDMTIGIRCLLAETPQEAMQYAQQLHVLNAERKQIEAEMQWDAMADLAQDFKDTQYTISVFQPDWHQGVIGILASRIKERYHRPVIAFADAGEALIKGSGRSIAGLHLRDALDLVTKQQPDLIVKFGGHAMAAVKSI

SEQ ID NO: 128297 - protein, 340 aa, Glycine max
  Coding DNA Sequence Number=SeqID_11519
  Gene Ontology: Mol. function=nucleoside-triphosphatase activity; Cellular component=membrane; Biological process=transport
  Homolog annotation: Hit_ID=Q6D592; Match level="QueryCoverage=68%, HitCoverage=100%, E-value=5e-99, Identity=77%"; Hit description =Putative ABC transport ATP-binding subunit
  Pfam annotation: Domain name=ABC_tran; Domain location=135-318; Score= 161.0; E_value=3.1e-45; Accession=PF00005.17; Description=ABC transporter
MLKTLRLGHERHRPAGLLSHGQKQFLEIGMLLVQEPHLLLLDEPAAGMTDAETDYTAELFRELAGKHSLMVVEHDMGFVETIADRVTVLHQGQVLAEGSLAQVQADERVIEVEELNQYYGGSHILRGLSFEARIGEVTCLLGRNGVGKTTLLKCLMGLVPARSGSVRWQGEIITGKKPHQRVRAGIAYVPQGREIFPRLTVEENLLMGLARFSGAAARTVPDPIYELFPVLRQMKDRRGGDLSGGQQQQLAIGRALACRPQLLILDEPTEGIQPSVIKEIGAVIKQLAAKGDMAILLVEQFYDFAADLADSYLVMSRGSIVQRGAGSNMEQDGVRGLVAI

SEQ ID NO: 128298 - protein, 233 aa, Glycine max
  Coding DNA Sequence Number=SeqID_11520
  Gene Ontology: Mol. function=transporter activity; Cellular component= membrane; Biological process=transport
  Homolog annotation: Hit_ID=Q66D19; Match level="QueryCoverage=52%, HitCoverage=34%, E-value=7e-44, Identity=76%"; Hit description=ABC type branched-chain amino acid transporter, permease protein precursor
MAACCGVPTGRVDMLAFGLGSGIAGLGGVALSQLGNVGPELGQGYIIDSFLVVVLGGVGQLAGTVAAAFGLGIVNKILEPQIGAVLGKILILVLIVLFIQKRPQGLFALKGRKAPRLALSIGALALLALLVMPFMTLLPADHPLAVSTYTLTLAGKILCYAVVAVALDLVWGYAGLLSLGHGLFFALGGYAMGHVPECGRRRATGCRRLWRSSPGMSCRGSGAAPSISPGRCA

SEQ ID NO: 128299 - protein, 56 aa, Glycine max
  Coding DNA Sequence Number=SeqID_11521
MRNALRLDSMKKPFDNMYEMPLRKISAKRSRRDAAAEGTSAALEFDSHRFRSAEHQ

SEQ ID NO: 128300 - protein, 102 aa, Glycine max
  Coding DNA Sequence Number=SeqID_11522
MGLYETFSMLISCTSCTSCTGLPFLKLASQTCGFNNSDELANASGEMPFHVKSPAVLAVCPDTCCVAAKSLLAMAVCMKNACSSRKKEHHAGISYKRTPFGE

SEQ ID NO: 128301 - protein, 105 aa, Glycine max
  Coding DNA Sequence Number=SeqID_11523
  Subcellular localization annotation: CTP_CleavageSite=56; ConfidenceScore=5.58e-01
MAFVSCTSCTLGLPFLKLASQTCSFSSSDKLSSASGEMPFHVKSPAVLAVCPDTCRVAAKSLLAMAVCLETACNSCYFDNNLVPPAKHQPPGDREFAYQKMMLVK

SEQ ID NO: 128302 - protein, 170 aa, Glycine max
  Coding DNA Sequence Number=SeqID_11524
  Gene Ontology: Mol. function=protein dimerization activity
  Homolog annotation: Hit_ID=Q2QPQ7; Match level="QueryCoverage=75%, HitCoverage=25%, E-value=2e-10, Identity=30%"; Hit description=HAT family dimerisation domain containing protein
MREIIVIVIMVHEEPFSIVEDEVWMWAPHMLNQNFRSMETSKESFEFCESASSKAWNRCGYCNFQMFKSLGVENKVFSISVDNASYNDSCLKNLKDNLSSSMQDGLSQIKESISNVRESVKYINHDDARLNRRQLIISGSDYLTVNLYLEEVWRVKKVIDDATEDKDFFM

SEQ ID NO: 128303 - protein, 77 aa, Glycine max
  Coding DNA Sequence Number=SeqID_11525
MASPSIPATANEVNTVNAHDKDQVNEDVIKRRIGKKHQQFGMILRKLELPEGLKKADFKYCKEKLATMVVKDPALAL

SEQ ID NO: 128304 - protein, 211 aa, Glycine max
  Coding DNA Sequence Number=SeqID_11526
  Gene Ontology: Mol. function=sequence-specific DNA binding; Cellular component=nucleus; Biological process=regulation of transcription
  Homolog annotation: Hit_ID=Q5IY47; Match level="QueryCoverage=99%, HitCoverage=63%, E-value=3e-49, Identity=43%"; Hit description=DNA binding protein WRKY2
  Pfam annotation: Domain name=WRKY; Domain location=74-132; Score =128.5; E_value=1.8e-35; Accession=PF03106.6; Description=WRKY DNA -binding domain
  Subcellular localization annotation: CTP_CleavageSite=69; ConfidenceScore=5.30e-01
MTHQQMLAQITSQAVPAHFNVQIHSEHPFSISAVSATSLTQFPTGSSTRVKESLHYSHSEQKLQSSSVNADKPNDDGYNWRKYGQKHVKGRDFSRSYYKCTHPNCPVKKKLERSLEGHVTAIIYKGEHNHQRPHPNKITKETQTSNINSVSKMDLESSQATGEHGSGTSDSEEVGDHESEEDEKNDEPDAKRSFMILQKHRSQAPGSSLFT

SEQ ID NO: 128305 - protein, 122 aa, Glycine max
  Coding DNA Sequence Number=SeqID_11527
  Gene Ontology: Mol. function=sequence-specific DNA binding; Cellular component=nucleus; Biological process=regulation of transcription
  Homolog annotation: Hit_ID=Q9ZPL6; Match level="QueryCoverage=98%, HitCoverage=54%, E-value=4e-33, Identity=52%"; Hit description=DNA -binding protein 2
  Pfam annotation: Domain name=WRKY; Domain location=18-66; Score=59.5; E_value=1.1e-14; Accession=PF03106.6; Description=WRKY DNA -binding domain
MAQIWAESCQRQPISKEKKVMHVFMICRSYYKCATQGCNVRKHVERASMDPKAVLTTYEGKHNHDVPVAKTNSHTLANNSASQLKAQNIAIPDDKHSFSSRGVRGNEQRPLGSLRLKEEQIT

SEQ ID NO: 128306 - protein, 60 aa, Glycine max
  Coding DNA Sequence Number=SeqID_11528
MGKQGWNLLANPDSMVAWIFKAKYYPNGDFMEAKMGCNLMKKKKVEAVGVSLSEADVLSE

SEQ ID NO: 128307 - protein, 142 aa, Glycine max
  Coding DNA Sequence Number=SeqID_11529
MVGVKGFVISDSKCERSIEQIAREGKLPDTEMDKEVKGGLVMMWKGSIKGEVMSLAKNFINLKVMDELLRSLASRISNPWCIIGDFNNLLMKKDKCEAMENCGLKDIIAEGYPFTWFNSRGIGRIVGQSYGNFQVVEFIPRG

SEQ ID NO: 128308 - protein, 102 aa, Glycine max
  Coding DNA Sequence Number=SeqID_11530
MADEKLKGQKVKFFGVPEPSPTYPKAKAFLLGQKVKFFGVPEPSPTYRKAEAFLLGLAVLCLIWPKNDLWDKRLNFLVFLSLLRHKVVTESKLCSAFEGQSY

SEQ ID NO: 128309 - protein, 67 aa, Glycine max
  Coding DNA Sequence Number=SeqID_11531
MFCENAPTIWDQHRLKGALKPGDTKAYTPKSPSWPLPPDSAYNTNNVTSRVNHTLIHNQNSFTIHIS

SEQ ID NO: 128310 - protein, 322 aa, Glycine max
  Coding DNA Sequence Number=SeqID_11532
  Homolog annotation: Hit_ID=Q9LI95; Match level="QueryCoverage=80%, HitCoverage=55%, E-value=3e-92, Identity=60%"; Hit description =Arabidopsis thaliana genomic DNA, chromosome 3, P1 clone:MUO22
  Pfam annotation: Domain name=DUF1336; Domain location=88-306; Score =377.5; E_value=2.1e-110; Accession=PF07059.3; Description=Protein of unknown function (DUF1336)
MMSNYILQEKTMRMPDGFPFVSNALGSVPNTQLLQYENASCVVDSGYKYDGLCDSYFKAGEPERFLYRPRAGLQILNTTQEKPCPGSWSAVSPSVFNLRGVNFFRHVSKLDKQKCPAPDFSPYIPIGVDLFACPRKLPTYAASMFPGDADGEGMSLVLYFKLSENFAKDTSPHFQESIKRLVDDEMEKVKGFAQESLVPFSERLKILAGVVNPEDLQLNSAERKLIHAYNGKPVLSRPQHKFFKGPNYFEIDLDIHRFSYISRKALHSLRDRTKNVVLNLGLTIQAQKQEELPEQVLCCLQLNKIDFANDGQIPTIVALDDN

SEQ ID NO: 128311 - protein, 99 aa, Glycine max
  Coding DNA Sequence Number=SeqID_11533
MMKHKLDKCLLEIGQSTDSNNRTHHILGFEEDDSCTVLDHTFIYKLKHTKLLEHVKASTPNPSFCLSRLPFIRVVSRKELVGFRCWKTHETNPRMWERP

SEQ ID NO: 128312 - protein, 76 aa, Glycine max
  Coding DNA Sequence Number=SeqID_11534
  Homolog annotation: Hit_ID=Q1SDN9; Match level="QueryCoverage=70%, HitCoverage=46%, E-value=1e-07, Identity=44%"; Hit description =Polynucleotidyl transferase, Ribonuclease H fold
MRTKTGCFNGTPEPKEVEVWDLYHALQWIVELGIQNVEYELDCKIVVEALSSKSTGTYDFHVILSFIFIKLTSEFC

SEQ ID NO: 128313 - protein, 184 aa, Glycine max
  Coding DNA Sequence Number=SeqID_11535
MDAVSSARVSTDATSSHAKPSTKEYDPLRRSNRKVKRKSNGGEEDCDMDIEKENVGDPITTNKSCCPMGLFNDKITSLQVKGRFTRICVDLELDKPLQPKVIARGYLINLQYEGRASCDLFQMWEIWSQGVAVWCRSIAKRREAEFRGHRRHRNSAATTRGGFQYWGDLRCSTISPTESANDGI

SEQ ID NO: 128314 - protein, 135 aa, Glycine max
  Coding DNA Sequence Number=SeqID_11536
MENISQGRTSVDNYIILQELVHSFTNLKGAKVHLLLALTRMEPRWRTFALKGTAARIWRTFTFWTDCWIPGFKPLSSMTQIQIPQHELGLLVSAYATPEGWNWNLLGQLRPPHVCYVIAAVNPPNPEKQMVVLTF

SEQ ID NO: 128315 - protein, 125 aa, Glycine max
  Coding DNA Sequence Number=SeqID_11537
MWTIKLDERIKMTKDKLQMWNMKKSRRTVNDQELDDRNTTVPKVQTRAGRGGGEMVAGVAEDVDADDGQSKRLRGDDVNDDENNRCKKEPDRDRARDRDCEHSSGLGGMIMRDFITELPWEAAME

SEQ ID NO: 128316 - protein, 548 aa, Glycine max
  Coding DNA Sequence Number=SeqID_11538
  Gene Ontology: Mol. function=protein-tyrosine kinase activity; Cellular component=integral to membrane; Biological process=protein amino acid phosphorylation
  Homolog annotation: Hit_ID=Q94CI5; Match level="QueryCoverage=99%, HitCoverage=99%, E-value=1e-162, Identity=57%"; Hit description =Protein kinase AtSIK
  Pfam annotation: Domain name=Pkinase; Domain location=169-444; Score=- 8.6; E_value=4.8e-08; Accession=PF00069.15; Description=Protein kinase domain
  Pfam annotation: Domain name=Pkinase_Tyr; Domain location=192-444; Score=-10.7; E_value=8.1e-12; Accession=PF07714.7; Description =Protein tyrosine kinase
  Pfam module annotation: Pfam domain module=Pkinase::Pkinase_Tyr; Domain location=169-444::192-444
  Subcellular localization annotation: CTP_CleavageSite=77; ConfidenceScore=5.27e-01
MGCFTVLKSKKKKSDPITYIKHVSHNENVPTVLPEPQTRTRSLQSAPPSFRTRVKPIQPINKASNNRTRTLSAPSTLDAAEQDALASIEYEEQEESRHRAGSMKEQRSSSPQPLPLPSPQGGSALKAIGSFKSVASSSPLHASGPLPLPPTGSLRNFLYEEIAAACHHFSSDRCMSECLSSTIYKASFGDDVSSSKKFEATVTRLHPSSQGLKEFINEVNTLASLQHPNLCKLLGFHAREGSEHRMLVYERLYHGSLDRLLYGRSDGPSIDWNTRMKIAICAAQGLTFLHEEGPFQAMYNEFSTANIQIDKDFSAKLSGYGCVGHIPEEEISSSSSAVGNLSMETLEKGMLTPKSNVWSFGIFLLELLTGRKNLDSRHPKEERNLVKWSRPFLADNYRLSLIMDPQLKGRFPSKAARTIADIAQRCLQKEPSDRPTMRTVVEHLKIIQDLKYSCRFPLQEPASNSGKHMSRSPSLNGIICPAPRLSFSPSPPSGVPVSVSPPRWSGGGPILLPPPRACASSLSLEELDRQESRKSSSSASRRASVEGF

SEQ ID NO: 128317 - protein, 232 aa, Glycine max
  Coding DNA Sequence Number=SeqID_11539
  Gene Ontology: Mol. function=translation elongation factor activity; Cellular component=cytoplasm; Biological process=translational elongation
  Homolog annotation: Hit_ID=Q2QYK4; Match level="QueryCoverage=66%, HitCoverage=66%, E-value=1e-66, Identity=76%"; Hit description =Elongation factor P, putative, expressed
  Pfam annotation: Domain name=EFP; Domain location=141-195; Score =90.1; E_value=6.8e-24; Accession=PF01132.10; Description=Elongation factor P (EF-P)
  Pfam annotation: Domain name=EFP_N; Domain location=77-134; Score =111.2; E_value=3e-30; Accession=PF08207.2; Description=Elongation factor P (EF-P) KOW-like dom
  Pfam module annotation: Pfam domain module=EFP::EFP_N; Domain location=141-195::77-134
  Subcellular localization annotation: CTP_CleavageSite=66; ConfidenceScore=5.95e-01
MVAGTATLKLSLSAFSSPMSNFSASSSFPSRLPMRTPSSSKPRFLSESLRSLISTLSLTTLRFSLTCAFLSGIYALTSNDIKVGTNLEVDGAPWRVLEFLHVKPGKGAAFVRTKMKNYITGNTVEKTFRAGSSIEQADVFKETKQFTYKDGAQFVFMDLNTYEEFRLGEKEIGDRTKWLKEGMDCNLLLWNGKVIDVELPITIKLAVVDVDPGLKGDTAQGGTFCLYCKLLF

SEQ ID NO: 128318 - protein, 111 aa, Glycine max
  Coding DNA Sequence Number=SeqID_11540
  Gene Ontology: Mol. function=translation initiation factor activity; Cellular component=protein complex; Biological process=translation
  Homolog annotation: Hit_ID=O04202; Match level="QueryCoverage=67%, HitCoverage=27%, E-value=5e-23, Identity=65%"; Hit description =Eukaryotic translation initiation factor 3 subunit 5
  Pfam annotation: Domain name=Mov34; Domain location=18-109; Score =35.6; E_value=1.7e-07; Accession=PF01398.11; Description=Mov34MPNPAD- 1 family
  Subcellular localization annotation: CTP_CleavageSite=20; ConfidenceScore=5.22e-01
MAASDRTVLQFSSSSSSSQSLSAKVHPLVIFNICDCYVRRPDQADRVIGTLLGSVLPDGTVDIRNSYAVPHNESIEQDLASYLARVDVTNFILEILVNSSFRLLEGGDGME

SEQ ID NO: 128319 - protein, 226 aa, Glycine max
  Coding DNA Sequence Number=SeqID_11541
MNYDFVELLENQKTKTESLFHCVRCTRENFVRQEKEKGKKGRKKGLWERVGANKDIMVSAMYCSITMRTHALLALLFLFLIMFDVSDASFVLKLRKLIGPDPNDTKTKDPNHVGETNKDNGSGPISSPVPQPQPQPLPKVMKNTNDDIKKDNDSAPPVSIPPPPKNDDGGDTGMHKGKDKTEGMKFSHHSTTETCDGFKKCTDDDGGMVACISKIGTHCSLLLIIH

SEQ ID NO: 128320 - protein, 179 aa, Glycine max
  Coding DNA Sequence Number=SeqID_11542
  Gene Ontology: Mol. function=sequence-specific DNA binding; Cellular component=nucleus; Biological process=regulation of transcription, DNA-dependent
  Homolog annotation: Hit_ID=Q8H1D2; Match level="QueryCoverage=86%, HitCoverage=90%, E-value=2e-44, Identity=58%"; Hit description =WUSCHEL-related homeobox 5
  Pfam annotation: Domain name=Homeobox; Domain location=27-88; Score =58.2; E_value=2.6e-14; Accession=PF00046.19; Description=Homeobox domain
  Subcellular localization annotation: CTP_CleavageSite=16; ConfidenceScore=5.09e-01
MEEGMSEFFSSGVSVGGNSGSATTGTKCGRWNPTTEQVKVLTELFSSGLRTPSTDQIQKISNQLSFYGKIESKNVFYWFQNHKARERQKRRKVDKDVIRSENSISINSFTQNFNQLYQVSEPERVIETLQLFPLNSFGESESKNMRVHASDQCRDSTMFSYTVGEQMDHPPLDLRLSFM

SEQ ID NO: 128321 - protein, 183 aa, Glycine max
  Coding DNA Sequence Number=SeqID_11543
  Subcellular localization annotation: CTP_CleavageSite=40; ConfidenceScore=5.14e-01
MEEHGDLSCKNHLSPVVFVHAVSKSSVQACGPVTHVNITRSSSESTQLTLNAGKGDCVLHMVSNIPEENFILRLPSYDKILTPVNGAYFLILMVLVFGGTWACCACRKKHRNEVPYQELEMALPESASATNVESAEGWDQDWDDDWDVNVAVKSPAALAGSISANGLTSRSSNKDGWENNWDD

SEQ ID NO: 128322 - protein, 967 aa, Glycine max
  Coding DNA Sequence Number=SeqID_11544
  Gene Ontology: Mol. function=protein kinase activity; Cellular component=integral to membrane; Biological process=protein amino acid phosphorylation
  Homolog annotation: Hit_ID=Q84XU7; Match level="QueryCoverage=94%, HitCoverage=95%, E-value=0.0, Identity=53%"; Hit description =Receptor-like protein kinase
  Pfam annotation: Domain name=LRRNT_2; Domain location=26-66; Score =57.1; E_value=5.8e-14; Accession=PF08263.3; Description=Leucine rich repeat N-terminal domain
  Pfam annotation: Domain name=LRR_1; Domain location=119-142; Score =17.7; E_value=0.041; Accession=PF00560.23; Description=Leucine Rich Repeat
  Pfam annotation: Domain name=LRR_1; Domain location=144-166; Score =11.3; E_value=2.2; Accession=PF00560.23; Description=Leucine Rich Repeat
  Pfam annotation: Domain name=LRR_1; Domain location=168-190; Score =8.7; E_value=6.7; Accession=PF00560.23; Description=Leucine Rich Repeat
  Pfam annotation: Domain name=LRR_1; Domain location=192-214; Score =19.4; E_value=0.013; Accession=PF00560.23; Description=Leucine Rich Repeat
  Pfam annotation: Domain name=LRR_1; Domain location=216-238; Score =12.3; E_value=1.4; Accession=PF00560.23; Description=Leucine Rich Repeat
  Pfam annotation: Domain name=LRR_1; Domain location=240-262; Score =16.0; E_value=0.13; Accession=PF00560.23; Description=Leucine Rich Repeat
  Pfam annotation: Domain name=LRR_1; Domain location=264-286; Score =10.6; E_value=3; Accession=PF00560.23; Description=Leucine Rich Repeat
  Pfam annotation: Domain name=LRR_1; Domain location=288-310; Score =16.4; E_value=0.11; Accession=PF00560.23; Description=Leucine Rich Repeat
  Pfam annotation: Domain name=LRR_1; Domain location=312-334; Score =15.2; E_value=0.24; Accession=PF00560.23; Description=Leucine Rich Repeat
  Pfam annotation: Domain name=LRR_1; Domain location=336-358; Score =9.5; E_value=4.7; Accession=PF00560.23; Description=Leucine Rich Repeat
  Pfam annotation: Domain name=LRR_1; Domain location=359-381; Score =2.7; E_value=88; Accession=PF00560.23; Description=Leucine Rich Repeat
  Pfam annotation: Domain name=LRR_1; Domain location=387-409; Score =15.8; E_value=0.15; Accession=PF00560.23; Description=Leucine Rich Repeat
  Pfam annotation: Domain name=LRR_1; Domain location=411-433; Score =13.8; E_value=0.63; Accession=PF00560.23; Description=Leucine Rich Repeat
  Pfam annotation: Domain name=LRR_1; Domain location=435-457; Score =11.6; E_value=1.9; Accession=PF00560.23; Description=Leucine Rich Repeat
  Pfam annotation: Domain name=LRR_1; Domain location=459-481; Score =8.0; E_value=8.9; Accession=PF00560.23; Description=Leucine Rich Repeat
  Pfam annotation: Domain name=LRR_1; Domain location=483-505; Score =18.4; E_value=0.026; Accession=PF00560.23; Description=Leucine Rich Repeat
  Pfam annotation: Domain name=LRR_1; Domain location=507-529; Score =19.5; E_value=0.012; Accession=PF00560.23; Description=Leucine Rich Repeat
  Pfam annotation: Domain name=LRR_1; Domain location=531-554; Score =10.3; E_value=3.4; Accession=PF00560.23; Description=Leucine Rich Repeat
  Pfam annotation: Domain name=LRR_1; Domain location=95-117; Score =16.0; E_value=0.14; Accession=PF00560.23; Description=Leucine Rich Repeat
  Pfam annotation: Domain name=Pkinase; Domain location=684-953; Score =108.1; E_value=2.7e-29; Accession=PF00069.15; Description=Protein kinase domain
  Pfam annotation: Domain name=Pkinase_Tyr; Domain location=684-953; Score=74.8; E_value=2.8e-19; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::Pkinase::Pkinase_Tyr; Domain ...
  Pfam module annotation: Pfam domain module=location=26-66::119 -142::144-166::168-190::192-214::216-238::240-262::264-286::288 -310::312-334::336-358::359-381::387-409::411-433::435-457::459 -481::483-505::507-529::531-554:...
  Pfam module annotation: =:95-117::684-953::684-953
MQFSMCVLFLILLAPVMLVFSVDPGFNDDVLGLIVFKAGLDDPKRKLSSWNEDDNSPCNWEGVKCDPSSNRVTGLVLDGFSLSGHVDRGLLRLQSLQILSLSRNNFTGPINPDLHLLGSLQVVDLSDNNLSGEIAEGFFQQCGSLRTVSFAKNNLTGKIPESLSSCSNLASVNFSSNQLHGELPNGVWFLRGLQSLDLSDNLLEGEIPEGIQNLYDIRELSLQRNRFSGRLPGDIGGCILLKSLDLSGNFLSGELPQSLQRLTSCTSLSLQGNSFTGGIPEWIGELKNLEVLDLSANGFSGWIPKSLGNLDSLHRLNLSRNQLTGNLPDSMMNCTRLLALDISHNHLAGYVPSWIFRMGVQSISLSGNGFSKGNYPSLKPTPASYHGLEVLDLSSNAFSGVLPSGIRGLSSLQVFNISTNNISGSIPVGIGDLKSLYIVDLSDNKLNGSIPSEIEGATSLSELRLQKNFLGGRIPAQIDKCSSLTFLILSHNKLTGSIPAAIANLTNLQYVDLSWNELSGSLPKELTNLSHLFSFNVSYNHLEGELPVGGFFNTISSSSVSGNPLLCGSVVNHSCPSVHPKPIVLNPNSSGSNSSISSQNHRHKIILSISALIAIGAAAFIAIGVVAVTVLNIHVRSSMEHSAAPFAFSGGEDYSCSPANDPNYGKLVMFSGDADFADGAHNLLNKESEIGRGGFGVVYRTFLRDGHAVAIKKLTVSSLIKSQEDFDREIKKLGNVKHPNLVALEGYYWTSSLQLLIYEYLSSGSLHKVLHDDSSKNVFSWPQRFKIILGMAKGLAHLHQMNIIHYNLKSTNVLIDCSGEPKVGDFGLVKLLPMLDHCVLSSKVQSALGYMAPEFACRTVKITEKCDVYGFGILVLEIVTGKRPVEYMEDDVVVLCDMVRGALEEGKVEQCVDGRLLGNFAAEEAIPVIKLGLICASQVPSNRPEMAEVVNILELIQCPSEGQEELE

SEQ ID NO: 128323 - protein, 82 aa, Glycine max
  Coding DNA Sequence Number=SeqID_11545
  Gene Ontology: Mol. function=nucleotide binding; Cellular component =membrane; Biological process=small GTPase mediated signal transduction
  Homolog annotation: Hit_ID=Q40525; Match level="QueryCoverage=92%, HitCoverage=37%, E-value=7e-27, Identity=79%"; Hit description=Nt -rab6 protein
MVTGTRQVSTEEGEAKSRELNVMFIEASAKAGFNIKALFRKIAAALPGMETLSTTKQEDMVDVNLRSSGSHDSQPQSGGCSC

SEQ ID NO: 128324 - protein, 38 aa, Glycine max
  Coding DNA Sequence Number=SeqID_11546
MEEELWEVCGTDPKYYLIVTPAPVSRTRPGCSGRLIEA

SEQ ID NO: 128325 - protein, 154 aa, Glycine max
  Coding DNA Sequence Number=SeqID_11547
  Pfam annotation: Domain name=Transposase_23; Domain location=37-107; Score=-1.8; E_value=0.0018; Accession=PF03017.5; Description =TNP1ENSPM transposase
MQSHELALPLEPKVGPSAACVSTKGSCVDPSPTDPETGDSDKCGLYIEENLSHLVAQGRVYEGSTIVHNIPLLHGQVMVGVEEVKDAEAPVLVPTDEVILVGQVLNTFLAWPTHLVKRLSQQLCLQQNLQMGRMLRLSGMLPCSGCLMNTSHCT

SEQ ID NO: 128326 - protein, 32 aa, Glycine max
  Coding DNA Sequence Number=SeqID_11548
MDLLITTTLELSGADAHNSSGWSSVNGGSILG

SEQ ID NO: 128327 - protein, 102 aa, Glycine max
  Coding DNA Sequence Number=SeqID_11549
  Gene Ontology: Mol. function=protein kinase activity; Cellular component=nucleus; Biological process=protein amino acid phosphorylation
  Homolog annotation: Hit_ID=Q9SYX2; Match level="QueryCoverage=81%, HitCoverage=8%, E-value=2e-28, Identity=70%"; Hit description =Phytochrome A supressor spa1
MDVEPRRIQSSVGCLGSFFEGLCKLAHYNKFEECGRLRNRDLLSSANVMCVLSFDRDEDHIAAGGVSKKIKIFDLNAISSDSVDIQYPLVEMPNKSKLSCVK

SEQ ID NO: 128328 - protein, 93 aa, Glycine max
  Coding DNA Sequence Number=SeqID_11550
MENNDGLWWLMVVVGDGESVWDKCSRERKLRAHSRHLLKDPNSQIMGKCLVKLQTKFREDPTVNKGWEEFLPRQLHVASSRSFIKRLSQEASP

SEQ ID NO: 128329 - protein, 124 aa, Glycine max
  Coding DNA Sequence Number=SeqID_11551
MISSTLALIWCWRRFSSTNHAFWCEAKNEGGVVEAHEEEGSNNNEQGGSNPARLGSNHLPPFLIKWREEGDFQGSKRLCAFSSLVRCTREPHAALLSKGPVEGEVSVNIGIAQEKTKRQKGDKA

SEQ ID NO: 128330 - protein, 128 aa, Glycine max
  Coding DNA Sequence Number=SeqID_11552
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=Q2HUX8; Match level="QueryCoverage=67%, HitCoverage=47%, E-value=2e-23, Identity=58%"; Hit description =Peptidase S26A, signal peptidase I; NAD-dependent glycerol-3 -phosphate dehydrogenase, C-terminal
  Pfam annotation: Domain name=NAD_Gly3P_dh_C; Domain location=36-119; Score=-20.7; E_value=4.2e-05; Accession=PF07479.4; Description=NAD -dependent glycerol-3-phosphate deh
MEVKKEGPTKISTLITKQLGINCSILMGANIANEVEDVEGVEFCGTLKNVVAIAAGFADGLEMGNNTKWVGEIGKLSMLMIEIEERGHASFYSLVLLKISTFCFSEYFSLPAVEGMLVSRIYPTNMLG

SEQ ID NO: 128331 - protein, 151 aa, Glycine max
  Coding DNA Sequence Number=SeqID_11553
MAMSSDDGDNGGNSDGCSDDNNNDGGCGNNNGGDGYDEDGGGCYGGKGGVVATTVVMVVAVVTMVKCDDSGGGCYGNDGGSDCYGDDGGGGDDGGCGGGGGDNNSESGGDKVSGGDNGDDYNDNGSGMGGEGKGVREKDYPNLLLFNPTPY

SEQ ID NO: 128332 - protein, 118 aa, Glycine max
  Coding DNA Sequence Number=SeqID_11554
  Gene Ontology: Mol. function=structural molecule activity
  Homolog annotation: Hit_ID=Q1SPB9; Match level="QueryCoverage=63%, HitCoverage=12%, E-value=7e-12, Identity=43%"; Hit description =Transposase
MDHGSQGFLYQPFLLYGVEPNDTGMGNNNDENVGVVFKKWQNIMDAWELLLQSLDEESYNERLKSFTNRCVHYKVFVDYVQNAWLTPFKEKFVQAWIHRVMHLGNTATNRVEGGHARL

SEQ ID NO: 128333 - protein, 132 aa, Glycine max
  Coding DNA Sequence Number=SeqID_11555
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q10LU3; Match level="QueryCoverage=99%, HitCoverage=12%, E-value=1e-46, Identity=69%"; Hit description =Phospholipid-translocating P-type ATPase, flippase family protein, expressed
DKDLSHRTLLQYPKLYGSGHRQEAYNMQLFWITMMDTVWQSLVLFYIPLFTYKDSSIDIWSMGSLWTIAVVILVNVHLAMDINRWDYLSSGKVPYILDNNFAYNYCGIAPTLYLQSCLSNFLAFGYSDSQRS

SEQ ID NO: 128334 - protein, 977 aa, Glycine max
  Coding DNA Sequence Number=SeqID_11556
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q10LU3; Match level="QueryCoverage=97%, HitCoverage=75%, E-value=0.0, Identity=69%"; Hit description =Phospholipid-translocating P-type ATPase, flippase family protein, expressed
  Pfam annotation: Domain name=E1-E2_ATPase; Domain location=123-399; Score=-134.2; E_value=0.086; Accession=PF00122.10; Description=E1-E2 ATPase
  Pfam annotation: Domain name=Hydrolase; Domain location=437-915; Score=36.4; E_value=1e-07; Accession=PF00702.16; Description =haloacid dehalogenase-like hydrolase
  Pfam module annotation: Pfam domain module=E1-E2_ATPase::Hydrolase; Domain location=123-399::437-915
MELGDADSRSVPFEISGASSQVQDSRLNSKSQRIRHKSVQFDDAALHEDSARLIHINDPRRTNGKYEFTGNEIRTSRYTFVTFLPKNLFIQFHRVAYLYFLAIAALNQLPPLAVFGRTVSLFPLLFVLCVTAIKDGYEDWRRHRSDRNENNRESLVLQSGDFRSKKWKKIQAGEVVKIFADETIPADMVLLGTSDQSGLAYIQTMNLDGESNLKTRYARQETAMVVASEACDVFGVIRCEQPNRNIYEFTANMEFNGLKFSLSQSNIVLRGCQLKNTDWIIGVVVYAGQETKAMLNSAASPSKRSRLETYMNRETLWLSIFLFIMCLVVAVGMGLWLVRHKNQLDTLPYYRKRYFTNGSDNGKKYKYYGIPMEAFFSFLSSVIVFQIMIPISLYITMELVRLGQSYFMIEDRDMYDASSGSRFQCRSLNINEDLGQIRYVFSDKTGTLTENKMEFQRASVHGKNYGSSLPMVDNTAAEDVIPKRKWKLKSEIAVDSELMTLLQKDSNREEKIAANEFFLTLAACNTVIPILSDDGFSSLGTNELNEDTRRIDYQGESPDEQALVSAASAYGYTLFERTSGHIVIDVNGEKLRLDVLGLHEFDSVRKRMSVVIRFPDNAVKVLVKGADTSMFSILENGSESNIWHATESHLNEYSSQGLRTLVVASRDLSDAELEEWQSKYEEASTSLTDRATKLRQTAALIESNLKLLGATGIEDKLQEGVPEAIEALRQAGIKVWVLTGDKQETAISIGLSCKLLSGDMQQITINGTSEVECRNLLADAKAKYGVKPSSGGHRNLKHKTNAGHGDLDIPNGSKSLSFPKWNPGNEEGTNAPLALIIDGNSLVYILEKELESELFDLATSCRVVLCCRVAPLQKAGIVDLIKSRTDDMTLAIGDGANDVSMIQMADVGVGICGQEGRQAVMASDFAMGQFQFLKKLLLVHGHWNYQRVGYLVLYNFYRNAVFVMMLFWYVWLSLDIT

SEQ ID NO: 128335 - protein, 430 aa, Glycine max
  Coding DNA Sequence Number=SeqID_11557
  Gene Ontology: Mol. function=protein binding; Cellular component =cellulose and pectin-containing cell wall; Biological process =protein amino acid phosphorylation
  Homolog annotation: Hit_ID=Q2HTP6; Match level="QueryCoverage=83%, HitCoverage=95%, E-value=1e-165, Identity=76%"; Hit description =Leucine-rich repeat, plant specific
  Pfam annotation: Domain name=LRR_1; Domain location=185-208; Score =10.7; E_value=2.9; Accession=PF00560.23; Description=Leucine Rich Repeat
  Pfam annotation: Domain name=LRR_1; Domain location=209-231; Score =11.2; E_value=2.2; Accession=PF00560.23; Description=Leucine Rich Repeat
  Pfam annotation: Domain name=LRR_1; Domain location=232-251; Score =10.0; E_value=3.8; Accession=PF00560.23; Description=Leucine Rich Repeat
  Pfam annotation: Domain name=LRR_1; Domain location=255-277; Score =5.0; E_value=33; Accession=PF00560.23; Description=Leucine Rich Repeat
  Pfam annotation: Domain name=LRR_1; Domain location=280-302; Score =5.0; E_value=33; Accession=PF00560.23; Description=Leucine Rich Repeat
  Pfam annotation: Domain name=LRR_1; Domain location=304-326; Score =8.4; E_value=7.7; Accession=PF00560.23; Description=Leucine Rich Repeat
  Pfam annotation: Domain name=LRR_1; Domain location=328-351; Score =8.2; E_value=8.4; Accession=PF00560.23; Description=Leucine Rich Repeat
  Pfam annotation: Domain name=LRR_1; Domain location=353-373; Score =8.3; E_value=8; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=185-208::209-231::232- 251::255-277::280-302::304-326::328-351::353-373
MPAKLLLTTLYILLVSLPIHMSPHDVNIDTHKFRSSSGHRSKTVGGGSAKGCNNNQFDTNTTPCQKSTTIQAVPASSPPLVFADQRLEVVYPIIQKFKSTITSDPLGVTKTWVGSDICSYKGFYCDIPPDNSSATALASIDLNGFQLSASTLDGFIDNLPDIALFHANSNNFGGTISPQIAKLPYLYELDVSNNQLSGPFPTAVLGMNSLTFLDLRFNSFSGEVPPQIFTQNLQVLFINNNIFTQGLPDNLASTHILLLTLANNKFMGPIPRSLPKALATLSEVLLLNNQLTGCLPYEIGFLEEATVFDAGNNQLTGPLPLSLSCLEKVEVLNLGGNMLYGMVPEVVCVGLVNLVNFSLSDNYFTHVGPLCRMLIQRGVLDVRNNCIPDLPFQRSVMECAEFFATPRMCPFMWFHGLIPCKLPFQHSIHN

SEQ ID NO: 128336 - protein, 53 aa, Glycine max
  Coding DNA Sequence Number=SeqID_11558
MEKSAKWVHLMGMPQFMDEKMKKKKRVRIAALNGCDCPASIANGSTSRLSPRI

SEQ ID NO: 128337 - protein, 192 aa, Glycine max
  Coding DNA Sequence Number=SeqID_11559
  Homolog annotation: Hit_ID=Q8GS71; Match level="QueryCoverage=48%, HitCoverage=8%, E-value=3e-19, Identity=58%"; Hit description =Kinesin-like protein
GNSPNSLKHYAEDIKEPLSPESVPVQKQRKYMPGITNGQVRESAAFVDQSRTDVRFAINADDTHWATVNEKTSNCRTSFWQAMEVEKKPPSVASFAAYNVNLNVIVIIHLLWLSVHFLTYKNDPRNQAIKNQKLGAALDAQQSNQNRAAPCPRSVTPSTSNGENARNWISNLVFKFHDDPTVNESEIVIFLR

SEQ ID NO: 128338 - protein, 96 aa, Glycine max
  Coding DNA Sequence Number=SeqID_11560
MAYEDLLPSLVANQMAMISPGRIYQPPFPKWYNPEEEIPTEGRGHNRALHVSVKCIDHVVAKVTFQVMDINLAYNYLLGRPWIHSVGVVPSTLHQK

SEQ ID NO: 128339 - protein, 691 aa, Glycine max
  Coding DNA Sequence Number=SeqID_11561
  Gene Ontology: Mol. function=microtubule motor activity; Cellular component=microtubule associated complex; Biological process =microtubule-based movement
  Homolog annotation: Hit_ID=Q8GS71; Match level="QueryCoverage=98%, HitCoverage=66%, E-value=0.0, Identity=77%"; Hit description=Kinesin- like protein
  Pfam annotation: Domain name=Kinesin; Domain location=4-146; Score =40.3; E_value=1.3e-16; Accession=PF00225.13; Description=Kinesin motor domain
MCPTSRSHAIFTITLEQMRKLNSHGEISLNDTMNEEYLCAKLHLVDLAGSERAKRTGSDGLRFKEGVHINKGLLALGNVISALGDEKKRKEGVHVPYRDSKLTRLLQDSLGGNSRTVMIACISPADINAEETLNTLKYANRARNIQNKPVVNRDPMSNEMLKMRQQLEYLQAELCARSGGSPEEVQVLKERIAWLEAANEDLRCELHEYRSRCSTVEQCEKDAYENSTCNVKTDGHKRGLPITASDYPMSETTGDSREIEEVEKEWEHTLLQNSMDRELHELNKRLEQKEVSEMKLFGIPDAEALKQHFGRKIMELEDEKRTVQRERDRLLAEVENLAANSDGQMQKSEDIHAQKLKTLEAQILDLKKKQESQVQLLKQKQKSDEAAKRLQDEIQSIKAQKVQLQHRIKQEAEQFRQWKASREKELLQLKKEGRRNEFERHKLQALNQRQKMVLQRKTEEAAMATKRLKELLEARKSSSRDISGSMNGSGTNGQSNEKSLQRWLDHELEVMVKEHEVRFEYEKQSQVRAALAEELAILKQVNGVAAKGLPPPRGKNGFARASSMSPNARMARIASLESMLNISSNSLVAMASQLSEAEERERAFTNRGRWNQLRSMGEAKNLLQYLFNSVGDARCQLWEKDTEIKEIKDQIKELVGLLRQSEMKRKETEKELKAREQAVATTLATPTSVRS

SEQ ID NO: 128340 - protein, 38 aa, Glycine max
  Coding DNA Sequence Number=SeqID_11562
MGQGRSDGLSGVTSSGGLPGATSSGGLPGATTSGSLSD

SEQ ID NO: 128341 - protein, 327 aa, Glycine max
  Coding DNA Sequence Number=SeqID_11563
  Homolog annotation: Hit_ID=Q10LV0; Match level="QueryCoverage=51%, HitCoverage=53%, E-value=1e-33, Identity=47%"; Hit description =Expressed protein
  Pfam annotation: Domain name=PRC; Domain location=196-268; Score =11.4; E_value=0.025; Accession=PF05239.7; Description=PRC-barrel domain
  Subcellular localization annotation: CTP_CleavageSite=60; ConfidenceScore=5.65e-01
MPDFLATNPLTISAAESPRFPFLHSCPTLTPRPQLNPNFRIPFSPKPSKNKSVSLALSSRSNEGSSRGYGFYNELEFEDRKDKTFGLEMNPVVGEDSQSETGSIPFDGVEGGDDKGEDDLVRAQGDADGDGDGLKKGYDDEEGENEKFGGKLRVRRGKEVRPNLLSGDSEKFLLDDISQVGDVVLVQDESVTDNEFKMVGLETLVGYKVVTPSRRNIGKVRGYTFGINSGAVEELELDSFGLSIIPSSLDVLEVVSDAVVVHEAAALRIQRLSKNVRVSVDDFEDFDSEQSDTYGPISRRRKSFGRKKPSHRDWDDEDNWELPMDYL

SEQ ID NO: 128342 - protein, 61 aa, Glycine max
  Coding DNA Sequence Number=SeqID_11564
MKKMMNEKQDILFQFTNAMLDGMKLAFPFGNELVNVEFKDALQETLLAELNAIKKKSESEN

SEQ ID NO: 128343 - protein, 201 aa, Glycine max
  Coding DNA Sequence Number=SeqID_11565
  Gene Ontology: Mol. function=nucleic acid binding; Biological process= DNA integration
  Pfam annotation: Domain name=zf-CCHC; Domain location=92-109; Score =6.2; E_value=0.094; Accession=PF00098.13; Description=Zinc knuckle
MWMENASDIWNTFKKCYYQGDVFRISDLQEEIYLLKQDKVFSILIQQERQLVIQFDDYRVFAQLDTNNGTYGRGRGRGGHTSGGKGRGRSTKICTYCNKSSHMVDTCYKKHGYLPHLHRGGPINQYSMDDQEIKDDLQSLGKKEVSADASSVAFTPEQHKTILSLLQQTSQASPSHATNQLVSSHKNGNSGQLLHEDNWSN

SEQ ID NO: 128344 - protein, 453 aa, Glycine max
  Coding DNA Sequence Number=SeqID_11566
  Gene Ontology: Mol. function=nucleic acid binding; Cellular component= chromatin; Biological process=DNA integration
  Homolog annotation: Hit_ID=Q1T010; Match level="QueryCoverage=98%, HitCoverage=53%, E-value=3e-68, Identity=48%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=1-162; Score=115.0; E_value=2.2e-31; Accession=PF00665.16; Description=Integrase core domain
  Pfam module annotation: Pfam domain module=RVT_2::rve; Domain location=194-321::1-162
MDKFEVIYSDVCGPIQTKSLGGNRYFVSFIDDLTRKVWIYLIKRKSDVFDVFKKFKRMVEKQSGKHIKVLRTNGGGEYVSDVLQKFCEAEGIMHEVTPSYTPQHNGTDERKSRTITNMVRSILKSKKVPNYLWGETSSTTTHITNRSPTKRLSGKTQEQAWACTKSNVTHFRVFGSICFRCVPNQLRRKLDDKGKQMVLVAYHSTGGYKLYDPRHKQIVISRYVIDESKSWDWNTKSFVKCAFKHGVYLKVLKVVTGTNLLIVYLYVDDLQVTGSNEGEIEEFKKKMKKEFEISDLRLLSYFLGIEFKTIDNAVETRMALEKEGDEELINPTYFKKIVGSLRYRCNTRPNLEFSVGLISIFMETPRMPHLLIAKRIIHYVKGTLDYGILFPIGSDNSKVYLLGYSYSDWCGDKSDQKSTASYVFMCEGTPISWCLKKEFVVVLSLCEVEHITA

SEQ ID NO: 128345 - protein, 277 aa, Glycine max
  Coding DNA Sequence Number=SeqID_11567
  Gene Ontology: Mol. function=phosphatidylinositol N-acetylglucosaminyl transferase activity; Cellular component=integral to membrane; Biological process=GPI anchor biosynthetic process
  Homolog annotation: Hit_ID=Q2HRH2; Match level="QueryCoverage=88%, HitCoverage=34%, E-value=1e-106, Identity=76%"; Hit description=N -acetylglucosaminyl transferase component
  Pfam annotation: Domain name=Gpi1; Domain location=1-137; Score =141.1; E_value=2.9e-39; Accession=PF05024.5; Description=N -acetylglucosaminyl transferase component (Gpi1)
MGNPAGFKLNAELAGVLGMASLNAVQIWSTLWIFVGYIFNYIIQGLSVLGILCGFTVPAALVIDMIALATLHISTLHWFISLVYSSQIQALAALWRLFRGRKWNPLRQRLDSFDYTVKQHIVGSLLFTPLLLLLPTTSVFYIFFSIMDTTINLVCLLIEVTISVIHVTPYTKIFLWLVRPRRFPSGIWLEIIGCQSNSTASPSADITDEMTSYKESLHLKDFNREKSSNLVSALHSNYLSLGEARSFYLWVQTDACIRLSRYVSMLINRETECDIMW

SEQ ID NO: 128346 - protein, 586 aa, Glycine max
  Coding DNA Sequence Number=SeqID_11568
  Gene Ontology: Mol. function=transporter activity; Cellular component= membrane; Biological process=transport
  Homolog annotation: Hit_ID=Q9FGR5; Match level="QueryCoverage=88%, HitCoverage=87%, E-value=1e-138, Identity=50%"; Hit description =Transmembrane transport protein-like
  Pfam annotation: Domain name=Sulfate_transp; Domain location=199-538; Score=-146.5; E_value=0.028; Accession=PF00916.10; Description =Sulfate transporter family
  Pfam annotation: Domain name=Xan_ur_permease; Domain location=86-525; Score=-29.1; E_value=5e-07; Accession=PF00860.11; Description =Permease family
  Pfam module annotation: Pfam domain module=Sulfate_transp::Xan_ur _permease; Domain location=199-538::86-525
  Subcellular localization annotation: CTP_CleavageSite=47; ConfidenceScore=5.36e-01
MAQLQLPPLSSRSSSTVTRINLVVAQSCIGKYFKLVERNTTFTTELRAGTATFLTMAYILAVNATIIADSGGTCSVSDCTPLCSDPKTSPSHCPTHLLTRPDSSCKYPPVNPGYAACVERTRRDLIVATVASSLMGSAVMGLLANLPLALAPGMGANAYFAYSVVGFHGSGSVPYKTALTAIFLEGLIFLVISAVGFRAKLAKLVPKPVRVSSAAGIGLFLAFIGLQSNEGIGLIGFSPSTLVTLGGCPRNKLTALAPVITINGTVSLIPGATVSDKILCSGNRMESPTLWLGLVGFFIIAYCLMKNIKGAMIYGIVFVTVISWFRNTPVTVFPNTELGDAGYEYFKKVVDVHVIKTTAGALSFDSMWKGAFWEALFTFLYVDILDTTGTLYSMARFAGFVDANGDFEGQYFAFMADASSIVVGSLLGTSPVTAFIESSTGIREGGRTGLTAVTVAGYFLMAFFFTPLLASIPAWAVGPPLIVVGVMMVRCVVEIDWEDMREAIPAFVTIVLMPLTYSIAYGLIGGIGTYLVLHAWDWGKEVVKNFFTKENFKDNNNNNNIPNSNINVNANSRVVDHEEGYDDNKV

SEQ ID NO: 128347 - protein, 73 aa, Glycine max
  Coding DNA Sequence Number=SeqID_11569
MALLVGIGSSFFKHVGVVECVFELSDEAIEAQIARIICQFEALKEENMRLLGVLYEKDNMIEMLKEDLDKCRD

SEQ ID NO: 128348 - protein, 87 aa, Glycine max
  Coding DNA Sequence Number=SeqID_11570
MNYSTEEAVFHSCNVNCGRQLLPWSLAEDVFREIPRNKFFSSAISTSTTSTDKNRTAQAPERRKRTRMEKTRTGMEETQERESKKEE

SEQ ID NO: 128349 - protein, 125 aa, Glycine max
  Coding DNA Sequence Number=SeqID_11571
MVRTRGLGRALGAGRGRGISEDTHEVDVPLHRRLTASARRQRVRLREDVTERHEDVPQLHEDVPHVSDATQEMTGAADAVQTEGVATDGSLGSPAADEGFLGGPRDPSILTDFAEHVAHNIWSGQ

SEQ ID NO: 128350 - protein, 84 aa, Glycine max
  Coding DNA Sequence Number=SeqID_11572
MEEFDTQMACPRDQPSSSRGGGASVAQEPVTDEPPAPAEEETTPDHTPQPSPSSASTPEETQPSALDHNEDHHRRSRTFYVSVL

SEQ ID NO: 128351 - protein, 133 aa, Glycine max
  Coding DNA Sequence Number=SeqID_11573
  Gene Ontology: Mol. function=protein binding; Biological process =defense response to fungus
  Homolog annotation: Hit_ID=Q1SWI6; Match level="QueryCoverage=72%, HitCoverage=43%, E-value=3e-16, Identity=43%"; Hit description =Leucine-rich repeat, plant specific
  Pfam annotation: Domain name=LRRNT_2; Domain location=27-67; Score =49.3; E_value=1.3e-11; Accession=PF08263.3; Description=Leucine rich repeat N-terminal domain
MNSSSIYILVFVQLWLLSLPCRESVCIPSERETLLKFKNNLIDPSNRLWSWNHNHTNCCHWYGVLCHNVTSHLLQLHLNSSLSDAFYYDYDGYYHFDEEAYRRWSFGGEISPCLADLKHLNYLDLSGNVFLRE

SEQ ID NO: 128352 - protein, 82 aa, Glycine max
  Coding DNA Sequence Number=SeqID_11574
MEVTILQKLGQKMDQVTSLLHLMPNTFRTVDVLVTSSFTLTKMSWTIKEHALRCHYQTRARARVMGEVEEVQEKIKADMEAM

SEQ ID NO: 128353 - protein, 314 aa, Glycine max
  Coding DNA Sequence Number=SeqID_11575
  Gene Ontology: Mol. function=RNA-directed DNA polymerase activity; Biological process=RNA-dependent DNA replication
  Homolog annotation: Hit_ID=Q1SAS4; Match level="QueryCoverage=56%, HitCoverage=8%, E-value=4e-12, Identity=27%"; Hit description=RNase H, putative
MVMVSPEKIYQFLFPQWYNPNATCAYDGGVPGHSIEQCVAFKHKLQSLIDEGWLTFQEDNPNRPKWMKDVLTSRRLILEALREAGMIFLDGGKGDVCLIHLGVAHDVKACPMVEELLQGLMDKSLFEIGTARKEGEDVCMQSADKNPSKPKPLVIHFTRDVATQKPRGFKPIPVNKPAPFPYKSDKAVPWRYATQGPDGRKDESVRGWVFVASEPLVRSKDSKGKVKAGMEERDKPSPILDEEVLAGRFAKESDKAMLMWSLPQLTGALSKGGKVRGVATNEGISTSHVDKSGALAPTYPPSKRKSDLRSSFLK

SEQ ID NO: 128354 - protein, 106 aa, Glycine max
  Coding DNA Sequence Number=SeqID_11576
MHKKELRRSDFLSKGGIMRYIRSEESSTGDVVEHIILDLSVTNVTKIGTKMKNMMSGTRLTVEAELLLSTTLIHEQDGAPDPEVSHLKFFAALLIISIICYTISGE

SEQ ID NO: 128355 - protein, 35 aa, Glycine max
  Coding DNA Sequence Number=SeqID_11577
MEDTIMRYIRSEESSTGDVVEHIILDLSGMNGKDG

SEQ ID NO: 128356 - protein, 82 aa, Glycine max
  Coding DNA Sequence Number=SeqID_11578
  Homolog annotation: Hit_ID=Q7XIR7; Match level="QueryCoverage=98%, HitCoverage=24%, E-value=1e-07, Identity=45%"; Hit description =Myosin-like protein
MEKKLAVMAQEMEKLHEKIANAEKRARDAAVTWNPGQGYDANYGNADAGNPYPGIYGMNPPGVENFPQYGPGPAAWGAYDMQ

SEQ ID NO: 128357 - protein, 311 aa, Glycine max
  Coding DNA Sequence Number=SeqID_11579
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=2e-39, Identity=31%"; Hit description= UPI00006A17C9 related cluster
RGLHVLTFGGLRVLAFKGLPVLLLRGLHVLTFRGLHALTFRGLHVLAIRGLHVLAFRGLQALTFRGLHVHPIKGLHVLQIRGLQILTFRKLHVLPFRGLHVLTFRGLHVLAFIGLHVLAIRGLHILSFRRLHVFTIRGPHVLTFRGLHVLAFRGLHLLAFRGLRVLPFRGLHILVFRGLHALTSRGLHVLAIRGLHVLPLRGVHVLTFRGLHVLAFRGLHILPVRGMQAVTIRGVHRTTRPRIRRATRPRLQRATRPLLQWATCPRLQRATRPLLQSTTRPRLQRATRPRLQRPTRPRSLSVFFSSVFNEL

SEQ ID NO: 128358 - protein, 36 aa, Glycine max
  Coding DNA Sequence Number=SeqID_11580
METTTLASVPRILKQRRYQEKCGDMQHRGKGKRPRP

SEQ ID NO: 128359 - protein, 120 aa, Glycine max
  Coding DNA Sequence Number=SeqID_11581
  Homolog annotation: Hit_ID=Q1RWU1; Match level="QueryCoverage=85%, HitCoverage=26%, E-value=7e-12, Identity=50%"; Hit description =Resistance-like protein HAAS-2-related
MAETGQCDGPYALRDLTLTRRYAWGAAGLVHMYDQLNDANLSTSRQLAGYITLLQCWIYKHFPSVAECNVDPNYDEVSPHACRWIVTKKIVKNIQTRKGYAPVRLCPVHSWTPCPFMGVI

SEQ ID NO: 128360 - protein, 223 aa, Glycine max
  Coding DNA Sequence Number=SeqID_11582
  Homolog annotation: Hit_ID=Q1SP02; Match level="QueryCoverage=88%, HitCoverage=42%, E-value=1e-21, Identity=34%"; Hit description=IMP dehydrogenase/GMP reductase
MYDQLNDANLSTSRQLAGYITLLQCWIYKHFPSVAECNVDPNYDEVSPHACRWIVTKKIVKNVSTVTYRQRLDRLRIPDVYWMPYAEHRPVQDFHSISCFSGQLRWGPVVVRYRLERVMRQFGYVQCIPGHLVHSWVSYDDMDDTWTHYSDHLAAADDLCVVPGQCAPDYIDWFFAISHSFMTVPQNDPPRDAYETQPNHIPHKAALTSTHADPDANEPKHAV

SEQ ID NO: 128361 - protein, 963 aa, Glycine max
  Coding DNA Sequence Number=SeqID_11583
  Homolog annotation: Hit_ID=Q2QYN0; Match level="QueryCoverage=84%, HitCoverage=93%, E-value=7e-84, Identity=32%"; Hit description =Expressed protein
  Subcellular localization annotation: CTP_CleavageSite=50; ConfidenceScore=5.30e-01
MEARKQKARNAYLDGEAPTKKKKNESTTTTLSTMVNNNTTTSPEATTPVVAEAAKRKRRREKRRRRRRTELAEEKNRNAEKKRNRRWGSEVSASDSGGYIFGGGGKWSRRVATMLPWLVIPLIGLWALSQLLPPAFRFEITSPRLACVFVLLVTLFWYEILMPWLSAWRVRRNARIRERKRFEAIEMQKLRKTATRRCRNCLSPYRDQNPGGGRFMCFNCGHVSKRPVLDLPVPPGLGISNSSIVKDLVGKGGKILNSKVWSENGWMCGQDWLENGNWVGGSVPGNPSNWRTSENAGVFGGDEHCLTERSYCGLLFLVCKLLTSFFKSIRWLWGKAFTVSSREECPSDAEALLAKRGENEASLNESRGEKARRKAEEKRQARLEKELLEEEERKQREEVSRLVEERRKLRDEKVEAEKDHSRSSNLSKEKDRQKEAEKKRQEKRKEKDKGSSKSNSDVEELERRAGKESERKRDFDKKSEMDRREHQKSGLESGKGQNTNNAQNKNVTANNYNRGGTGTRGINVPSTVVKENKFNSSVDHVHSRREICPPERPAAKSNVNGDDRNINHPVLPEPQPWTAAPKKSWQQLFTRSSPAPQSSNSNVICRPNSKIQAEVKSPQLSAQSPVTQSFTNPIQFGLPSPFNISTHASGPTSSSLGFSPAIEPFFPPVGNTSHDFRQDEQELFEDPCYVPDPVSLLGPVSESLDNFQLDLGIGFGTDNEMTKPHSLKSISAGSDVNKPSLIESPSSREKHSCSNWFPSTPNGQDKHGFPLDDAAANEKGTWQMWSTSPLGQEGLGLVGGAGSWLLSSQRNIPNKDDFVLSSSQKTMASLFNKEDNIISSTHSPQNVFLPNGQSGENFSPVTGSSGYDPWLQSALFPPLSGGPSAQEGATQNETIYGSPSGSASSHGLDGSPANCWSNPHALATCGTCTAAPSTGHIAWTHHQEDFRYKGSPRPRSIAAILLV

SEQ ID NO: 128362 - protein, 474 aa, Glycine max
  Coding DNA Sequence Number=SeqID_11584
  Gene Ontology: Mol. function=protein binding; Cellular component =thylakoid; Biological process=ethylene mediated signaling pathway
  Homolog annotation: Hit_ID=Q9LV01; Match level="QueryCoverage=99%, HitCoverage=49%, E-value=1e-118, Identity=49%"; Hit description=ETO1- like protein 2
  Pfam annotation: Domain name=TPR_1; Domain location=429-462; Score =15.4; E_value=0.079; Accession=PF00515.18; Description =Tetratricopeptide repeat
  Pfam annotation: Domain name=TPR_2; Domain location=429-462; Score =16.8; E_value=0.077; Accession=PF07719.7; Description=Tetratricopepti de repeat
  Pfam module annotation: Pfam domain module=TPR_1::TPR_2; Domain location=429-462::429-462
  Subcellular localization annotation: CTP_CleavageSite=82; ConfidenceScore=5.75e-01
MRGLKLTERFKSTQVHALSSSSSQTNGSNSRKASVAATTKPHNNLNRNKTMLPSWSKTKSRTTNNKNSTSSLANLAPLRLPSTDTIEPSIEPHLKPINLVETLSELYHRLECCSQSNKALMCVEQYSLLRGLGDQKILRRCLRTACQNAEDVLSKVVLSAWLRFERRDDELVGVCSMDCGGFVLECPKKNLEHGLSPCSVSDHCQCQKEPNQKTCTETESVCLLDEESDILFCVGSEEISCVRCRIASLSDPFNAMLYGGFAESKINKIDFSGNGICPKGMRAVEFYSRNKRLDLFCPMTVLELLSFANRFCCEDMKSACDAHLASIVVNVEDALVLIEYGLEERATLLVGACLQVLLRELPNSLYNPKVAKIFCSFEVKERLANVGCASFLLYYFLSQVAIEENMVSKTTMMLVERMGECATERWQKALAFHQLGCVLLERNEYVEAQHCFEAALEEGHVYSLAGLARTKHKQ

SEQ ID NO: 128363 - protein, 83 aa, Glycine max
  Coding DNA Sequence Number=SeqID_11585
MVILKENERSENNGGLWWLMVAVGDGERAWVVGNGFGRKKEKKMVFFLSYLDYKAQNAQVSSALGNENVTHTPDILSKIPMTR

SEQ ID NO: 128364 - protein, 149 aa, Glycine max
  Coding DNA Sequence Number=SeqID_11586
  Subcellular localization annotation: CTP_CleavageSite=24; ConfidenceScore=5.38e-01
MVHNMQGFCSCTCHFSSTPSTYMDCQSVRSLRIANPPSHKTPKHFIMDLTQTTPTPSPSLASTVTRISVASRDSGVAMPSSGTRGRVMAMKDTREESAMGSNLALEASRAEMVAAKYAGGMRGRRSVARLEQRGTTVVRWWCCDVAKLV

SEQ ID NO: 128365 - protein, 273 aa, Glycine max
  Coding DNA Sequence Number=SeqID_11587
  Gene Ontology: Mol. function=protein binding; Cellular component =thylakoid; Biological process=ethylene mediated signaling pathway
  Homolog annotation: Hit_ID=Q1SC84; Match level="QueryCoverage=98%, HitCoverage=55%, E-value=1e-115, Identity=57%"; Hit description=TPR Domain, putative
  Pfam annotation: Domain name=TPR_1; Domain location=225-258; Score =21.5; E_value=0.0031; Accession=PF00515.18; Description =Tetratricopeptide repeat
  Pfam annotation: Domain name=TPR_1; Domain location=96-129; Score =30.0; E_value=8.6e-06; Accession=PF00515.18; Description =Tetratricopeptide repeat
  Pfam annotation: Domain name=TPR_2; Domain location=128-161; Score =15.0; E_value=0.28; Accession=PF07719.7; Description=Tetratricopeptid e repeat
  Pfam annotation: Domain name=TPR_2; Domain location=192-225; Score =13.9; E_value=0.57; Accession=PF07719.7; Description=Tetratricopeptid e repeat
  Pfam annotation: Domain name=TPR_2; Domain location=22-55; Score =11.5; E_value=1.5; Accession=PF07719.7; Description=Tetratricopeptide repeat
  Pfam annotation: Domain name=TPR_2; Domain location=226-258; Score =6.9; E_value=5.2; Accession=PF07719.7; Description=Tetratricopeptide repeat
  Pfam annotation: Domain name=TPR_2; Domain location=96-127; Score =13.2; E_value=0.96; Accession=PF07719.7; Description=Tetratricopeptid e repeat
  Pfam module annotation: Pfam domain module=TPR_1::TPR_1::TPR_2::TPR _2::TPR_2::TPR_2::TPR_2; Domain location=225-258::96-129::128 -161::192-225::22-55::226-258::96-127
LNYQKAAMRSLRLARNHSSPMQERLIYEGWILYDTGYREEAVARADRSIAIQRSFEAFFLKAYVLADTTLDPESSSYVIQLLKEALKCPSDGLRKGQALNNLGSIYVDCGKLELAKECYKNALAIRHTRAHQGLARVYHQKNQRKAAYDEMTKLIEKAESNASAYEKRSEYCDREMAKADLDVATQLDPLRTYPYRYRAAVMMDEQKETEAVEELTKAIKFKPDLQMLHLRAAFYESTGDLSSALQDCQAALCLDPNHTGTLDVYRRIQKLNF

SEQ ID NO: 128366 - protein, 315 aa, Glycine max
  Coding DNA Sequence Number=SeqID_11588
  Gene Ontology: Mol. function=protein-tyrosine kinase activity; Cellular component=integral to membrane; Biological process=protein amino acid phosphorylation
  Homolog annotation: Hit_ID=Q84U00; Match level="QueryCoverage=96%, HitCoverage=93%, E-value=1e-123, Identity=67%"; Hit description=Ser -thr protein kinase
  Pfam annotation: Domain name=Pkinase; Domain location=19-279; Score= -0.2; E_value=1.5e-08; Accession=PF00069.15; Description=Protein kinase domain
  Pfam annotation: Domain name=Pkinase_Tyr; Domain location=31-279; Score=5.5; E_value=8.3e-13; Accession=PF07714.7; Description=Protein tyrosine kinase
  Pfam module annotation: Pfam domain module=Pkinase::Pkinase_Tyr; Domain location=19-279::31-279
MYDLGVPSLKRTELEVACEDFSNIIGSLPEGTIYKGTLSSGVEIAVASSAVTSSQDWSKKMETQFRKKIEMLSRVNHKNFVNLIGYCEENKPFTRMMVFEYAPNGTLFEHLHIREAEQLDWGMRMRIAVGIAYCLEHLHQLTPPIAYRNILSSSMYLTEDYAAKLSDLSLWTDIVSTKKGSEAPQLLETASAYIKANVYSFGVLLFELITGRIPFAMENGLFEDWAAEYMKGQPLKDLVDTSLNSLQANEIEKWEEVINSCVHQDPEKRPTMREVTAKLKEITAMGPDGATPKASPLWWAEIEIMPSDLSSEVKP

SEQ ID NO: 128367 - protein, 135 aa, Glycine max
  Coding DNA Sequence Number=SeqID_11589
  Gene Ontology: Mol. function=protein-tyrosine kinase activity; Biological process=protein amino acid phosphorylation
  Homolog annotation: Hit_ID=Q8GY10; Match level="QueryCoverage=82%, HitCoverage=16%, E-value=4e-10, Identity=32%"; Hit description =Putative receptor protein kinase
  Pfam annotation: Domain name=LRR_1; Domain location=35-57; Score=5.7; E_value=25; Accession=PF00560.23; Description=Leucine Rich Repeat
  Pfam annotation: Domain name=LRR_1; Domain location=59-82; Score =12.5; E_value=1.3; Accession=PF00560.23; Description=Leucine Rich Repeat
  Pfam annotation: Domain name=LRR_1; Domain location=84-106; Score =7.2; E_value=13; Accession=PF00560.23; Description=Leucine Rich Repeat
  Pfam module annotation: Pfam domain module=LRR_1::LRR_1::LRR_1; Domain location=35-57::59-82::84-106
MGPNAQKYIAHVFARNLKDLCLHGILAPEIGKLVHIKSIIFRNNYFYGDIPKEILQLEDLEVLDLGFNNFSGQFPFHDLASYPSLTTLLLDNNDNLASLTPEVYELKTFSELHVDEEQLTGATTREACASITNNW

SEQ ID NO: 128368 - protein, 86 aa, Glycine max
  Coding DNA Sequence Number=SeqID_11590
  Homolog annotation: Hit_ID=Q1SMM8; Match level="QueryCoverage=95%, HitCoverage=12%, E-value=7e-07, Identity=35%"; Hit description =Protein kinase
  Pfam annotation: Domain name=LRRNT_2; Domain location=36-79; Score =49.6; E_value=1.1e-11; Accession=PF08263.3; Description=Leucine rich repeat N-terminal domain
MEERWRFITWLKLLRVFVAVVSLSPFSMQPIWCTTLNNEGLALQKMRERVVIDRLGGLSSWNSKEGEIDPCSWFGVECSHGNVVSL

SEQ ID NO: 128369 - protein, 46 aa, Glycine max
  Coding DNA Sequence Number=SeqID_11591
TMEGRMGLLFLLVLGGAWACDGRELANCDQLSSNTANSGSSDNIVH

SEQ ID NO: 128370 - protein, 100 aa, Glycine max
  Coding DNA Sequence Number=SeqID_11592
  Homolog annotation: Hit_ID=Q1SI22; Match level="QueryCoverage=98%, HitCoverage=20%, E-value=2e-08, Identity=48%"; Hit description =BTB/POZ; NPH3
MWTDGCPKIDSRSSISFRTPGNNSACDPLCSPMNRDEGYETTMGDSCQATLKNQMSHLRIKDEELHKNGKLSKKNSKNNKTDIQLLPLQSRRIFDKLWSV

SEQ ID NO: 128371 - protein, 73 aa, Glycine max
  Coding DNA Sequence Number=SeqID_11593
VPMNSKRIKVIPEWPTPPTPLTKFMRNHVPSWEDAQEMGVEERNLEFQEPQDLRSNPFQGGGNDAILPRKGIG

SEQ ID NO: 128372 - protein, 149 aa, Glycine max
  Coding DNA Sequence Number=SeqID_11594
MEELINKTQLSPKIIPTSSRRLGGSTKESHFSHSTVVILLPRTKVRDHHRYQPHGTKIARGNSLSVSTQHSHLGKLGSKCRGHPILHRQLPTMMINLSLKGVPNRVTYPQVQVFLLMRNYKYLLTKFILFPCHMKYETWALSNALIVDN

SEQ ID NO: 128373 - protein, 41 aa, Glycine max
  Coding DNA Sequence Number=SeqID_11595
MKTGVKIIHARVSVAQWYFGFNRIQLGIYSDTGYEHINLKL

SEQ ID NO: 128374 - protein, 83 aa, Glycine max
  Coding DNA Sequence Number=SeqID_11596
MDDEKREEDTDNKTEISLVGKGQGLSWYLDNRCLRHMTRERSMFLDLKPHEGGAIAFGDIGKGKLSGIDKELRWNDTFSELKQ

SEQ ID NO: 128375 - protein, 497 aa, Glycine max
  Coding DNA Sequence Number=SeqID_11597
  Gene Ontology: Mol. function=actin binding
  Homolog annotation: Hit_ID=Q10LQ3; Match level="QueryCoverage=98%, HitCoverage=89%, E-value=5e-78, Identity=38%"; Hit description =Expressed protein
  Pfam annotation: Domain name=DUF827; Domain location=2-340; Score =198.9; E_value=1.2e-56; Accession=PF05701.2; Description=Plant protein of unknown function (DUF827)
MAIPHHREEVSAEKLEEQAVVLEKELILKERETLDVLKELESTKRLVEDLKSKIQKEESEANLNLQMGKYDKKSVVDENVEKENQMSQLNVLQPSREGFIPYPSSTPGLILMELKQAKLNLTKTTNDLADVQTSVESLNKKLEKERISLEKTRDRLAQNTLKISSLEEELNQTRLRLQIAKDAEIKGALDDPSDITRELQQLSSEAENFKRMGEFAKSEVLRSMSEIEQTKTMIRTAEIRLLAARKMKEAARAAEAFALAEINALSNHDSSPGNQVTLSFEEYTALMGKARDAEEQSKQRVASATLEVDEANLANMDILKRVEEATGQVKTSKKALEEALERVEAANRDKVAVEEALRNWRSEGQKKRSSIHNSTKFKNCCLSHHRRDPRLLDVNGMHLVNDEARPVLKPTLSIGQILSRKLLQPQEFEAREGISMKQNVSLGKMLGKQNNDRPVDRQVEKETGHKLFSTKRKKFGFARFSHILSKQKKKKPTLNLR

SEQ ID NO: 128376 - protein, 68 aa, Glycine max
  Coding DNA Sequence Number=SeqID_11598
MEAADVVETTTNHAERGLEKKNNKSGLRTEIDTSAPFESVKEAVTMFGGGYWKSPLHSNITCVASGSE

SEQ ID NO: 128377 - protein, 80 aa, Glycine max
  Coding DNA Sequence Number=SeqID_11599
MESVYVVVYCEGDMISSSEGILFECPSGPNVITISEDMSLDSLRKTIMDAIGGDGCVEYKYIELKHDNGEGKMFIYLFES

SEQ ID NO: 128378 - protein, 159 aa, Glycine max
  Coding DNA Sequence Number=SeqID_11600
MGSKIYPKVHENPRAFFSSSSTSLLESSIQYPWELDQEDCSNMSLRLLNKNKSFPSGLDAEKTQAEGQKGHFKHVLGPGSPGPPNSLGGRLRQYAMKNSSDLELTPQAPSDPTILVVTVYDSSPFKEYVRLIKVELLRTREALAQALEDHAHAENKIME

SEQ ID NO: 128379 - protein, 55 aa, Glycine max
  Coding DNA Sequence Number=SeqID_11601
MGEKRLHKKALVHWFHVVMLFSVSSHRISQLDELPQVLRRIFMDSATEWVVLEHL

SEQ ID NO: 128380 - protein, 135 aa, Glycine max
  Coding DNA Sequence Number=SeqID_11602
MQLRFQLQGRSSVTKGKQGRVKETEGVLNGAVYSHCHGFFSVQKILSAYTTITADAIARFQNKMHGITHMDAALDAMRPLGFRTQLILRTELLQVYGGNQGWCFIEEAYYKLLMEALLSKQQGSAEYKVGMELTK

SEQ ID NO: 128381 - protein, 275 aa, Glycine max
  Coding DNA Sequence Number=SeqID_11603
  Gene Ontology: Mol. function=RNA-directed DNA polymerase activity; Biological process=RNA-dependent DNA replication
  Pfam annotation: Domain name=AT_hook; Domain location=136-148; Score =14.9; E_value=0.061; Accession=PF02178.9; Description=AT hook motif
DDGEIEGDVNHRIQAGWMKWRKASGVLCDAKVPIKLKGKFYRTAVRLAILYGTECWVVKSQHENKVGVAEMRMLRWMCGKTRQDKIRNEAIRERVGVAPIVEKMVENRLRWFGHVERRPVDSVVRRVDQMERRQTIRGRGRPKKTIREVIKKDLEINGLDRSMSWMFAHLPSVGYSEGGTGALDDLVANKRGPWACTSDYLPWFYKVSHPYVNPPRMDSHHVLLRASKLGVTQKGKGKGLPRPRTRMVTRVTRWVAEADDFIIIFTCSMENFLLF

SEQ ID NO: 128382 - protein, 120 aa, Glycine max
  Coding DNA Sequence Number=SeqID_11604
MPQSMPGGRQMEPPMVESMGEQSSKEEKSYKSKGTNNIDENIALKGIIVDEDEIRRRRKSQRRREEEEIKLSGLEVVCALFQIQISLTPEVAISTHFPYSGYSTTDVAASGPLKTKTKST

SEQ ID NO: 128383 - protein, 86 aa, Glycine max
  Coding DNA Sequence Number=SeqID_11605
MPLPVALLAAIVDRMLTQSAFDASLQHDPRHVRGPGPNERDRMQQYTKVGEGKGCAKKGEGKVGEEVGVFVVVRDRVRARGRGRGC

SEQ ID NO: 128384 - protein, 134 aa, Glycine max
  Coding DNA Sequence Number=SeqID_11606
  Subcellular localization annotation: CTP_CleavageSite=22; ConfidenceScore=5.33e-01
MGVATLSAAVKVKFPASSFAVVGGSKRGTQMVFVRRGRTDDFRIKLICKKLTDQLDPEGCYRSNEWMYEIMSERADMDYENAESCGANEPHVDCSDAFKTSQVFECREDVLRWARSVAHENGFVAVILRSDTNT

SEQ ID NO: 128385 - protein, 263 aa, Glycine max
  Coding DNA Sequence Number=SeqID_11607
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q93X34; Match level="QueryCoverage=87%, HitCoverage=92%, E-value=1e-120, Identity=91%"; Hit description =Putative alpha7 proteasome subunit
  Pfam annotation: Domain name=Proteasome; Domain location=31-216; Score=235.1; E_value=1.5e-67; Accession=PF00227.16; Description =Proteasome A-type and B-type
MSSIGTGYDLSVTTFSPDGRVFQIEYAAKAVDNSGTVIGIKCKDGVVLGVEKLIPSKMMLPGSNRRIHSVHRHSGMAVAGLAADGRQIVARAKSEATNYDSVYGEPIPVKELADRVASYVHLCTLYWWLRPFGCGVILGGYDRDEPQLYMVEPSGVSYRYFGAAIGKGRQAAKTEIEKLKLADMTCRQGLIEVAKIIYGVHDEAKDKDFELEMSWVCDESNRQHEKLVVNLYAAELILLQVPDELLELAKAAAKAALEEMDAD

SEQ ID NO: 128386 - protein, 350 aa, Glycine max
  Coding DNA Sequence Number=SeqID_11608
MAHKNRISIKYEALWEAMKLANNVDEKLSNFVSSKVALVVSDDGKGVYKELGEELLAKESDGVHQSLSHSSFEMFKCNKRVGAPNKVILIEKGSQRSGDASTKPPCAILFTNKEDSEDINIVLFSQGLPQEEHKWHDLYVEEGEGHEVHLKLIWAKWGSRGSQMSGVEDLVSSGGEVKGVELVHETNGGDFKENAVGLWGDKGERLESLNFTVDVGGQAKNETTQQKEVGRPTMQLAKLSKSAREQNAGQVLARMTAKTASAGDIELHMIFRAQGRKGINFSIGSFRFEEREAIKNLIKFGVEGALGSGERGLGIAPNDRCWIYNQEKKDNHVFKVKIVPLEYKERKRYL

SEQ ID NO: 128387 - protein, 162 aa, Glycine max
  Coding DNA Sequence Number=SeqID_11609
  Homolog annotation: Hit_ID=Q2QYN0; Match level="QueryCoverage=72%, HitCoverage=13%, E-value=2e-19, Identity=48%"; Hit description =Expressed protein
MSHDFRHEEQELFEDPCYIPDPVSLLGPVSESLDNFQLDLGSGFVTDTEIPKPHSLKNTAAGSDINKPSPIESPLSREKNICSNRFPSISQAQDMHPFPLDNAAANEKGTWQMWNTLPLGQEVVGPSAQLLVQMVMILGYRMLYFHDCPVDLKLRRVLLRMK

SEQ ID NO: 128388 - protein, 160 aa, Glycine max
  Coding DNA Sequence Number=SeqID_11610
MGKGWGPGTAGIGYTGRNYCSNAPNPYDWLPAGQPNAACRAPSSTCESRWTLEMVVAVEVEVVRLRPTIVVGLAPTPNWQRHVIKAENPNALLDFSGSTGCLGGMIPTNWKDVAEEKCHPDLCQGGHASAYDPHLPPRHALCKVLSHGAQQLSHDLLIKS

SEQ ID NO: 128389 - protein, 51 aa, Glycine max
  Coding DNA Sequence Number=SeqID_11611
MFGSKDKFTDLEDPGREAQSPQRKKSMTSAMSPSSLAPSSPPGASTGPAPA

SEQ ID NO: 128390 - protein, 85 aa, Glycine max
  Coding DNA Sequence Number=SeqID_11612
MTVHLRLDVDCHYGAWQQMNSLSLPQYLLQAIHFCKVSDFKPLNYQRKTMNYRIKERTHPRQCQHRQQARRLHNTRWLYHYLALG

SEQ ID NO: 128391 - protein, 78 aa, Glycine max
  Coding DNA Sequence Number=SeqID_11613
TLPPQDEHTPSPPPQREDSALLNEVLTELRGLRSYVGERFDSLDTRFASMDIRLTQVEEDVSFIRTCFDPPPPPPSSS

SEQ ID NO: 128392 - protein, 280 aa, Glycine max
  Coding DNA Sequence Number=SeqID_11614
MSIAGLIDPEMNHNKSFHRRNNSGELDVFEAARYFSGYSEVLGSTTTTYTQKINMREERHHHHHHHGHRAARISLDMPMRSLLPQQFHGMEKQIIMKEKKHKQPSSPGGRLASFLNSLFSQSASKKKKSNKSSSQSMKDEDESPGGRRRRRSSISHFRSSSTADSKSLYSSLSSGFRTPPYVQTPTKSCKEFRTFSSENKHALSFSAKYNNNKNNNGQHVRSSTATTTLQNEFLWDEKKKREPTTTTTLLDDNSNHKHLSEKQKNNNNKGSHELLLEKDR

SEQ ID NO: 128393 - protein, 63 aa, Glycine max
  Coding DNA Sequence Number=SeqID_11615
MGVAHTGWRTSMGLHYSDGGWGGVVRLWWTGVGLCAVLMDEDWVTCGGGSRFGGGNSSSHSHA

SEQ ID NO: 128394 - protein, 144 aa, Glycine max
  Coding DNA Sequence Number=SeqID_11616
MEMMINDAFEQYRQHDPNVGASQPLNEDEIVNDEPREDHNGFYELLNDGSQTLYEGSNYAKTQAYMQCGTMSVKNLVGRLGVHDKTNHTLESKSESQCFARMLQPYGINIGLKELSNRVTPKAYTPKSPLGPLPPDSGPTQKIF

SEQ ID NO: 128395 - protein, 172 aa, Glycine max
  Coding DNA Sequence Number=SeqID_11617
MEEAAQSGSTDTVIDPSSPIRRHKKWKMARTKKTRQMTYEAAKEIANKIASQGSFVAHERQDGLALPLEPKVGPSAGRVSTKESCVDPSGNNSDTGDLEKCGLYVEGNPPRLVALGRLYEGSITVHNMALCHDQPKVGHVPIHVPTQEVQLVGQTLNLRCLVDTSCEAFIIT

SEQ ID NO: 128396 - protein, 64 aa, Glycine max
  Coding DNA Sequence Number=SeqID_11618
MKPLQGTTQTLTRGIDTWQSTGAKSVIGDKVGDQFCNFSKNQGDSSEDSREDSRYARTSRKTSR

SEQ ID NO: 128397 - protein, 273 aa, Glycine max
  Coding DNA Sequence Number=SeqID_11619
  Gene Ontology: Mol. function=transcription factor activity; Biological process=regulation of transcription, DNA-dependent
  Homolog annotation: Hit_ID=Q2NRV1; Match level="QueryCoverage=57%, HitCoverage=78%, E-value=6e-43, Identity=57%"; Hit description =Putative transcriptional regulator
  Pfam annotation: Domain name=HTH_1; Domain location=8-67; Score=83.9; E_value=5.1e-22; Accession=PF00126.17; Description=Bacterial regulatory helix-turn-helix protein, lysR family
  Pfam annotation: Domain name=LysR_substrate; Domain location=93-264; Score=-22.6; E_value=0.028; Accession=PF03466.10; Description=LysR substrate binding domain
  Pfam module annotation: Pfam domain module=HTH_1::LysR_substrate; Domain location=8-67::93-264
  Subcellular localization annotation: CTP_CleavageSite=55; ConfidenceScore=5.13e-01
MNLANVDLNLLVVFEALYQTRNVTAAGRRLNRAQPSVSNALARLRTLLNDPLFVRSGGGMAPTPRAHQLMPQIQQVLEQIHLALAPPARFDPATAGQRRFTLAAGDYADILLLPAIISRLRQTAPGIDIRVSRLDRHNIYRQLDRGEVDIALGGHLSGAESHYVRTLFEEHLPAAWAVRTGRRRLCQGIGRPAPGGNRRSTARRRNLFTYCRSAGCGRRQRSDRHPGRQRGPAFFRSATRTHSPAARRVGIAPFPIELIAGSWRNATGVNLAL

SEQ ID NO: 128398 - protein, 139 aa, Glycine max
  Coding DNA Sequence Number=SeqID_11620
  Gene Ontology: Mol. function=pyroglutamyl-peptidase I activity; Biological process=proteolysis
  Homolog annotation: Hit_ID=Q8XT56; Match level="QueryCoverage=99%, HitCoverage=64%, E-value=1e-40, Identity=60%"; Hit description =Pyrrolidone-carboxylate peptidase 2
  Pfam annotation: Domain name=Peptidase_C15; Domain location=3-139; Score=147.0; E_value=5.2e-41; Accession=PF01470.8; Description =Pyroglutamyl peptidase
MMNKVLITGIEPFDGDAVNPSWQIAQALAGEHIAGAEIAALELPCVLGEANQQLIAAIEALQPLAVICLGLAGGRAEISLERVAINLIDARIPDNAGKQPVDIPVVAGGPVGYFSTLPVKAAVQQLRRQGIPAAVSYTA

SEQ ID NO: 128399 - protein, 267 aa, Glycine max
  Coding DNA Sequence Number=SeqID_11621
  Gene Ontology: Mol. function=oxidoreductase activity; Cellular component=vacuole; Biological process=hydrogen peroxide catabolic process
  Homolog annotation: Hit_ID=P22195; Match level="QueryCoverage=92%, HitCoverage=78%, E-value=1e-102, Identity=74%"; Hit description =Cationic peroxidase 1 precursor
  Pfam annotation: Domain name=peroxidase; Domain location=2-231; Score= 393.3; E_value=3.7e-115; Accession=PF00141.13; Description=Peroxidase
MAKSGLFWQQAFASKLSCNEGCDASVLLDDTSSFKGEKTAGPNAGSIRGFNVIDTIKSKVESLCPGVVSCADILAVAARDSVVALGGPTWTVQLGRRDSTTASLSSANSDLPAPTSSLSALISSFSNKGFSSKELVALSGSHTIGQAQCSSFRTRIYNDTNIDSSFAKSLQGNCPSTGGGSTLAPLDTTSPNTFDNAYFKNLQSKKGLLHSDQELFNGGSTDSQVNSYSSNPASFKTDFANAMIKMGNLSPLTGSSGQIRTNCRKTN

SEQ ID NO: 128400 - protein, 76 aa, Glycine max
  Coding DNA Sequence Number=SeqID_11622
MTGDFESYEGEDFESSKGEDFESKESEDFESYEGEDFESYEGNDLESFKARTLSPLKARTLSPIKERTLSPLRKGI

SEQ ID NO: 128401 - protein, 60 aa, Glycine max
  Coding DNA Sequence Number=SeqID_11623
MSEFTSDSPQISASQHQLDLAPYVSGSYNAQWNAPKLLHGVAFVADLGFLANRATGNEKG

SEQ ID NO: 128402 - protein, 121 aa, Glycine max
  Coding DNA Sequence Number=SeqID_11624
MANLEVAKYNGAMGTSEGGGGGKNRKVESIRKHYFAMQRRLPRCRHFDTTNATEECKVMFLCEKTIEDFSLPDIPVSFQGKGRSLEGRVNSNDECGNDGLRINAPVVTWIIFLCNGTNITS

SEQ ID NO: 128403 - protein, 260 aa, Glycine max
  Coding DNA Sequence Number=SeqID_11625
  Gene Ontology: Mol. function=cysteine-type endopeptidase activity; Cellular component=endoplasmic reticulum; Biological process =proteolysis
  Homolog annotation: Hit_ID=Q1SPP4; Match level="QueryCoverage=100%, HitCoverage=77%, E-value=3e-92, Identity=64%"; Hit description =Peptidase C1A, papain
  Pfam annotation: Domain name=Inhibitor_I29; Domain location=1-54; Score=76.5; E_value=8.3e-20; Accession=PF08246.2; Description =Cathepsin propeptide inhibitor domain (
  Pfam annotation: Domain name=Peptidase_C1; Domain location=84-260; Score=261.8; E_value=1.3e-75; Accession=PF00112.13; Description =Papain family cysteine protease
  Pfam module annotation: Pfam domain module=Inhibitor_I29::Peptidase _C1; Domain location=1-54::84-260
MAQYGKLYTDAAEKEKRFQIFKNNVQFIESFNAAGDKPFNLSINQFADLHNEEFKASLINVQKKESGVETATETSFRYESITKIPVTMDWRKRGAVTPIKDQGNCGSCWAFSTVAAIEGIHQITTGKLVSLSEQELVDCVKGKSEGCNFGYKEEAFEFVAKNGGLASEISYPYKANNKTCMVKKETQGVAQIKGYENVPSNSEKALLKAVANQPVSVYIDAGALQFYSSGIFTGKCGTAPNHAVTVIGYGKARGGAKYWL

SEQ ID NO: 128404 - protein, 53 aa, Glycine max
  Coding DNA Sequence Number=SeqID_11626
MKRVKLGDLMVKNLFGNVVASIILSDRGKNRSGQALKGLSLAYNESLRPKPGL

SEQ ID NO: 128405 - protein, 48 aa, Glycine max
  Coding DNA Sequence Number=SeqID_11627
MKRGMTESRNMPEKTLDEASLSSSDSETQHDHRLTSTPYGSHRPGYRA

SEQ ID NO: 128406 - protein, 188 aa, Glycine max
  Coding DNA Sequence Number=SeqID_11628
  Gene Ontology: Mol. function=helicase activity; Biological process =protein amino acid phosphorylation
  Homolog annotation: Hit_ID=Q1SM26; Match level="QueryCoverage=75%, HitCoverage=32%, E-value=2e-28, Identity=48%"; Hit description =Nucleic acid-binding, OB-fold
  Pfam annotation: Domain name=DUF889; Domain location=26-188; Score =46.9; E_value=1.1e-14; Accession=PF05970.5; Description=Eukaryotic protein of unknown function (DUF889)
MDMVELAKHLFGQPYHLLYAPMVELFVQLLQVELLHYSSLVANNEELKQFSEWLLDIGDGKIGQHNDGFSEITIPYEFLIMDYGDPIHVIVEATYPNLMDNYSNTYYLQKRVVLATKKEIVDKINDYVLSLIPNNEREYCSADSIDKSDELLNPAFALLPPEFLYSLQTSCIPNHKLKLKVGTPIMLI

SEQ ID NO: 128407 - protein, 138 aa, Glycine max
  Coding DNA Sequence Number=SeqID_11629
MEAPQKRSYHSGSDMERLLVLKLAPTSRTSDLNTDRARLVYGLITRMDMNIGDLISGHMTMMAQSNSSRLGFPALITTLCRSRGVGSDALTSYENLRLAIDLAYIIRNCGMRMTKQLNFQRQGRPSSEQLMLPLPLGQ

SEQ ID NO: 128408 - protein, 131 aa, Glycine max
  Coding DNA Sequence Number=SeqID_11630
MAFVRRGRTDGFRIKLIMDEDEWMYEIMSKRADMDYENPESCGANESHVDCSEAFKTSQVFECREDVLRWTRFVAHENGFVAVILRSDTNTGVTSISVGKKNLSEETLRLRNVGVPSSFVASQWLEEKAGW

SEQ ID NO: 128409 - protein, 220 aa, Glycine max
  Coding DNA Sequence Number=SeqID_11631
  Gene Ontology: Mol. function=transporter activity; Cellular component= integral to membrane; Biological process=transport
  Homolog annotation: Hit_ID=Q0X8N9; Match level="QueryCoverage=99%, HitCoverage=38%, E-value=2e-67, Identity=58%"; Hit description=Major facilitator superfamily MFS_1
  Pfam annotation: Domain name=MFS_1; Domain location=25-220; Score= -40.2; E_value=0.022; Accession=PF07690.6; Description=Major Facilitator Superfamily
MAYGFSVFWKPLGNALTGADGKPVEACAAGASTFGDKLAGTAKALFATDCNWTQFDLGWMYTLFFVLLGCSAALWGGWLERAGPRKAGLVAMLCWCGGLLLSALGVYQHQLWMMWLGSGVIGGIGLGLGYISPVSTLIKWFPDRRGMATGLAIMGFGGGAMIGSPLATKLMSIFATPASPGVWQTFVVLALIYAVFMTLGSLGYRVPAANWKPAGWTPPD

SEQ ID NO: 128410 - protein, 112 aa, Glycine max
  Coding DNA Sequence Number=SeqID_11632
  Subcellular localization annotation: CTP_CleavageSite=70; ConfidenceScore=5.55e-01
MGPKSTLRLMRPLGPSLAFLAQSSRSLLSNALGGHGTRAGWGRGVLPRPPSANLTLLPTPRGRGIFCLVYGSNVFQVYFDDAKDSSQESRVKQVSRIKESFNQSKFQESRLK

SEQ ID NO: 128411 - protein, 241 aa, Glycine max
  Coding DNA Sequence Number=SeqID_11633
  Gene Ontology: Mol. function=two-component response regulator activity; Cellular component=membrane; Biological process=two -component signal transduction system (phosphorelay)
  Homolog annotation: Hit_ID=UPI00005F9418; Match level="QueryCoverage =55%, HitCoverage=60%, E-value=7e-49, Identity=76%"; Hit description =COG0745: Response regulators consisting of a CheY-like receiver domain and a ...
  Homolog annotation: Hit description=winged-helix DNA-binding domain
LLLGHRTAAPVHQRGQHRQFARRQRQRLALQQKIAFVVIGQRAVLQRRLRGADAAAQQRPDARFQLVQFERLGEVIVRPQIQAFHPVGHVGACRQQQHRQILPALAQARQQIQAVHTRQRHIQHRERIAFVEQQVIRRHAVRGDVNGKAGAGSAPFATIACSHSIDLPEQPGADTAPVNRPITENGMENKGIKERRAASFGELAHNYAYGARSQGGCQISGMGLSATAMSSTRAQFVGGKR

SEQ ID NO: 128412 - protein, 194 aa, Glycine max
  Coding DNA Sequence Number=SeqID_11634
  Gene Ontology: Mol. function=hydrolase activity, hydrolyzing O -glycosyl compounds; Cellular component=extracellular region; Biological process=cell adhesion
  Homolog annotation: Hit_ID=A0AC67; Match level="QueryCoverage=54%, HitCoverage=13%, E-value=3e-12, Identity=33%"; Hit description =Putative secreted protein
  Pfam annotation: Domain name=F5_F8_type_C; Domain location=44-159; Score=82.1; E_value=1.7e-21; Accession=PF00754.15; Description=F58 type C domain
MTLRAERSKVARSAIPWLTAATLILAALAAAAQAQPLPPRSQWQASSSSQQVPAMAISHLIDGDPKTVTGGAFSPGHWFQIDLGTPTLLAGARLTWDVSNPEGYSLQTSMDGTQWQTAYTMADSLGDVETLYFAPRQARYLRLASPQRTSDWGVSIFEMEPLDSTLSARIADVDATQAAALWQGGGTIAVPTGK

SEQ ID NO: 128413 - protein, 391 aa, Glycine max
  Coding DNA Sequence Number=SeqID_11635
  Gene Ontology: Mol. function=nucleoside-triphosphatase activity; Cellular component=1-2nm peptidoglycan-based cell wall; Biological process=transport
  Homolog annotation: Hit_ID=Q35MK1; Match level="QueryCoverage=65%, HitCoverage=42%, E-value=2e-77, Identity=58%"; Hit description=Amino acid ABC transporter, permease protein, 3-TM region, His/Glu/Gln/Arg/o pine
  Subcellular localization annotation: CTP_CleavageSite=34; ConfidenceScore=5.42e-01
MPTCADASAAALARSCSATRRRPLLPRWAPSCCCCATGWRFPAVRSCRTAIRIPPNSSASGHCPGCVARALRGACCRSWKSRRRGKGTGGPTRKRLRICRSRSTCGRRRPSLHLHRHCCTEPTHEHTVDRAGGHRRSSGARTGTEDRAGPTSAAGLRHGAGTGADPDRAAVRAGQSALGLGHLRRVVLRTPGAGRPGSHAAADRAWHRPRFRAGYAARAGTRLRFAAAVGGVVGLCVVVPFDPVAGAVAAVEQPGLSVQHHRTGRAVHRHQPVLVPDHAADRRVHRRGAGPDPEPGSVLGRGDPRWHPLGRPRPVRGRGRARPAAWPPGAPHHPAAGDAFDPAGGVQRCDRPGQEHLGGLRAGAAGAVLHRAGDLSAQPGSGAAADGGHGL

SEQ ID NO: 128414 - protein, 98 aa, Glycine max
  Coding DNA Sequence Number=SeqID_11636
MMLTFNKCSTFFTITHQAYMQYGTLSVKNLVRRLGVHDKTNHTIEDQSGSQCFARMLQPYGINIGLKEHSNRVTPKAYTPKSPSGPLPPDSGPTQETF

SEQ ID NO: 128415 - protein, 965 aa, Glycine max
  Coding DNA Sequence Number=SeqID_11637
  Gene Ontology: Mol. function=DNA binding; Cellular component =membrane; Biological process=DNA integration
  Homolog annotation: Hit_ID=Q1SLU3; Match level="QueryCoverage=93%, HitCoverage=88%, E-value=1e-133, Identity=39%"; Hit description =Integrase, catalytic region
  Pfam annotation: Domain name=zf-CCHC; Domain location=202-219; Score =15.7; E_value=0.0025; Accession=PF00098.13; Description=Zinc knuckle
  Pfam module annotation: Pfam domain module=RVT_2::zf-CCHC; Domain location=550-805::202-219
MSERDLQTPGVDSFLYLHPSKNPAVSLVSPVLDSSNYHSWRGSMMTALSAKNKLEFIDGGAPEPLKVDRTYGAWRRCNNMVVSWIVHSVSMTIRQSILWMDKAEEIWKDLNSDMRRVIFLGSLISNKRQLQLGKLEDKAIQFLKGLNEQYGNVQSHVLLMDPLPEVSRIFSYVAQQERQIGSNLIAANNIDMKGSLINAVKLACNYCGKTGHTENVCYKKHGVPSNNSERNKSSSHRSGNHGFPPGYRFSNPRRSANSLVAGDDAVTNDQTQLLESKEIRFSLEQYKALLALIQQPTDGNSANMSSNLKQIASCSADTTPAHATDHVPASLDLFKSYTQLNPPTVVRLPNGHHVTATYSGDICISDSIILSTDVITQAKIGTIEVRNGLYYLTPNYMAISNIETNIVHPHCTITPIDLWHFRMGHLSSERLRNMQSTYPFTHDVVPISLPTSSAHIENNSATPLRRSTRDRRPPTYLHDYHAFLIATANTNSASVSHPLGYSASVCHPLDFVLSYLHLSSSHRHFVLSISTSTEPKTYDEASQHGCWLKAMQAELQALQTNNTWTLTDLPANKKAIGCRWVYKIKYHADGSVERYKARLVAKGYTQMEGLDFLDTFSPVAKLTAVRLLLALAAIHGWHLRQLDVNNAVLHGELNEEVYMQLPPGMQLSHLNQVCRLQRSLYGLKQASRQWFHRLSSFLLTHGFTQASTDHSLFLCFNDNSFTALLVYVDDIVLIGNDIMAINRITIFLDQTFKIKDLGTLKFFLRIEVACSQQGIHLCQRKYVLDILSDSGMLACRPASTPMDCTTRLQAGIGDPLPVEDSSSYRRLVGRLIYLTNTRPDISYAMQQLSQFMANPTTDHSKAASRILRYLKSSPGCGIFFPTTGSTRLQAFSDSDWAGFRDTRRSITGFSIFLEKSLNGLLKLLLVRSSMQLVDVFTKPLSPTQFKTLVSKLGMMNIYSQLEEGS

SEQ ID NO: 128416 - protein, 106 aa, Glycine max
  Coding DNA Sequence Number=SeqID_11638
  Subcellular localization annotation: CTP_CleavageSite=55; ConfidenceScore=5.23e-01
MFSRQGLGRANHCSQLWLPLVSSSSNHATTISLQFGEFPSGLAPVGAAIRAVGVFASHNQTEKRCRDRINALRCRSPLNPLIVTMLVTLEEQVADQQRTIGDAAAD

SEQ ID NO: 128417 - protein, 72 aa, Glycine max
  Coding DNA Sequence Number=SeqID_11639
MAATETEQQVTLKLMVSKERNEVFLIKAAKDFGEVMLSFLTFPLGNIAIQMEKEPIEVGSLSSLYQSVANIE

SEQ ID NO: 128418 - protein, 240 aa, Glycine max
  Coding DNA Sequence Number=SeqID_11640
MESVKHLFFKCGYLGQIKLPFTTIDQPHCGLLAIHDCEQHYQHAPRTVQLSNSTSKQYTVLQIEPRTIIITDDEQDHYLRNKSCKTFSNNFTLHHNTPLASFYIKYNITIFRCNHSLRGSLHEGFNKYSNCSHQYHIYYGYPNTETPLDSKWPRSLAPCSTIQLATQATSTVDPFQFLSGNIAIEVQLTDDCERCLLDGKPQCSLDTEGKLNCAKVLAKETHLHVVQKRAERVKGTSKEC

SEQ ID NO: 128419 - protein, 150 aa, Glycine max
  Coding DNA Sequence Number=SeqID_11641
  Homolog annotation: Hit_ID=Q1SM44; Match level="QueryCoverage=38%, HitCoverage=41%, E-value=6e-07, Identity=53%"; Hit description =Pentatricopeptide repeat
MGKPVEMTSLRESTGCRPHVYTYTVLASRPHVYAYSNGEDMEEAHKIFVEAKKKHVKLGHLMFHALIHGYCKLSLGARLWCRPSVDEYDKLIQSLCLKALDWEMAEKLHEEMKGSGLRLKCMMRGLIRAVKEMDKEVVEALEHCRSGVNI

SEQ ID NO: 128420 - protein, 373 aa, Glycine max
  Coding DNA Sequence Number=SeqID_11642
  Subcellular localization annotation: CTP_CleavageSite=69; ConfidenceScore=5.21e-01
MVSISRALQTFYLTILPVNSYRKIVILPKASSTSLRGGKSNGKGFKLALPKPSLKKISSLKTGSSTQSRSSTQKCKQQDGSFTQLVEIKLELATQEPSKNQTSKQAKVDHAFPIETFLVLQDIGLTKLPKKTWADIASKSYDEYEIDLKTLIQKAKDTKVIYNSPKEKHIITPIATPAPKPTNNYIYKNKFSTVLQMELEYWNNNPFKATVKAFPPEFHFKPESRILADLKYFSSFALSWIFSWQYKYRKTESNKIFPSLQRHAFVKWWNQFDTSKAEPDKVKIWFKAHLEFLKATDPEISLFLNQKSQLASLMNGSNSKEHLTKNLKEVLQLLQSQEERSSSSRKEYANSFNHDDDFYQNEDDCFGICLDED

SEQ ID NO: 128421 - protein, 241 aa, Glycine max
  Coding DNA Sequence Number=SeqID_11643
MRLQSKKIQESLSGHSDNEESDTFISEKSFQGTKSLLEVNFPDTNSHSELIKDDGLEKEIESHEKLCADKSDGKDGNEFGSSVIDTCGTPPSIDNTNDNSLTKVNCTTEDSLTSLLDSSIVDNPLKFDHEENYKVLYGERSNGDTNGERKMLPDSNACKLATSDQVEEPKVTENGVPFSVDAYVNNSNKASEESGAVSDQKHFVVLEAKRVSFIAGLTVVDSRHKEEESYKNKIENIMLAF

SEQ ID NO: 128422 - protein, 138 aa, Glycine max
  Coding DNA Sequence Number=SeqID_11644
MGSVPKEITEGVCFAEETAIATGAMAEPAIASCGKAGERGHVDGERRVSPMRTATHTQLEPPSRLAGTVRTRYFINSRPLLGQIFASEGCSNSRSRHVESKLPTTLNTQKFNIEESISVEEEEKVSFEESILKFAASI

SEQ ID NO: 128423 - protein, 159 aa, Glycine max
  Coding DNA Sequence Number=SeqID_11645
  Homolog annotation: Hit_ID=Q47336; Match level="QueryCoverage=26%, HitCoverage=47%, E-value=2e-17, Identity=97%"; Hit description=LacZ -alpha peptide
CGYVSMNYYQYIDVVYTNEHILKAYSAQWWPLGNEAEIPPSDEAWTLIPDPTTIRAKGHNRRRCPMQSDRGTAATAGGAPIRPIVSRITIHWPSFYNVVTGKTLALPNLIALQHIPLSPAGVIAKRPAPIALPNTGTATLASADVRRVLFAVTHHPVSS

SEQ ID NO: 128424 - protein, 123 aa, Glycine max
  Coding DNA Sequence Number=SeqID_11646
  Subcellular localization annotation: CTP_CleavageSite=79; ConfidenceScore=5.29e-01
MQIDTPSRTLTRWKPELKRIMASPPASNPPPPPSPPPPPLTPSDASASPSTIKQTHKASRLRSLSTRPLGAERPVVHVYPATGKADGPHRKKLRTYLGIVASDKVDITYENWKVGVTYLGGYS

SEQ ID NO: 128425 - protein, 135 aa, Glycine max
  Coding DNA Sequence Number=SeqID_11647
  Subcellular localization annotation: CTP_CleavageSite=32; ConfidenceScore=5.41e-01
MAGSAMPPVAMAVSSAKQTPSVISFGTDPIPVALANWSLTPQSEKMLVSALERVCFCNDNDDSITDDNNSNVRSVSDGDSFCVDSKVNGGGVNGGGDDNPDDKGDGVMPAVMLVPMTMVIVIIVIMMMVTVIVQY

SEQ ID NO: 128426 - protein, 54 aa, Glycine max
  Coding DNA Sequence Number=SeqID_11648
MEIFGLGIESKVLQELIRQLIVVEVKKRHISFDNLAARKNENVNSLASVTNCLK

SEQ ID NO: 128427 - protein, 596 aa, Glycine max
  Coding DNA Sequence Number=SeqID_11649
  Gene Ontology: Mol. function=sequence-specific DNA binding
  Homolog annotation: Hit_ID=Q1WR57; Match level="QueryCoverage=55%, HitCoverage=89%, E-value=4e-60, Identity=41%"; Hit description =Transcriptional regulator
  Pfam annotation: Domain name=DUF955; Domain location=418-538; Score =67.4; E_value=4.5e-17; Accession=PF06114.4; Description=Domain of unknown function (DUF955)
  Pfam annotation: Domain name=HTH_3; Domain location=269-323; Score =52.4; E_value=1.5e-12; Accession=PF01381.12; Description=Helix-turn -helix
  Pfam module annotation: Pfam domain module=DUF955::HTH_3; Domain location=418-538::269-323
  Subcellular localization annotation: CTP_CleavageSite=43; ConfidenceScore=5.34e-01
VIILAKGSYLLMSLRTASPYVPNTARKSHLLPSASFGRRADLAAIMVKNAAVTKRNNRKIHARKFIATPEVLMTAFDVNHRSSMTRSISQAYLMSAERSREFGVFSREAQPYLRWFYCEALLEKTAINLGLDFHAAPNAARNCRHLSIKSNNWTLTAHHVNGPGQLPRKARYRAAYAQSMNYDLFEGFEDSDNALLSVGGHVYLLHDGVGSSLGAISLTIPTPDLRAVLYAEPLELVSSYEVEEETIEDELDEKIALRNRDKLINPERLTEAREAKGLTMADLARLLEISRQAISAFEKGLKNPSHETLNQISRVLSFPEAFFLAAESSPSIKGAVHFRSRASASKKERLMGTTKGRWVSGILSNLLQYAILPELKLPPIDIDDFEMLTPSDLEHIATQTRRYWGLGDGPIKNLTQLLENKGVVVSNIHAGDRVDAFSFWTNSGPVIVADKNSTAVRLRFTIAHELGHLILHRSVQDDYLDDKELFKKVEKQADYFASCFLLPASTFGNEFFSPNLQGLIKLKERWGVSIGAITMRASSLHLINDNQKEYVFRQLAPYRKKEPLDDIIKHEEPKLINRLAHLLDENNIISKGELYE

SEQ ID NO: 128428 - protein, 105 aa, Glycine max
  Coding DNA Sequence Number=SeqID_11650
  Subcellular localization annotation: CTP_CleavageSite=22; ConfidenceScore=5.04e-01
MALVKTVIDGATLKTVVPKIVVVMHSSPSCSHHHHAAINIKAVNPTSNVLSSLEVGVAIDNIWFWGAAKGALGFGLLSRPWRRSVGVWGCGPGHSGGTLEFGVLH

SEQ ID NO: 128429 - protein, 132 aa, Glycine max
  Coding DNA Sequence Number=SeqID_11651
MYSKVWKILKEVAIGILLVLSLWLVINGALEKSKGHFEFGSLMDFFNTAGTLGTLFVAYLVYRNAPKWINQKLDDHALNIAKELITHDLPTLFLKLRETSIYIQTFHDCYKNNITDSYKVKDIIFRKVRVEF

SEQ ID NO: 128430 - protein, 101 aa, Glycine max
  Coding DNA Sequence Number=SeqID_11652
MDGAILKTVILKIVVVLHVKIKIGDQVKHSSSHAPETLKLFHHHRVAINIKVVNPSSNVLSSLEGYSGGVLGFGVMVQVVVEEQWGLGFFVKDLSSFMWPS

SEQ ID NO: 128431 - protein, 125 aa, Glycine max
  Coding DNA Sequence Number=SeqID_11653
MLQPYGINIGLKEHSNRVTPKAYTPKSPSGSHPPDSVHSSQLNTHISIHIYFTINHRVPKRQREERIEASILYCLDAILFSLSVDIISQIPMMKVWWSTGKREGFGSRREKNENEEKRRHRQSEN

SEQ ID NO: 128432 - protein, 144 aa, Glycine max
  Coding DNA Sequence Number=SeqID_11654
MLPWRRASHACLENVIRWIKITQLQLQVSHLTEQLASLHLQPQHHVHEVGFKVNMLDFDVDIGPIIVADDEIVMDANEEPDGSYSPEDDHIGNLTFQCTIIDLRMNLYEEVGNDVEIWCNHGLRRDQRGCQGFSIEIQRPKRSV

SEQ ID NO: 128433 - protein, 144 aa, Glycine max
  Coding DNA Sequence Number=SeqID_11655
  Gene Ontology: Mol. function=nucleic acid binding; Cellular component= endoplasmic reticulum membrane; Biological process=DNA integration
  Homolog annotation: Hit_ID=Q1S4N1; Match level="QueryCoverage=97%, HitCoverage=12%, E-value=9e-39, Identity=51%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MFTSFPKKFWVEAASTSIFLLNRLPTKALSKSTLFEAWYGFKPKLMNLKVFGYLCFSYIPQFKRDKLDKKAEAGIFVGYSSSSKAYRIFLPQSNKVIVRRDVIFFEEEKWSKESEKLQVQEESEEDMDDQPVRGTRSLSDIYQR

SEQ ID NO: 128434 - protein, 380 aa, Glycine max
  Coding DNA Sequence Number=SeqID_11656
  Gene Ontology: Mol. function=nucleic acid binding; Biological process= DNA integration
  Homolog annotation: Hit_ID=Q1S4N1; Match level="QueryCoverage=87%, HitCoverage=32%, E-value=4e-83, Identity=42%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=139-156; Score =23.7; E_value=0.00012; Accession=PF00098.13; Description=Zinc knuckle
MEAYLDANDVWEVVEEDYEVPPLPNNPTNNDDENDSKIYNFLKEEYEGSEKIKGMQALNLIRELEMQRMKDSDTVKDYVDKLLSIANKICLLGTDIPNSRIVQKILALEQRRLMRQEGTTEGDLVAKSQDKKKKGKLYVKCHKCGQLGHVEKICKSSQKQENVQAAVEEVDEEELFVVSCFATTRSTESWLIDSGCMHHMTYDQELFKDLDATYNTKVRIGNGAKIAVKGKGTIVIKGCTGLKLIPDVLYVPEINQNLLSIGQLLEKGYKVLFEDKSCMIKDSDNKELFRVQMKGKSFVLNLIDEEQLVVHKVEDNMLVWHKRMGHFHHGTLLYLRKNDLVQGLPELEEKSPVWVACHMENKRGFLFQKANLGEQQASYS

SEQ ID NO: 128435 - protein, 313 aa, Glycine max
  Coding DNA Sequence Number=SeqID_11657
  Gene Ontology: Mol. function=nucleic acid binding; Cellular component= chromatin; Biological process=DNA integration
  Homolog annotation: Hit_ID=Q1S6N9; Match level="QueryCoverage=97%, HitCoverage=30%, E-value=3e-72, Identity=57%"; Hit description =Integrase, catalytic region; Zinc finger, CCHC-type; Peptidase aspartic, catalytic
MGAHEKPKDKNVIGVKWAYRTKLNADETFSSVARLDAIRLLLALAAQKGWIIHHMDVKSAFLNGHLEEEIFVEQPEGFVVHGQEEKVYRLKKTLYGLKQAPRSWYGRIDAYLISLGFEKSLSKFTLYVKKTDVEIVIVSLYVDDLLMTGSSKLIEEFKGGMKEAFEMTNLGKMSFFLGIQVQQDIGEVFVSQEKYAKEILRKFKMEECKPIATPMNQKEKFSNEDGAEKPVKDFSLYGYSDSDWAGSNDDMKSTSGYCFAFGSGVFSWRSKKQDAIAQSVVKAEYVAAVTAANQAIWLRKLMVDIHMEQKEST

SEQ ID NO: 128436 - protein, 358 aa, Glycine max
  Coding DNA Sequence Number=SeqID_11658
  Homolog annotation: Hit_ID=Q1T3M1; Match level="QueryCoverage=92%, HitCoverage=69%, E-value=2e-67, Identity=40%"; Hit description =Cyclin-like F-box; FBD
MAKRARSDSLALSSVSSVSLLPRIFEELPLEILLHVFSFLPIKVAAQNCTQGSKFRNCKQFNRKFIFGRELAMRRNRESVAKLVDHLFDTHKGDLIDSFQLHIDPVEIEELLDKWLRICVEKKIQDLELYFLRPGYTLTEDFLNQLKNLSSLKLVHCEFELPLKLQSLTNLRSLILWHVPLRNERLQTLIVRCRMLQTIDLLHCAELSRVEIYAAEHRYFKMLRIAGCNNLSMVEVVSPTLRCVHYCGHVPSTITFQAPQLSEALFNFVPAGNRRYLRASVLEKLVCDISNVTVLSASVLIPEALTAKIHHGVFGEICYNFLNLRELHLIMNGGLFCNPYDIIMLMKRCPILEKLFID

SEQ ID NO: 128437 - protein, 546 aa, Glycine max
  Coding DNA Sequence Number=SeqID_11659
  Gene Ontology: Mol. function=zinc ion binding; Cellular component =mitochondrion; Biological process=regulation of transcription, DNA -dependent
  Homolog annotation: Hit_ID=Q8H349; Match level="QueryCoverage=92%, HitCoverage=60%, E-value=9e-99, Identity=41%"; Hit description =VP1/ABI3 family regulatory protein-like protein
  Pfam annotation: Domain name=B3; Domain location=314-417; Score=86.9; E_value=6.3e-23; Accession=PF02362.12; Description=B3 DNA binding domain
MDLLTGVMTAVFSVASVDVKQWSSAFEEGRFCEIFHSNASGWRSCETCLKRIHCGCIVSSHAFMLLDPGGIECYACARKSIILPSNLPWPQSFSLQNRLSDRLRDLSAKGWSQLAGSGPVPWKQAPSLFNSASSSDLIPEVPSLVELSNSFDKMYCNERLPASALEKKNEDLSGIPVNWNVKLGSREMMLMNGMRNEDKSSSCLNMCQQPSSLKEESSPQPFGLAVPNSCQNERNGQLGVTGSHPQQTPPPPGKQFNGTMHLAPDSSGEAQIRNGRPRADSRGRNQLLPRYWPRCTDLELQQISIEYPSNQMIVVLKTLSASDAGRIGRLVLPKKCAETYFPPISQPEGLPLKILDAKGKEWIFQFRFWPNNNSRMYVLEGVTPCIQSMQLQAGDTVTFSRLEPEGRLVMGFRKASSVMPSDQDNETKTGNGFSAHGEVELADPNSWSKVDKSGYIAKEALGSKSLISRKRKSNILSSKSKRLRIENEDLIELKITWQEAQGLLRPPPSHIPSIVVIEGFEFEEYEVPVFLLHIRKGYGLLMLLYF

SEQ ID NO: 128438 - protein, 185 aa, Glycine max
  Coding DNA Sequence Number=SeqID_11660
  Gene Ontology: Mol. function=diacylglycerol kinase activity; Cellular component=membrane fraction; Biological process=protein kinase C activation
  Homolog annotation: Hit_ID=Q4SN93; Match level="QueryCoverage=73%, HitCoverage=17%, E-value=8e-24, Identity=38%"; Hit description =Chromosome 8 SCAF14543, whole genome shotgun sequence
  Pfam annotation: Domain name=DAGK_cat; Domain location=52-182; Score =121.2; E_value=3e-33; Accession=PF00781.14; Description =Diacylglycerol kinase catalytic domain
MVIGWTPTVFVDRKGRPRDRGLWALHQNQEPRGDPRRMLHQQFPCKARRPKSLLVFVNPFGGKQSAKKIFAEQVKSLLEDAQIQITVQETKHELHAKEVARSLDITKYHGIVCVSGDGILVEVVNGLLQREDWDTAIKMPLGVVPAGNGMAKSLLDSVGDPCEVANAVLAIIRGSKRPLDVATIT

SEQ ID NO: 128439 - protein, 247 aa, Glycine max
  Coding DNA Sequence Number=SeqID_11661
  Gene Ontology: Mol. function=binding; Cellular component =intracellular; Biological process=RNA processing
  Homolog annotation: Hit_ID=Q8LIB1; Match level="QueryCoverage=99%, HitCoverage=26%, E-value=1e-95, Identity=66%"; Hit description =Putative adapter protein ATH-55
MVIAQDLYPSEDDLLYEEELLRNPFSLKLWWRYLIARSEAPFKKRFVIYERALKALPGSYKLWHAYLRERLDLVRNLPVIHSQYDTLNNTFERALVTMHKMPRIWIMYLQTLTNQKLITRTRRTFDRALCALPVTQHDRIWEPYLVFVSQKGIPIETSLRVYRRYLKYDPSHIEDFIEFLLNSSLWQESSERLASVLNDDQFYSIKGKTKHRLWLELCDLLTRHANEVSGLNVDAIIRGGIRKFTDE

SEQ ID NO: 128440 - protein, 185 aa, Glycine max
  Coding DNA Sequence Number=SeqID_11662
  Gene Ontology: Mol. function=nucleic acid binding; Cellular component= mitochondrion; Biological process=translation
  Homolog annotation: Hit_ID=P93486; Match level="QueryCoverage=63%, HitCoverage=80%, E-value=3e-51, Identity=82%"; Hit description =Glycine-rich RNA-binding protein PsGRBP
  Pfam annotation: Domain name=RRM_1; Domain location=80-151; Score =110.9; E_value=3.8e-30; Accession=PF00076.12; Description=RNA recognition motif. (a.k.a. RRM, R
MKIKEDKNDDSSKRDLLAQDFIAHSIKRKIFTTPAPASETIIMAFCNKVGNVLRQGAARSTHAPVASMLNYIRCMSSSKLFIGGLSYGVDDQSLKDAFSGFGDVVDAKVITDRDSGRSRGFGFVNFSNDESASSALSAMDGKDLNGRSIRVSYANDKPSAPRPGGGGGYRGGDYDGDFASRSGGW

SEQ ID NO: 128441 - protein, 550 aa, Glycine max
  Coding DNA Sequence Number=SeqID_11663
  Gene Ontology: Mol. function=binding; Cellular component =intracellular; Biological process=RNA processing
  Homolog annotation: Hit_ID=Q8LIB1; Match level="QueryCoverage=99%, HitCoverage=59%, E-value=0.0, Identity=68%"; Hit description =Putative adapter protein ATH-55
  Pfam annotation: Domain name=HAT; Domain location=164-196; Score=1.0; E_value=19; Accession=PF02184.7; Description=HAT (Half-A-TPR) repeat
  Pfam annotation: Domain name=HAT; Domain location=237-271; Score=6.9; E_value=1.7; Accession=PF02184.7; Description=HAT (Half-A-TPR) repeat
  Pfam annotation: Domain name=HAT; Domain location=346-380; Score=6.9; E_value=1.7; Accession=PF02184.7; Description=HAT (Half-A-TPR) repeat
  Pfam annotation: Domain name=HAT; Domain location=72-108; Score=9.0; E_value=0.72; Accession=PF02184.7; Description=HAT (Half-A-TPR) repeat
  Pfam annotation: Domain name=Suf; Domain location=149-434; Score= -132.2; E_value=0.026; Accession=PF05843.5; Description=Suppressor of forked protein (Suf)
  Pfam annotation: Domain name=TPR_2; Domain location=184-217; Score =7.8; E_value=4.1; Accession=PF07719.7; Description=Tetratricopeptide repeat
  Pfam annotation: Domain name=TPR_2; Domain location=223-256; Score =2.2; E_value=18; Accession=PF07719.7; Description=Tetratricopeptide repeat
  Pfam annotation: Domain name=TPR_2; Domain location=259-292; Score =5.2; E_value=8.1; Accession=PF07719.7; Description=Tetratricopeptide repeat
  Pfam annotation: Domain name=TPR_2; Domain location=58-91; Score=9.7; E_value=2.5; Accession=PF07719.7; Description=Tetratricopeptide repeat
  Pfam annotation: Domain name=TPR_2; Domain location=96-128; Score =0.5; E_value=28; Accession=PF07719.7; Description=Tetratricopeptide repeat
  Pfam module annotation: Pfam domain module=HAT::HAT::HAT::HAT::Suf::TP R_2::TPR_2::TPR_2::TPR_2::TPR_2; Domain location=164-196::237 -271::346-380::72-108::149-434::184-217::223-256::259-292::58-91::96 -128
MERRPELANSVLLRQNPHNVEQWHRRVKLFEGNPTKQILTYTEAVRTIDPMKAVGKPHTLWVAFAKLYEQHKDIANARVIFDKAVQVNYKTVDNLASVWCEWAEMELKYKNFKGALELMRRATAEPSVEVKRRVAADGNEPVQMKLHKSLRLWTFYVDLEESLGTLESTCAVYERILDLRIATPQIIINYAYFLEEHKYFEDAFKVYERGVKIFKYPHVKDIWVTYLSKFVKRYGKNKLERARELFENAVESAPADQVKPLYLQYAKLEEDYGLAKRAMKVYDQATKAVPNNEKLSMYEIYIARAAEIFGVPKTREIYEQAIESGLPDKDVKTMCLKYAELEKSLGEIDRARGIFVFASQFADPRSDPEFWNKWHEFEVQHGNEDTFREMLRIKRSVSASYSQTHFILPEYLMQKDQTVNLDEAKDKLKQAGIPEDEMAALERQLAPAVDNTVTKDRKVGFVSAGVESQLDRGVKTSANHEDIELPEESDSDDDDDKIEIAQKDVPSAVFGGLIRKRDENENNGEVDAAKDKDNGIRLGALERMKRLKQN

SEQ ID NO: 128442 - protein, 587 aa, Glycine max
  Coding DNA Sequence Number=SeqID_11664
  Gene Ontology: Mol. function=solute:hydrogen antiporter activity; Cellular component=integral to membrane; Biological process =regulation of pH
  Homolog annotation: Hit_ID=Q1SA42; Match level="QueryCoverage=60%, HitCoverage=45%, E-value=1e-123, Identity=63%"; Hit description =Na+/H+ antiporter-like protein, putative
IMVVACIVQWSVKFLYDPSRKFAGYQKRNMMNLKPWSELRMLVCIHKPSHISSMIDVLDLCCPTTESPIIVEVLHLIELVGRALPIFIPHRLRRQASGLQHKSYSDDVILTFDIYEHDNPHAVSAYPCTAIAPPNLMHEDVCNLAFDKVASIIILPFHQRWSSDGEVQFDDKNIRTLNNRVLEISPCSVGILVTRASHQIRGSTTRLALIYLGGHDDEEALCIARRAIRNPEVNLVVYHLVFKEDDEWGQEVDDELEDVKHAHEHNIRYQQIIAKEGAQTAAFLSDIVKEHDFFLVGRRHGIESPQTDGLTDWSEFPELGVIGDFLASPDLESRASILVVQQQLSSKAHSGWVYFFVLMLQQFELDNKIDEMKLVLKSLQNLQFTVKWFEVVEQIEYAFMELKVLAFGENCIRLSLQTYMPTFVGISYLPRVEATVDTAELNHELLIEVFEGTMRSKNVQVFPNDIYVNDIVDTAKFVSKSSLQWFIQKVQDRIILSTLRHLVVKDANKSRYSLEYLDKDKTIVVHMAGGIDAYIKLSLGWPIFVSPLKLICIKGSDDLKRTSLSFRCKVEAFSVWHQGFKLKNVHT

SEQ ID NO: 128443 - protein, 196 aa, Glycine max
  Coding DNA Sequence Number=SeqID_11665
  Homolog annotation: Hit_ID=Q1S9V4; Match level="QueryCoverage=28%, HitCoverage=11%, E-value=1e-19, Identity=84%"; Hit description =Rhodanese-like
MPIVRYVIDIKTASFNSSVCALVVNPYLVQGGFQSWMQQGLRIKELKPETALSILNEEAEAILEDVSPSPGQLLGYGTVLIAGLYALLEWEKTLQLIGAFGLGLTIYLRVSSYEKSEDLKQDVRLLLSPVRLGAQAFSWAAGKLESNGLGLPTSPSSSDVQNRVLQAAAKHESQPSDSEGNQDPVPEPTVPLNQNV

SEQ ID NO: 128444 - protein, 185 aa, Glycine max
  Coding DNA Sequence Number=SeqID_11666
VSRHSCEKSAVGENLKKRKDIESNGIMHANDSWPSKLPKPSPSLSHLTENGRILEPCQISLQNTSDRLAAASNIKVDNKERKINGIIEALPSTVSSKTPTPIATMPAPVSEASAKPPHPDSKYISQVYSVPKVDEWSDFDDQEWLFGSSHWQGRTPAVKSSEVEDTLQVAHDTSKIPDLLKEPSI

SEQ ID NO: 128445 - protein, 284 aa, Glycine max
  Coding DNA Sequence Number=SeqID_11667
  Gene Ontology: Mol. function=endonuclease activity; Biological process=DNA catabolic process
  Homolog annotation: Hit_ID=O80326; Match level="QueryCoverage=85%, HitCoverage=88%, E-value=3e-99, Identity=62%"; Hit description =Endonuclease precursor
  Pfam annotation: Domain name=S1-P1_nuclease; Domain location=33-274; Score=399.4; E_value=5.3e-117; Accession=PF02265.7; Description=S1P1 Nuclease
MVRLGRLWMSLLPFGFLLFFSSAFIRVPGALAWSKEGHVMTCQIAQALLEPEASEAVYQLLPDYVKGDCHDSHGVEDMCVAGAVKNFTSQLMHYKEGTSDRRYNMTEALLFLSHFMGDIHQPMHVGFTTDEGGNTIELHWFRHKSNLHHVWDREIILTALADYYDKDVSLLLQDIERNYTDGIWSDDITSWKHCNDISQCVNNWAKESIQIACKWGYEGVEAGATLAVYQHEMSRLCAHDAFVDDYFDSRVPFVMKRIAQGGIRLAMILNKVFADSEERFATAT

SEQ ID NO: 128446 - protein, 448 aa, Glycine max
  Coding DNA Sequence Number=SeqID_11668
  Gene Ontology: Mol. function=Rab GTPase activator activity; Cellular component=intracellular; Biological process=regulation of Rab GTPase activity
  Homolog annotation: Hit_ID=Q1SDX8; Match level="QueryCoverage=78%, HitCoverage=88%, E-value=1e-128, Identity=61%"; Hit description =RabGAP/TBC
  Pfam annotation: Domain name=TBC; Domain location=158-373; Score= -59.0; E_value=0.0022; Accession=PF00566.9; Description=TBC domain
  Subcellular localization annotation: CTP_CleavageSite=47; ConfidenceScore=5.49e-01
MKKKKQVPEWMNSSLWSTPSDPPASVSVREEPPTIPTNQNASPPLSSSSSVSSPTATADDISRHAQAQVQLLAELSRKVIDMRELRRVVASQGISDAGALRPTLWKLLLGYLPPDRSLWSSELAKKRSQYKNFKDDLLTNPSEITRRMYNSNSAALGIDDAKSHTQTRLLLSRSRITHQDHPLSLVKTSIWNQFFQDTEIIDQIDRDVNRTHPDIHFFSGDSLFAKSNQEALKTILIVFAKLNSGIRYFQGMNEVLAPLFYVFKNDPDEENEAFAEADTFFCFVELLSRFQDNFCQQLDNSIVGIRSTITRLSQLLKEHDEELWRHLEVTTKEFNFADILHIWDVILSDPEGPQVTLKVPYRQRDSFSSLMRMSTTIIPNENVHNKLQQDLSASTCCVFTPRNAYLRASNPAEFLLILHVLCIHDSNSIPIVLIHFIHWTLCPMIAIF

SEQ ID NO: 128447 - protein, 87 aa, Glycine max
  Coding DNA Sequence Number=SeqID_11669
MAEMQPSPMEHHARSWKPLPNGFLKCNLDAAIFNELNSFRVGVCVRGEQDNFIKAKTTLFKRYPNINRSLKLDLTLCYSMDHAVRFQ

SEQ ID NO: 128448 - protein, 275 aa, Glycine max
  Coding DNA Sequence Number=SeqID_11670
  Gene Ontology: Mol. function=solute:hydrogen antiporter activity; Cellular component=integral to membrane; Biological process =regulation of pH
  Homolog annotation: Hit_ID=Q1SA42; Match level="QueryCoverage=99%, HitCoverage=37%, E-value=1e-72, Identity=49%"; Hit description =Na+/H+ antiporter-like protein, putative
MNSNPNETMFLSITPVDEATHRYTVCLAAPPHIVSDGLWGSAAANRKPMKSFLPLFELQMLAGLILQACFALDPFASYMRLLFPYGTHDTITTISSIGFVLFIFINGVQMDFGLITRMGKRAWTIAISGLLVPIFCAISILSLFPFGHSGNYDDLVVALVSHTVISFAVISSFLNELQIQNSELGKLALSSALISDVLCTIVTSTGTAVMVTEDSNVKEVTRNILSLICMGILIPLVCRPAMLWIIKHTPEGRAVKDGYVYVIIVLLFILGWLSS

SEQ ID NO: 128449 - protein, 373 aa, Glycine max
  Coding DNA Sequence Number=SeqID_11671
  Gene Ontology: Mol. function=zinc ion binding; Cellular component =COPII vesicle coat; Biological process=ER to Golgi vesicle-mediated transport
  Homolog annotation: Hit_ID=Q9FG78; Match level="QueryCoverage=85%, HitCoverage=45%, E-value=2e-95, Identity=56%"; Hit description =Protein transport protein SEC23
  Pfam annotation: Domain name=Sec23_BS; Domain location=272-373; Score= 85.9; E_value=1.3e-22; Accession=PF08033.2; Description=Sec23Sec24 beta-sandwich domain
  Pfam annotation: Domain name=Sec23_trunk; Domain location=14-264; Score=230.4; E_value=3.8e-66; Accession=PF04811.5; Description =Sec23Sec24 trunk domain
  Pfam module annotation: Pfam domain module=Sec23_BS::Sec23_trunk; Domain location=272-373::14-264
STVEYSSPSPSPPPPPPAFVFLLDLSTPQDELPPLKNQLLHLLHHLPDHSLVSLITFDSMVYLHHLSSSHFSSLLVFHGNRHLSSNQIRHFLNPHRHQAFLLPISECQFSITTAIEEIHSTSNSTISASRPPRCTGSAISVALGLLESCPINTGSRILVFTSGPATLGPGIVVDSDRRQPIRTHHHIFNAQATHYAKSSAFYNQLSKRLSGASVVLDLFACSLDQVGAAELRGPVEHSGGFIVLSESFDSDQFKNCLRQMFRCDDQGHLRMNFDATIEIVTTKDVKICGALGPCVSLERNNCLVSEAEVGEGGTSVWKLNTLTHKTCIAFFFQVNQEQKMKIQPGSAFLIQFITRYRPGNMIRKRVTTAARRW

SEQ ID NO: 128450 - protein, 131 aa, Glycine max
  Coding DNA Sequence Number=SeqID_11672
  Homolog annotation: Hit_ID=Q9SXF7; Match level="QueryCoverage=93%, HitCoverage=24%, E-value=1e-59, Identity=90%"; Hit description=Amino acid transporter-like protein 1
MEERPEAELISIPATPRVSTPEILTPGQRSPRAASKEGKSWTPTSFISPRFLSPIGTPMKRVLVNMKGYLEEVGHLTKLNPQDAWLPITESRNGNAHYAAFHNLNAGVGFQALFLPVAFAYLGWRNFTFIL

SEQ ID NO: 128451 - protein, 100 aa, Glycine max
  Coding DNA Sequence Number=SeqID_11673
MGETRGTLVRWGLYNSETWKLWKWKEHRSITRRGAERTESVMAGGMINDGKSFPRRFSGRPIPKRGQVKVAIVLGLAHSLAAIFSRTTTSCVAPPHHLSH

SEQ ID NO: 128452 - protein, 541 aa, Glycine max
  Coding DNA Sequence Number=SeqID_11674
  Gene Ontology: Mol. function=hydrolase activity; Cellular component =extracellular space; Biological process=biological_process
  Homolog annotation: Hit_ID=Q1SA45; Match level="QueryCoverage=97%, HitCoverage=97%, E-value=0.0, Identity=90%"; Hit description =Metallophosphoesterase; Purple acid phosphatase, N-terminal
  Pfam annotation: Domain name=Metallophos; Domain location=186-399; Score=70.5; E_value=5.3e-18; Accession=PF00149.18; Description =Calcineurin-like phosphoesterase
MGWVIVCMLFSLSCVIVDGGVPTTLDGPFKPVTVPLDQSFRGNAVDLTDTDPLVQRTVEGFQPEQISLSLSASHDSVWISWITGEFQIGDNIEPLDPETVASIVQYGRFGRSMRHQATGYSLVYSQLYPFEGLQNYTSGIIHHVRLTGLRPNTLYQYKCGDPSLSGMSDVHYFRTMPASGPKSYPSRIAVVGDLGLTYNTTSTVNHMTSNHPDLILLVGDVSCANLYLTNGTGADCYSCSFPNTPIHETYQPRWDYWGRYMQPLISSVPIMVIEGNHEIEEQAENQTFVAYSSRFAFPSEESGSSSTFYYSFNAGGIHFIMLGAYISYDKSGDQYKWLERDLASVDREVTPWLIATWHAPWYSTYKAHYREAECMRVEMEDLLYKYGVDIVFNGHVHAYERSNRVYNYTLDPCGPVYITVGDGGNREKMAITHADEPGQCPEPSTTPDDYMGGFCAFNFTSGPAEGNFCWDRQPDYSAFRESSFGHGILEVKNETHALWIWHRNQDFYGSAGDEIYIVREPQNCPPIKPEEGAKIFNFKMH

SEQ ID NO: 128453 - protein, 134 aa, Glycine max
  Coding DNA Sequence Number=SeqID_11675
MAFGGSGKGSRKGGSCVGSSSSSMMRRNTLEWEEEAFHKTNVKGLETSPRAIEPSLRPEPMSEAGALEPLDEFEGHPWGRHTMKMQIESPKLAKTQAKKPIVHCESTTETTLMLDHPCKRRKWSNDPGLVLSGI

SEQ ID NO: 128454 - protein, 83 aa, Glycine max
  Coding DNA Sequence Number=SeqID_11676
MRRKSKNEVVIVFELGDDVEFSGIGGFIPFPAPSPPWIGVVVVGAATFGIAVGVVTVVFVFVFVFVTPAPAVIHSHYKELKPN

SEQ ID NO: 128455 - protein, 617 aa, Glycine max
  Coding DNA Sequence Number=SeqID_11677
  Gene Ontology: Mol. function=binding; Cellular component=plastid chromosome; Biological process=positive regulation of transcription, DNA-dependent
  Homolog annotation: Hit_ID=Q1S8V7; Match level="QueryCoverage=96%, HitCoverage=86%, E-value=0.0, Identity=80%"; Hit description =Pentatricopeptide repeat
  Pfam annotation: Domain name=PPR; Domain location=130-164; Score =26.9; E_value=7.2e-05; Accession=PF01535.11; Description=PPR repeat
  Pfam annotation: Domain name=PPR; Domain location=165-199; Score =20.9; E_value=0.0044; Accession=PF01535.11; Description=PPR repeat
  Pfam annotation: Domain name=PPR; Domain location=200-234; Score =39.1; E_value=1.5e-08; Accession=PF01535.11; Description=PPR repeat
  Pfam annotation: Domain name=PPR; Domain location=235-269; Score =31.3; E_value=3.4e-06; Accession=PF01535.11; Description=PPR repeat
  Pfam annotation: Domain name=PPR; Domain location=270-304; Score =38.9; E_value=1.7e-08; Accession=PF01535.11; Description=PPR repeat
  Pfam annotation: Domain name=PPR; Domain location=305-339; Score =32.8; E_value=1.2e-06; Accession=PF01535.11; Description=PPR repeat
  Pfam annotation: Domain name=PPR; Domain location=340-374; Score =47.6; E_value=4.3e-11; Accession=PF01535.11; Description=PPR repeat
  Pfam annotation: Domain name=PPR; Domain location=375-409; Score =29.9; E_value=8.9e-06; Accession=PF01535.11; Description=PPR repeat
  Pfam annotation: Domain name=PPR; Domain location=410-444; Score =19.0; E_value=0.017; Accession=PF01535.11; Description=PPR repeat
  Pfam annotation: Domain name=PPR; Domain location=476-510; Score =29.9; E_value=9.1e-06; Accession=PF01535.11; Description=PPR repeat
  Pfam annotation: Domain name=PPR; Domain location=511-545; Score =16.1; E_value=0.092; Accession=PF01535.11; Description=PPR repeat
  Pfam annotation: Domain name=PPR; Domain location=95-129; Score=30.5; E_value=6e-06; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=130-164::165 -199::200-234::235-269::270-304::305-339::340-374::375-409::410 -444::476-510::511-545::95-129
MAKDVWTRTSSSNTSRQRSRRQQYWDRSVDMEELLAAIGQTQNEDELYAVMSPYNGRQLSMRFMVSLLSREPDWQRALALLDWINDKALYSPSLFAYNVLLRNVLRAKQWHLAHGLFDEMRQKGLSPDRYTYSTLITSFGKHGLFDSSLFWLQQMEQDNVSGDLVLYSNLIDLARKLSDYSKAISIFSRLKASTISPDLIAYNSMINVFGKAKLFREARLLLQEMRDNAVQPDTVSYSTLLAIYVDNQKFVEALSLFFEMNEAKCPLDLTTCNIMIDVYGQLHMPKEADRLFWSMRKMGIQPNVVSYNTLLRVYGEADLFGEAIHLFRLMQSKDVQQNVVTYNTMINIYGKTLEHEKATNLIQEMKKRGIEPNAITYSTIISIWEKAGKLDRAAILFQKLRSSGVRIDEVLYQTMIVAYERAGLVAHAKRLLHELKRPDNIPRDTAIGILARAGRIEEATWVFRQAFDAREVKDISVFGCMINLFSKNKKYGNVVEVFEKMRVVGYFPDSDVIALVLNAFGKLREFDKADALYRQMHEEGCVFPDEVHFQMLSLYGARKDFVMVESLFEKLDSNPNINKKELHLVVASIYERADRLNDASRIMNRMNQKANRSHYHA

SEQ ID NO: 128456 - protein, 782 aa, Glycine max
  Coding DNA Sequence Number=SeqID_11678
  Gene Ontology: Mol. function=RNA binding
  Homolog annotation: Hit_ID=Q9LHC3; Match level="QueryCoverage=53%, HitCoverage=61%, E-value=2e-60, Identity=37%"; Hit description =Transcription or splicing factor-like protein
  Pfam annotation: Domain name=Extensin_2; Domain location=264-648; Score=-139.4; E_value=0.075; Accession=PF04554.4; Description =Extensin-like region
  Pfam annotation: Domain name=KH_1; Domain location=175-248; Score =17.1; E_value=0.012; Accession=PF00013.19; Description=KH domain
  Pfam module annotation: Pfam domain module=Extensin_2::KH_1; Domain location=264-648::175-248
MSAEIDSTCAPEPHKMSGQKLSIFSAKSGFVIPKNKLSGSLVPIFRGAKKHGVTVGATNEESSKQIERKSKWGPDLTQDAAVRRGKVLALQIRVDQITKQLESEKLEVGDTQNLNPDQSKSGPRITSKKSEMLELEKREAIGEILKLDPSYKPPRGFKPLLKEASIPLPVQEYPGYNFVGLIYGLEGDNQKQLEKETGAKIKIHGIKADTGEKGEIKPGTDIQCNYKEMHVNLSADSFEKVDAAMSIIELLVTSVIGNLAAGSTPSISVSRYSTNVLSQSHECPPSHADSLSLENQAVLQPVAVTQMHGDNFQYSSPWFSVVPSHSPVFASSGSVALPNPLGLARTPHFPSHTSNMTSPFGAQPGPAGFQPIIPNQHVSVQAPPPRQVLQYSHMTQTSPLGHIGPPRNPVQNLLTPTNASLSFPVTLSQPTPIGQHQTSVSSMHLPMSGISSSIPNQSLTHLGVSSGQNEAPVTVKMSVGPSNMVPMASPVVPPARPVSLHQQPDVAFKPPQSNMSMMPRSATFPPHQVGISPGQPSSLRPMPVPISANHLLGPVSFPSPGISPSLPLPQQAGIPNLAFGVAPYHTHVKPPVLGTSKSGNFTFQSHLPNADYGQVYSGPNSQSGATQEPPSGPRPPPFGFAVPDQPRQIFPRTQFPGQVDQAVAFGGRSGSISNSIPPPRHGVFPYAGQPAPRSSAAQMGMKNFISAPQIPNLTSAGSQRGMPIRKSYATQMAWADISMPLNQKFVSNPPMASGKIAYATDQIYDPFSPTSAPPQHKGNPGK

SEQ ID NO: 128457 - protein, 390 aa, Glycine max
  Coding DNA Sequence Number=SeqID_11679
  Gene Ontology: Mol. function=transferase activity; Cellular component= chloroplast; Biological process=biosynthetic process
  Homolog annotation: Hit_ID=Q1S8W1; Match level="QueryCoverage=97%, HitCoverage=97%, E-value=1e-146, Identity=70%"; Hit description =Ribosomal protein S2; Squalene/phytoene synthase
  Pfam annotation: Domain name=SQS_PSY; Domain location=97-377; Score =314.9; E_value=1.4e-91; Accession=PF00494.10; Description =Squalenephytoene synthase
  Subcellular localization annotation: CTP_CleavageSite=36; ConfidenceScore=5.25e-01
MMSLSFCSLIAKPCSMINGSNRKPCCGRTRFGVIIRSEVNVAPKQRGIPQLSKQGVPLAVQEVVHRQSQIINHCSKPRPLFEPTFLYDAYEMCRNICAEYAKTFYLGRTFLPILNRNLAYDGRKTESYMGNLWRTDELVDGPNAGYMSSSVLDRWEDRLHDIFNGQPYDMLDAALTDTVSKFPLDIKPFKDMIQGMRMDTRKARYNNFQELYLYCYYVAGTVGLMTVPIMGIAQESVIPVQSVYDAALYLGVGNQLTNILRDVGEDALRGRVYLPQDELAQFGLCDKDVFSRNVSERWRKFMKYQITRARFYFNRAEEGVSQLQKASRWPVWSSLILYRKILDAIEDNDYDNLTKRAYVGRAKKFLTLPLAYTRSLSNHKTKFRSLTRPI

SEQ ID NO: 128458 - protein, 79 aa, Glycine max
  Coding DNA Sequence Number=SeqID_11680
  Homolog annotation: Hit_ID=O80848; Match level="QueryCoverage=86%, HitCoverage=66%, E-value=1e-30, Identity=76%"; Hit description =Putative gibberellin-regulated protein
  Pfam annotation: Domain name=GASA; Domain location=1-79; Score=129.1; E_value=1.3e-35; Accession=PF02704.5; Description=Gibberellin regulated protein
MAFVTQVAYGGGEGSLTPQECPGACDYRCSKARARKACLYFCNLCCAKCLCVPSGTYGHKEECPCYNNWKTNKGTPKCP

SEQ ID NO: 128459 - protein, 87 aa, Glycine max
  Coding DNA Sequence Number=SeqID_11681
  Gene Ontology: Mol. function=O-methyltransferase activity; Biological process=lignin biosynthetic process
  Homolog annotation: Hit_ID=Q1S8W2; Match level="QueryCoverage=60%, HitCoverage=14%, E-value=7e-17, Identity=79%"; Hit description=O -methyltransferase, family 2
MKIEEEGGEKHNGLKDVGLMLDMIMMAHTNFGKERTLKEWEYVIKMAGFSSYTVKPIIFMLCSPSLWLLLKYPPKITLASLPLKCIK

SEQ ID NO: 128460 - protein, 127 aa, Glycine max
  Coding DNA Sequence Number=SeqID_11682
  Gene Ontology: Mol. function=RNA-directed DNA polymerase activity; Cellular component=mitochondrion; Biological process=DNA integration
MDVKTIFLNGHLEEKVYMKQLEGFSSSDNEHLVCKLNKSIYGLKQVSRQWYLEFHEVLTSFDFEDNIMDQCIYQKVCTKPNITYDDGVLGRYQSNLGVDHRKDAKKVIRYLQGTKDYMLMYRQTNDL

SEQ ID NO: 128461 - protein, 323 aa, Glycine max
  Coding DNA Sequence Number=SeqID_11683
  Gene Ontology: Mol. function=RNA-directed DNA polymerase activity; Biological process=RNA-dependent DNA replication
GRKLHWMSQRKLSRNKKDGGLGFRFVHVFNETLLAKQWWRIMTQEDSLVARMMKARYFLNSSIWESRVNYRPNFTWSSILSRKSIIEEDCMWCACDGKTIPTMKDKWLPNLPRARILPYEGGHIHESIMGVFQNHKLECHQVLVKMFQNMPKENIQDGEAGIQQTKNVFWKEPTYGRYKINFDTSVSKNGGTWIVFISRDKEGHVLASTTKLLDFVLEPREVEAYAFRWEICLAVELLFENVIFETDCLQQVKQSILKEKNGHALFHGIVYDCQRTIHRTSSLVHKVHLAIYIALHYARQPSMSALTQEHGRPVLISRALNRQ

SEQ ID NO: 128462 - protein, 65 aa, Glycine max
  Coding DNA Sequence Number=SeqID_11684
MKQSLKTLEGPTGGKGKGTEGGWGGFTEVFVASKDPLILASFYTPSSRSDGSTCNKELVKNLNLI

SEQ ID NO: 128463 - protein, 191 aa, Glycine max
  Coding DNA Sequence Number=SeqID_11685
MGVCFLHGCRKLEWRDSYSTICNDEIGWVPPLLQARRLLTWRVSPVARARSFHVGSTNAAGENPADLAPREQGVGSSPRLACFCIFERCFLNVRNHWRNAYVEEYLTGRNGGISLAYLAGTTGGIAAYVEEYLARSTGGIAAYVEYPAIAVGDFSSSRFYEWRHAYVANAIGGTTPRRYPIRKLLKKGPLY

SEQ ID NO: 128464 - protein, 162 aa, Glycine max
  Coding DNA Sequence Number=SeqID_11686
MEEKNSAKAKHQQHQEHSKKFKNGEKQSVYNGQILLCIPKQCCCIPKQWRAELKSYKGVSPVLWTRPKLQAVSPAVWASPTWAISPVGLAAPAGCVAVPIGDTLLSPSYVAISPPLVTIHPSLQLCRHWQWRVEPCRQWQWRFPPQNKPPPLFLLEQTPSRK

SEQ ID NO: 128465 - protein, 98 aa, Glycine max
  Coding DNA Sequence Number=SeqID_11687
MGRTIGLRGSVVAVVLSQGFNSGVGGGGVRLGNQLCFPKQFLEHLDSILSVNMASEMDKYVCRSIKEPHSQVKHNSKSTTREQGAFKLQTRNTISQAE

SEQ ID NO: 128466 - protein, 255 aa, Glycine max
  Coding DNA Sequence Number=SeqID_11688
  Gene Ontology: Mol. function=transcription factor activity; Cellular component=nucleus; Biological process=regulation of transcription, DNA-dependent
  Homolog annotation: Hit_ID=O80337; Match level="QueryCoverage=78%, HitCoverage=80%, E-value=2e-46, Identity=49%"; Hit description =Ethylene-responsive transcription factor 1A
  Pfam annotation: Domain name=AP2; Domain location=135-200; Score =144.4; E_value=3.1e-40; Accession=PF00847.10; Description=AP2 domain
MYGQSSSSSSSYESDLALLDSIRHHLLGESESIFGAPNFGSGRSSSFSSLDSCLSDNWGELPFKEDDTEDMVLYGVLRDAVNVGWVPSLDAGSPESVSSGFPAVKLEPDLMPALISPCPPPAAAAEEKKVVPAKGKHYRGVRQRPWGKFAAEIRDPAKNGARVWLGTFETAEDAALAYDRAAYRMRGSRALLNFPLRVNSGEPDPVRVKSKRSSSPESAAALPAKRKKVVVVGTVQEQVGSQVAECTRGEQLLVS

SEQ ID NO: 128467 - protein, 77 aa, Glycine max
  Coding DNA Sequence Number=SeqID_11689
MTSQEYKYVGSKRGCKVYKGRYLVLQRQKNKGNICYLDDQVLKRNHDSKMKKKVKFSNVVEVLGDTSVGGGVCSFSN

SEQ ID NO: 128468 - protein, 270 aa, Glycine max
  Coding DNA Sequence Number=SeqID_11690
  Gene Ontology: Mol. function=ubiquitin thiolesterase activity; Cellular component=intracellular; Biological process=ubiquitin -dependent protein catabolic process
  Homolog annotation: Hit_ID=Q8GWE1; Match level="QueryCoverage=76%, HitCoverage=81%, E-value=2e-75, Identity=68%"; Hit description =Putative carboxyl-terminal proteinase
  Pfam annotation: Domain name=Peptidase_C12; Domain location=12-235; Score=272.0; E_value=1.2e-78; Accession=PF01088.11; Description =Ubiquitin carboxyl-terminal hydrolase, family 1
MATLDERPSAKRWLPLEANPEVMNQFLWGLGLPLDEAECCDVFGLDEELLEMVPKPVLAVLFLYPITAKSEEERLQQENEKKDYSSKVYFMKQTVGNACGTIGLLHALGNITSEVKLVEGSFFDKFFKSTASMDPLQRAVFLENDREMEVAHSVAATAGDTVITDVVMKGLVWLSYLENLASDNVDTHFICFACVDGELYELDGRKSGPISHGPSSPSTLLRLLALSATSYNDQDPIQHSPSTLLLAQKNWTGVDYALVNKSALWCPVGM

SEQ ID NO: 128469 - protein, 197 aa, Glycine max
  Coding DNA Sequence Number=SeqID_11691
MSKSFDVSLRKVRMSGYAIKGHGACKFATPYHFGLARVLFQLGQSVTKWNIKLQGGFDPARVGARWALNLALNVFVVTNKNGPIEYTSGRIPINVWSCNPTEKLHFCDLMLNPTQFQAKEEKIEAADDSLSEVDPLSEMPQLSEASSLLSGWETLEEDNEPSEAEESKSLSIEVGGVSKERRVLSNKESLVQENIEI

SEQ ID NO: 128470 - protein, 215 aa, Glycine max
  Coding DNA Sequence Number=SeqID_11692
MAVSLVWRHVDEAVRMNGETAASWMPPVEVARHPWKSPVVAARPVEEDEYLAGCNGETAASWMPPVEVARHPWKPPVVAARPVEEDEYLAGCNGETAASWMPPVEVARHPWKPPVVTTRPVEEDECVKPSTFISSRNTHWRDLPVHSLRPSAVPSKHACKAKSPLRVARTCHSKIAISNYDIYTDITGSTGGIIPRVNGLRISPFILAIHLHSFA

SEQ ID NO: 128471 - protein, 152 aa, Glycine max
  Coding DNA Sequence Number=SeqID_11693
MENHLEPQDSSPKAAVLLCGINYPRELTSSIEMFHCQQQQQPESINHLLFQCPKTHGLWLQFYTRHLQIACSHTWAFDQSKAGNEGWAIVWCTWKSRGALCELVMVETREVFCQISHIRFTNGLLMLMHVYVLQLDTFYGRIGTYLGAVYVR

SEQ ID NO: 128472 - protein, 76 aa, Glycine max
  Coding DNA Sequence Number=SeqID_11694
  Subcellular localization annotation: CTP_CleavageSite=29; ConfidenceScore=5.06e-01
MVGLGADLMMARHKSVSRKGENRTSRTPRAVENKKAATSMESIAKRRRRKKKASSAPKCEKKGKITRYPYESMLRK

SEQ ID NO: 128473 - protein, 73 aa, Glycine max
  Coding DNA Sequence Number=SeqID_11695
MSHCEREKPTTERANRVRENEVRRENESHAREMVAGEEVRYSKNTTRIRVQTHLIPIHVDTSQYESKKYLSTF

SEQ ID NO: 128474 - protein, 162 aa, Glycine max
  Coding DNA Sequence Number=SeqID_11696
MAIKVHKECDELRDINIATTEALEWETKRARKEEWGQNKSKRSLLEQLSRTKENMWAIIDQYKEKLNLAATHEQRLEDEYAKVSVLQVEREARERVIYSLHREVMMWMDRFAFTLNGSQELPRLLAKAKAMADVYSAPEEVHGLLDYCQHMINLMAHIIRNR

SEQ ID NO: 128475 - protein, 953 aa, Glycine max
  Coding DNA Sequence Number=SeqID_11697
  Gene Ontology: Mol. function=RNA-directed DNA polymerase activity; Cellular component=nucleus; Biological process=RNA-dependent DNA replication
MVTEAEYTDFSDMLEQTGLAEMDSQGDYFTWSNKHVEGTIYSIIDRVLANVSWFQNNLNVNLHIMPPNVSDHALLWLQHRDRVILKKSHFKFINGSVDLDGYNDAVSASWREPITSRPMFMVWEKLKRLPPVLRNLSKPLMHLKQNILQTRGNLQQAQLDLSIDLMNSTNIAKELEENVLRQKAKIDWLKLGDGNNSFFYATVKLRANAKGMNMLRKIDGTVCATQEDIENLVLEFYGELMGKKSTNLKHIDADAMRRGGQLSMEQRQLLVTPVSDQEILKALNGIGDLKSPSIDGYGAKFFKSSWDTIKDDINNALYDFFNNDRLLKAFNCTIVTLIPKHEKVVSVKDYRPIAGCTILYKIISKILTARLGKVLNSIVSPCQAAFVPGQQIHNHILLAYELIRGYARKNGTPRCMIQLDLQKAYDMVDWFALETILLETGIPKQFVKWIMLTVTSVTYRFNINGNYTKCMKANRGIRQGDPLSPVLFVIIMEYLNRLLHKMQRNPDFNHHSKCEKLNITNLAFADDVLLFARGDCRSVEMLMQTLNTFSETTGLVVNPSKCNIYFEGVDAPTKTDIMKLTGFKEGPLPFKYLGVPLTSKKLSISHYLSLVDRITGKINHWSNKLLSYAGRLQLIKSVTFSIANYWMQCFPLPKFVIHKINTVCRTFLWTGGVDKSRKSPVAWTNVCRPRKYGGLNVIHLQTWNHVTMMKLLWSLSEKADNLWVKWIHTYYLKNQSIMEIPQKTTQSWIMRSILNQRVHINNMQSDLGQRDRGKFSMKTLYLKMRCEGSNEVVWNRLFCGNPARPCTLMTLWQACHGRLPTKDRLLRFGMLGDKICCFCEGPESHDHLFFGCSVLGDVWKQVLEWIQVKHHPQEWNEELKWIIRHGKGKGHKASILKLEVTETVYGIWKYRNAKIFEETIDNTNIVDYIIDNIVYRGWYNNKLKSHIAHFMMF

SEQ ID NO: 128476 - protein, 91 aa, Glycine max
  Coding DNA Sequence Number=SeqID_11698
  Gene Ontology: Mol. function=protein serine/threonine kinase activity; Cellular component=cytoplasm; Biological process=protein amino acid phosphorylation
  Homolog annotation: Hit_ID=Q1SK93; Match level="QueryCoverage=73%, HitCoverage=16%, E-value=2e-22, Identity=71%"; Hit description=EPS15 homology (EH); Protein kinase
  Pfam annotation: Domain name=efhand; Domain location=30-58; Score =36.8; E_value=7.4e-08; Accession=PF00036.22; Description=EF hand
MEHLINLDLDVFVLSRMKQFRTMNKLKKAALKEMFKSMDIDNSGTITFEELKAGLPKLGTKVSESEVRQLMEANTVRIMVQGANLKNMTCN

SEQ ID NO: 128477 - protein, 364 aa, Glycine max
  Coding DNA Sequence Number=SeqID_11699
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=2e-33, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DRPSQWINLLLSHQGGPLGTSTLTFRGLHALAFRGLHVLAFRGLHALTFRRLHALTYRGLHVLAIRGLHALAFRGLHVLALRGPYVLAFRGLHVLNFRGLHALSFRGLHVLAFRGPHILAFRGLHALAFRGLHVLTFRGLHVLTFGRLHVLDFRRLHALTFRGLHVLAFRGLHALTFRGLHALTFRGLHDLALRTTRPHLPRATHPHLQRTTRPRLEDYTSSPSEGYTPSPLEDYTSSPSEGYMPSPSEDYMSSPSEDYTSSPFRGLNILTFRGLHALAFRGLHVLAFRGLHALAFRVLHVLAFRRLHALAFRGQHVLALKGLHALAMRGLHTLTFRVLHILAFRGLHALAFKELHVLAFYRTE

SEQ ID NO: 128478 - protein, 120 aa, Glycine max
  Coding DNA Sequence Number=SeqID_11700
  Homolog annotation: Hit_ID=Q8H6T6; Match level="QueryCoverage=39%, HitCoverage=37%, E-value=2e-13, Identity=88%"; Hit description=Auxin- regulated protein
MRPRTEPKQRVTTSSWYSVEVKANSCPKTYEARTPSPLPCSVSDMTPTLTPTRHRRPCICLHLVSHDVPKGYLVGLELRRFIICSRFCWKRLQRNLGLIRVVDSPFHVKLRPFELLREPS

SEQ ID NO: 128479 - protein, 95 aa, Glycine max
  Coding DNA Sequence Number=SeqID_11701
MKGKGKGFRKFREEEKRRERKEKKEKRSRGVAESQPRIIPYIAFLASLVPCATIDEAPQRRRLTTYARGQRITTPIAENVEHMDLAIDEVHEQPQ

SEQ ID NO: 128480 - protein, 77 aa, Glycine max
  Coding DNA Sequence Number=SeqID_11702
MKLVTPLAMTGLTDVAIGSSGTGLSRREEHVTPMGLAGHAEAMPPLVLAGHAYMDSPAIGTCGSPLKHVTLPLPMTV

SEQ ID NO: 128481 - protein, 259 aa, Glycine max
  Coding DNA Sequence Number=SeqID_11703
  Gene Ontology: Mol. function=asparagine-tRNA ligase activity; Cellular component=cytoplasm; Biological process=tRNA aminoacylation for protein translation
  Homolog annotation: Hit_ID=Q1SPB1; Match level="QueryCoverage=95%, HitCoverage=41%, E-value=1e-108, Identity=73%"; Hit description =Aspartyl-tRNA synthetase, class IIb; tRNA synthetase, class II
  Pfam annotation: Domain name=tRNA-synt_2; Domain location=1-258; Score=-138.9; E_value=2.8e-06; Accession=PF00152.11; Description =tRNA synthetases class II (D, K and N)
VARVRNALAYATHKFFQENGFVWVSSPIITASDCEGAGEQFCVTTLALSRRFGFILDSGVGGDLWPLGMLLFLAYGKTLIPSSHETTDSPVDAIPKTNDGLIDWSQVYTFGPTFRAENSNTSRHLAEFWMIEPELAFADLNDDMACATAYLQFVIRHVLDNCKEDMEFFDTWINKGIIDRLSDVADKDVVQITYTEAIDLLSGANKKFEFPVKWGSDLQSEHERYITEEAFSGCPVIIRDYPKACYFSPHLLDMAYGKH

SEQ ID NO: 128482 - protein, 150 aa, Glycine max
  Coding DNA Sequence Number=SeqID_11704
  Gene Ontology: Mol. function=protein binding; Cellular component =peroxisome
  Homolog annotation: Hit_ID=Q1SPB0; Match level="QueryCoverage=74%, HitCoverage=46%, E-value=6e-32, Identity=64%"; Hit description=Pex19 protein
MADSSQDLDQLLDSALDDFQSFNLNPPPPSGEATANSKKESPSLPSGVQGLGMGLPDLRTKKKGKQKASKDSHVSEALNKLREQTKEAVKGLESISPPTADDLGKDALMEDWVKQFEQLAGSQGEKRVGEGIMKMENLTINSWYSEVVRL

SEQ ID NO: 128483 - protein, 245 aa, Glycine max
  Coding DNA Sequence Number=SeqID_11705
  Homolog annotation: Hit_ID=Q1SPB1; Match level="QueryCoverage=31%, HitCoverage=15%, E-value=2e-19, Identity=57%"; Hit description =Aspartyl-tRNA synthetase, class IIb; tRNA synthetase, class II
MDSSDSDFEEMLEWELNEDFINDDHPYLPSFHPNTSSAANVEQKEGKRKRKSKVNEASSSANVEQTVMLEMQMSKVRVMTELIRTSTKKQMAVSIGVGATKAISMAIAARHLGTKPYAAAATTTALALLSLHKPLFLPHSSPFSSRRAFCAATLRTADNRVQQFRRKLRVSEIKEGDGADVFGRNLVVQGWINDGSCLSNMQCVLNSEAEGYDQVESGLVTTGASVWVQGVVVKSQGSKQKVELK

SEQ ID NO: 128484 - protein, 181 aa, Glycine max
  Coding DNA Sequence Number=SeqID_11706
  Gene Ontology: Mol. function=protein binding; Biological process=two -component signal transduction system (phosphorelay)
  Homolog annotation: Hit_ID=Q1SH09; Match level="QueryCoverage=99%, HitCoverage=57%, E-value=7e-62, Identity=40%"; Hit description =Leucine-rich repeat; Leucine-rich repeat, ribonuclease inhibitor subtype; Leucine-rich ...
  Homolog annotation: Hit description=repeat, cysteine-containing subtype
  Pfam annotation: Domain name=LRR_1; Domain location=112-134; Score =9.8; E_value=4.2; Accession=PF00560.23; Description=Leucine Rich Repeat
  Pfam annotation: Domain name=LRR_1; Domain location=136-158; Score =13.0; E_value=1.1; Accession=PF00560.23; Description=Leucine Rich Repeat
  Pfam annotation: Domain name=LRR_1; Domain location=33-55; Score =13.1; E_value=1; Accession=PF00560.23; Description=Leucine Rich Repeat
  Pfam annotation: Domain name=LRR_1; Domain location=57-79; Score=7.5; E_value=11; Accession=PF00560.23; Description=Leucine Rich Repeat
  Pfam annotation: Domain name=LRR_1; Domain location=8-31; Score=6.1; E_value=21; Accession=PF00560.23; Description=Leucine Rich Repeat
  Pfam annotation: Domain name=LRR_1; Domain location=81-103; Score =3.8; E_value=55; Accession=PF00560.23; Description=Leucine Rich Repeat
  Pfam module annotation: Pfam domain module=LRR_1::LRR_1::LRR_1::LRR _1::LRR_1::LRR_1; Domain location=112-134::136-158::33-55::57-79::8 -31::81-103
MELIGLKKLEYLNIGCCKCVTDSDIKSISELINLKELQISNSSITDIGITYLRGLEKLTTLNVEGCNITAACLEFIHALTSLACLNLNRCGLSDDGFEKISACTSFPAGLKNLKRLSLAFNRITDACLVHLKDLTNLEYLNLDSCRIGDGGLANLTGLTLLKSLVLSDTDIGNSGLRYISG

SEQ ID NO: 128485 - protein, 116 aa, Glycine max
  Coding DNA Sequence Number=SeqID_11707
MNNRKGPAGASTNDRSKLCALWTNFSMSVVLDGEDVGIDECIGDDMLNEIDKFHNSDEDIETQGPTQGLGGPMTRARVKKPKETLKQVVATILEVALAVKDIEPKLFQCMIVIKDP

SEQ ID NO: 128486 - protein, 90 aa, Glycine max
  Coding DNA Sequence Number=SeqID_11708
MCFIYGGKSKDVPENIIGELIDIEQWQLESDLKKTVSTPRNERGNTLTCNLWGAFAIQLKTYMDMNQKESGPVVILLQLAKIKVAKGLLP

SEQ ID NO: 128487 - protein, 284 aa, Glycine max
  Coding DNA Sequence Number=SeqID_11709
  Gene Ontology: Cellular component=integral to membrane; Biological process=protein transport
  Homolog annotation: Hit_ID=Q9ZTX0; Match level="QueryCoverage=88%, HitCoverage=76%, E-value=7e-68, Identity=52%"; Hit description =Similarity to SCAMP37
  Pfam annotation: Domain name=SCAMP; Domain location=148-281; Score =167.2; E_value=4.2e-47; Accession=PF04144.4; Description=SCAMP family
MAHRYDSNPFDEEEVNPFSEPAVRGKTSSQSSYSGGAFYTTVMAIAHKCISEQPCFFNLSDLTCTGDVVRKNPGSVAPATNSRLSPLNPEPADYNYGFGATVDIRLDPSMDLKKKEKELQAKENELRKREQEVRRKEEAAARAGIVLEEKNWPPFFPIIHHDIANEIPIHLQRLQYVAFTSLLGVKIWFLAIIYFIAGIPGAYVLWYRPLYRAFRTDSALNFGWFFLFYLLHLGFCILAAVAPPIVFKGKSLTYVNFIYVHFINMTILLNPFCLHAALPVKYED

SEQ ID NO: 128488 - protein, 74 aa, Glycine max
  Coding DNA Sequence Number=SeqID_11710
MAGHALSRDILVQALCGVDHKDLKQLFHVSKMIREVTMMAKEHFDICTPKTFAFLNPFCSGANGFKEIETPKVN

SEQ ID NO: 128489 - protein, 458 aa, Glycine max
  Coding DNA Sequence Number=SeqID_11711
  Gene Ontology: Mol. function=DNA binding; Cellular component=nucleus
  Homolog annotation: Hit_ID=Q84YJ6; Match level="QueryCoverage=74%, HitCoverage=50%, E-value=5e-13, Identity=23%"; Hit description=DNA -binding protein family-like
  Pfam annotation: Domain name=Bromodomain; Domain location=250-339; Score=44.8; E_value=2.9e-10; Accession=PF00439.15; Description =Bromodomain
MKENYLVCKAKYEDLQKRYSGNKAWFEELRKTRVAELKRALEVSEDSIGSLESKLESLKAGKNEKKDDRYVDKGSARPKLHVASQKLERVESSTKETSKDGLSAGSFTHETRTNWSPECPVPARSVEDMETKPEVSHSTEQAKVLNVDNRAHTIYEGQGGSLKKRRGKRKRKDCGRNMKEASVGESDLLDSADIVSWCKESSTSNCGEVAKSCGVDDQNRNLKKDRVEDMMEILDFIFETKGAPAFRRRLDSQLVSEFFHHNAFDDRSISFLDADALDLKRGRYKKMIRQHMDFDTIRSRISSQTIKSSVELFRDLLLLTNNALVFYSKSTREYKTVLLLRGIVTKKMKETLKGTTSNKVTTQATNVPIKLPVHNPHVKPRSVRPGNRKIVAKAVGGNNSASGVSHGTKKPSKVESPSSVESLTVKKKGFGRPKKVGRGAAGQRPAMPMKGKKRVRTK

SEQ ID NO: 128490 - protein, 93 aa, Glycine max
  Coding DNA Sequence Number=SeqID_11712
MDPATAERLSQIDQEIQNIDTEKAQRQQTLAAFWEHLPPIDPALVAAAMQRILDRIRGLEERRRALLQEQRDLILCGWFVYVCLRSTPDAYWR

SEQ ID NO: 128491 - protein, 289 aa, Glycine max
  Coding DNA Sequence Number=SeqID_11713
  Gene Ontology: Cellular component=chloroplast thylakoid membrane
  Homolog annotation: Hit_ID=Q9FF91; Match level="QueryCoverage=65%, HitCoverage=19%, E-value=9e-31, Identity=38%"; Hit description =Arabidopsis thaliana genomic DNA, chromosome 5, P1 clone:MRO11
  Pfam annotation: Domain name=SLH; Domain location=164-221; Score =11.6; E_value=0.03; Accession=PF00395.10; Description=S-layer homology domain
  Subcellular localization annotation: CTP_CleavageSite=40; ConfidenceScore=5.05e-01
MPLWDSALRSLLFSPSLLPQGKVGVAVYGVGFIFRFPRPMWSAVETRHDQNDAREFDVSGGSKSTLSEADTEDNNVAVTQTDKSVVVEKPKRVVIPVCVDSTQEEALSVLKSLKIIEDDVEANELCTRREFARWLVKLNSSLERNPKHRIAPIVSLSGSVFTAFDDISIDDPDFRSIQVLAEAGVIPSKLSWNNSFDYGGFDTQQNINFFPDRFISRQDLIDWRAQLEYDFFSGVVDQISIKKAGYMDVKEIISSAVYVDMLAGDKSILRKVFGIFSQASPQCIDVYFV

SEQ ID NO: 128492 - protein, 82 aa, Glycine max
  Coding DNA Sequence Number=SeqID_11714
  Gene Ontology: Mol. function=microtubule-severing ATPase activity; Cellular component=cytoskeleton; Biological process=cell division
  Homolog annotation: Hit_ID=Q5ZCG1; Match level="QueryCoverage=89%, HitCoverage=8%, E-value=2e-24, Identity=67%"; Hit description =Katanin p80 (WD40-containing) subunit B 1-like protein
MPNTSTSVATGVRSIAFHPDGRTLFTGHEDGLKVYSWEPVICHDTVDMGWTTLGDLCIHDEKLLGCSFYRNSVGVWVADISI

SEQ ID NO: 128493 - protein, 756 aa, Glycine max
  Coding DNA Sequence Number=SeqID_11715
  Homolog annotation: Hit_ID=Q9LI74; Match level="QueryCoverage=99%, HitCoverage=76%, E-value=0.0, Identity=53%"; Hit description =Similarity to pherophorin
  Pfam annotation: Domain name=Tup_N; Domain location=70-132; Score= -10.8; E_value=0.038; Accession=PF08581.1; Description=Tup N-terminal
MIVRLGLIVAASLAAFTVKQLNVKSSKPEHKDEGSEEEHVTRVTDLLQENEGEEEEEKEEVKLISSIINRANDFEDDILPEFEDLLSGEIEFPIPPDKDEKDKVYEIEMAHNATELERLRQLVKELEEREVKLEGELLEYYGLKEQESDIVELQRQLKIKTVEIDMLNITINSLQAERKKLQEELTQGASAKRELEVARNKIKELQRQIQLEANQTKGQLLLLKQQVSTLLVKEEEAARKDAEVQKKLKAVNDLEVTVVELKRKNKELQHEKRELMVKLNAAESRAAELSNMTESEMVAKAKEEVSNLRHANEDLLKQVEGLQMNRFSEVEELVYLRWVNACLRYELRNNQTPQGKVSARDLSKSLSPKSQEKAKQLMLEYAGSERGQGDTDLESNFSHPSSPGSEDFDNASIDSSTSKYSSLSKKTSLIQKFKKWGKSKDDSSALSSPARSFSGGSPRRMSVSVKQRGPLESLMLRNAGDSVSITSFGLRDQEPIDSPETPTDMRRVPSSDSLNSVASSFQLMSKSVDGALDEKYPVYKDRHKLALAREKQLKEKAEKARVLRFGDNSGLNMTKPERGSTISLPPKLTQIKEKPVVSGTPNEQSDDGKNVDNQSISKMKLAHIEKRPTRVPRPPPKPSGGGAAAAVTTNANPSNEVPSAPPPPPPPPGAPPPPPPPGGPPPPPPPPGSLSRGGMDGDKVHRAPQLVEFYQTLMKREAKKDTSSSLLVTSASNASDARSNMIGEIENRSSFLLAVC

SEQ ID NO: 128494 - protein, 118 aa, Glycine max
  Coding DNA Sequence Number=SeqID_11716
MVREHNINSGWPPIGAPLLNVQRDEYDQHWSSFDSSVNAVSFGFVATAILVSMFLVMAIFERFLKPTSPPILPSGGRNRRRSSQMDFNGKLGHPSPKIHDNVKAFFFAFGLVLQVSCC

SEQ ID NO: 128495 - protein, 260 aa, Glycine max
  Coding DNA Sequence Number=SeqID_11717
  Subcellular localization annotation: CTP_CleavageSite=24; ConfidenceScore=5.06e-01
MGCCVSSTNRSHSSPSSKPIDRPRSTAKGSENRAPPPEEETVKEVLSETPKWKPKFEAEKPTESDAENEKEKLFVKPDEISEVSEVCSVSESLSTLAEEEARQRVNRSPAKVRKARSFSGEFGCRREMTAGKSPARRPEQSPGRRNIGSVRVVQMANGGTGSQPRRRDSGENSGRRSRSPGTRTDSVSTRSIVGRSPSKRRTPMNQSPARVRSCAAESGGRKMENSSMEGVSYYWRERVVGPYFYLHCNMAFWIVEYVNG

SEQ ID NO: 128496 - protein, 130 aa, Glycine max
  Coding DNA Sequence Number=SeqID_11718
MPVSSLPNILDINRVEVSGVHVRVHASWVAVLMESLIKLCKQEAIQNLGLLQRWLPLLLLLVTNPQRFRTQRRRKRRDSSVGEDGNPKRKVGIGLDVSDQKWSQKNNNKKKKKMKKKKNTDSTVRNEKGE

SEQ ID NO: 128497 - protein, 90 aa, Glycine max
  Coding DNA Sequence Number=SeqID_11719
MGLLERLEWVNTYGKKRCRSLFWRVRAALKRAFKNGGKQRLKFQYDPSSYALNFDDGCCAAKKFIGDARLMELTDIHNNTLVYVLWIKTN

SEQ ID NO: 128498 - protein, 373 aa, Glycine max
  Coding DNA Sequence Number=SeqID_11720
  Gene Ontology: Mol. function=protein binding; Cellular component =actin cytoskeleton; Biological process=cytoskeleton organization and biogenesis
  Homolog annotation: Hit_ID=Q6PFL3; Match level="QueryCoverage=67%, HitCoverage=50%, E-value=1e-14, Identity=26%"; Hit description=Kelch- like 20
  Pfam annotation: Domain name=Kelch_1; Domain location=133-184; Score =56.5; E_value=9e-14; Accession=PF01344.15; Description=Kelch motif
  Pfam annotation: Domain name=Kelch_1; Domain location=186-241; Score =28.4; E_value=2.5e-05; Accession=PF01344.15; Description=Kelch motif
  Pfam annotation: Domain name=Kelch_1; Domain location=305-356; Score =9.4; E_value=0.33; Accession=PF01344.15; Description=Kelch motif
  Pfam annotation: Domain name=Kelch_1; Domain location=68-131; Score =25.7; E_value=0.00017; Accession=PF01344.15; Description=Kelch motif
  Pfam annotation: Domain name=Kelch_2; Domain location=133-184; Score =22.9; E_value=0.0012; Accession=PF07646.5; Description=Kelch motif
  Pfam annotation: Domain name=Kelch_2; Domain location=186-241; Score =3.0; E_value=15; Accession=PF07646.5; Description=Kelch motif
  Pfam annotation: Domain name=Kelch_2; Domain location=68-131; Score =8.3; E_value=3.1; Accession=PF07646.5; Description=Kelch motif
  Pfam module annotation: Pfam domain module=Kelch_1::Kelch_1::Kelch _1::Kelch_1::Kelch_2::Kelch_2::Kelch_2; Domain location=133-184::186 -241::305-356::68-131::133-184::186-241::68-131
  Subcellular localization annotation: CTP_CleavageSite=20; ConfidenceScore=5.07e-01
MGSLPSPPRPTAPPSPENLLSNHVVVAVFCPREPTPGVSLPNSIELYYPSMNTWTYVGTIPGLIDDQILKGFAIVSLGDFIYIIGGQICHKEMVHVSDECADYVDEGIKVVATVLRYNIRTNQWFNCAPLGVARYDFACTVCDNKIYVAGGKSTLSCAGPARGISSAEVYDPENDKWIPLPNLHILRYKCIGVTWQGKVYIVGGFAEREDSDKTMPSIVERSSAEVYDTQAGKWDMIAGMWQLDVPPNQIVAVNGTLLSSGDCLNAWKGHIEAYDGKLWNEVDGSHKRNLSTLEDNYENWPPNDQRLYLTMAPIGTRLFFLAGYRIGGELPRTMSVVHMFDTSATRDAWRSFEPMELEGEKELCGHCCVVQLS

SEQ ID NO: 128499 - protein, 734 aa, Glycine max
  Coding DNA Sequence Number=SeqID_11721
  Gene Ontology: Mol. function=protein-tyrosine kinase activity; Cellular component=integral to membrane; Biological process=protein amino acid phosphorylation
  Homolog annotation: Hit_ID=Q6R2K3; Match level="QueryCoverage=96%, HitCoverage=94%, E-value=1e-123, Identity=37%"; Hit description =Strubbelig receptor family 3
  Pfam annotation: Domain name=LRRNT_2; Domain location=27-67; Score =15.7; E_value=0.02; Accession=PF08263.3; Description=Leucine rich repeat N-terminal domain
  Pfam annotation: Domain name=LRR_1; Domain location=115-137; Score =14.9; E_value=0.29; Accession=PF00560.23; Description=Leucine Rich Repeat
  Pfam annotation: Domain name=LRR_1; Domain location=139-161; Score =15.6; E_value=0.18; Accession=PF00560.23; Description=Leucine Rich Repeat
  Pfam annotation: Domain name=LRR_1; Domain location=163-182; Score =13.4; E_value=0.83; Accession=PF00560.23; Description=Leucine Rich Repeat
  Pfam annotation: Domain name=LRR_1; Domain location=70-89; Score=0.8; E_value=2e+02; Accession=PF00560.23; Description=Leucine Rich Repeat
  Pfam annotation: Domain name=LRR_1; Domain location=93-112; Score =13.7; E_value=0.67; Accession=PF00560.23; Description=Leucine Rich Repeat
  Pfam annotation: Domain name=Pkinase; Domain location=414-730; Score =34.9; E_value=1.2e-10; Accession=PF00069.15; Description=Protein kinase domain
  Pfam annotation: Domain name=Pkinase_Tyr; Domain location=414-730; Score=59.5; E_value=4e-16; Accession=PF07714.7; Description=Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=27-67::115 -137::139-161::163-182::70-89::93-112::414-730::414-730
MKLELHVGIFVTCMVILSGTFCVGDTDMVDVAAINSLYVSLGSPPLQGWKPVGGDPCLELWQGVACVFSNITAIHLGGMNLGGQLGSNLNFPSVIELDLSNNHIEGPIPFTLPPTLRTLSLSANRLNGSIPDALSLLTQLSNLDLSNNNLSGQLPSSTGSLSSLTTLNIENNLFSGPIPPKLLTIPNFSKNGNPFNTTIIPSPPAAAPAPVAIGSSPQESPWKMAHGPSALTAPVPASTRKSVIAKSVIWIAGAGLLVFIVLGVCLVMLRCIKRRPEKKNAKKLDDVGVFAGPLNKPTCSDSDVETANQEEKGKCEVPNRSTNFIPKVQEEQDIYVKVVSATSEGNNGHESINTGGASKLSSLQPPPQHFLPTSPGEKVIINPAITTQVTERQVMSNSIRVYTVALLQQYTNSFSQENCIGEGTLGPVYRAELPDGKLIICQLISCNRNTSVLPFCLAEAWVFLREEELVCVVQFLPLLAVRKLDATASMGQSHEQFLQLVSSISKIQHANIARLVGYCAEHNQRLLVYEYCSNGTLHDALHGDGNHRIRLPWNARIQVALGAARALEYLHESFRPSIVHRNFRSANVLLSDNLEVCISDCGLGPLLSSGSTGQLSGRLLTAYGYSAPEFESGSYTQQSDVFSFGVVMLELLTGRKSYDKSLPRGEQFLVRWAVPQLHDIDALSKMVDPCLNGAYPMKSLSRFADIVSSCIQAKREPEFRPAMSEIVQDLLRMM

SEQ ID NO: 128500 - protein, 58 aa, Glycine max
  Coding DNA Sequence Number=SeqID_11722
MGQENKTLKSFAFIFLIDLLDIKRVGSQLSLSGAVSSRFLTLWTNGRSHNMIARVQKR

SEQ ID NO: 128501 - protein, 142 aa, Glycine max
  Coding DNA Sequence Number=SeqID_11723
MTSTHSIEKLGEFVGTLIKGTKPYLGRIGVLVENAHNSVQIDAELIVVGDVSVVAQEIRKASPQKQNLRWQISKSKSDEVFNPIPKRERGRREARVREESAEVSEKVREATFLRNVVLCSEEERERGKVRERKDKVVRESWM

SEQ ID NO: 128502 - protein, 156 aa, Glycine max
  Coding DNA Sequence Number=SeqID_11724
MLQSSPEDFSLKNNSPGEAGLHDNFLLQNGNYVLECKHENQGPSSQIFSSPNALAGGFRDSSMVESDENCFTEMTEVSNCELPAYIADRRFPVPEAISSCAAVCGDNLNLTPWKRENDSQIKHIGYDAQSECMKNLYWVIIRQRHWQLVHSLKILL

SEQ ID NO: 128503 - protein, 253 aa, Glycine max
  Coding DNA Sequence Number=SeqID_11725
  Gene Ontology: Mol. function=protein binding; Cellular component =nucleus
  Homolog annotation: Hit_ID=Q7XZU8; Match level="QueryCoverage=60%, HitCoverage=58%, E-value=2e-44, Identity=59%"; Hit description=PG4
  Pfam annotation: Domain name=LisH; Domain location=118-144; Score =41.9; E_value=2.2e-09; Accession=PF08513.1; Description=LisH
MGTSYINVIMQKPMCLYVKIENWVQLRPGRKRSGSELNEENRSKYLYITLKQNSRSNLEERDRRRHPPKTEIHPLTTTFPENNHRPQFLGIYFAAASKKLITREEWEKKLSDVKIRKEDMNKLVMNFLVTEGYVEAAEKFRMESGTERILFINLFIYLFIFGSMSARDSDIDLATITDRMAVKKAVQSGNVEDAIEKVNDLNPEILDTNPQLFFHLQQQRLIELIRNGKVEEALEFAQEELAPRGEENVNLIK

SEQ ID NO: 128504 - protein, 56 aa, Glycine max
  Coding DNA Sequence Number=SeqID_11726
EGLFLYGCRQRNWRHRCPAIADGEKHAELEGAASGTSEIHHAGMPPMQMTLCSELL

SEQ ID NO: 128505 - protein, 151 aa, Glycine max
  Coding DNA Sequence Number=SeqID_11727
  Gene Ontology: Mol. function=protein binding; Cellular component =spliceosome; Biological process=mRNA processing
  Homolog annotation: Hit_ID=Q6K5F4; Match level="QueryCoverage=62%, HitCoverage=31%, E-value=1e-23, Identity=56%"; Hit description=2 coiled coil domains of eukaryotic origin (31.3 kD)-like protein
LLDAGELLGNPKVAVSRATLAQVRDINDDSIEICYLRGVLQVIWPVKLHDAAFPVRLFANDLVDLVIEIAEAVLVETSVLDLSYFSVDLSHDCRPPRASTRPSPHYEPSFKKETLMTRCSRKATSCAIVGSAVVTVFVEEEKERDDVTMMC

SEQ ID NO: 128506 - protein, 277 aa, Glycine max
  Coding DNA Sequence Number=SeqID_11728
  Gene Ontology: Mol. function=protein binding; Cellular component =nucleus; Biological process=carbohydrate metabolic process
  Homolog annotation: Hit_ID=Q6Z6T3; Match level="QueryCoverage=92%, HitCoverage=81%, E-value=5e-96, Identity=68%"; Hit description =Nuclear protein-like
  Pfam annotation: Domain name=DUF572; Domain location=11-269; Score =83.6; E_value=6.1e-22; Accession=PF04502.3; Description=Family of unknown function (DUF572)
MGKTHVIISLYDSSKMPKLMFEMPFNIWCGGCNSMIAKGVRFNAEKKQVGNYYSTKIWSFTMKSACCKQEIVIQTDPKNCEYVIISGAQKKTEDFDIEDAETFELPADEEKGKLADPFYRLEHQEEDLKKKKEAEPVIVRLQRQSDARHSDDYSLNKTLRAQLRGQKKRVAQEENASKKRGLGIRLLPATEQDSATAKSVKFPAKFERNRKDKRALINSESIFSGVSSYSISDKRKQELESKRRKICATSASNLLAGRVKPSSWSQSSTKQKGTMRR

SEQ ID NO: 128507 - protein, 527 aa, Glycine max
  Coding DNA Sequence Number=SeqID_11729
  Gene Ontology: Mol. function=nucleic acid binding; Cellular component= nucleus; Biological process=RNA processing
  Homolog annotation: Hit_ID=Q5ZCG4; Match level="QueryCoverage=94%, HitCoverage=38%, E-value=1e-167, Identity=61%"; Hit description =Putative ATPase
  Pfam annotation: Domain name=Helicase_C; Domain location=390-468; Score=77.5; E_value=4.3e-20; Accession=PF00271.21; Description =Helicase conserved C-terminal domain
  Pfam annotation: Domain name=SNF2_N; Domain location=1-173; Score= -89.7; E_value=0.0026; Accession=PF00176.13; Description=SNF2 family N-terminal domain
  Pfam annotation: Domain name=zf-C3HC4; Domain location=211-251; Score= 10.8; E_value=0.012; Accession=PF00097.15; Description=Zinc finger, C3HC4 type (RING finger)
  Pfam module annotation: Pfam domain module=Helicase_C::SNF2_N::zf -C3HC4; Domain location=390-468::1-173::211-251
AWFRVVLDEAQSIKNHRTQVARACWGLRAKRRWCLSGTPIQNAIDDLYSYFRFLRYDPYAVYTSFCSTIKIPISRSPSKGYRKLQAVLKTIMLRRTKGSLLDGEPIISLPPKSVELKKVEFSQEERDFYSKLEADSRAQFQEYADAGTVKQNYVNILLMLLRLRQACDHPLLVKRYNSNSLWKSSVEMAKNLPQEKRLSLLKCLEASLALCGICNDPPEYAVVSVCGHVFCNQCICEHLTGDDNQCPATNCTTRLSMSSVFSKVTLNSSFSEQAGDNLPDYSGCEVEESEFFSQAQPCNSSKIKAALEVLQLLSKPQCCASQNNSVQSTSGESTDGLGSSSSADRMKSLNEIPESQNVFEERSSNNSVGVGEKAIVFSQWTRMLDLLEACLKNSSIQYRRLDGTMSVTARDKAVKDFNTLPEVSVMIMSLKAASLGLNMVAACHVLMLDLWWNPTTEDQAIDRAHRIGQTRPVTVLRLTVRDTVEDRILALQGQFNEQNFLEGDRNTAELSMDNCTYKCIDYNEFTK

SEQ ID NO: 128508 - protein, 57 aa, Glycine max
  Coding DNA Sequence Number=SeqID_11730
MSKTQSSYGLLHFNPRTNEWVPWTWQSITANWVYEKVDTTVSVSVIADWVRVLVDTG

SEQ ID NO: 128509 - protein, 59 aa, Glycine max
  Coding DNA Sequence Number=SeqID_11731
MLMCFSHQECVPLESPQQLISEPMVQVGDRLRRVCKYRRWPEWLAVQRAPQVERGSQNG

SEQ ID NO: 128510 - protein, 362 aa, Glycine max
  Coding DNA Sequence Number=SeqID_11732
  Gene Ontology: Mol. function=transferase activity
  Homolog annotation: Hit_ID=Q9FMD0; Match level="QueryCoverage=88%, HitCoverage=54%, E-value=3e-26, Identity=29%"; Hit description =Genomic DNA, chromosome 5, P1 clone:MUK11
MYNQVAGRQLLNKLCTQVKQLEHNTIMDLITRPSPVLFDAIKSGNVEAVEILIDKNREFVRIKDPQNGRNLLHLVVLFRQESIFESIPNTLKENLGRAADNEGNNILHLAAHLPVDFKESSSLRASIQMQRDLEWFKFVELQVPLELSRMRNNMGKRPIDVFYEEHKKLSEEIKDAGKGISESGMLVAALVATVAFAAALTVPGDKTNPWFTVPGDKSNAWFTVFILANAVALFTSSASILSFLSNFTSSRFAQSEFVKSQHPSLTFGRALLFISVFAMVVAFTAASFLIFDHKSKWVAYLVASMAVFPILVFFLFQIRFLDDHLWSRWYRLCDDDFMWYFRTLHRQLRSFRDAISEVAQVA

SEQ ID NO: 128511 - protein, 283 aa, Glycine max
  Coding DNA Sequence Number=SeqID_11733
  Gene Ontology: Mol. function=sequence-specific DNA binding; Cellular component=nucleus; Biological process=regulation of transcription, DNA-dependent
  Homolog annotation: Hit_ID=Q1PFA4; Match level="QueryCoverage=97%, HitCoverage=79%, E-value=6e-46, Identity=37%"; Hit description=MADS -box family protein
MDCNRKLETLEALKKTFKKLDHDVNVQEFMGTSSQTIEDLSNQARLLQTQISETHKRLSHWTEFDKISNVDQLGQMENSLRESLNQIRTRKENIKKQQQLMSLQCNNQFNEMNIPFRMSVEQQLQPLSWIANDDNHNIVLPEDSNMFLHKDVEGSTSSSFGSHVSYLGSSIKNDMSNSAQENGVLSDMSNTAPMRLQLNGHFPYLPYNFNLPNNLKFQPTAEINPYENPVDYHVNGGFEAPRSGYDSNNHHDWASTSGPCGVTMFDEQLYAQASSTKMNFGFI

SEQ ID NO: 128512 - protein, 99 aa, Glycine max
  Coding DNA Sequence Number=SeqID_11734
MDGTYCTWLKIEHIARAVDNEGNNVLHLAVHLPLEFKALSSFRATIQMQRELAWFKKVEMDDPRELRTMRNHMGKTLIDAFYDEHKKLSEEIKEMQPKE

SEQ ID NO: 128513 - protein, 190 aa, Glycine max
  Coding DNA Sequence Number=SeqID_11735
  Pfam annotation: Domain name=Ank; Domain location=108-142; Score =17.3; E_value=0.056; Accession=PF00023.20; Description=Ankyrin repeat
  Pfam annotation: Domain name=Ank; Domain location=143-175; Score=8.7; E_value=1.7; Accession=PF00023.20; Description=Ankyrin repeat
  Pfam module annotation: Pfam domain module=Ank::Ank; Domain location =108-142::143-175
MVVEVLGQGLFNYLVVNLVLNENLLMVFGSGENMQNNMGIGFWGGGMGVVGSQEREKRLDKLQLLLMGRIAGSLKEDLTRHIWWDKWLESKSIIDKCPDMVRIPLNDRGDTALHVAVSQWSLETVKELVQRMSPEDMLIPNLDGMLPVHLAALYGRNIMVQILSSQKVLDKMDSKHIELLFLMTIRFNMF

SEQ ID NO: 128514 - protein, 292 aa, Glycine max
  Coding DNA Sequence Number=SeqID_11736
  Gene Ontology: Mol. function=ligase activity, forming carbon-nitrogen bonds; Biological process=tRNA processing
  Homolog annotation: Hit_ID=Q5PD76; Match level="QueryCoverage=94%, HitCoverage=64%, E-value=1e-69, Identity=48%"; Hit description =tRNA(Ile)-lysidine synthase (EC 6.3.4.-) (tRNA(Ile)-lysidine synthetase) (tRNA(Ile)-2-lysyl-cytidine synthase)
  Pfam annotation: Domain name=ATP_bind_3; Domain location=1-54; Score=- 100.1; E_value=0.099; Accession=PF01171.11; Description=PP-loop family
  Pfam annotation: Domain name=DUF1946; Domain location=88-289; Score =279.2; E_value=8.2e-81; Accession=PF09179.1; Description=Domain of unkown function (DUF1946)
  Pfam module annotation: Pfam domain module=ATP_bind_3::DUF1946; Domain location=1-54::88-289
MPQQRQVNGHWHLRPLLNLSRQQLEAYAVGHQLDWIDDESNADRRYDRNFLRQEVLPLLQARWPHFSAASARSAALCGEQEQLLDELLSEQLAQLTDAQGALHFPPLLACSEARRHALLRRWIGERGGAMPARDALQRITDEVMHSREDAQPCLRFGAHELRRYRERLYWLPRQHSLSQHSLTWQPLTQPLILPDGLGELRASPAQAELRQPAADEQVIVRFQAHGYHHVVGRAGGREMKKLWQELGVPPWQRERIPLIYYNQTLIAAPGLFVTRAGAAGETQGWQAIWSTP

SEQ ID NO: 128515 - protein, 332 aa, Glycine max
  Coding DNA Sequence Number=SeqID_11737
  Homolog annotation: Hit_ID=Q6D1B9; Match level="QueryCoverage=28%, HitCoverage=16%, E-value=2e-37, Identity=80%"; Hit description =Prolyl-tRNA synthetase
  Pfam annotation: Domain name=RF-1; Domain location=107-216; Score =70.5; E_value=5.5e-18; Accession=PF00472.11; Description=Peptidyl -tRNA hydrolase domain
MAEAGDVVETQLARFTGERQRPVFGTGELEVVVVITVDGGNIIECFQCASDRVWHIPQGFAGNQPGGAGKVAKKGQKVTASTGLSQPGGAQKVISGYNRADNGRWQMIVLSRSVSIADNEVELSAIRAQGAGGQHVNKTSTAIHLRFDIHASSLPPFYKQRLLEANHHLISADGVVIIKAQEYRSQEMNREAALQRLINLIRELTTVEKQCEGAARQATLKKTPPAGGVRGLLVEGAAEEVDDVVLLDHLLLAGGAGFVLDLLVIQVAIANHDSVRYADQFHIGEHHARTLFTIVKNDIDAFGAQLVVQLFRQLFHAEGFVHVHRQNRHFER

SEQ ID NO: 128516 - protein, 80 aa, Glycine max
  Coding DNA Sequence Number=SeqID_11738
MLKSFSTRHVRRYMEKNEEMIMEEKMSYRMSRHHASEHADYMCPYEQIKQVNNTRELFTQFGATSPTSGGYQAREEIHSQ

SEQ ID NO: 128517 - protein, 164 aa, Glycine max
  Coding DNA Sequence Number=SeqID_11739
MRKAWSHRESETERKRRNQESLCGGERGGEGEWEMMDEIRDSRRRDWEGRRTRSFWERKDCTACLHCDCGVSSWACAFWPCRRSQGGVLSSIIYFTLVYGGIRKLNIVKLTPRITLHGPHSLHTPSTSSRTQIHLSTIEGRGRRRRPSRGCRKETQLLLRVLGK

SEQ ID NO: 128518 - protein, 704 aa, Glycine max
  Coding DNA Sequence Number=SeqID_11740
  Gene Ontology: Mol. function=binding; Cellular component=thylakoid; Biological process=photosynthesis
  Homolog annotation: Hit_ID=Q6K378; Match level="QueryCoverage=96%, HitCoverage=93%, E-value=1e-108, Identity=45%"; Hit description =Tetratricopeptide repeat protein-like
  Pfam annotation: Domain name=PB1; Domain location=270-347; Score =47.7; E_value=3.9e-11; Accession=PF00564.15; Description=PB1 domain
  Pfam annotation: Domain name=TPR_1; Domain location=110-143; Score =23.6; E_value=0.0007; Accession=PF00515.18; Description =Tetratricopeptide repeat
  Pfam annotation: Domain name=TPR_1; Domain location=36-69; Score =18.7; E_value=0.021; Accession=PF00515.18; Description =Tetratricopeptide repeat
  Pfam annotation: Domain name=TPR_1; Domain location=74-109; Score =6.6; E_value=0.87; Accession=PF00515.18; Description=Tetratricopeptid e repeat
  Pfam annotation: Domain name=TPR_2; Domain location=110-143; Score =21.8; E_value=0.0024; Accession=PF07719.7; Description =Tetratricopeptide repeat
  Pfam annotation: Domain name=TPR_2; Domain location=36-69; Score =23.3; E_value=0.00085; Accession=PF07719.7; Description =Tetratricopeptide repeat
  Pfam annotation: Domain name=TPR_2; Domain location=479-512; Score =3.4; E_value=13; Accession=PF07719.7; Description=Tetratricopeptide repeat
  Pfam annotation: Domain name=TPR_2; Domain location=74-109; Score =5.8; E_value=6.9; Accession=PF07719.7; Description=Tetratricopeptide repeat
  Pfam module annotation: Pfam domain module=PB1::TPR_1::TPR_1::TPR _1::TPR_2::TPR_2::TPR_2::TPR_2; Domain location=270-347::110-143::36 -69::74-109::110-143::36-69::479-512::74-109
MGKKKKQVGEIGEDGKVGDSSPRAYDNDTMVFISMSQELKNEGNKLFQKRDLEGSILKYEKALKLLPRNHIDVSYLRSNMAACYMQMGLSEFPRAIHECDLALQVTPKYSKALLKRARCYEALNRLDLALRDASTVVKMEPNNVMALEISEKVKNALEEKGLRVSNSVIELPPDYVEPPNALPPEKALKEKTRKKKSSKEEEKAPDGKIPEKQTEEKFEDKKAEGSIVVVEKKINTPKKKKAKVKVDEKKADIKEVIEERSNGRREPVPKKTAKLIFGDDIRYAELPINCSLFQLREVIHDRFPRLGAVLVKYRDQEGDLVTVTSDDELRWAETGSNGSIRLYIVEATPEQDPLFEKFKVKEAEVVGINIAHKSGCVGKAKEIVSSSCIEDWIIQFAKLFKNHVGFESDRYLDFHELGMNLCSEALEETVTSEEAQGLFDIAGDMFQEMTALALFNWGNVHMSRARKKVYVKEDSSKEHLCEQIKSSYEWALEEYAKAGEKYEAAIKIKSDFHEGFLALGLQQFEQAKLSWYHALGCNVDLLTWPSTEVLHLYNNAEENMEKGMQIWEESEKQNLSKTSSSNDVRLHLQNMGLDGLFKNISLDEFAAQEAHMRSQINLLWGTMLYERSFVEFKLGLPIWHESLEVAVEKFELAGASPTDIAVVLKNHCSNNTAVDGLAFKIDEIVQAWNEMYKAKMWQSGVPSF

SEQ ID NO: 128519 - protein, 311 aa, Glycine max
  Coding DNA Sequence Number=SeqID_11741
  Homolog annotation: Hit_ID=Q2QZ53; Match level="QueryCoverage=58%, HitCoverage=46%, E-value=4e-19, Identity=30%"; Hit description =Expressed protein
MAAECVLAAAVFRLAHAAPYPAVSRRFAISPPDACRAFFAVCKALADNLGHLFELRTDSERVVVGFGFSSLPNCFGVLGFTRFKIDDSLLGENGALIVQALVDSEGRFLDVSAGWPSTMKPEIFLRESKLYREVEQSKELLNGPSYNLSEGCLIPQYILGDSCFPLLPWLLTPYNRVNEEDSFGSAERAFNCVHGNAMELVGDAFGRLRARWRLLAASRKWKQECVEHLPFVVVACCLLHNFVVKFNEAMPDEGVSKWCVEKEKEKEEELPAFDGVGDESAVRVELEKMNGVNVGRTSGCLIGELVVWELL

SEQ ID NO: 128520 - protein, 53 aa, Glycine max
  Coding DNA Sequence Number=SeqID_11742
MVAGGGWEPSKEVSHLRPDRLLTMGEKEIQATRKTRGGTCKIKDFDAQIITNR

SEQ ID NO: 128521 - protein, 85 aa, Glycine max
  Coding DNA Sequence Number=SeqID_11743
MDELRERAKGYIQMDRDKQEGNTKANSHKLNKRHKPDKRQPLPKGPRYERYTPLTTNHTTILKKDFNLELLDGSLLEKLLWRLDL

SEQ ID NO: 128522 - protein, 130 aa, Glycine max
  Coding DNA Sequence Number=SeqID_11744
  Homolog annotation: Hit_ID=Q00M75; Match level="QueryCoverage=23%, HitCoverage=5%, E-value=2e-09, Identity=96%"; Hit description=PPR -repeat containing protein
MDEFGAAAPNTEDHKQFGHAFKEGVFDASQYAFFGKDVAEEVELRGLEDEDDYKAMPAAEFKEEDFLLNKEEAVDVRSLSDIDDLTTTFLKPYPCICEEAVSGFEPMTNKSPRHNFTAAPGLALSNSIVK

SEQ ID NO: 128523 - protein, 772 aa, Glycine max
  Coding DNA Sequence Number=SeqID_11745
  Homolog annotation: Hit_ID=Q9LHJ0; Match level="QueryCoverage=84%, HitCoverage=93%, E-value=1e-137, Identity=44%"; Hit description =Arabidopsis thaliana genomic DNA, chromosome 3, P1 clone: MMP21
MAVLFPFSLHALFPLTELFLILDFTDSSASEWSQRDDIPYWFDQHAYDPEGQGFQDGKRWSSHPHSSLTQLHDSRPLYRTSSYPEQQRQLQHQLQHCSSEPVSNWFDQHFNDSETTEDGKRWSSQPHSSIAHLQESKPLYRTSSYPDKRQELTRFSSEPILVPKSSFTSYPPPGGRSQQSSPNHSTGRLNIPFHAGGDHMALPSQNHSHLFNSALQLSGSKHESLFSGKVGQFTAGSHLNYQMQNPWVNQSGLYSGDHPNLLSNMLQQQLHHRSGSLSPHLLTQLQQQQHRLHHPILQSGSYMSGFQSHLINPQLSSGSSMVSKYEHMLGLADVREPRPKSTHKGKQSHRVFQQGSDASSQKNESGSLHFRSKYMTSDEIESILKMQLAVTHCNDPYVDDYYHLACLSKKTGAKLKKSFCPTQIKELPSRARSNTDSHGFLQVDALGRVSFLAIRRPHALLEVDPSNSGISERNISEKALEQEPLFAARVTIEDGLCLVLDVEDIDRFLQCNQLQDGGTQLRRRRKVLLEGLATSLQLVDPLGKNGHKVGFGAKDDVVFLRLVSIAKGRKLLAKYLQLLVPGSELMRIVCMAIFRHLRLLFGGLPSDPAAAETTSDLAKVVCQCVLGMDLGALGACLAAVVCSSEQPPLRPLGSTAGDGASRILVSVLERATELLTDPHGAGSYVGMENVSVIGSDAAKAISREMPVELLRASLPHTNDHQRKLLLDFGQRSVPVVGFNSYTGSSSGHVNSETVLIYLEQTEVEVQVASMVE

SEQ ID NO: 128524 - protein, 193 aa, Glycine max
  Coding DNA Sequence Number=SeqID_11746
MGHRHGQCILDKEKSQCIIERDRNQKCNLNNPLKCAKNKARETKQSLNGPKPTRLCALQSCEPRNNDQKGEQTRRQSTNRRSCLAWQKITYWRGVIRIQFMITEKVIKVVLVIEDNRKRCRKICWSAATGHQKNSQPRIGALDKGKNEGQKGQGLDTKMTASGKEVKPRNNRKCSRLAALQPRQYFHATTQSW

SEQ ID NO: 128525 - protein, 244 aa, Glycine max
  Coding DNA Sequence Number=SeqID_11747
  Homolog annotation: Hit_ID=Q1SH12; Match level="QueryCoverage=99%, HitCoverage=80%, E-value=9e-42, Identity=48%"; Hit description=C2; Sterile alpha motif homology
HRLEILKLVKKQEGGATARPNKKLSGVIKKCLRKCMNKFVSREDHHHHHAVKHVPCSMVPVSVPPPPPPPEISWYHQGKLKGSLVRKQQGSEELKEEEKEKPLPVPPMYRSRTIALSGPLEYGSRMHHEKMAQNRALKLSGPLDGRMHERMMMNSTNSRSPLMPRPLDARFVATTRSPRVSGPLDPRVMVENRSPRLTRPSNATRAETQSPMGYSPYNKPKADFDFDDDDHTLWPSLFQDLKPT

SEQ ID NO: 128526 - protein, 122 aa, Glycine max
  Coding DNA Sequence Number=SeqID_11748
  Gene Ontology: Mol. function=receptor activity
  Homolog annotation: Hit_ID=UPI00001971B2; Match level="QueryCoverage =92%, HitCoverage=16%, E-value=9e-30, Identity=50%"; Hit description =transferase, transferring glycosyl groups
MESQSQRDRRTDAVGDLRVLPDEILCSILEGLTPRDAARVACVIGVMYILYNEDPLWMSLCRKGASGSWKKTALHKRLYRCHTTLDAFFADIGNVERIKDISLFYNDYDAKKPVDKKEIKLT

SEQ ID NO: 128527 - protein, 111 aa, Glycine max
  Coding DNA Sequence Number=SeqID_11749
MVMLVVLEATMTMLEIPVMIAMTVIAEMVIIVIVMVAMFVVVVVIGAISDGNSDDNDNGSGNNVNGDSDNDMIMMITLLVSVARGDSSSIDNNDSVGGGHSGDNEIWNCQM

SEQ ID NO: 128528 - protein, 161 aa, Glycine max
  Coding DNA Sequence Number=SeqID_11750
  Gene Ontology: Mol. function=receptor activity; Cellular component =nucleus; Biological process=multicellular organismal development
  Homolog annotation: Hit_ID=UPI00001971B2; Match level="QueryCoverage =73%, HitCoverage=14%, E-value=3e-39, Identity=58%"; Hit description =transferase, transferring glycosyl groups
MELTNETNDEATDLKQKKKEEKNVQEEKEEGRKGEKREELERVMLAGLADTWPARRKWTTDKLLLNYGDVAFKISQKSSRKISIKFKDYVSDMKFGETAPSLLKDYCVPHLFQEDFFDILDTDKRPSYRWLIIGPERSGASWYVDPALTSAWNSLLCGRKR

SEQ ID NO: 128529 - protein, 378 aa, Glycine max
  Coding DNA Sequence Number=SeqID_11751
  Homolog annotation: Hit_ID=Q1SH13; Match level="QueryCoverage=99%, HitCoverage=66%, E-value=1e-131, Identity=62%"; Hit description =Nodulin-like
  Pfam annotation: Domain name=Nodulin-like; Domain location=11-258; Score=428.1; E_value=1.2e-125; Accession=PF06813.4; Description =Nodulin-like
MLRVKGGKRPPWVGLGAAVWVQIASGNGYCFPLYSHSLKSVLGFNQSQITLLGVANDIGENVGILPGLACNKFPPWLILFIGALFSFLGFGVLWLAITKTLDSLPFILLWFALAVGTNSCAWLSTAILVTNMRNFPVSRGTVAGILKGYSGLSAAVFTQIYSVVFHNSSSKFLLFLAIGIPALCFSTMFLVRPCTPASGEDSAEKGHFLFIQGASVAMGLYILATTILDNFIHISDSVSYALLAVMILLLLAPLVIPTKMTLCPRKASNTETPEEHVGSSDFLVQDGKDNIEPLLSSSSASGLGSFNDVVDGSAEVAMLLAEGEGAVRKKRRPKRGEDFKFTEALVKADYWLLFFVYFVGVGTGVTVLNNLAQIGIAQ

SEQ ID NO: 128530 - protein, 120 aa, Glycine max
  Coding DNA Sequence Number=SeqID_11752
  Homolog annotation: Hit_ID=Q1SPQ1; Match level="QueryCoverage=42%, HitCoverage=9%, E-value=8e-08, Identity=50%"; Hit description =Polynucleotidyl transferase, Ribonuclease H fold
MNEGEPLGKLANLGKWEQESNDGWVVKGVGFELGGTDERGVNGEKGSKLDLVLILLENHAIADKKLSVRVYAKLVKRGSQPSQSGLKAQMPCRESGMELLKEGSTKLENLRNKKTIMKIK

SEQ ID NO: 128531 - protein, 74 aa, Glycine max
  Coding DNA Sequence Number=SeqID_11753
MGNKDETWRNGGRLGCCCDAHGGGDKSLHGLVGFGRGGPLGSWSYDRKHGHDGIHGLNNKLIRQKIEGIIHNLG

SEQ ID NO: 128532 - protein, 79 aa, Glycine max
  Coding DNA Sequence Number=SeqID_11754
MKLHIYQDVCQVHDLHVILHVDVDNSDDSLVDVGSGGDEVDIHLLNQLDSNNENDLNDIKSEIEYFSQPKTDNENDKFS

SEQ ID NO: 128533 - protein, 83 aa, Glycine max
  Coding DNA Sequence Number=SeqID_11755
MEAMTCSKGGVWFACGKRQGEDEEEVEVSASTCWVTSNRACPAVQPCPVTVEAPDTASHRSRIRIRVQCESDVGHDRILGYPT

SEQ ID NO: 128534 - protein, 68 aa, Glycine max
  Coding DNA Sequence Number=SeqID_11756
MAIDFKMKSNMVSKQVLILGPRLRFRCDEHLPSVVHAPSPISAGREGEGKIHIGSYVALGIEAPVRDS

SEQ ID NO: 128535 - protein, 180 aa, Glycine max
  Coding DNA Sequence Number=SeqID_11757
  Gene Ontology: Mol. function=serine carboxypeptidase activity; Cellular component=cellulose and pectin-containing cell wall; Biological process=proteolysis
  Homolog annotation: Hit_ID=O04084; Match level="QueryCoverage=90%, HitCoverage=34%, E-value=4e-57, Identity=64%"; Hit description =Serine carboxypeptidase isolog; 30227-33069
  Pfam annotation: Domain name=Peptidase_S10; Domain location=50-179; Score=-67.3; E_value=1.3e-09; Accession=PF00450.12; Description =Serine carboxypeptidase
MDNIIYTLVLILFLSLKASSVSSRDRQWGGVRRKLSFGDHNNGDLVTNLPGQPPVDFQHYAGYVTVNETNGRALFYWFYEAMTKPQDKPLVLWLNGGPGCSSVGYGATQEIGPFLVDTDGKGLKFNNFSWNKEANILFLESPVGVGFSYSNTTSEYARLGDDFTGLNFDILVVYININCY

SEQ ID NO: 128536 - protein, 256 aa, Glycine max
  Coding DNA Sequence Number=SeqID_11758
  Gene Ontology: Mol. function=serine carboxypeptidase activity; Cellular component=cellulose and pectin-containing cell wall; Biological process=proteolysis
  Homolog annotation: Hit_ID=UPI000034F551; Match level="QueryCoverage =99%, HitCoverage=52%, E-value=1e-106, Identity=69%"; Hit description= SCPL31; catalytic/ serine carboxypeptidase
  Pfam annotation: Domain name=Peptidase_S10; Domain location=1-249; Score=88.7; E_value=1.8e-23; Accession=PF00450.12; Description =Serine carboxypeptidase
MLGNPETSDAEDWSGMVDYAWSHAVISDETYKTIKASCEFNSSDPWSNKDCTQGVDETLKQYNEIDIYSLYTSVCFASTARSNDQSKKMVMNRSSKMMPRIMGGYDPCLDNYAKTFYNRPDVQKALHASDGYNLRNWSICNENIFKGWAQSKPSVIPIYKKLISAGLRIWVYSGDTDGRVPVLSTRYSLSILGLPITKRWRPWYHEKEVSGWYQEYEGLTFATFRGAGHAVPCFKPSNSLAFFYSFLLGESPPSTK

SEQ ID NO: 128537 - protein, 204 aa, Glycine max
  Coding DNA Sequence Number=SeqID_11759
  Gene Ontology: Mol. function=hydrolase activity; Cellular component =membrane; Biological process=proteoglycan metabolic process
  Homolog annotation: Hit_ID=Q8L608; Match level="QueryCoverage=92%, HitCoverage=35%, E-value=5e-65, Identity=60%"; Hit description =Heparanase-like protein 2 precursor
  Pfam annotation: Domain name=Glyco_hydro_79n; Domain location=1-138; Score=-67.7; E_value=2.1e-08; Accession=PF03662.4; Description =Glycosyl hydrolase family 79, N-terminal domain
MGASVGVAQYGKDLIKLILSTLYESSKFKPSLVAPGGFYEKYWYDRLLQVSGLGIINVLTHHLYNLGPGSDEHLERKILDHERLSRVESIFGNLSEIIKIYGPWSSAWVGEAGGAYNSGVNHVSNRFLNSFWYLDQLGIASCYNTKVYCRQTLIGGNYDLLNTTTFAPNPNYYSALLWHRLMGKKVLAVSSDVHIKDFYLQLGN

SEQ ID NO: 128538 - protein, 130 aa, Glycine max
  Coding DNA Sequence Number=SeqID_11760
MTEGCGEGFCLANLPGDAFSLWGNFFEAKKQMMADAKFAGLLGLGKPLVEILPPGQLRGFCPLLAWLGSAVLGEGRIKATRAESQWIVAARPLCHLQYPVAYLSRLQRILPAARWELRFKASRRANPPHE

SEQ ID NO: 128539 - protein, 424 aa, Glycine max
  Coding DNA Sequence Number=SeqID_11761
  Gene Ontology: Mol. function=serine-type endopeptidase activity
  Homolog annotation: Hit_ID=Q1RW49; Match level="QueryCoverage=99%, HitCoverage=77%, E-value=9e-90, Identity=42%"; Hit description=IMP dehydrogenase/GMP reductase
MSTAVPFLSVAVAWFVIFGIFLLIILACCCCCNGGESNDDDDYSKALHHLSLTLLILCTIAAIGGCAVLYSGQGKFRESTSNTLDYVVNQAQIIAENLRNVTSYFDSAKQLVNGIPLPLDLGSNIDDVKVKVTTAADSLSKKAKENSRMIHKVIDGVRLALVTVAAVMIFVAFLGLLFSLLALPGPVYSLVVIGWILVTGTLLLCAAFLFVHNVTADTCVAMDEWVVNPTAHTALDDILPCVENATAVETLLRSKTLTYTIVDAFDQIISNFTNVNAAANFNQSGPLVPLLCNPYIANFTSRQCEPGEVTFKNAIEVWKNYTCQVSSSEQCMSEGRLTPKIYNKLAAAVNVTNGLFHYGPFFVDLVDCTFARKAFSEISSNYCPSLRRYTERVYLGTVVVSAAVMLSLIFFIVFVREQWRRLHN

SEQ ID NO: 128540 - protein, 103 aa, Glycine max
  Coding DNA Sequence Number=SeqID_11762
MDRIREPRKKERRKEPDGVRREFKRENVAEAEKRKRKRKKNRRRKKEEFDFDVKRSMMMVKKSLMLLWVMAWRKWEQETVASCSDCVTYGVTSHYLKALVNAL

SEQ ID NO: 128541 - protein, 107 aa, Glycine max
  Coding DNA Sequence Number=SeqID_11763
  Homolog annotation: Hit_ID=Q8H6R2; Match level="QueryCoverage=75%, HitCoverage=46%, E-value=9e-12, Identity=40%"; Hit description=CTV.15
  Subcellular localization annotation: CTP_CleavageSite=101; ConfidenceScore=5.77e-01
MKSQSSRTCMCSPTNHPGSFRCSMHKKPPRAVVARPLSRTPSSWNSSSMAAKANSLKAILLQMIKPSSHEHHRRKSFQPKPSRFSLMNNDNAAVVAVLLMSDMAGVE

SEQ ID NO: 128542 - protein, 273 aa, Glycine max
  Coding DNA Sequence Number=SeqID_11764
  Gene Ontology: Mol. function=zinc ion binding; Cellular component =intracellular
  Homolog annotation: Hit_ID=Q6H889; Match level="QueryCoverage=87%, HitCoverage=99%, E-value=1e-93, Identity=68%"; Hit description =Putative zinc-binding protein
  Pfam annotation: Domain name=PLATZ; Domain location=49-159; Score =272.1; E_value=1.1e-78; Accession=PF04640.4; Description=PLATZ transcription factor
MQLVQGESQSGVCLAILIELISQGDEQRIGHQKPAWLEALYTQKFFVGCSYHENAKKNEKNVFCLDCCTSICPHCLPSHRFHRLLQVRRYVYHDVVRLEDLQKLIDCSNVQAYTINSAKVVFIKKRPQNRQFKGSGNYCTSCDRSLQEPFIHCSLGCKVDFVLKHYKDLSPYLRTCNSLQLSPDFLIPQDMGDEEMTRSTVVDCDEPMSSSSGSSESENNMSMMACTEIVRKRRSGWSTVCAKFMANSNKVSDEDMATSMSRRKGIPHRSPLC

SEQ ID NO: 128543 - protein, 121 aa, Glycine max
  Coding DNA Sequence Number=SeqID_11765
MWMSRERFPTDFRREEKEKSDFRREEKEKSDFRQEDDKEKREGKDDIQQKRQKKLAKTIANEDKALETFGLATKVKRILREKKGKVQTKKPAQQQKKEQKIVIEEQWMKKRHEVPRPSLPV

SEQ ID NO: 128544 - protein, 248 aa, Glycine max
  Coding DNA Sequence Number=SeqID_11766
  Homolog annotation: Hit_ID=O82258; Match level="QueryCoverage=79%, HitCoverage=81%, E-value=2e-83, Identity=72%"; Hit description =Expressed protein
  Pfam annotation: Domain name=DUF1817; Domain location=85-240; Score =320.5; E_value=2.9e-93; Accession=PF08847.1; Description=Domain of unknown function (DUF1817)
  Subcellular localization annotation: CTP_CleavageSite=49; ConfidenceScore=5.40e-01
MATTPIKCKPLLPLSSLPKPTTSWLFGKPISHPFPNSRPVYQRGNVAISVSYNPQGNFDLSLFDDDDETKAAPPLPPTEGRFEVAIDNDVISRLDLSPFQAATGMKSPLSVKPKEFLERTIGFTINYTREDPRDPRELSEYPDIRVWFVRLDATYPWLPVLLDWRAGELARYAAMLVPHQMNIKMGVVFNPEALELFVMKKVFIVYSWLKHHNIPKPKLKANDMARMLGFTIGDELYDFIDKHPLDLS

SEQ ID NO: 128545 - protein, 116 aa, Glycine max
  Coding DNA Sequence Number=SeqID_11767
KKLGWRLDLVLVIIYNLTGHGFNLASPIDLILDVGKLVVRPQAKDVVLSGFFFVLSYFKLYNINIHEPKAGKTISWFPSLCFLAISIAHSKGWGKLWLEVNSLLVLKAFNVITVAP

SEQ ID NO: 128546 - protein, 239 aa, Glycine max
  Coding DNA Sequence Number=SeqID_11768
  Gene Ontology: Mol. function=ionotropic glutamate receptor activity; Cellular component=integral to membrane; Biological process=ion transport
  Homolog annotation: Hit_ID=Q9SW97; Match level="QueryCoverage=89%, HitCoverage=24%, E-value=3e-71, Identity=60%"; Hit description =Glutamate receptor 3.5 precursor
  Pfam annotation: Domain name=ANF_receptor; Domain location=53-238; Score=25.0; E_value=2.4e-06; Accession=PF01094.18; Description =Receptor family ligand binding region
  Subcellular localization annotation: CTP_CleavageSite=59; ConfidenceScore=5.24e-01
MFEFLELHDFLGGSRELVYLAFSPTSVNSTVSSRPKVVKFGALFTMGSVIGRLALPAIMAAVKDVNSSTSSLLGIDLQLMENDVVVVVGPLPSGIAHVISHVVNELHVPLLSFGATDPTLSALQYPYFVRTTQNNYLQMYAIVDFVDYYRSTKVIAIYVDDDNGRNGVSVLGDAMSRKRAKISYKAVFPPGATESDISDLLNEVNLVESRVYVLHVNPDHGLAIFSIAKRLRMMDSGYV

SEQ ID NO: 128547 - protein, 69 aa, Glycine max
  Coding DNA Sequence Number=SeqID_11769
WDFRPPKGAAEPAWVSALEGLSAVEGAAEPALFSLPLHVLHDCFKVRTRGTEDLSSESVASVSVRASQR

SEQ ID NO: 128548 - protein, 1046 aa, Glycine max
  Coding DNA Sequence Number=SeqID_11770
  Gene Ontology: Mol. function=translation elongation factor activity; Cellular component=ribonucleoprotein complex; Biological process =translation
  Homolog annotation: Hit_ID=Q1SP45; Match level="QueryCoverage=95%, HitCoverage=100%, E-value=0.0, Identity=90%"; Hit description =Translation factor; Elongation factor G, III and V
  Pfam annotation: Domain name=Dynamin_N; Domain location=190-320; Score=-37.9; E_value=0.02; Accession=PF00350.13; Description=Dynamin family
  Pfam annotation: Domain name=EFG_C; Domain location=889-988; Score =102.0; E_value=1.8e-27; Accession=PF00679.14; Description=Elongation factor G C-terminus
  Pfam annotation: Domain name=EFG_IV; Domain location=766-887; Score =92.2; E_value=1.5e-24; Accession=PF03764.8; Description=Elongation factor G, domain IV
  Pfam annotation: Domain name=GTP_EFTU; Domain location=185-505; Score= 195.6; E_value=1.1e-55; Accession=PF00009.17; Description=Elongation factor Tu GTP binding domain
  Pfam annotation: Domain name=GTP_EFTU_D2; Domain location=555-629; Score=41.3; E_value=3.3e-09; Accession=PF03144.15; Description =Elongation factor Tu domain 2
  Pfam annotation: Domain name=MMR_HSR1; Domain location=188-321; Score= 6.4; E_value=0.00026; Accession=PF01926.13; Description=GTPase of unknown function
  Pfam annotation: Domain name=Miro; Domain location=189-321; Score= -4.8; E_value=0.016; Accession=PF08477.3; Description=Miro-like protein
  Pfam module annotation: Pfam domain module=Dynamin_N::EFG_C::EFG _IV::GTP_EFTU::GTP_EFTU_D2::MMR_HSR1::Miro; Domain location=190 -320::889-988::766-887::185-505::555-629::188-321::189-321
MAQSSGNPISTIVHRYPKTRKTPSPSVRNDGDTNSLPLPLYFPLHTPHSAMDDSLYDEFGNYIGPEIESDRDSDRDSDADDNPDDQSDAVGAAHSDGEDPSNGWMTTISDELENQVVLAEDKKYYPTAEEVYGEDVETLVMDEDEQPLEQPIIKPVRNIKFEVGVKDSSTYVSSQFLLGLMSNPTLVRNVALVGHLQHGKTVFMDMLVEQTHHMSTFDSQSEKHMRYTDTRIDEQERRISIKAVPMSLVLEDSNSKSYLCNIMDTPGHVNFSDEMTAALRLADGAVLIVDAAEGVMVNTERAIRHAIQERLPIVVVINKVDRLITELKLPPKDAYHKLRHTLEVINTHISAASSIAGGVQVVDPVAGNVCFASATAGWSFTLHSFAKLYGKLHGIPLEANKFASRLWGDYYFHPDTRAFKKKPPASGGERSFVEFVLEPLYKIYSQVIGEHKKSVETTLAELGVSLSNAAYRLNVRPLLRLACSSVFGPASGFTDMLVQHIPSPRDAAIKKVDHIYAGPKDSSIYKAMAQCDSYGPVMVNVTKLYPKSDCSVFDAFGRVYSGKIQTGQTVRVLGEGYSPDDEEDMTVKEVTKLWVYQARDRMPVAEAPPGSWVLIEGVDASIMKTATLCNVDYDEDVYIFRPLQFNTLSVVKTATEPLNPSELPKMVEGLRKISKSYPLAVTKVEESGEHTILGTGELYLDSIMKDLRELYSEVEVKVADPVVSFCETVVESSSMKCFAETPNKKNKITMVAEPLERGLAEDIENGVVSTDWSKKKLGDFFQTKYDWDLLAARSIWAFGPDKQGPNILLDDTLPTEVNKDLMNAVKDSIVQGFQWGAREGPLCDEPIRNVKFKIVDAKIATESLHRGSGQIIPTARRVAYSAFLMATPRLMEPVYYVEVYALLTIMMAIQTPIDCVSAIYTVLSRRRGHVTADVPQPGTPAYIVKAFLPVIESFGFETDLRYHTQGQAFCMSVFDHWAIVPGDPLDKSIVLRPLEPAPIQHLAREFMVKTRRRKGMSEDVSINKFFDEAMMVELAQQAADLHQQMM

SEQ ID NO: 128549 - protein, 166 aa, Glycine max
  Coding DNA Sequence Number=SeqID_11771
MWSVERKIEREWEGIGVTVVSNRRRWGFSGFRVTMDDSGDGISRGLGLARASVGGLDGSATTLLHGNIGSNMSVKFGVIVVMLVRIWVTWVGGELTRRVVALMGGEGLGGGSCGRRGGGLSGLGGWWCGALEVEEMDEHVVAEQVHDAMGRMGRGGDEGLVQWAGM

SEQ ID NO: 128550 - protein, 87 aa, Glycine max
  Coding DNA Sequence Number=SeqID_11772
MTKLKTSLSLESKAAAPKWIEVKSHVQTGCYECGYYVMHWMWNIITSEIKSDWSMWFADVTPLDIDNITTIRNKWARYFLKTACKKG

SEQ ID NO: 128551 - protein, 266 aa, Glycine max
  Coding DNA Sequence Number=SeqID_11773
  Gene Ontology: Mol. function=RNA-directed DNA polymerase activity; Cellular component=nucleus; Biological process=RNA-dependent DNA replication
MGRVMDSIVGKNQAAFVPGQKIYNHILLAYELIKGYSRKGGTPRCMMQIDLQKAYDMVNWDALECILKEIGVPQQFIRWIMIAVTTVSYRFNINGCHSNLLQAKRGLRQGDPMSPLLFVIVMEYLNRIMYDMQKNPNFNHHAKCEKLSITNLAFADDLLLFSRGDPISVDLMVKAFKNFSESTGLIANPSKCKIYFGGVGDDSKRNILNLTGFTEGPLPFRYLGVPLTSKKLSIHHYMPLVDKIVGRINHWSTNLLTYAGRVQLIR

SEQ ID NO: 128552 - protein, 210 aa, Glycine max
  Coding DNA Sequence Number=SeqID_11774
MEFYQADPTLENYWRGVILFGRNVASYKFALASALYEVDKTGSDLITLDQLAVPFSRYLCEHLKHAPKQITSRSSQFLETCLKFNRGEITHAQLIEATVRLGFNNVIDAFHYVNQGEIDKRFFLDERKTHNGIRLTDNFYLLGERLQYKNLAFETNARWNLVEQAWSMGISRNLVGVEFDEDNQLLFTRVNARRVDITSCRDSLNGYQKG

SEQ ID NO: 128553 - protein, 93 aa, Glycine max
  Coding DNA Sequence Number=SeqID_11775
  Homolog annotation: Hit_ID=Q1SGX5; Match level="QueryCoverage=44%, HitCoverage=10%, E-value=4e-10, Identity=66%"; Hit description =Peptidase S10, serine carboxypeptidase
MAYCGPGCSWFSRIVLEIGPVAFNHEQYNGSLPTLILRPQSWTKISMTCLYMAVVEILTNNNGCNVHPDIEILKNNDGCNVHPDVEIFKNNDG

SEQ ID NO: 128554 - protein, 66 aa, Glycine max
  Coding DNA Sequence Number=SeqID_11776
MEHETFLATWLAEIDFSPNGLRFSNLQPQPRLINHEKPILCRWHKLNPLKIEGRRFALDSVRDYFP

SEQ ID NO: 128555 - protein, 413 aa, Glycine max
  Coding DNA Sequence Number=SeqID_11777
  Gene Ontology: Mol. function=protein-tyrosine kinase activity; Cellular component=integral to membrane; Biological process=protein amino acid phosphorylation
  Homolog annotation: Hit_ID=Q1SX72; Match level="QueryCoverage=90%, HitCoverage=59%, E-value=1e-102, Identity=38%"; Hit description =Tyrosine protein kinase, active site
  Pfam annotation: Domain name=LRRNT_2; Domain location=30-69; Score =45.9; E_value=1.4e-10; Accession=PF08263.3; Description=Leucine rich repeat N-terminal domain
  Pfam annotation: Domain name=LRR_1; Domain location=122-144; Score =5.0; E_value=34; Accession=PF00560.23; Description=Leucine Rich Repeat
  Pfam annotation: Domain name=LRR_1; Domain location=146-169; Score =16.3; E_value=0.11; Accession=PF00560.23; Description=Leucine Rich Repeat
  Pfam annotation: Domain name=LRR_1; Domain location=171-193; Score =16.2; E_value=0.12; Accession=PF00560.23; Description=Leucine Rich Repeat
  Pfam annotation: Domain name=LRR_1; Domain location=195-217; Score =9.3; E_value=5.3; Accession=PF00560.23; Description=Leucine Rich Repeat
  Pfam annotation: Domain name=LRR_1; Domain location=219-241; Score =12.0; E_value=1.6; Accession=PF00560.23; Description=Leucine Rich Repeat
  Pfam annotation: Domain name=LRR_1; Domain location=243-266; Score =11.9; E_value=1.7; Accession=PF00560.23; Description=Leucine Rich Repeat
  Pfam annotation: Domain name=LRR_1; Domain location=268-290; Score =19.3; E_value=0.014; Accession=PF00560.23; Description=Leucine Rich Repeat
  Pfam annotation: Domain name=LRR_1; Domain location=292-314; Score =14.1; E_value=0.5; Accession=PF00560.23; Description=Leucine Rich Repeat
  Pfam annotation: Domain name=LRR_1; Domain location=316-338; Score =18.5; E_value=0.024; Accession=PF00560.23; Description=Leucine Rich Repeat
  Pfam annotation: Domain name=LRR_1; Domain location=340-362; Score =14.7; E_value=0.33; Accession=PF00560.23; Description=Leucine Rich Repeat
  Pfam annotation: Domain name=LRR_1; Domain location=364-386; Score =10.8; E_value=2.7; Accession=PF00560.23; Description=Leucine Rich Repeat
  Pfam annotation: Domain name=LRR_1; Domain location=73-96; Score=0.1; E_value=2.7e+02; Accession=PF00560.23; Description=Leucine Rich Repeat
  Pfam annotation: Domain name=LRR_1; Domain location=98-120; Score =12.6; E_value=1.3; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1; Domain location=30-69::122-144::146-169::171-193::195-217::219 -241::243-266::...
  Pfam module annotation: Domain location=268-290::292-314::316 -338::340-362::364-386::73-96::98-120
MVLSIEFLGRYWILLVVFLTHSSPQLAAAENNEANALLRWKDNFDKPSQNLLSTWTGSDPCKWQGIQCDNSNSVSTINLPNYGLSGTLHTLNFSSFPNLLSLNIYNNSFYGTIPPQIGNMSKLNVLNFSLNLFRGSIPQEMWTLRSLRGLDLSQCSQLSGEIPNSISNLSNLSYLDLSICNFSGHIPPEIGKLNMLEILRIAENNLFGSIPQEIGMLTNLKDIDLSLNLLSGTLPETIGNMSTLNLLRLSNNSFLSGPIPSSIWNMTNLTLLYLDNNNLSGSIPASIKKLANLQQLALDYNHLSGSIPSTIGNLTKLIELYLRFNNLSGSIPPSIGNLIHLDALSLQGNNLSGTIPATIGNLKRLTILELSTNKLNGSIPQVLNNIRNWSALLLAENDFTGHLPPRVCSAGTL

SEQ ID NO: 128556 - protein, 140 aa, Glycine max
  Coding DNA Sequence Number=SeqID_11778
  Gene Ontology: Mol. function=protein transporter activity; Cellular component=membrane; Biological process=intracellular protein transport
  Homolog annotation: Hit_ID=A0F0A7; Match level="QueryCoverage=68%, HitCoverage=37%, E-value=3e-35, Identity=78%"; Hit description =Syntaxin
  Pfam annotation: Domain name=Syntaxin; Domain location=9-112; Score =51.8; E_value=2.3e-12; Accession=PF00804.15; Description=Syntaxin
MTRNHLKFHVTKANEVVQELDKQYAKLDKLLKKLQDAHEESKAVTKAPSMKAIKQRMEKDVDEVKKTAHYLKTKIEELDKENLANGCGKGSGADRSRTATTISLKKKLKDTEFQILREAIHQEYREVVERRVFTACLLDN

SEQ ID NO: 128557 - protein, 207 aa, Glycine max
  Coding DNA Sequence Number=SeqID_11779
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=9e-31, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPSEDYTSSPSEGYTPSPLEDYTSSPSEGYTSSPSEDYTSSPSEGYMPLPSEGCTPSPSEGCTPSPSEGCTPSPSEGYTSSPSEGYTPSPSKDRTSSPLEGYTSSPSKGYTPSPSEGYMPSPSEGYMSSPSDGFTSSPSEDYTSSPSKGYTPSPSECCTPSPSEDYMSPPLEDYMFSPSEGYTSSLSEGSTSASSENSRSSILNA

SEQ ID NO: 128558 - protein, 293 aa, Glycine max
  Coding DNA Sequence Number=SeqID_11780
  Gene Ontology: Mol. function=transcription factor activity; Cellular component=nucleus; Biological process=regulation of transcription, DNA-dependent
  Homolog annotation: Hit_ID=Q1RTN9; Match level="QueryCoverage=99%, HitCoverage=92%, E-value=7e-23, Identity=50%"; Hit description =Pathogenesis-related transcriptional factor and ERF
  Pfam annotation: Domain name=AP2; Domain location=30-94; Score=136.3; E_value=8.2e-38; Accession=PF00847.10; Description=AP2 domain
  Subcellular localization annotation: CTP_CleavageSite=39; ConfidenceScore=5.08e-01
MEIQFQHPKKHLRASTSKGGKGRNNNNKTKSKYVGVRQRASGKWVAEIKDTTQKIRMWLGTYETAEEAARAYDEAACLLRGSNTRTNFITRVSLDSPLASRIQNLVNNRKGTKTKQEQYVVETCDTRIKSNRHESIALPEGASPPQRGELRSESSLEDVSKFSIQQLYIDQDCLRKKIRVGNEKKRRVNSTTCSTSNSTNSSNNSDSCENSLSSETTTQNTQQFDDDAYRPDLSNFMVSESGSHQNNPSWGFEPSFSQVMDVANLPDIAGLELPDFERIKVERQISASLYAIN

SEQ ID NO: 128559 - protein, 68 aa, Glycine max
  Coding DNA Sequence Number=SeqID_11781
MQREKLLQERDTKVRNFARMKEVSDAVKLSVAVKNEGGFRCSQDHRKPPPAAECRGFREKPRERIVRG

SEQ ID NO: 128560 - protein, 97 aa, Glycine max
  Coding DNA Sequence Number=SeqID_11782
  Gene Ontology: Mol. function=protein transporter activity; Cellular component=integral to membrane; Biological process=intracellular protein transport
  Homolog annotation: Hit_ID=A0F0A7; Match level="QueryCoverage=45%, HitCoverage=16%, E-value=1e-13, Identity=84%"; Hit description =Syntaxin
  Pfam annotation: Domain name=SNARE; Domain location=17-66; Score =35.6; E_value=1.8e-07; Accession=PF05739.9; Description=SNARE domain
MFRCYAGTNMHIIHTPARYVKIFLDISVLVDAQGDMLDNIETQVSSAVDHVHQGNNALQKAKKLQRNSRKWMCIAIMIVVIIIVVAIIKPRVTKNGV

SEQ ID NO: 128561 - protein, 267 aa, Glycine max
  Coding DNA Sequence Number=SeqID_11783
  Gene Ontology: Mol. function=metal ion binding; Cellular component =integral to membrane
  Homolog annotation: Hit_ID=Q6R567; Match level="QueryCoverage=82%, HitCoverage=89%, E-value=1e-42, Identity=40%"; Hit description=Ring domain containing protein
  Pfam annotation: Domain name=zf-C3HC4; Domain location=36-84; Score =26.7; E_value=8.1e-05; Accession=PF00097.15; Description=Zinc finger, C3HC4 type (RING finger)
MALDHFEESVHQKGNWKSSSEIIADSGRNASGSFDCNICLECVQDPVVTLCGHLYCWPCIYKWLHFQSTSLDNEEQQKPQCPVCKSEVSQSSLVPLYGRGQTTIPSKGKPHQVGTVIPQRPHGPRTHNIRSVSQPISQSYHPYSNPYHPQQFNSIPSGYTSPMIRTSGSIDNTFGIFGEMIYARSYTYERIDGSITWYSRRCKYSNPLAPTSAMPKERTTARVLPKVKIKVGHLRPVHLIILISQLMLLPERRANKRIQDRNDFAYL

SEQ ID NO: 128562 - protein, 96 aa, Glycine max
  Coding DNA Sequence Number=SeqID_11784
MEYGGVYEHKRLSINKEGELRKTKTKLHAPCLDITSYEERERERKGATTIASRENIWKLNRKEGKLRRRVETDEEKEEEQEMMEYEGKKSWENEIL

SEQ ID NO: 128563 - protein, 70 aa, Glycine max
  Coding DNA Sequence Number=SeqID_11785
HDIKIPNGENAQNWVANLVLKCHDDPTVNEFEIVVFLRQIWWAAGKRKGFERRRRKNENEGKKRHRQCEN

SEQ ID NO: 128564 - protein, 142 aa, Glycine max
  Coding DNA Sequence Number=SeqID_11786
  Gene Ontology: Mol. function=sequence-specific DNA binding; Cellular component=nucleus; Biological process=regulation of transcription
  Homolog annotation: Hit_ID=Q1T4J9; Match level="QueryCoverage=81%, HitCoverage=19%, E-value=9e-22, Identity=51%"; Hit description=DNA -binding WRKY
MENIYNSYMQRNKNVPISPPQHSLPDTIAAATKVITADPNFQSALAAALTTIIGSGSTTQGNHGGAGENLSQKMKWGELFPSSSSALPSSSTKVNGCASSFLNKSAANTQPGTALMFLQPPLPLSSPKSASGSPGDHIDKRN

SEQ ID NO: 128565 - protein, 87 aa, Glycine max
  Coding DNA Sequence Number=SeqID_11787
  Gene Ontology: Mol. function=isomerase activity; Biological process =cell redox homeostasis
  Homolog annotation: Hit_ID=Q1RTP5; Match level="QueryCoverage=94%, HitCoverage=60%, E-value=3e-12, Identity=60%"; Hit description =Thioredoxin domain 2; Thioredoxin fold
MAYNLQCFFSKYGIHSLPAILLVNQTSKLRYHGPNNLLSLFEFYERKTGDRCQEDLEQAKTVQDQDFSRKGKECPRLGFIYNFCFPW

SEQ ID NO: 128566 - protein, 248 aa, Glycine max
  Coding DNA Sequence Number=SeqID_11788
  Gene Ontology: Mol. function=translation initiation factor activity; Cellular component=cytoplasm; Biological process=translational initiation
  Homolog annotation: Hit_ID=Q1RTP4; Match level="QueryCoverage=85%, HitCoverage=86%, E-value=1e-104, Identity=86%"; Hit description =Eukaryotic translation initiation factor 4E
  Pfam annotation: Domain name=IF4E; Domain location=8-248; Score =339.1; E_value=7.3e-99; Accession=PF01652.9; Description=Eukaryotic initiation factor 4E
MDFTVEKKESENNAENAHPTTLDSSSQLASALDSNNKEIEERQARELKAGLHPLKGNFDFDPGLWLCIWDEMHKFVFWYTRRTPGVRNQTSYEDNIKKIVEFSTVEGFWVCYCHLARPASLPSPTDLHLFKEGIRPLWEDSANCNGGKWIIRFKKVVSGRFWEDLVLALVGDQLDYGDNICGAVLSIRFNEDILSVWNRNASDHQAVMALRDSIKRHLKLPHSYVMEYKPHDASLRDNSSYRNTWLRG

SEQ ID NO: 128567 - protein, 722 aa, Glycine max
  Coding DNA Sequence Number=SeqID_11789
  Gene Ontology: Mol. function=protein binding; Cellular component =cytoplasm
  Homolog annotation: Hit_ID=Q10CW7; Match level="QueryCoverage=82%, HitCoverage=92%, E-value=1e-103, Identity=39%"; Hit description =YT521-B-like family protein, expressed
  Pfam annotation: Domain name=YTH; Domain location=543-633; Score =201.2; E_value=2.4e-57; Accession=PF04146.6; Description=YT521-B -like family
  Subcellular localization annotation: CTP_CleavageSite=72; ConfidenceScore=5.63e-01
MIYPHKGIFGIWLKNTHVGGANSSSPFSKTKKLKPQSKTVAAATPSPSFSSLFFSPSSSLLSLAIFTFIWIMATLAPSSDTANLLQNLSLDSESKTVPEPAKKNGHGPAKGVTKPFNPNASFTPNGHLSASAYYYGGKDGCFLLAKITLDLFLGVLNCYTNGVLGDSCSYLYHQGYGYTPYGAPMQHDDNLYGLQQYQYPSSYYQSPASADGSFAANKINAQEGRISAAASAEHIPSSAVINKGSSIGVVNEGSTNNNGVKEFLSSTQRPLLNSNDSYQRAGFPVYAPLSGYQDPRVGPHGTQPALPLDPLLFSNKKSNDGAKIGLSSPAVPGKKISSQRNTTIPQPLPQSMNLHGSIHSSGLEPFSGFINGTYPSNTMYSQYGNAYRASSHFGQAPYGYGYRIGSVNNKPKASNDGCAIDHVKRNMDGFGELNKGPRSGNSSDDKSVDGPGPVTLLIKGQNLPIKSDNKEVPLVPNNEQYNGKDFPENYSDAKFFVIKSYSEDDIHKSIKYKVWASTFNGNKKLDAAYHESKEKPGDCPVFLLFSVNTSGQFVGLAEMVSPLDFGRTVEYWQQDRWSGCFSVKWHIIKDIPNSVLRPITLENNENKPVTNSRDTQEVKFEKGIQILKIFKQHSSKTCILDDFGFYETREKMIQERKSMEQQLPKQASKSNDLTTNGTVMLPKSHDGALKNESATTDEAGQKEKLVEVNGSTQASEDCSKNC

SEQ ID NO: 128568 - protein, 92 aa, Glycine max
  Coding DNA Sequence Number=SeqID_11790
  Gene Ontology: Mol. function=UDP-glucose:hexose-1-phosphate uridylyltransferase activity; Biological process=carbohydrate metabolic process
  Homolog annotation: Hit_ID=Q9FK51; Match level="QueryCoverage=90%, HitCoverage=33%, E-value=4e-21, Identity=44%"; Hit description =Probable galactose-1-phosphate uridyl transferase
MKIGRLERTKLHVLDGFMAGELWNSLGISEENAPNFSRRQIGEGAGESGVEVLDDPDFPIRVTGRDPEYLGRALVLVADTEGALLVRVRVGG

SEQ ID NO: 128569 - protein, 259 aa, Glycine max
  Coding DNA Sequence Number=SeqID_11791
  Gene Ontology: Mol. function=unfolded protein binding; Cellular component=cytosol; Biological process=cellular protein metabolic process
  Homolog annotation: Hit_ID=Q94K05; Match level="QueryCoverage=92%, HitCoverage=43%, E-value=1e-114, Identity=84%"; Hit description =Putative T-complex protein 1, theta subunit; TCP-1-Theta
  Pfam annotation: Domain name=Cpn60_TCP1; Domain location=38-259; Score=-198.9; E_value=0.0072; Accession=PF00118.14; Description=TCP -1cpn60 chaperonin family
MGFNIQPYGIQSMLKEGHKHLSGLDEAVLKNIDACKQLSTITRTSLGPNGMNKMVINHLDKLFVTNDAGTIVNELEVQHPAAKVLVLAGKAQQEEIGDGANLTISFAGELLQGAEELIRMGLHPSEIISGYTKAINKTVQILDELVEDGSDNMDVRDKEQVISRMKAAVASKQFGQEDIICSLVADACIQVCPKNPANFNVDNVRVAKLLGGGLHNSTVVRGLVLKSDAVGTIKQAEKAKSEILHNCLNLFIFPVLYAR

SEQ ID NO: 128570 - protein, 295 aa, Glycine max
  Coding DNA Sequence Number=SeqID_11792
  Gene Ontology: Mol. function=transcription factor activity; Biological process=regulation of transcription, DNA-dependent
  Homolog annotation: Hit_ID=Q1BJ74; Match level="QueryCoverage=99%, HitCoverage=97%, E-value=3e-61, Identity=44%"; Hit description =Transcriptional regulator, LysR family
  Pfam annotation: Domain name=HTH_1; Domain location=8-67; Score=62.3; E_value=1.6e-15; Accession=PF00126.17; Description=Bacterial regulatory helix-turn-helix protein, lysR family
  Pfam annotation: Domain name=LysR_substrate; Domain location=91-293; Score=13.4; E_value=0.00011; Accession=PF03466.10; Description=LysR substrate binding domain
  Pfam module annotation: Pfam domain module=HTH_1::LysR_substrate; Domain location=8-67::91-293
MKTLQYSFAQIEAFATIAETGSLSRAAIRLGKDRTTLRDLLDYLEDALGYRLFSRAGRSLTLTAEGEQLFRQAHLLLRQAQAFESFAQTLPQTAWQELRLVYDSFVPREFLCLLADTLARRQIRLSCWSASRREAEQALSDGVADMAICQANNRTLGSEMEWRALGTVDLRFYAAQRLFAGTARPLTLLNLSLTPQLVMHRRSDDQIARRLQISGHTLYMNEITMLRHAMEQGQGWGFLPDHLQPGEWQGVAEIATEVGNQGLNVTMVMLWLPGMNKHRALGEIVDDAPGLWRRR

SEQ ID NO: 128571 - protein, 342 aa, Glycine max
  Coding DNA Sequence Number=SeqID_11793
  Gene Ontology: Mol. function=unfolded protein binding; Cellular component=cytosol; Biological process=cellular protein metabolic process
  Homolog annotation: Hit_ID=Q75HJ3; Match level="QueryCoverage=99%, HitCoverage=55%, E-value=1e-143, Identity=78%"; Hit description =Putative TCP-1/cpn60 chaperonin family protein
  Pfam annotation: Domain name=Cpn60_TCP1; Domain location=1-326; Score= 32.3; E_value=1.9e-10; Accession=PF00118.14; Description=TCP-1cpn60 chaperonin family
VAVFASGVDTSATETKGTVLIHTAEQLYFFYCLSGEAYFVFAGISWRSIPISQIRKLKVDCDRLENYSKTEEAKVEELIKAVADSGAKVIVSGGAVGEMALHFCERYKLMVLKISSKFELRRFCRTTGSVAMLKLCQPNPDDLGYVDSVSVQEIGGVRVTIVKNEEGGNSVATVVLRGSTDSILDDLERAVDDGVNTYKAMCRDSRFVPGAAATEIELAKRVKDFSFKETGLDQYAIAKFAESFEMIPRTLAENAGLNAMEIISSLYAEHASGNAKVGIDLEEGICKDVSTLSIWDLHVTKLFALKYAADAACTVLRVDQIIMAKPAGGPRREQPAGGMDED

SEQ ID NO: 128572 - protein, 361 aa, Glycine max
  Coding DNA Sequence Number=SeqID_11794
  Gene Ontology: Mol. function=RNA-directed DNA polymerase activity; Cellular component=intracellular; Biological process=RNA-dependent DNA replication
WAAKRLRHYMINHTTWLISKMDPIKYIFEKPALTGRIARWQMLLSEYDIEYRTQKAIKGSVLADHLAHQPIEDYQPIKFDFPDEEIMYLKMEDCDDPLLGEGPDPESRWGLIFDGAVNVFGNGIGAVIITPEGNHLPFAARLQFDCTNNMAEYEAYYARHLLTFFNKVELHHIPRDENQMADALATLSSMYEVSHQNNLPTIRIQRLERPAHVFAVEEVVDDKPWFHDIKCFLQSQEYPPGASNKDRRTLRRLSGSFGTHSNGHAMARKLLRAGYYWMSMETDCCKHARKCHKCQIYADRIHVPPTTLNVLSSPWPFSMWGIDMIGRIEPKASNGHRFILAAIDYFTKWVEAASYANVTKQ

SEQ ID NO: 128573 - protein, 203 aa, Glycine max
  Coding DNA Sequence Number=SeqID_11795
MGHEFSNGGGDLTGEFAGFMHKSHWHGASRSASTSPLRSRTQDNIKIFMTPRKLIHSLQEDLNDEISDCSEKPNRRIKSLSSGNIKLSPASYSKYDQNGIADHVNYDSKESGSLCGDGEGDVQFQGGLESVSSTDDIPCNTDMQKPSEVGPESRNGTETVLMGKPFQKTKHKLVYGISFALLAIATPFLWINSQDQGHFLVPT

SEQ ID NO: 128574 - protein, 281 aa, Glycine max
  Coding DNA Sequence Number=SeqID_11796
  Gene Ontology: Mol. function=isomerase activity; Biological process =carbohydrate metabolic process
  Homolog annotation: Hit_ID=Q8W307; Match level="QueryCoverage=80%, HitCoverage=57%, E-value=1e-24, Identity=35%"; Hit description =Putative antifreeze glycoprotein
  Subcellular localization annotation: CTP_CleavageSite=31; ConfidenceScore=5.43e-01
MALSSLFGSTRFIPTPFVTSTRNIPSSAHTCASNNKREFPLPPVASVPYQPINNFAYLQEEFSGHAGVTFEGVEDSCVAKMELKNGSIVELLHTNVSEGEYGDAIIQGGVSLNFNFQTHDDGEFSWSPTNWLLHKIQGNANEYIQDGEGQAPLGSVTEVELTNRTSDDKIGLKYIVTLEQDALNSELEISNKKSLPVQMTGSILNHLTVSSPEATYALGLERSNYCSKPLFESEFMLSPPDSCQEEGFGKILQQFFPHWGTKGQNNGSEGGQHEEMDEASS

SEQ ID NO: 128575 - protein, 310 aa, Glycine max
  Coding DNA Sequence Number=SeqID_11797
  Gene Ontology: Biological process=nuclear mRNA splicing, via spliceosome
  Homolog annotation: Hit_ID=Q2R240; Match level="QueryCoverage=96%, HitCoverage=48%, E-value=7e-97, Identity=61%"; Hit description =Expressed protein
MGRSLSPMLRREIQNLDKDTDSRKSAMRALKSYVKDLDMKTIPIFLAQVSETKETGSLSGEFTISLYEVLARVHGVKIVPMIDSIMQSIVQTLASSAGSFPLQQACSKVVPAIARYGIDPATPEEKKRQIIHSLCKPLSDSLLSSQESLTCGTALCLKALVDSDNWRFASVEMVNRVCQNVAAALEGKSTQTNSHMGLIMSLAKRNALIVEAYARLLIQSALRILNAGSEPVEGNSQKQFVAIQMVNFLMKCLDPRSIFSEVEQIIEVMKLCQSDKMAYVKGAAFEALQTANIIAADKKSRGVKSPASVP

SEQ ID NO: 128576 - protein, 921 aa, Glycine max
  Coding DNA Sequence Number=SeqID_11798
  Gene Ontology: Mol. function=binding; Cellular component =intracellular; Biological process=metabolic process
  Homolog annotation: Hit_ID=Q2QNV4; Match level="QueryCoverage=93%, HitCoverage=64%, E-value=0.0, Identity=36%"; Hit description =Pentatricopeptide, putative, expressed
  Pfam annotation: Domain name=PPR; Domain location=104-138; Score=8.2; E_value=0.79; Accession=PF01535.11; Description=PPR repeat
  Pfam annotation: Domain name=PPR; Domain location=170-204; Score =21.0; E_value=0.0044; Accession=PF01535.11; Description=PPR repeat
  Pfam annotation: Domain name=PPR; Domain location=272-306; Score =34.4; E_value=3.9e-07; Accession=PF01535.11; Description=PPR repeat
  Pfam annotation: Domain name=PPR; Domain location=307-341; Score=6.8; E_value=1.2; Accession=PF01535.11; Description=PPR repeat
  Pfam annotation: Domain name=PPR; Domain location=373-407; Score =46.8; E_value=7.3e-11; Accession=PF01535.11; Description=PPR repeat
  Pfam annotation: Domain name=PPR; Domain location=474-508; Score =31.5; E_value=2.9e-06; Accession=PF01535.11; Description=PPR repeat
  Pfam annotation: Domain name=PPR; Domain location=575-609; Score =43.7; E_value=6.5e-10; Accession=PF01535.11; Description=PPR repeat
  Pfam annotation: Domain name=PPR; Domain location=676-710; Score =43.8; E_value=6e-10; Accession=PF01535.11; Description=PPR repeat
  Pfam annotation: Domain name=PPR; Domain location=69-103; Score=0.2; E_value=7.2; Accession=PF01535.11; Description=PPR repeat
  Pfam annotation: Domain name=PPR; Domain location=777-811; Score =47.0; E_value=6.4e-11; Accession=PF01535.11; Description=PPR repeat
  Pfam annotation: Domain name=PPR; Domain location=812-846; Score =14.8; E_value=0.13; Accession=PF01535.11; Description=PPR repeat
  Pfam annotation: Domain name=PPR; Domain location=848-882; Score=0.0; E_value=7.4; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=104-138::170 -204::272-306::307-341::373-407::474-508::575-609::676-710::69 -103::777-811::812-846::848-882
MNETETNIRDNYQRLPSMLISSLSLRPFFFLCPKAYSFPRQCKFPLQNFPKPIFNDHKLLSGNLSFAAFSNTALSYAYSNDEGEANGINFLHLMEERGVRANSQTYLWLLDGCLSSGWFSDGWKLHGKILKMGFCAEVVLCERLMDLYIAFGDLDGAVTVFDEMPVRPLSCWNKVLHRFVAGKMAGRVLGLFRRMLQEKVKPDERTYAGVLRGCGGGDVPFHCVEKIHARTITHGYENSLFVCNPLIDLYFKNGFLNSAKKVFDGLQKRDSVSWVAMLSGLSQSGCEEEAVLLFCQMHTSGVYPTPYIFSSVLSACTKVEFYKVGEQLHGLVLKQGFSLETYVCNALVTLYSRLGNFIPAEQVFNAMLQRDEVSYNSLISGLSQQGYSDKALELFKKMCLDCLKPDCVTVASLLSACSSVGALLVGKQFHSYAIKAGMSSDIILEGALLDLYVKCSDIKTAHEFFLSTETENVVLWNVMLVAYGLLDNLNESFKIFTQMQMEGIEPNQFTYPSILRTCSSLRAVDLGEQIHTQVLKTGFQFNVYVSSVLIDMYAKLGKLDHALKIFRRLKEKDVVSWTAMIAGYAQHEKFAEALNLFKEMQDQGIHSDNIGFASAISACAGIQALNQGQQIHAQACVSGYSDDLSVGNALVSLYARCGKVRDAYFAFDKIFSKDNISWNSLISGFAQSGHCEEALSLFSQMSKAGQEINSFTFGPAVSAAANVANVKLGKQIHAMIIKTGHDSETEVSNVLITLYAKCGNIDDAERQFFEMPEKNEISWNAMLTGYSQHGHGFKALSLFEDMKQLGVLPNHVTFVGVLSACSHVGLVDEGIKYFQSMREVHGLVPKPEHYACVVDLLGRSGLLSRARRFVEEMPIQPDAMVCRTLLSACIVHKNIDIGEFAASHLLELEPKDSATYVLLSN

SEQ ID NO: 128577 - protein, 89 aa, Glycine max
  Coding DNA Sequence Number=SeqID_11799
MTYLLVGNEIKREKGSKKLNNGSLGATVFVVPVSFVFLKMRVKVFGEDISMALYGILGCLPAALSICPELGMGRRSIGRDPSLYLRPSL

SEQ ID NO: 128578 - protein, 80 aa, Glycine max
  Coding DNA Sequence Number=SeqID_11800
MNTMHNRNKKEHRNIGEGQKRERTHTRWCRRRDGIGVGCRQHAAELVGIVSASLKAQGCRCLEAEGSFAIKSGGGGSMQR

SEQ ID NO: 128579 - protein, 299 aa, Glycine max
  Coding DNA Sequence Number=SeqID_11801
MGVKYLEVIKRGSHPNKQMVPGRNLGMTPGKPKVSLEHHGLCQSLPLEKFGNSGGEWATTPRGFALSVILGDEVKLPNVASATVALIEAMKSNHQLSSKVGSVLAKLLRTRLDGDELFKCCKDLQEEKNNLVGKVEDVAMEKDELTKKVANLKARLKESESMLDEFELWAARERKASKELEGELFIYKKEVEFFAKDLDLCLFDPLNYVNDNFLLDKEEIVAEEKGSREEKQNLVDVEVLSLIWWCFLVLCKASPLMLVRNQGDALGFVEVCTKGMPCGVTTLRDYGMREAILAYEVFL

SEQ ID NO: 128580 - protein, 92 aa, Glycine max
  Coding DNA Sequence Number=SeqID_11802
MPIKNHDQGGGEVYLETPHMQVWPPSCHSHEGLLHHKASPWCILLQNPRHLLGLLTRNNYDEHHQRSKFNKTNYHQTIWQDLQSGGSHTYSS

SEQ ID NO: 128581 - protein, 107 aa, Glycine max
  Coding DNA Sequence Number=SeqID_11803
MADLEEVFRELHKYDMHLNPIKSNPNKCTAILEMRCLTNVQEVQKLNGRLASLSRFLQKITKKVKPFYKLLKKTKPFSWDETCEQAFLAFKKTIATPLVLSLPSLSG

SEQ ID NO: 128582 - protein, 199 aa, Glycine max
  Coding DNA Sequence Number=SeqID_11804
MAAKRIGPHSDVGYQRCICAHGLSYVHCPGLSPNCSLTSSSMGFGPLLEVLLHGSISNSSSKMAWYMVRAQIRGLSFMLMTWSTFNHCGVRLSKLPASCLYSFAYEAKEWTGMRDLEHHEACDDDGDNHGVVLVHGVDTLEVVTCAFVVGIAIYLNLSLYLFFCPHHDSYANSLGVLQGPTVFCIVIDTMMVSTVFGRI

SEQ ID NO: 128583 - protein, 87 aa, Glycine max
  Coding DNA Sequence Number=SeqID_11805
MMSIMNLKVAQLLDDLKMNDVERKKQFHTTKRKKETETEGTTAYELTGPLSSLQLHTAKWPLVSYQPKHPRVMLPNFQKLNKFNCED

SEQ ID NO: 128584 - protein, 108 aa, Glycine max
  Coding DNA Sequence Number=SeqID_11806
MDRFGRIVVKIQNLNPKVALHAMVLALRPGMFVDSLCKNTSDDMDELCERAKGYIQMEEMSRFQNKVKQARQKHDKREENAKIDSHKLDKRHKPDKRQPLLKGPRYEH

SEQ ID NO: 128585 - protein, 91 aa, Glycine max
  Coding DNA Sequence Number=SeqID_11807
EIRHLSESPTEGQEARQERFARLKTVLDSVDSRLDQAREIDRVRDNERARLRAEMDHDCDRWRALERKNAQMRLKVNELNLKKRGPLIKFK

SEQ ID NO: 128586 - protein, 101 aa, Glycine max
  Coding DNA Sequence Number=SeqID_11808
MTTSGRTSSGSGEGQFRKKFFRKLLLEDLLPECVVNFWMWLYDNLNVLVYDAYVLKMDEDQWRYDFAMSQEVHMDYDYDNQEECGVNERHVDCSNAFNTSQ

SEQ ID NO: 128587 - protein, 398 aa, Glycine max
  Coding DNA Sequence Number=SeqID_11809
  Gene Ontology: Mol. function=hydrolase activity, hydrolyzing O -glycosyl compounds; Cellular component=membrane; Biological process =carbohydrate metabolic process
  Homolog annotation: Hit_ID=Q6TQD7; Match level="QueryCoverage=99%, HitCoverage=79%, E-value=1e-169, Identity=74%"; Hit description=Beta- 1,3-glucanase, acidic
  Pfam annotation: Domain name=Glyco_hydro_17; Domain location=8-345; Score=223.5; E_value=4.6e-64; Accession=PF00332.9; Description =Glycosyl hydrolases family 17
MVIMGKGLGVNWGTQATHQLRADTVVEMLKDNGIQKVKLFDADESSMSALSGSGIEVMVAIPNNQLAEMNDYDRALQWVKKNVTRYNFRGGVNIKVSICECGMFLNLRESKMYVAVGNEPFLKSYNGSFLNITLPALQNIQNALNDAGLGDSIKATVPLNADVYESPPNSPVPSAGIFRPDISDLMTQIVQFLAKNKAPFTVNIYPFLSLYGNDNFPFDYAFFDGVANPIIDNGVSYTNVFDANFDTLVSALKKVGYGNMPVLVGEVGWPTDGDKNANVGNAFRFYNGLLPRLAMNKGTPLRPGFIEVYLFGLIDEDAKNIAPGNFERHWGIFGYDGKPKFPMDLSGKGQKKVLVGAQNVHYLEPNWCMFNPDAQDLSKLADNINYACTLADCTALGY

SEQ ID NO: 128588 - protein, 442 aa, Glycine max
  Coding DNA Sequence Number=SeqID_11810
  Gene Ontology: Mol. function=transcription regulator activity; Cellular component=nucleus; Biological process=regulation of transcription, DNA-dependent
  Homolog annotation: Hit_ID=Q9FK48; Match level="QueryCoverage=75%, HitCoverage=29%, E-value=5e-39, Identity=36%"; Hit description =Similarity to transcription regulator
  Subcellular localization annotation: CTP_CleavageSite=82; ConfidenceScore=5.50e-01
MYSTEQADDTASQDSNSDIVAGTPPPKSSIVSPTTTTPAGNFSTPVSMNVPMPNLSSPPAIASAMPGSNSVRSSLEISSPVNASSFVNQSSTMKEEEINSFPGQRPSPSLSDVALVRNISRNSLSNQATNNIPLVSGNMVSSNGPLGSVPSASEITKRNILVVDDRLGSNGMVQPLVSPLSNRMIMPQVARPNDGTSSVDSSSVNEAATVSGRVFSPSAVPGMQWRPGSPFQNQNDVIRQAKTIYILMYINYKIFRVLRPIYMENNYMGAHIYICRTEIALMIRGRTEIAPDQRERYLQKLQQVQQQGQSALLNMPSFVGGNSKQFSAQQQNPLLQQFNSQGSSVASQSSVGLGVQSPGLSGIASTSLPQPPNSVHSPSSQQSLLLVVSKDADVGNSKVDEPQLHIFPDDSGTESTASTGIGKNFVNEDELKSTYAVDSPVC

SEQ ID NO: 128589 - protein, 319 aa, Glycine max
  Coding DNA Sequence Number=SeqID_11811
  Gene Ontology: Mol. function=zinc ion binding; Biological process =cell redox homeostasis
  Homolog annotation: Hit_ID=Q1S8X5; Match level="QueryCoverage=95%, HitCoverage=92%, E-value=3e-46, Identity=36%"; Hit description=Zinc finger, RING-type; RINGv
  Pfam annotation: Domain name=zf-C3HC4; Domain location=228-268; Score= 44.2; E_value=4.3e-10; Accession=PF00097.15; Description=Zinc finger, C3HC4 type (RING finger)
MENDIEGVHWCNICSKMVNPMSDDENICPFCETEFSEVMDNLRDQNDVFDLRSAWVFSLYAPIFLGLMGAFSPSLARIAPHGGSSSSRGVEEEVEQERENELVLGRRRRTSTYMMHLFRGLHIRMVSELENPEDNNRNMDGSSILVIDPFSEGALIVRGPNLSHTTSSNENNAVGSSLNDLVVGSGFDLLLQHLAQIGPGGYSSVNPPAQKAAIEALPSVTSEEKFQCPVCLEDVEVGSEAKEMPCMHKFHGDCIVSWLKLHGSCPVCRFQMPSEDSTLEANVDNRNSELVRAGEERPRNGRRNWFPVLQSFNNFLPYP

SEQ ID NO: 128590 - protein, 114 aa, Glycine max
  Coding DNA Sequence Number=SeqID_11812
  Gene Ontology: Mol. function=pyruvate kinase activity; Cellular component=mitochondrion; Biological process=glycolysis
  Homolog annotation: Hit_ID=Q10M32; Match level="QueryCoverage=85%, HitCoverage=21%, E-value=6e-39, Identity=79%"; Hit description =Pyruvate kinase, cytosolic isozyme, putative
  Pfam annotation: Domain name=PK; Domain location=2-114; Score=-210.2; E_value=8.4e-05; Accession=PF00224.11; Description=Pyruvate kinase, barrel domain
MSSLSFSVRLEDQHPLQGPEIRTGFLKQGKPIEIQRGQEITITTDYSIKGDENMISMSYNKLAHHLSPESNILCADGTISFTVLECDMENGLVRCRCENSAVLGERKNVNLPGV

SEQ ID NO: 128591 - protein, 95 aa, Glycine max
  Coding DNA Sequence Number=SeqID_11813
  Gene Ontology: Mol. function=pyruvate kinase activity; Cellular component=mitochondrion; Biological process=glycolysis
  Homolog annotation: Hit_ID=Q5F2M7; Match level="QueryCoverage=98%, HitCoverage=23%, E-value=4e-33, Identity=86%"; Hit description =Pyruvate kinase
MLGLYFATSFEVVPPLVSTKIRAALLQYAVLTAAEAMLSKGLIGVGAGHGLNSNVWIGSCRSFPAKHNTVCAIKDCISNIGGLGSRRPGRFDHGL

SEQ ID NO: 128592 - protein, 138 aa, Glycine max
  Coding DNA Sequence Number=SeqID_11814
MTNLVSGVQEHTNIVLSGNADRIKLFHDNRKSCQLPPLQNILHFEHPPSNIILRRTVARNRLTTIETKIKGVLLRTWRGGDCWWWFLGSGLELARKRKVERHCCCCEHFGAVAESERDGVGECKRKSGKQERRWSVRN

SEQ ID NO: 128593 - protein, 298 aa, Glycine max
  Coding DNA Sequence Number=SeqID_11815
  Gene Ontology: Mol. function=DNA binding; Biological process =regulation of transcription
  Homolog annotation: Hit_ID=Q9SQQ9; Match level="QueryCoverage=96%, HitCoverage=68%, E-value=4e-52, Identity=45%"; Hit description =Transfactor-like
MEAAARISEASGVQMKHLSIGLQTNKNSEINDALQMQIEVQRRLHEQLEVQRHLQLRIEAQGKYLQAVLEKAQETLGRQNIGAEGVEATKVQLSELASRVSPQSLDSRFSELKELQVLWPQQTQEGQATDCSMGSFLTYSEESQRDRETHNMNLNLRAYNGPPFSVSKGSVEESMHLKPDHTLCDEVKENLMFLSSSSDSKVVKGDFLSERPSSLLSMNEGVQEEENFGRTTVPKEEGWKGRKSTETGRAPVKLNHEKISQDYRLANFEVKLDLNSHDDNDASSHCQQFDLNGFSWNC

SEQ ID NO: 128594 - protein, 216 aa, Glycine max
  Coding DNA Sequence Number=SeqID_11816
  Gene Ontology: Mol. function=pyruvate kinase activity; Cellular component=mitochondrion; Biological process=glycolysis
  Homolog annotation: Hit_ID=Q1T2K7; Match level="QueryCoverage=99%, HitCoverage=53%, E-value=1e-77, Identity=59%"; Hit description =Pyruvate kinase
  Pfam annotation: Domain name=PK; Domain location=1-125; Score=-44.1; E_value=2.4e-14; Accession=PF00224.11; Description=Pyruvate kinase, barrel domain
  Pfam annotation: Domain name=PK_C; Domain location=128-215; Score= -19.0; E_value=0.00039; Accession=PF02887.6; Description=Pyruvate kinase, alphabeta domain
  Pfam module annotation: Pfam domain module=PK::PK_C; Domain location =1-125::128-215
VENQEGVANFDEILANSDAFMVARGDLGMEIPIEKIFLAQKVMKHKSSIQGKPVVTATQMLESAIKSPRPTRAEATNVANTVLDGTDCVMLSGETAAGAYPDIAVQTMARICSEAESFIDSTDLFRRVIETAPTPMSPLESMVSAAETPLRHSLIYRGLIPVLGTGSYGDSMTKSTEETIELALSYAKKNDLCKTGDSVVALHRLESSTVIKILDV

SEQ ID NO: 128595 - protein, 300 aa, Glycine max
  Coding DNA Sequence Number=SeqID_11817
  Gene Ontology: Mol. function=amino acid-polyamine transporter activity; Cellular component=membrane; Biological process=amino acid transport
  Homolog annotation: Hit_ID=O22778; Match level="QueryCoverage=99%, HitCoverage=64%, E-value=1e-86, Identity=57%"; Hit description =Putative tyrosine-specific transport protein
  Pfam annotation: Domain name=Trp_Tyr_perm; Domain location=1-300; Score=-38.3; E_value=1.8e-12; Accession=PF03222.4; Description =Tryptophantyrosine permease family
TIDVANRLLCFLMLFSITGLVAIGISVARANIISSFALASWKISSILPIIPVAVLTLGFHVITPFICKVAGNTIDEARKAILIGGTVPLVMVLSWNLIVLGLVGTNNIPATFGDPMSLLLSVNPSALSAVQGFAFSAMATSLIGYAVSLPKQLLDTLELVSEKAKACDEHNYSGKVGLASYSGGSCIGNSGKVCFKGSRNVTMVASTMRSNEQACDPIKVLVTLSLLGFSVLIASFFRSMFSRALDLAGVYANCFLFGIIPPVMAYMQQSKKKIRKSIIPGGNGTLLLLFIVSVVLGIWH

SEQ ID NO: 128596 - protein, 161 aa, Glycine max
  Coding DNA Sequence Number=SeqID_11818
MGSRKPRGPKDLLNMKIVKKSRSKQPIRVVRRRIQSEEYAASEIQRQTHHRGSNKKSNESYKSTESMEEIVIPGDIPELDSLVVYEKELCSDFFSNGTGCLEPSGERRKKNGHKSCNKDESHDLNKSITDFVIPGDVPAIDSLMVFDNNFFSDFFTNIPVF

SEQ ID NO: 128597 - protein, 156 aa, Glycine max
  Coding DNA Sequence Number=SeqID_11819
  Gene Ontology: Mol. function=amino acid-polyamine transporter activity; Cellular component=membrane; Biological process=amino acid transport
  Homolog annotation: Hit_ID=O22778; Match level="QueryCoverage=52%, HitCoverage=18%, E-value=8e-25, Identity=65%"; Hit description =Putative tyrosine-specific transport protein
METQEAIIGGARSNSRTHLQTSYKKTVAPIFITNGSNAPLTTKLAPCNAITLPTLSAEDDANNANNRTKNEVSNGTSKGKSFWGAVSLIIGTAVGPGMLALPALTVKSGPFPSSIIILASWLYVISSIIIVAELCFESMEQDGVEEMSFTSLQQRH

SEQ ID NO: 128598 - protein, 123 aa, Glycine max
  Coding DNA Sequence Number=SeqID_11820
  Gene Ontology: Mol. function=hydrolase activity, acting on glycosyl bonds; Cellular component=beta-galactosidase complex; Biological process=carbohydrate metabolic process
  Homolog annotation: Hit_ID=Q4QYX3; Match level="QueryCoverage=83%, HitCoverage=12%, E-value=1e-44, Identity=79%"; Hit description=Beta -galactosidase
  Pfam annotation: Domain name=Glyco_hydro_35; Domain location=30-123; Score=-121.6; E_value=2.2e-07; Accession=PF01301.10; Description =Glycosyl hydrolases family 35
MGSITTLLLLCLALISIAIEAIDVSYDGRAITIDGKRKILFSGSIHYPRSTAEMWPSLIEKSKEGGLDVIETYVFWNVHEPHPGQYDFSGNLDLVRFIKTIQNQGLYAVLRIGPYVCAEWNYG

SEQ ID NO: 128599 - protein, 130 aa, Glycine max
  Coding DNA Sequence Number=SeqID_11821
  Homolog annotation: Hit_ID=O48579; Match level="QueryCoverage=42%, HitCoverage=2%, E-value=1e-15, Identity=65%"; Hit description=Mi-2 autoantigen-like protein
MVFYMAVEHFLIHKRKARSLSVVMKDIKVFYMASEHFLIHVQKEGSKSPSGIRSGRQEIKQVVHLAKVVLERDACQQYKMFKAECIYQTEKLTSMAFINQEKFPRNSGKEEESARIILDFCCCDYKPWDL

SEQ ID NO: 128600 - protein, 289 aa, Glycine max
  Coding DNA Sequence Number=SeqID_11822
  Gene Ontology: Mol. function=beta-galactosidase activity; Cellular component=beta-galactosidase complex; Biological process =carbohydrate metabolic process
  Homolog annotation: Hit_ID=Q4QYX3; Match level="QueryCoverage=99%, HitCoverage=35%, E-value=1e-127, Identity=69%"; Hit description=Beta- galactosidase
  Pfam annotation: Domain name=Glyco_hydro_35; Domain location=1-213; Score=263.6; E_value=3.9e-76; Accession=PF01301.10; Description =Glycosyl hydrolases family 35
GFPVWLHNIPNIEFRTNNAIFEDEMKKFTTLIVDMMRHEKLFASQGGPIILAQIENEYGNIMGSYGQNGKEYVQWCAQLAQSYQIGVPWIMCQQSDAPDPLINTCNGFYCDQWHPNSNNKPKMWTEDWTGWFMHWGGPTPHRTAEDVAFAVGRFFQYGGTFQNYYMYHGGTNFGRTSGGPYITTSYDYDAPLNEYGDLNQPKWGHLKRLHEVLKSVETTLTMGSSRNIDYGNQMTATIFSYAGQSVCFLGNAHPSMDANINFQNTQYTIPAWSVSILPDCYTEVYNTAK

SEQ ID NO: 128601 - protein, 66 aa, Glycine max
  Coding DNA Sequence Number=SeqID_11823
MEKLSEEAMDAKSELSNHHTIPKKESHNNDLNPPSEGQNFFCCSLISTISEVPNNVNIEGGCIMTF

SEQ ID NO: 128602 - protein, 400 aa, Glycine max
  Coding DNA Sequence Number=SeqID_11824
  Gene Ontology: Mol. function=beta-galactosidase activity; Cellular component=beta-galactosidase complex; Biological process =carbohydrate metabolic process
  Homolog annotation: Hit_ID=Q1RTL3; Match level="QueryCoverage=94%, HitCoverage=47%, E-value=1e-104, Identity=47%"; Hit description=D -galactoside/L-rhamnose binding SUEL lectin; Galactose-binding like
  Pfam annotation: Domain name=Gal_Lectin; Domain location=312-389; Score=73.7; E_value=5.8e-19; Accession=PF02140.8; Description =Galactose binding lectin domain
MTINNENSYALDWQWMPETHLEQMKDGKVLGSVAITAPRLLDQKVANDTSDYLWYITSVDVKQGDPILSHDLKIRVNTKGHVLHVFVNGAHIGSQYATYGKYTFTFEADIKLKLGKNEISLVSGTVGLPNYGAYFDNIHVGVTGVQLVSQNDGSEVTKDISTNVWHYKVGMHGENVKLYSPSRSTEEWFTNGLQAHKIFMWYKTTFRTPVGTDSVVLDLKGLGKGQAWVNGEDGCSSTCDYRGTYRSNKCTTNCGNPTQRWYHVPDSFLRDGLDNTLVVFEEQGGNPFQVKIATVTIAKACAKAYEGHELELACKENQVISEIKFASFGVPEGECGSFKKGHCESSDTLSIVKRLCLGKQQCSIQVNEKMLGPTGCRVPENRLAIDALCQTTVSNERRKY

SEQ ID NO: 128603 - protein, 59 aa, Glycine max
  Coding DNA Sequence Number=SeqID_11825
MKSGDTRDYLMVFTLVVRKHSSPTTREILLYWAGTIECNGVGSAGGDIDRPNDVPLERN

SEQ ID NO: 128604 - protein, 138 aa, Glycine max
  Coding DNA Sequence Number=SeqID_11826
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=79%, HitCoverage=18%, E-value=3e-54, Identity=77%"; Hit description =Photosystem I P700 chlorophyll a apoprotein A1
GGKVALLPIPLGTADFLVHHIHAFTIHVTVLILLKGVLFARSSRLIPDKANLGFRFPCDGPGRGGTCQSDVWGSISDQGIVNHITGGNFAQSSITINGWLRDFLWAQASQDPLHVRPIAHAIWDPHFGQPAVEAFTRG

SEQ ID NO: 128605 - protein, 412 aa, Glycine max
  Coding DNA Sequence Number=SeqID_11827
  Gene Ontology: Mol. function=DNA binding; Cellular component=nucleus; Biological process=regulation of transcription
  Homolog annotation: Hit_ID=Q9SQQ6; Match level="QueryCoverage=47%, HitCoverage=55%, E-value=2e-75, Identity=71%"; Hit description=NAM -like protein
  Pfam annotation: Domain name=NAM; Domain location=25-152; Score =290.2; E_value=4e-84; Accession=PF02365.6; Description=No apical meristem (NAM) protein
LFDDGEPVVVNKGDDHDHDHEPLDLPPGFRFHPTDEEIITCYLTEKVLNRTFSATAIGEADFNKCEPWDLPKKAKMGEKDWYFFCQRDRKYPTGMRTNRATQSGYWKATGKDKEIFKGKNNLVGMKKTLVFYRGRAPKGEKSNWVMHEFRLDGKFACYNLPKASKDEWVVCKVFHKGNTTTTDVVNKRALPIINPCLLRMNSSIGEDLFDFSSLPPLVDPLFDQTSNKHIDNDFKGTNNTPSSSSAKPPSSGYYLPNFINNNNNQHMLMMMKPEEHKMYEIPTNNYASTSQVNFTTTNNPIMGISTGNNNTLLSQPQIRTQNSTSVPFNMFQDYYNYMNQGKQCKMEQFSNTKNQPVVSASQDTCLSNDTSSVVSKQDNNIGRNKALYEDNFEAPSSVATTLSDLECLWDDY

SEQ ID NO: 128606 - protein, 45 aa, Glycine max
  Coding DNA Sequence Number=SeqID_11828
MGQVTLPLFPCYWHPKGHHVEVKMSAQIKDLDLGIQAFGFECKKA

SEQ ID NO: 128607 - protein, 133 aa, Glycine max
  Coding DNA Sequence Number=SeqID_11829
MATQTVEDNSRSGPRRTVVGELNEGPREVGAEQPFSSFFKYRCTGYSPSCAAPRITAFIASTADSIASPPTPLTDEVPLAFSSFSLTMSYAFTKGKKAGQKMVAWNSTLTMGQIPIGTDPEEPHLSQAQADPT

SEQ ID NO: 128608 - protein, 116 aa, Glycine max
  Coding DNA Sequence Number=SeqID_11830
  Gene Ontology: Cellular component=microtubule organizing center; Biological process=microtubule cytoskeleton organization and biogenesis
  Homolog annotation: Hit_ID=Q9FG37; Match level="QueryCoverage=76%, HitCoverage=11%, E-value=9e-09, Identity=42%"; Hit description=Gamma- tubulin interacting protein-like
MQWLVGDCWFGEIEVGEESGGDGVVVAIFGDDFEEVEEGPFFVDTLGFGGEFGEEVSEGEGLGGVAVGGEAALDGVGDGDGVVGNGGGEATGEDVEGVAEAPLPLQCEFLLHLPKF

SEQ ID NO: 128609 - protein, 828 aa, Glycine max
  Coding DNA Sequence Number=SeqID_11831
  Gene Ontology: Mol. function=hydrolase activity, acting on glycosyl bonds; Cellular component=beta-galactosidase complex; Biological process=carbohydrate metabolic process
  Homolog annotation: Hit_ID=Q4QYX3; Match level="QueryCoverage=95%, HitCoverage=97%, E-value=0.0, Identity=59%"; Hit description=Beta -galactosidase
  Pfam annotation: Domain name=Gal_Lectin; Domain location=740-817; Score=69.9; E_value=7.9e-18; Accession=PF02140.8; Description =Galactose binding lectin domain
  Pfam annotation: Domain name=Glyco_hydro_35; Domain location=30-336; Score=637.2; E_value=1.4e-188; Accession=PF01301.10; Description =Glycosyl hydrolases family 35
  Pfam annotation: Domain name=Glyco_hydro_42; Domain location=51-364; Score=-237.4; E_value=0.0084; Accession=PF02449.6; Description=Beta -galactosidase
  Pfam module annotation: Pfam domain module=Gal_Lectin::Glyco_hydro _35::Glyco_hydro_42; Domain location=740-817::30-336::51-364
MGSITTLLLLCSALISIAIEAIDVSYDGRAITIDGKRKILFSGSIHYPRSTAEMWPSLIEKSKEGGLDVIETYVFWNVHEPHPGQYDFSGNLDLVRFIKTIQNQGLHAVLRIGPYVCAEWNYGGFPVWLHNIPNIEFRTNNAIFEDEMKKFTTLIVDMMRHEKLFASQGGPIILAQIENEYGNIMGSYGQNGKEYVQWCAQLAQSYQIGVPWIMCQQSDTPDPLINTCNGFYCDQWHPNSNNKPKMWTEDWTGWFMHWGGPTPHRTAEDVAFAVGRFFQYGGTFQNYYMYHGGTNFGRTSGGPYITTSYDYDAPLNEYGDLNQPKWGHLKRLHEVLKSVETTLTMGSSRNIDYGNQMTATIFSYAGQSVCFLGNAHPSMDANINFQNTQYTIPAWSVSILPDCYTEVYNTAKATRPMLHVKVNAQTSIMTINNENSYALDWQWMPETHLEQMKDGKVLGSVAITAPRLLDQKVANDTSDYLWYITSVDVKQGDPILSHDLKIRVNTKGHVLHVFVNGAHIGSQYATYGKYPFTFEADIKLKLGKNEISLVSGTVGLPNYGAYFDNIHVGVTGVQLVSQNDGSEVTKDISTNVWHYKVGMHGENVKLYSPSRSSEEWFTNGLQAHKIFMWYKTTFRTPVGTDSVVLDLKGLGKGQAWVNGEDGCSSTCDYRGTYRSNKCTTNCGNPTQRWYHVPDSFLRDGLDNTLVVFEEQGGNPFQVKIATVTIAKACAKAYEGHELELACKENQVISEIRFASFGVPEGECGSFKKGHCESSDTLSIVKRLCLGKQQCSIHVNEKMLGPTGCRVPENRLAIDALCQTTVSNERRKY

SEQ ID NO: 128610 - protein, 546 aa, Glycine max
  Coding DNA Sequence Number=SeqID_11832
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q94EN5; Match level="QueryCoverage=83%, HitCoverage=92%, E-value=0.0, Identity=76%"; Hit description=Beta-1 ,3-glucanase
  Pfam annotation: Domain name=Glyco_hydro_17; Domain location=73-394; Score=349.7; E_value=4.8e-102; Accession=PF00332.9; Description =Glycosyl hydrolases family 17
  Pfam annotation: Domain name=X8; Domain location=409-494; Score =176.6; E_value=6.3e-50; Accession=PF07983.3; Description=X8 domain
  Pfam module annotation: Pfam domain module=Glyco_hydro_17::X8; Domain location=73-394::409-494
MSWTKIPLLRNDSRGIFSLVELNTVAKWFRFSPTPKCCQYEHSTLQIYGDGGSLACMSLGPSCGCENGSYAFIGVNIGTDATNMPSPTEVVALLKAQGIQHVRLYDADRAMLRTLANTGIRVIVSVPNDQILGIGQSNATAANWVARNVIAHVPATNITAIAVGSEVLTSLPNAAPVLVSALKFIQAALVAANLDQQIKVSTPHSSSVILDSFPPSQAFFNKTWDPVMVPLLNFLQSTGSYLMLNVYPYYDYMQTNGVVPLDYALFRPLPPNKEAIDSNTLLHYTNVFDAIVDAAYFAMSYLKFTNIPILVTESGWPSKGDSSEPDATVDNANTYNSNLIRHVLNNSGTPKQPGIAVSTYIYELYNEDLRSGPVSENNWGLFYANGAPVYTLHLTNSGTVFANDTTNQTFCVAKSNADTKMLQAALDWACGPGKVDCSPLLQGQPCYEPNSVASHATYAINAYYQQMAKSAGTCDFKGVASVTTTNPSHGSCIFPGSGGKNVTSVNGTALAPSTNSTNSGCLTQYYNGGFFTSSVILTLILSVVVL

SEQ ID NO: 128611 - protein, 78 aa, Glycine max
  Coding DNA Sequence Number=SeqID_11833
MQRLYSISLSNCCSKKMIKRAQCRLRHLKSKREVMAMQIGKDLSELIQNGHQETAIMRVRRYICFVIFVGTNYEMSKP

SEQ ID NO: 128612 - protein, 98 aa, Glycine max
  Coding DNA Sequence Number=SeqID_11834
  Gene Ontology: Mol. function=microtubule motor activity; Cellular component=microtubule associated complex; Biological process =microtubule-based process
  Homolog annotation: Hit_ID=Q6EP41; Match level="QueryCoverage=54%, HitCoverage=27%, E-value=7e-22, Identity=83%"; Hit description =Putative dynein light chain 2
MVQWFNSCLEEKDINLINGKVQKATNRMCNIGTKASTHNAVPSWTIRRIKFLFYPYLNVESMESHKRKVMQREWGEPYALVHPLNMYSGQRLSEESGF

SEQ ID NO: 128613 - protein, 270 aa, Glycine max
  Coding DNA Sequence Number=SeqID_11835
MQKCDNSLSVAVAVELFPSNLVYKKKYKVVDEIASDNCLQQEVKEHIGNQLVESDGETNHTIAEYTSTENSALVYSVQQYPPCGEEMEKEDFPDLQNKGETMALGPSSEGVSLLPYAEAMVEYYVEEIEESENFESKDGQEESASERSSIRVGLRKSKGAPKKRLKRRSSLLERQGTTENGCIIYYQQPCKSPSTQNYADLPCYCCFSYDKKCYSRALTMTTEQPKNYKDELLRTYSRSSPHPKHVHPKLPQCEDIVAIFTALKRERGRG

SEQ ID NO: 128614 - protein, 294 aa, Glycine max
  Coding DNA Sequence Number=SeqID_11836
MYGITKDEEGNYVTDPNEIEGMITNFYKNSKILREAPDIVSKQFSSRSIELWLVMTSARKMRNQTFITLIPKKDEVLWNGKALEDFAPSRELSHETWNPISLSKHDSPTSYLAFADGLILFAEALLEQCQFMRILTKLAGDLHGEIQLKQGESILLLGILCPLPTKARRIHLLKVRSSSGLEETYWIMPKEGPVALNCDASMVQFGEVMDCGGVIHNHAGSSVCDFQAQLRGDSILYGKLKAILHGIKLAKAIKALEGNCDHLHPHYQSIQEIHLVHGRSEGGPIVPVTALRGF

SEQ ID NO: 128615 - protein, 111 aa, Glycine max
  Coding DNA Sequence Number=SeqID_11837
MEEAEKELERRSKFLNSLIQQKKKAAIESEHEHESSLKVDVRACDMPLPLQNRAFQCARLYLESMPPANKLDSKRLALALKKDKLDVFPLVLLVRTVVESELEFHPDNLCY

SEQ ID NO: 128616 - protein, 61 aa, Glycine max
  Coding DNA Sequence Number=SeqID_11838
MDNHLGISACHLTSRVRIKQKSFVPITTWPDFTGQDDKGADDDDAEDDVSLYMLPDSESDE

SEQ ID NO: 128617 - protein, 197 aa, Glycine max
  Coding DNA Sequence Number=SeqID_11839
  Gene Ontology: Mol. function=ubiquitin-protein ligase activity; Cellular component=ubiquitin ligase complex; Biological process =protein ubiquitination
  Homolog annotation: Hit_ID=Q9AR60; Match level="QueryCoverage=56%, HitCoverage=26%, E-value=2e-20, Identity=44%"; Hit description =Photoperiod responsive protein
  Pfam annotation: Domain name=U-box; Domain location=7-81; Score=62.8; E_value=1.1e-15; Accession=PF04564.6; Description=U-box domain
MNESQNAIPHLFRCPISLDLFEDPVTLCTGQTYDRSNIEKWLAQGNLTCPVTMQKLHDPSIVPNHTLRHLIDQWLQLDPQFDPANPEASTIESLASLKLNLESYESSLENKLQALRKISVLSDEYCSFNKSCFLQLDFLPLLLELVFGTQVSPENDMNFIELALCCIKKLLPLGSLEPLNMIKDGSKLATFVLLFEK

SEQ ID NO: 128618 - protein, 182 aa, Glycine max
  Coding DNA Sequence Number=SeqID_11840
  Homolog annotation: Hit_ID=Q2HV76; Match level="QueryCoverage=66%, HitCoverage=57%, E-value=2e-09, Identity=33%"; Hit description=F-box protein interaction domain; Galactose oxidase, central
MVPSIRFWVHAEGSYFCTTRREYYFLYGFGYDPSTDDYLIVLVGFLDEFDEEPYGVPNVHIFSFKTNSWEEDSVRVPNEIFHGKFRSGSLLNETLHCVCCSVIIDCAKTEIWVMKEYKVQSSWTRIIDIPAYGISLICTTKDGGMYVSQNRPLRKINRNGEPPECLAFDGDRGLFCANLPSG

SEQ ID NO: 128619 - protein, 133 aa, Glycine max
  Coding DNA Sequence Number=SeqID_11841
  Homolog annotation: Hit_ID=Q1SN45; Match level="QueryCoverage=43%, HitCoverage=3%, E-value=1e-10, Identity=44%"; Hit description=AAA ATPase
MDNHEHANHRDTAQARIKNKGIRQHKVNDQAQNIDFNIRDSSEDDSSKSTQVSSPENQNYMSSANEPAINREGYFDLGDQLMQCSHCNANMWYDERVSKDKRTTNPRFSLCCGNGKVELPLLQNPPKYLYQLL

SEQ ID NO: 128620 - protein, 45 aa, Glycine max
  Coding DNA Sequence Number=SeqID_11842
MSQSYKKTKVTSFGTDASILLMLNEVANNLSKMYVGKGIRNGQLD

SEQ ID NO: 128621 - protein, 112 aa, Glycine max
  Coding DNA Sequence Number=SeqID_11843
MKKESFWVMVNTTPTWHRAGARPMIRSITTQHPTKDVKEALLGGSLIWITLLHSNILASNHNSDLPLPKCQLVYVILTQAQQLGQDQQQQQLATDAPLSPLQQPPSRLTCKG

SEQ ID NO: 128622 - protein, 85 aa, Glycine max
  Coding DNA Sequence Number=SeqID_11844
  Gene Ontology: Mol. function=oxidoreductase activity; Biological process=auxin mediated signaling pathway
  Homolog annotation: Hit_ID=P40691; Match level="QueryCoverage=68%, HitCoverage=18%, E-value=2e-11, Identity=77%"; Hit description=Auxin- induced protein PCNT115
MWKLEKNGESVYAGTWVHGHVDHSSMFLLSLNPDMIDLIHQAVECGVTFLDTSDIYGPHTNEVLLGKSGILPRLALLFLAGPKPG

SEQ ID NO: 128623 - protein, 122 aa, Glycine max
  Coding DNA Sequence Number=SeqID_11845
GVVLAEVLLADSRFTRPDMGFHPTKLNFVPSDADEAPLDVSICLHAFGIVGCGSFSGVKSCEREDPFHPGLFVGDAGGFQSPTREPLNVGGLVPPHCSLKSVVSDDACPGACFVQRDATTLN

SEQ ID NO: 128624 - protein, 208 aa, Glycine max
  Coding DNA Sequence Number=SeqID_11846
  Gene Ontology: Mol. function=oxidoreductase activity; Biological process=electron transport
  Homolog annotation: Hit_ID=Q9SZ83; Match level="QueryCoverage=99%, HitCoverage=56%, E-value=3e-51, Identity=47%"; Hit description =Probable oxidoreductase At4g09670
MIHSCLTYNPGPEFLKNSIRVKPDLDGLGALGDTGWYCIRAILWAVNYELPKSVLAFPGAILNEEGVIISCGSSMHWEDGRSATFHCSFLSYVTFDVTVLGTKGCLRLNDFALPFEESLGFGKFLEASELDYGKIEQGMWCPKPNEHVVETGFSQDILMVKEFADLVRKVQGCEMKPEKTWPVLSRKTQVVLDAVKESIEKGYQPVEL

SEQ ID NO: 128625 - protein, 97 aa, Glycine max
  Coding DNA Sequence Number=SeqID_11847
  Homolog annotation: Hit_ID=P93045; Match level="QueryCoverage=62%, HitCoverage=32%, E-value=7e-07, Identity=38%"; Hit description =Chromatin structure remodeling complex protein BSH
MRNSMDTNRKEVTSQFAEFRSYEGQVMYVGEKIVPIKDLDNFESDHEEFAKISTRTRALNIPRLEKIFVFYMSFFSSCAIDSLNFSCNSSFAISATL

SEQ ID NO: 128626 - protein, 41 aa, Glycine max
  Coding DNA Sequence Number=SeqID_11848
MVTVNNDSGKDGNHNDNYNDVHDNNKSDDNGKYIKKIRGLG

SEQ ID NO: 128627 - protein, 56 aa, Glycine max
  Coding DNA Sequence Number=SeqID_11849
MRTRFFFLSFGGGLVLWVLWYCGSLIALRKVMTYEVAMKIGRGVGVVVANNIDGTK

SEQ ID NO: 128628 - protein, 359 aa, Glycine max
  Coding DNA Sequence Number=SeqID_11850
  Homolog annotation: Hit_ID=Q8H612; Match level="QueryCoverage=98%, HitCoverage=65%, E-value=3e-35, Identity=29%"; Hit description =Pentatricopeptide (PPR) repeat-containing protein-like
  Pfam annotation: Domain name=DUF247; Domain location=47-342; Score= -69.8; E_value=5.7e-07; Accession=PF03140.6; Description=Plant protein of unknown function
MVENQIPTYMLLRILVLQSSKPIDSVQEYLGSMLLSFCEKHSPLKLTHTPTCSEAVTKHYHILDLMYHLVVSEHEKLETPTPESEGMCKPNSNCSNTPTRSSKSEGIVTFLNKVKGLLTWTLATLKRLKVTNIPLPQPVKRPLDAILNMPTTFQKFSSSETPPSETEAPAVVVTFPSVRELHSVGIHFQPSKGGITTIEFDEKKGIFYLPVLKLDVNSEVIMRNLVAHEALSKPDFLIFTRYTELMRGIIDTVEDVKLLKNEGILESSSSLSVEETEELFNGMSKSIGPTKTEKLDETVKKVNKYFRDKQKAKPYRILNNYVYSSWRFLTLLATFVLLAMTILQSFCSVYDCPSHFRNR

SEQ ID NO: 128629 - protein, 393 aa, Glycine max
  Coding DNA Sequence Number=SeqID_11851
  Homolog annotation: Hit_ID=Q8H612; Match level="QueryCoverage=98%, HitCoverage=78%, E-value=8e-35, Identity=40%"; Hit description =Pentatricopeptide (PPR) repeat-containing protein-like
  Pfam annotation: Domain name=DUF247; Domain location=3-390; Score =45.5; E_value=5.1e-12; Accession=PF03140.6; Description=Plant protein of unknown function
MPVCIYQVPKSLCCAKPEAFSPQLIAIGPYTHFHPELYPMERFKVFAAKGVLDHFEKHDFKQLVELLRNTGQFIRASYHKYLDFKEDTLLYVIAIDGLFLLDFFHNYLNEEVSCSFMTGLQDQVQLSGVKLTRDAIIRDIIMVENQIPTYMLLRILVLESSKPADSVLEYLGSMLLSFCKKHSPLKLTHIPTCSEAVSKHYHILDLMYHLVVSHTEKSETPTPDQSEGSVKKLKDVNIPLLKPIKRHIDTILKMSSHLESLSSNPKLSEEEEEALEVVNIPCVRELHSVGVYFQPVEGGNMAIEFDEKKGIFYLPVLKLDLNSEVIMRNLVAHEALTKPDFLIFTRYTELMRGIIDTVEDVKLLKNAGIIESNSSLGVEETEELFNGMTNVTG

SEQ ID NO: 128630 - protein, 82 aa, Glycine max
  Coding DNA Sequence Number=SeqID_11852
MAISCGEKASGLTQLNDLGTWYMQTGILFKIERLVSLTNWLIWMTQESSSDSELKIVREAIYEGGYIDEELYMNDCYSHGLQ

SEQ ID NO: 128631 - protein, 193 aa, Glycine max
  Coding DNA Sequence Number=SeqID_11853
  Gene Ontology: Mol. function=hydrolase activity; Cellular component =membrane
  Homolog annotation: Hit_ID=Q9FF10; Match level="QueryCoverage=85%, HitCoverage=29%, E-value=5e-38, Identity=46%"; Hit description =Heparanase-like protein 1 precursor
  Pfam annotation: Domain name=Glyco_hydro_79n; Domain location=1-158; Score=-94.5; E_value=1.4e-06; Accession=PF03662.4; Description =Glycosyl hydrolase family 79, N-terminal domain
MMDFSRVFYFLLVVLWPECGWQPVSLTDMITSSAVKKVYRKANLCIHPDKVQQKGATLEQKYTAEKVFDILKVNVQILNVHDSLRSNKDNDEHLERKILDPEHLSKVESIFGNLSETIKIYGPWSSAWVGEAGGAYNSGGNHVSNRFLNSFWYLDQLGIASCYSTKVYCRQTLIGGNYGLLNTTTFAPNPDYY

SEQ ID NO: 128632 - protein, 60 aa, Glycine max
  Coding DNA Sequence Number=SeqID_11854
MGKGKEKKSKIKELSIILEVGRPLGATLGSTLLLVAVMININSSFERPSVEILTVQVAIV

SEQ ID NO: 128633 - protein, 72 aa, Glycine max
  Coding DNA Sequence Number=SeqID_11855
MEFHKKTFEGQLRDVDEVGKYCLKRRELENTSTSEELKASEPMVETQQGDREKRIAKMESEEDKHHGGSGCT

SEQ ID NO: 128634 - protein, 61 aa, Glycine max
  Coding DNA Sequence Number=SeqID_11856
MVVIAALDIIVGFSSSATTTPYHCWEAGFEVDMPCFDVGSEPIYETDDEFDDFNENLDDHC

SEQ ID NO: 128635 - protein, 127 aa, Glycine max
  Coding DNA Sequence Number=SeqID_11857
MAKGKHSYTRAQGKKWSTFSLVLWALFFLTLILVLLLALGIVYLPTTDDDFPTPDLSVFRRKTSQSGESLVENSEQRTKILSWEPRAFIYHNFLRASAKRNTHGLSARKTLEEDELYRLAKSTASSH

SEQ ID NO: 128636 - protein, 76 aa, Glycine max
  Coding DNA Sequence Number=SeqID_11858
MDQDHMVAIAALDTIVGFSSSATKTPSLILQKMVCIILVFLTFPCMIVDSRTDLYEEVGNDVERGCNHGLKRMSGL

SEQ ID NO: 128637 - protein, 53 aa, Glycine max
  Coding DNA Sequence Number=SeqID_11859
DDSALGGKVRCGGAYRNDVRLRVTSEVHGVEVVDGADDGLKERGDEFARGGRA

SEQ ID NO: 128638 - protein, 42 aa, Glycine max
  Coding DNA Sequence Number=SeqID_11860
MKHINLGSHFLAMIIKVHCRCQNKAYRPQILLPDNVVVEGIH

SEQ ID NO: 128639 - protein, 86 aa, Glycine max
  Coding DNA Sequence Number=SeqID_11861
MRFWIVSKRPFRGNTGSNKDRRKSLKVYQSHTGQGLTFSPWVKVYDKLGFWLKACRTAGHDICQGLASGSGIKGMSYIISMIHMQQ

SEQ ID NO: 128640 - protein, 328 aa, Glycine max
  Coding DNA Sequence Number=SeqID_11862
  Gene Ontology: Mol. function=oxygen transporter activity; Cellular component=flagellin-based flagellum; Biological process=flagellum organization and biogenesis
  Homolog annotation: Hit_ID=UPI00005F8D0B; Match level="QueryCoverage =98%, HitCoverage=69%, E-value=3e-89, Identity=54%"; Hit description =COG1345: Flagellar capping protein
  Pfam annotation: Domain name=Flagellin_IN; Domain location=4-46; Score=22.5; E_value=0.0015; Accession=PF07196.3; Description =Flagellin hook IN motif
  Pfam annotation: Domain name=FliD_C; Domain location=83-314; Score =228.8; E_value=1.2e-65; Accession=PF07195.2; Description=Flagellar hook-associated protein 2 C-
  Pfam module annotation: Pfam domain module=Flagellin_IN::FliD_C; Domain location=4-46::83-314
MTITLSKDQTSLTDIKDAINKQQGSVTASIIKSDDNTYYLALTSRDTGTTNEMTVSTDDSALAQYIGFTKGGSSNGMTEQVTAADAKLSINGVAITRSSNTITDAPEGVTLNLTKTNTGSPETLSVTKDNAPMIAAVQAYVDAYNSLQTTISNQTKYTAVDQGSTSQDTSNGDLLGDGTLRNIQTSLRSKLSTSAQSGGSISLLSQIGITQDINGKLTVDSTKLNKALDEKSADVVTFLSGDGKTTGFATQTSNYLDQILGTDGSVQNATDGINKTLKKLSDDYDRVNAQITATMARYKTQFTNLNTLVSSMTQTQNYLTQQFAAMSS

SEQ ID NO: 128641 - protein, 52 aa, Glycine max
  Coding DNA Sequence Number=SeqID_11863
MVIVREARLESPKSPSLLVALLDSSDCALASWVTSTEKLPAAASLASVAVNA

SEQ ID NO: 128642 - protein, 49 aa, Glycine max
  Coding DNA Sequence Number=SeqID_11864
GITYYSILLGCPRCRKVVFYVSYPNFVRGPLLDDIRLFFGPCEVLGTHH

SEQ ID NO: 128643 - protein, 107 aa, Glycine max
  Coding DNA Sequence Number=SeqID_11865
MASRKRKSIGTRPTSQYDTRSSEGPSPKQVRVRGHVVKIDVDSLNTFLETPVVLAEGETLPAYSRYCRLPADIREIEVALCIPGRGFVLNAEGHAGNILRKDSTTLA

SEQ ID NO: 128644 - protein, 259 aa, Glycine max
  Coding DNA Sequence Number=SeqID_11866
  Subcellular localization annotation: CTP_CleavageSite=32; ConfidenceScore=5.36e-01
GSSSTTTAAGHRCHGTSEDPPTPVLPSLSSPRSSTLFSSDDQRQRYFSQFCNRVILDPKYLDLEFFDGETFDCYQVHNIPIVIDQSLFYSLTKLLSQGVPFEGTLVDGWKFDYSSHDARRMALQANAPLLYPHLVTLFLHHFNVPLDDEPYVKVKRSFSIGVGAVTSFGYRKDVDGQWVHKQDLPSPIPDERTPSPPPQRDTSSSLLIEVLTELHDLRAFVGEHFDVMDTRFDGMDTHIIRLGDDMSFIRRFFDPPTDS

SEQ ID NO: 128645 - protein, 171 aa, Glycine max
  Coding DNA Sequence Number=SeqID_11867
  Gene Ontology: Mol. function=zinc ion binding
  Homolog annotation: Hit_ID=Q1SP42; Match level="QueryCoverage=94%, HitCoverage=33%, E-value=5e-58, Identity=82%"; Hit description=Zinc finger, RING-type; RINGv
MGSRIHRLNERRMRHSRSEIWERLRGGFDEIGRWNSCPLGIHADGMCFCESSPMAEESSTRASISRIVMLAEALFEVLDEIHRQPGSLSLSMVSLPAPESIVDSLPLKSHKKVDGADVGNDAEHFHFINNNLLSFPLFTVYVLCVAAMSVEGPQSLLPTRKCSLIDIVHRM

SEQ ID NO: 128646 - protein, 505 aa, Glycine max
  Coding DNA Sequence Number=SeqID_11868
MVYSYYTPTYYSTLHDSLTSLCKTILPFSFKKRPLPAAEHKLSKLQSGNLKWQQDSFHQVLNLMGLHKEGIVAESEVSAFRTHLLDTLIASPPEQEHPVILRDKLLFLQELLYAKCISEEEYHSSKRPLLRRLAAQGAQIEARDVIVAGPKDSKENSEEEWSVIDLKDEKCSVNKENSGCKSKSNPGSAMKQIKGAASVFGFGKGGKNGAEKSIFDSPSLSAKNESRENPFWDLQTKEKQSEGGSILMEESGPPEPVKESNGLDKLKRKPFRTLFHKEQSGCPEQDQRSGKSGKKQWGFEGFKKWRRNESEDETAPLPRNEKSDSEAYSGSLAKALGEGPHTKLIKKKLHSDGSPSDFFIDKVLGDKIKKELSRIQTELSSTNPNLKFSNDQIEAISTRIPVDKAELKNYFPKSWCDRYGDVVLDVVKKEFKDHVAEMENMRSIAREKHSNSRRWTTTTTFDDDENLHPNLFDHRDNNSVRSRNINPFSHVFGSRFTNNEEKEME

SEQ ID NO: 128647 - protein, 57 aa, Glycine max
  Coding DNA Sequence Number=SeqID_11869
MAFVFGCLAFKLRLRSTPLLSLSSLPFIYIDTPFFSHSLGQRLERGARQGRAFQAEE

SEQ ID NO: 128648 - protein, 398 aa, Glycine max
  Coding DNA Sequence Number=SeqID_11870
  Gene Ontology: Mol. function=nucleoside transporter activity; Cellular component=membrane; Biological process=transport
  Homolog annotation: Hit_ID=Q7XAU2; Match level="QueryCoverage=92%, HitCoverage=91%, E-value=2e-99, Identity=52%"; Hit description =Equilibrative nucleoside transporter ENT8 splice variant
  Pfam annotation: Domain name=MFS_1; Domain location=21-397; Score= -22.0; E_value=0.0032; Accession=PF07690.6; Description=Major Facilitator Superfamily
  Pfam annotation: Domain name=Nucleoside_tran; Domain location=127 -398; Score=233.4; E_value=4.8e-67; Accession=PF01733.8; Description =Nucleoside transporter
  Pfam module annotation: Pfam domain module=MFS_1::Nucleoside_tran; Domain location=21-397::127-398
MEAVKLVSSDPSERPDTYRVAYIIHFLLGAGNLLPWNALITAVDYFAYLYPTKHIEKVFSVAYMISSVMVLLGMISWGGWSKTTLRLRMNLGFSMFVMSLMVAPVIDWTSSSTKLNERPSGAYGLTVAAVVICGLADGLVGGSLIGSAGKLPKQYMQAVFAGTASSGIIISILRIITKASLPQTPKGLKISAHLYFMVATIFLLCCVIFSNLQHKLPVMQQYHQRLHQESTLCTGTKFWAVAGKIKGAAFGIFIIYIVTLSIFPGFIAEDLESKLLRDWYPILLITVYNLADLIGKSLTAFYVMQSMTRAIWVATARLLFYPLFVVCLHGPKWLKTEVPMVVLTFLLGFSNGYLTSVLMILAPKSVPLSESELSAIVMTGFLGFGLVGGSVLGWFWIL

SEQ ID NO: 128649 - protein, 167 aa, Glycine max
  Coding DNA Sequence Number=SeqID_11871
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1RT13; Match level="QueryCoverage=97%, HitCoverage=22%, E-value=5e-53, Identity=57%"; Hit description=Beta -1,3-glucan synthase, putative
MQPSIYVGRGMHDSQFALMNFFVQIKPLVRPTKDIMSIPRVNYGWHAFFPMVYFMDTQIWYALFTTLCGGLVGAFDRLGEIRTLSMLRSRFQSLPGAFNTCLVPSDKKQKGRFSFSKKFSEFIFTLVSILVWITASKRNEAAKFAQLWNEIICSFREEDLISDMKGP

SEQ ID NO: 128650 - protein, 266 aa, Glycine max
  Coding DNA Sequence Number=SeqID_11872
  Homolog annotation: Hit_ID=Q1T518; Match level="QueryCoverage=31%, HitCoverage=19%, E-value=4e-27, Identity=65%"; Hit description =Tetratricopeptide-like helical
MKNQRLRSIVASLYKTPSPFSTTLSDKQDLQIHDNNDNASAKLVHADSQFSHPSPEGFASRTRNPSPEPAHALAHALRVVEFALAGRSFAEQNDAGASDEGDGVGGGGGGDGWDNGDGGGSGFWDSNNGNDSTDLYYRTMIEANPGNPLFLGNYARYLKEVRGDYVKAEEYCGRAILANPNDGKVLSMYADLIWESQKDASRAETYFDQAVKAAPDDCYVLASYAHFLWDAEGEEDVEVQEDSSEISPSFLHGAAPLPPPLAAASS

SEQ ID NO: 128651 - protein, 1376 aa, Glycine max
  Coding DNA Sequence Number=SeqID_11873
  Gene Ontology: Mol. function=RNA-directed DNA polymerase activity; Cellular component=chromatin; Biological process=chromatin assembly or disassembly
  Pfam annotation: Domain name=Chromo; Domain location=1275-1325; Score= 33.1; E_value=9.8e-07; Accession=PF00385.14; Description='chromo' (CHRromatin Organisation MOdifier
  Pfam annotation: Domain name=RVP_2; Domain location=286-413; Score= -53.9; E_value=0.016; Accession=PF08284.2; Description=Retroviral aspartyl protease
  Pfam annotation: Domain name=rve; Domain location=989-1145; Score =75.8; E_value=1.3e-19; Accession=PF00665.16; Description=Integrase core domain
  Pfam module annotation: Pfam domain module=Chromo::RVP_2::RVT_1::rve; Domain location=1275-1325::286-413::498-667::989-1145
MPKHHTRQVTTDNLEEAISRLSLGHTNLNTKVESIHTSLTAKIDSLLECFAAISAPPHSPSSSPIQPLAPVHRHHMKLDVPRFDGSDPLGWIFKISQFFDYQGIPDQKRLTVAAFYMDGPALSWHWNHDSRLPFTKIRKEHCLSSSRPAPCFISGLSPELRREVQALRPLSLLQATELARHQEDKMLDRRRGTRAPSHPNPTFNPRSSPNPSTAHPKVPLKRLMTEEMATRRDQGLCYHCDDKWSQGHRCKPRLHLLIADEDLEPSSGFPLPDSLTYTTPKPGLTPQISLNAMEGTPAPQTFRLLDSLCHHQVVILVDGGSTHNFIQSRVAKFLTLPTTPTAALKVGNGHTLDCDTISFQVPLSIQGHDFRLDLYHLPLCGADIVLGVQWLKFLGPITTDYHNLTMTFVHMGQPITLNADAPPIPSAASIHKLKRLAQTQSISALFHISTTPNLHTSLLPQTTPVNVRPYRYPHFQKAEIEKQNAAMLAANLIQPSYSPFSSPILLVKKKDGSWRCCVDYQALNAVTIKDRFPMPTIDELLDDLGQAVWFSKLDLRQGFHQIRMAEEDIHKTVFRTHQGNYEFKVIPFGLCNAPSTFQAAMNDTLKPFLRKHVAVFFDDILVYSADLATHVSHLDSVLDTLSAQQFLLRRTKCLFAQTQLNYLGHKRSLRCWPSLYPHLRQLFVDSWVSPVSTGNSLRTTQQSPLPSRHYCGRSNSHGPRKPCKLFKHFSKLWYKPPSSPTRIFLDHSPLKRTPPLQPWVRFYSKTITLLLITTRYYVHDYSEPRRISASSTPSPPPLGNGVTICWERPSRSSQTIETPEQQTYLLKLLGFDYVIKYKSGATNVVADALSRIIPAEATCFTLVMPHFTFLEQLRKSLMADPQYLNLLKDIQSKPEAHSDLSLYQDLIIRNRHIWIPFPCPFTDRLLEEFHSSPIGGHTGAAKTLHRLRQNFDWPTIQKDVRHFVGQCSVCQQTKYETKKPAGLLQPLPIPATAWEDLTVDFITGLPCSHGFTVIMVVVDRYSKGAHFGALLTHYSAFKVVVLFLDCVCKLHGFPRNIVSDRDPVFVSHFWCELFKLSGTKLRMSTAYHPQTDGQTEVLNRTLEQYLRAYVHNHPSHWFRFLSLAEWSYNTATHVGTGMSPFEGSTVAAVDHLLSSRETIHATLQRRLRKMQEAMKATADRHRRDLSFRVGDWVYVRLQPYRQTSVAPAYSKLTKRFYGPFKVVECIGAVAYRLQLPPSSRIHPVFHVSLLKLHKGPLPSSLVTLPTASTDNHPLVAPLAILDWRMDHSQDPPVTQVLVQWEGQAPEDSSWERWDELRRIHNLEDKAVFRDGSVDSNTGQGDTGVITGNHNNTGDITDNHSRPKRVSVRPTYLRDYV

SEQ ID NO: 128652 - protein, 159 aa, Glycine max
  Coding DNA Sequence Number=SeqID_11874
  Gene Ontology: Mol. function=ATPase activity, coupled to transmembrane movement of substances; Cellular component=membrane; Biological process=transport
  Homolog annotation: Hit_ID=Q7CIC1; Match level="QueryCoverage=84%, HitCoverage=51%, E-value=2e-49, Identity=73%"; Hit description=Inner membrane permease of zinc ABC transporter
  Pfam annotation: Domain name=ABC-3; Domain location=1-159; Score =105.0; E_value=2.3e-28; Accession=PF00950.8; Description=ABC 3 transport family
MIELLLPGWLGGVLLALAAGPLGSFVVWRRMSYFGDTLAHASLLGVAFGLLLNVNPYYAVILVTVCLALGLVWLERRPHLAIDTLLGIMAHSALSLGLVVVSLMQGVRVDLMAYLFGDLLAITPDDLSLMAGGVAIVLVVMAWQWRSLLSMTISPELAQ

SEQ ID NO: 128653 - protein, 109 aa, Glycine max
  Coding DNA Sequence Number=SeqID_11875
  Gene Ontology: Mol. function=nucleoside-triphosphatase activity; Cellular component=membrane; Biological process=zinc ion transport
  Homolog annotation: Hit_ID=P0A9X1; Match level="QueryCoverage=100%, HitCoverage=43%, E-value=3e-38, Identity=70%"; Hit description=High -affinity zinc uptake system ATP-binding protein znuC
MAGLHPLQRRQNSVTATAARQTHKALNADWQRRIDVQLLRHIANTQPRRAADAAAVWREQAEYRAHQRGLAGSVGTQQGENFARLQRQADACQHRTLAKLHRNVFECNK

SEQ ID NO: 128654 - protein, 214 aa, Glycine max
  Coding DNA Sequence Number=SeqID_11876
MDKLDDIRLNKLPDEMVVYVNVLGSFVVRRVVREHVSKWNLPQELGFSHSLLDTIQDREQLDDKIEVHTQLESDKYKGGLVWCVLLLKVIEGKGLGLGNVLVRGMGITKSSKESRMTWFYEMTTRTVDPSDEEKEVDVGKEDSEGNDNAQMGQFSGEVDDVGIEADKSAAMETTVCEEEDGGDPDTGKEIWESHGSLFCLNMSVIVLNFIILLN

SEQ ID NO: 128655 - protein, 688 aa, Glycine max
  Coding DNA Sequence Number=SeqID_11877
  Gene Ontology: Mol. function=protein binding; Cellular component =nucleus; Biological process=negative regulation of ethylene mediated signaling pathway
  Homolog annotation: Hit_ID=Q2PQJ1; Match level="QueryCoverage=89%, HitCoverage=99%, E-value=0.0, Identity=65%"; Hit description=EIN3 -binding F-box protein 1
  Pfam annotation: Domain name=F-box; Domain location=84-132; Score =25.4; E_value=0.00021; Accession=PF00646.23; Description=F-box domain
  Pfam annotation: Domain name=LRR_1; Domain location=234-258; Score =3.8; E_value=54; Accession=PF00560.23; Description=Leucine Rich Repeat
  Pfam annotation: Domain name=LRR_1; Domain location=260-283; Score =5.5; E_value=27; Accession=PF00560.23; Description=Leucine Rich Repeat
  Pfam annotation: Domain name=LRR_1; Domain location=286-313; Score =3.1; E_value=76; Accession=PF00560.23; Description=Leucine Rich Repeat
  Pfam annotation: Domain name=LRR_1; Domain location=391-414; Score =3.1; E_value=76; Accession=PF00560.23; Description=Leucine Rich Repeat
  Pfam annotation: Domain name=LRR_1; Domain location=417-441; Score =4.3; E_value=45; Accession=PF00560.23; Description=Leucine Rich Repeat
  Pfam annotation: Domain name=LRR_1; Domain location=471-494; Score =3.1; E_value=75; Accession=PF00560.23; Description=Leucine Rich Repeat
  Pfam annotation: Domain name=LRR_1; Domain location=497-521; Score =5.7; E_value=25; Accession=PF00560.23; Description=Leucine Rich Repeat
  Pfam annotation: Domain name=LRR_1; Domain location=524-547; Score =5.5; E_value=27; Accession=PF00560.23; Description=Leucine Rich Repeat
  Pfam annotation: Domain name=LRR_1; Domain location=551-578; Score =9.4; E_value=4.9; Accession=PF00560.23; Description=Leucine Rich Repeat
  Pfam annotation: Domain name=LRR_1; Domain location=603-627; Score =1.3; E_value=1.6e+02; Accession=PF00560.23; Description=Leucine Rich Repeat
  Pfam module annotation: Pfam domain module=F-box::LRR_1::LRR_1::LRR _1::LRR_1::LRR_1::LRR_1::LRR_1::LRR_1::LRR_1::LRR_1; Domain location =84-132::234-258::260-283::286-313::391-414::417-441::471-494::497 -521::524-547::551-578::603-627
DSAAATQILLLVLVDLLSSVLMPALVNYSGDDELYPGGSFCPNPMELGRLYTTIGSNLDMYYPPTKRPRSIFEAIEREQYYQDPGIEVLPDECLFEIFRRLPSGKERSSCACVSKRWLMLMSTICKDEIEGTTSVAETVSSDENQDIDDDGYLTRCLDGKKATDVRLAAIAVGTSSRGGLGKLSIRGSNSERGVTNLGLSAVAHGCPSLRSLSLWNVSTIGDEGLSQVAKGCHMLEKLDLCHCSSISNKGLIAIAEGCPNLTTLTIESCPNIGNEGLQATARLCPKLQSISIKDCPLVGDHGVSSLLASASNLSRVKLQTLNITDFSLAVICHYGKAITNLVLSGLKNVTERGFWVMGAAQGLQKLLSLTVTACRGVTDTSIEAIGKGCINLKHLCLRRCCFVSDNGLVAFAKAAISLESLQLEECNRFTQSGIIVALADIKTKLKSLALVKCMGVKDIDMEVSMLSPCESLQSLAIQKCPGFGSASLATIGKLCPQLQHLNLTGLYGITDAGLLPLLENCEAGLVNVNLTGCWNLTDNIVSALARLHGGTLEVLNLDGCWKITDASLVAIANNFLVLNDLDVSKCAITDAGVAVLSRASLPSLQVLSLSDLAGIESSKLQFNWQQHNGVASGEVVEMVDWWQFGDLVVFQGTLACYFMTHFFRKHEMLVPTYNPFGPLAYWGYFFHG

SEQ ID NO: 128656 - protein, 500 aa, Glycine max
  Coding DNA Sequence Number=SeqID_11878
  Gene Ontology: Mol. function=protein serine/threonine kinase activity; Cellular component=cytoplasm; Biological process=protein amino acid phosphorylation
  Homolog annotation: Hit_ID=Q4W3B3; Match level="QueryCoverage=99%, HitCoverage=99%, E-value=0.0, Identity=65%"; Hit description =Calcineurin B-like interacting protein kinase
  Pfam annotation: Domain name=NAF; Domain location=360-421; Score =114.8; E_value=2.5e-31; Accession=PF03822.5; Description=NAF domain
  Pfam annotation: Domain name=Pkinase; Domain location=11-318; Score =272.2; E_value=9.9e-79; Accession=PF00069.15; Description=Protein kinase domain
  Pfam annotation: Domain name=Pkinase_Tyr; Domain location=11-316; Score=5.4; E_value=8.4e-13; Accession=PF07714.7; Description=Protein tyrosine kinase
  Pfam module annotation: Pfam domain module=NAF::Pkinase::Pkinase_Tyr; Domain location=360-421::11-318::11-316
MKKVRRKIGKYEVGRTIGEGTFAKVKFARNSETGDSVAIKIMAKTTILQHRMVEQIKREISIMKIVRNPNIVRLHEVLASQTRIYIILEFVMGGELYDKIVQQGKLSENESRRYFQQLIDTVDHCHRKGVYHRDLKPENLLLDAYGNLKVSDFGLSALTKQGVDLLHTTCGTPNYVAPEVLSNRGYDGAAADVWSCGVILYVLMAGYLPFEEADLPTLYRRGEIHCSYVHAYYPVDLLNENLFGTLLLGRTIAEYWGWKIGFPSSLEGATVLDSGINAAEFVCPFWFSADTKSFIQKILDPNPKTRVKIEEIRKEPWFKKNYFPVKLGEDEQVNLDDVRAVFDDIEDQYVAERSEITEGGPLIMNAFEMIALSQGLNLSPLFDRLQDNVKRQTRFVSRKPAKVIISSIEAVAESMGLKVHSRNYKVRLEGVSANRVGPFAVVLEVFEVAPSLFMVDVRRATGDTFDYHKFYMNFCAKLGNIIWRPAGTMPNSNLLKQMTL

SEQ ID NO: 128657 - protein, 86 aa, Glycine max
  Coding DNA Sequence Number=SeqID_11879
MKLSKTEITFSRNVATLRADELARLFNIKAVSDHSPCGEVQVASLEIGSGSQNAFQISERYWIEDVSLQLLIGVSCDVRPQAASLS

SEQ ID NO: 128658 - protein, 96 aa, Glycine max
  Coding DNA Sequence Number=SeqID_11880
MWSVKVKHTHREDIDDNTLQKILVFGSSDKEESAINCAPLIPLTVNTKYTTRLQSVDHILNGETKSPSENKIKFETTSSTNTKKGESMMETLIQNR

SEQ ID NO: 128659 - protein, 79 aa, Glycine max
  Coding DNA Sequence Number=SeqID_11881
  Gene Ontology: Mol. function=structural constituent of ribosome; Cellular component=ribonucleoprotein complex; Biological process =translation
  Homolog annotation: Hit_ID=Q1U5Y4; Match level="QueryCoverage=47%, HitCoverage=97%, E-value=3e-11, Identity=81%"; Hit description =Ribosomal protein L36
  Pfam annotation: Domain name=Ribosomal_L36; Domain location=1-38; Score=64.2; E_value=4.2e-16; Accession=PF00444.9; Description =Ribosomal protein L36
MKVRSSVKKMCEFCQIVKRRGRIYVICSGNPKHKQRQGMATFASEGPSQPVICTLFTGAHCAHAINSTVEKFNFYPLWV

SEQ ID NO: 128660 - protein, 353 aa, Glycine max
  Coding DNA Sequence Number=SeqID_11882
  Gene Ontology: Mol. function=chitin binding; Cellular component =extracellular region; Biological process=chitin metabolic process
  Homolog annotation: Hit_ID=UPI000044A8F0; Match level="QueryCoverage =61%, HitCoverage=99%, E-value=3e-25, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DGPLGTSTLTFRGLYVLVIRGLHVLAIRRLRVLAIRGLHVLAFRGLHVLAFRGLHVLTIRGLHALTFRGPHILAFRGSCTLTLRGLHVLAFKGLHALTFRGLPVLAFKGLHALIFKGLHTLTFKGLHALIFKGLHALIFKGVHALTFRGLNVLALRGLHVLAFGGLHALVFRGLYVLPFRGLHVLAFGGLYVLTFKGLHVLTFRGLHVLTFRGLRVLIFRGPTMRAQPEEGYRAATVHTGARGRAHKTSSGPGEVQQGPGVSSFGYGPLSFLQGAHSPQQGIVPAGHPVDPKKSNRVLGFPALITGLCQFYRVPVTPNKAGRGRDTTTAWGWLATGNKCTAATSRAPQLIHEK

SEQ ID NO: 128661 - protein, 185 aa, Glycine max
  Coding DNA Sequence Number=SeqID_11883
MFLFVGGPPSAAEGKEKLDLIEERLRVVEGFGDYPFVDMTDLCLVSDVVIPSKFKSADKEGPKKPKPLVIHFTRDTTPQRPPHPSTMSGVRSIPFPYKNSRAVPWRYAPLGGRKEEATHIGSLSAKVTNITGLNDITRSGRMFAPPGLPTQPANFKGKAKVIEGQNVKVIPTPGEDVPTKKFAEG

SEQ ID NO: 128662 - protein, 131 aa, Glycine max
  Coding DNA Sequence Number=SeqID_11884
  Gene Ontology: Mol. function=acyltransferase activity; Cellular component=integral to membrane; Biological process=metabolic process
  Homolog annotation: Hit_ID=Q1SYU3; Match level="QueryCoverage=99%, HitCoverage=25%, E-value=1e-47, Identity=74%"; Hit description =Phospholipid/glycerol acyltransferase
MSRVLVSLTVGMGERISERRETEYVTAGILRRRTEERTTGSIRVRWVQTKRTPEFSPEGGRGGLPFTMTLPPNSLEMWGMAQKGKIEPMAMRIMASIMPTGIHRRIKREVDGVGRFTRRPSWKITGSGRSS

SEQ ID NO: 128663 - protein, 69 aa, Glycine max
  Coding DNA Sequence Number=SeqID_11885
MNGTSKCLTLGDRRGELPPVLDWSQRVLNDLPLTVKKVVNHLEKIHIRKTCLNYSQLTPLFPYRKTNPT

SEQ ID NO: 128664 - protein, 153 aa, Glycine max
  Coding DNA Sequence Number=SeqID_11886
PRVGSRAPGHYYHGYYRPEPKEGKERTKARSSLAIHSEGGWGSTSFMTHGPIETRFSDMDFFEMVNHFFNREREVIQNPLAPVQNRWKFPTPIPQRRLSVHFPEIEEIYSSVAENIMSRDLEISAEISIETLRGWVEEIKENPNPLKSLIREH

SEQ ID NO: 128665 - protein, 346 aa, Glycine max
  Coding DNA Sequence Number=SeqID_11887
  Gene Ontology: Mol. function=zinc ion binding; Biological process =cell redox homeostasis
  Homolog annotation: Hit_ID=Q1SYU4; Match level="QueryCoverage=97%, HitCoverage=87%, E-value=5e-98, Identity=54%"; Hit description=Zinc finger, RING-type; Thioredoxin-related; RINGv
  Pfam annotation: Domain name=DUF1117; Domain location=251-346; Score =38.8; E_value=1.8e-08; Accession=PF06547.3; Description=Protein of unknown function (DUF1117)
  Pfam annotation: Domain name=zf-C3HC4; Domain location=187-227; Score= 25.2; E_value=0.00024; Accession=PF00097.15; Description=Zinc finger, C3HC4 type (RING finger)
  Pfam module annotation: Pfam domain module=DUF1117::zf-C3HC4; Domain location=251-346::187-227
MSSHWCHRCNKFVRAWRQEMPVCPDCDSGFVEEIEPSNRPVHHVETRRRRFPTAAAMYMMGHRSGNSDHNPRYSSRQHCRNVIGDRSLLNRVIMLQSEGTSRDRGSGFELFFDDGAGSGFRPLPPRMSEFLLGTGIDRVMDQLSHVESNSDGGRHDQQSHAPASKSAVESLPAIEINATHTAIESHCAVCKEPFELCTMAKEMPCKHIYHAECILPWLAIKNSCPVCRHELPCENARARLERVEEEEENNNLGLTIWRLPGGGFAVGRFGRREGEREVNVPLVYTEVDGGFNFNNVLVGEPRRVSWSVLESSGSRRGGAFRRMFNHLFSCLRGGGVGPNRSSSSST

SEQ ID NO: 128666 - protein, 103 aa, Glycine max
  Coding DNA Sequence Number=SeqID_11888
MSASPLVTPTCFGYHWTTHVKFSWYWLQLEPIIFHPKGETKERAFLIRQWLMQEKSLQLWNSLNCFVVFFDFGKQTTEKHITHYPLHILVKEKVVDKWPTVKS

SEQ ID NO: 128667 - protein, 148 aa, Glycine max
  Coding DNA Sequence Number=SeqID_11889
  Subcellular localization annotation: CTP_CleavageSite=14; ConfidenceScore=5.29e-01
MCSMISAQGVAVATAMAVSGTVILLALRLQKSFPPPQFSVHHQIPPSPSPVLRSCISNAGKKSKKKKKKKRVHFAEDVVESCRDGEEFRKRSSRSKVQKSYNNNNNGEEDEEEEEEEAKIGGVMPANRVALYNGILRGRVAQRLAYSC

SEQ ID NO: 128668 - protein, 305 aa, Glycine max
  Coding DNA Sequence Number=SeqID_11890
  Gene Ontology: Mol. function=pepsin A activity; Cellular component =endoplasmic reticulum; Biological process=proteolysis
  Homolog annotation: Hit_ID=O22282; Match level="QueryCoverage=83%, HitCoverage=57%, E-value=6e-98, Identity=70%"; Hit description =Expressed protein
  Pfam annotation: Domain name=Asp; Domain location=61-304; Score= -181.4; E_value=0.0068; Accession=PF00026.14; Description=Eukaryotic aspartyl protease
  Subcellular localization annotation: CTP_CleavageSite=75; ConfidenceScore=5.36e-01
MASSISSLSLLLPSLTTLILLQIQTCVSSSQTQKPLLLPLKTQTQTPPRKLAFQHNVTLTISLTIGSPPQNVTMVLDTGSELSWLHCKKLPNLNSTFNPLLSSSYTPTPCNSSVCMTRTRDLTIPASCDPNNKLCHVIVSYADASSAEGTLAAETFSLAGAAQPGTLFGCMDSAGYTSDINEDAKTTGLMGMNRGSLSLVTQMVLPKFSYCISGEDAFGVLLLGDGPSAPSPLQYTPLVTATTSSPYFDRVAYTVQLEGIKVSEKLLQLSEVGVRARPHRSGSDNGGFGYPVYFSPRAGLQFPKG

SEQ ID NO: 128669 - protein, 65 aa, Glycine max
  Coding DNA Sequence Number=SeqID_11891
MWHLQSSFFLLDSAAIDLQEAKDSIDEEDPRPTSSTWSYVMCYPEHLYLGDVLLLPISFCSVNSF

SEQ ID NO: 128670 - protein, 130 aa, Glycine max
  Coding DNA Sequence Number=SeqID_11892
MKFTTGSHSPIQNKFVGCAFTGKNPKKFQIPSTCTIDELKNLIKQVAPKGIPLLGIHESQTVPRLFFRQPARFEYSDTVIKYEINELITNEELLKVLVQSNYWKKYGPIEILAVFTKYVEDEVSGTSLNN

SEQ ID NO: 128671 - protein, 59 aa, Glycine max
  Coding DNA Sequence Number=SeqID_11893
MTLFCTRLPIESKIKRGVGYRQSRTTLNGNLKGRMTFAGSHLPCRKFIWSEDLPFSFFH

SEQ ID NO: 128672 - protein, 120 aa, Glycine max
  Coding DNA Sequence Number=SeqID_11894
  Gene Ontology: Mol. function=structural molecule activity
  Homolog annotation: Hit_ID=Q1SPB9; Match level="QueryCoverage=92%, HitCoverage=20%, E-value=1e-16, Identity=36%"; Hit description =Transposase
MRWVVTHIDKNVKAKCKHVTPKEAWGQVMEAWGTFMDCSAEFDYEDCLTKFEVICQPWHEFVAYVKDTWLIPHNERFVKEWTDKVMHLGNTTTNRAEFSHWALKRLLQSSMRDLCECWIQ

SEQ ID NO: 128673 - protein, 162 aa, Glycine max
  Coding DNA Sequence Number=SeqID_11895
  Gene Ontology: Biological process=regulation of progression through cell cycle
  Homolog annotation: Hit_ID=Q9C5X2; Match level="QueryCoverage=78%, HitCoverage=54%, E-value=1e-35, Identity=57%"; Hit description =Cyclin J18
MECGCERLPMVEFLMESAQIHDSRPLSVTCFKSLADASIKEQHFTSRNFLEAEVVFMQVLNFEIGTTNIAFLFLEDLWIQFNGVAKVGALISIETCMEIMDLLYEKEEMSILFRSPHSIAASILVASYVMTVPKQKWEFPVLAWDLILYQPSNINHIHVLRN

SEQ ID NO: 128674 - protein, 887 aa, Glycine max
  Coding DNA Sequence Number=SeqID_11896
  Gene Ontology: Mol. function=binding; Cellular component =intracellular; Biological process=metabolic process
  Homolog annotation: Hit_ID=Q1T265; Match level="QueryCoverage=85%, HitCoverage=98%, E-value=1e-142, Identity=32%"; Hit description =Tetratricopeptide-like helical
  Pfam annotation: Domain name=PPR; Domain location=126-160; Score =14.7; E_value=0.14; Accession=PF01535.11; Description=PPR repeat
  Pfam annotation: Domain name=PPR; Domain location=196-229; Score =10.8; E_value=0.39; Accession=PF01535.11; Description=PPR repeat
  Pfam annotation: Domain name=PPR; Domain location=230-264; Score =18.5; E_value=0.025; Accession=PF01535.11; Description=PPR repeat
  Pfam annotation: Domain name=PPR; Domain location=332-366; Score =49.1; E_value=1.4e-11; Accession=PF01535.11; Description=PPR repeat
  Pfam annotation: Domain name=PPR; Domain location=367-401; Score =44.1; E_value=4.7e-10; Accession=PF01535.11; Description=PPR repeat
  Pfam annotation: Domain name=PPR; Domain location=478-512; Score =26.9; E_value=7.3e-05; Accession=PF01535.11; Description=PPR repeat
  Pfam annotation: Domain name=PPR; Domain location=582-616; Score =44.8; E_value=3e-10; Accession=PF01535.11; Description=PPR repeat
  Pfam annotation: Domain name=PPR; Domain location=617-650; Score=9.1; E_value=0.62; Accession=PF01535.11; Description=PPR repeat
  Pfam annotation: Domain name=PPR; Domain location=653-687; Score =12.9; E_value=0.22; Accession=PF01535.11; Description=PPR repeat
  Pfam annotation: Domain name=PPR; Domain location=719-753; Score=7.7; E_value=0.93; Accession=PF01535.11; Description=PPR repeat
  Pfam module annotation: Pfam domain module=PPR::PPR::PPR::PPR::PPR::PP R::PPR::PPR::PPR::PPR; Domain location=126-160::196-229::230-264::332- 366::367-401::478-512::582-616::617-650::653-687::719-753
MIKDRVRTETYRDAIMQHQSSIAGKQLHHRYRCSISMLLRCFPIKSKLLQSQFTNTRLLSCATIPITALKECNSLAHAKLLHQQSIMQGLLFHLATNLIGTYIASNSTAYAILLLERLPPSPSSVFWWNQLIRRALHLGSPRDVFTLYRQMKSLGWTPDHYTFPFVFKACANLSSLSLGASLHATVSRSGFASNVFVCNAVVSMYGKCGALRHAHNMFDDLCHRGIQDLVSWNSVVSAYMWASDANTALALFHKMTTRHLMSPDVISLVNILPACASLAASLRGRQVHGFSIRSGLVDDVFVGNAVVDMYAKCGKMEEANKVFQRMKFKDVVSWNAMVTGYSQAGRLEHALSLFERMTEENIELDVVTWTAVITGYAQRGQGCEALDVFRQMCDCGSRPNVVTLVSLLSACVSVGALLHGKETHCYAIKFILNLDGPDPGADDLKVINGLIDMYAKCQSTEVARKMFDSVSPKDRDVVTWTVMIGGYAQHGDANNALQLFSGMFKMDKSIKPNDFTLSCALVACARLAALRFGRQVHAYVLRNFYGSVMLFVANCLIDMYSKSGDVDTAQIVFDNMPQRNAVSWTSLMTGYGMHGRGEDALRVFDEMRKVPLVPDGITFLVVLYACSHSGMVDHGINFFNRMSKDFGVDPGPEHYACMVDLWGRAGRLGEAMKLINEMPMEPTPVVWVALLSACRLHSNVELGEFAANRLLELESGNDGSYTLLSNIYANARRWKDVARIRYTMKRTGIKKRPGCSWIQGRKGVATFYVGDRSHPQSQQIYETLADLIQRIKAIGYVPQTSFALHDVDDEEKGDLLFEHSEKLALAYGILTLHPRAPIRITKNLRICGDCHSAITYISKIIEHEIILRDSSRFHHFKNGSCSCKGYW

SEQ ID NO: 128675 - protein, 128 aa, Glycine max
  Coding DNA Sequence Number=SeqID_11897
MEEKKKKQLEEAAQFGSIDTVIDPPSPIRRHNSLEEQASQGSFVAHGRQDVPTAAIRQLEHPSRVRVAGADVMIKQYFGPTSRTSCTSSSMAPEDLEQLTQKIRDQLEESIIEKVTRQLMLSFSQMQS

SEQ ID NO: 128676 - protein, 91 aa, Glycine max
  Coding DNA Sequence Number=SeqID_11898
DADEAPLDVSICLHAFGIVGCGSFSGVKSCEREDPFHPGLFVGDAGGFQSPTREPLNVGGLVPPHCSLKSVVSDDACPGACFVQRDATTLS

SEQ ID NO: 128677 - protein, 114 aa, Glycine max
  Coding DNA Sequence Number=SeqID_11899
MTRGNPSDLQPFDLEIDRTFHKLVSHHLVPFEHPKHSVIDDFEHPDLEHYNFEHSDFEHSENMAQPPPRERTLREMAAPNFTYESLCIQYPDEDVPYVLKTGLIHLLPTFHGLA

SEQ ID NO: 128678 - protein, 149 aa, Glycine max
  Coding DNA Sequence Number=SeqID_11900
MSGHRIRHLGSCSFNASLDFYLALYSTSSILEQDVRTLGSTFNFERLDILRDSIRHPSKKLLSFAFAQRFNIQFRACRYITGLNKTSRVKYYGRLHGLRGSTFNSERLDILRDSIRLPSKKSWSFELAQRFNIQFRGSRYITGLNQTSE

SEQ ID NO: 128679 - protein, 87 aa, Glycine max
  Coding DNA Sequence Number=SeqID_11901
VPITSNKGIRPPTNRAFIKKYCGSRQAQGETPQQPGDGQQRATDAPPSPLEFTSAHPQKGNGRTHLVAHDPRNLNKMSTSSEGRKIP

SEQ ID NO: 128680 - protein, 100 aa, Glycine max
  Coding DNA Sequence Number=SeqID_11902
  Gene Ontology: Mol. function=nucleoside-triphosphatase activity; Cellular component=nucleus
MAELKLSERRDLTCIEHSHIHGLGLYSSLELHGRANRVVVLVGQPGTDKTAIAMGMAKDGGFMNGGLPFGDTVMEGVVVVGRGSRGRRGRSQEEECNEAE

SEQ ID NO: 128681 - protein, 232 aa, Glycine max
  Coding DNA Sequence Number=SeqID_11903
  Gene Ontology: Mol. function=hydrolase activity
  Homolog annotation: Hit_ID=Q5NT84; Match level="QueryCoverage=47%, HitCoverage=23%, E-value=3e-24, Identity=56%"; Hit description =Apyrase
MVVAKVCHRTEGGVGGEGRIRFQTNTHSHIQIQIENTNTLSLFLIHTDTRIPPIRRRFPKLRAFKSNPHSHQSALESLQVLKPPSPSAAGQIRFRSPSSAELLATAELDLETTKMLKRSGRPPPPTPESLTDKIYHLRGAFLMVAVPLLLVTLVLYAMPSASSSESVEDYALTHRKVGNERSTSFAVIFDAGSSGSRVHVFRFDRNLDLVHIGKDLELFVQIWGGRREIGKK

SEQ ID NO: 128682 - protein, 92 aa, Glycine max
  Coding DNA Sequence Number=SeqID_11904
  Subcellular localization annotation: CTP_CleavageSite=10; ConfidenceScore=5.14e-01
MAQASQRLACVSQGPEKPQNYPFALPFGYFPHSFPKHRKTLQIVRQLVLSSSIRLARIKMLANEEVFFSKNDKYSEGAKNMELKYFVVKEEV

SEQ ID NO: 128683 - protein, 104 aa, Glycine max
  Coding DNA Sequence Number=SeqID_11905
  Pfam annotation: Domain name=zf-CCHC; Domain location=68-85; Score =25.7; E_value=5.6e-05; Accession=PF00098.13; Description=Zinc knuckle
MCALSQEEYSKAHNFKSTKQIWDTLAITHEGSSQEKCNKLSLLVTNKNPSKFNESSKRSFYKKEKSPMICYKCKKPGHFKLECPGLEKPKDKKKKFFKSKKRSS

SEQ ID NO: 128684 - protein, 86 aa, Glycine max
  Coding DNA Sequence Number=SeqID_11906
MPSFTFQKMTMSSVIYAFKRFFDVSEKNAENTQKGGQKGHFERKHPARLGELLFNLHPSFAIYRREGAEGNRFQGPELRKKKRKRS

SEQ ID NO: 128685 - protein, 118 aa, Glycine max
  Coding DNA Sequence Number=SeqID_11907
MSFDLNCKLKKHEVLREVPPMFATLYEEIETLRNKLGKFVAGQEAINKIIKVQRNLKDKSGHGFKGKKIWVMKFTSARTSLKRETHHRASSALSNTHMLTREKDPKRFGYLRGKIVML

SEQ ID NO: 128686 - protein, 80 aa, Glycine max
  Coding DNA Sequence Number=SeqID_11908
  Subcellular localization annotation: CTP_CleavageSite=56; ConfidenceScore=5.02e-01
MDKAMAVILKYFLSVRINVSNRKGSSRKTLVRQVMDVWSRHDGLKRHGSRRIKAVPAQNKATSNPRSFEKLKMEYASQTT

SEQ ID NO: 128687 - protein, 319 aa, Glycine max
  Coding DNA Sequence Number=SeqID_11909
MRAPTVRNLCTLSNLLLSEVLTCKRNTIVVPSTKPSPESELDLARDTSQGDSIEESEDTKELSDIWCSKEDKRSASEEIDDDDEKRQRAVDIPWIPGLSHGKLWVKRKEVAHKLGAGKTVYVFGHLGRETGVKEYNALIKMCIKKARATDDEFIGLIQLFTDIIKAENPSSASQLGYYEMLLWLRVGDEEMIQDICEYITVETSEDTSALRESYLMALWESDRKMQILDVVKNIDITELSSEKSIADIFQSLGRFQLESVADDLLLDLRARGGWTHWCILVGRIVYRGSEQRGNKMERCGNGLVFKGQGGGSGLNQYSQ

SEQ ID NO: 128688 - protein, 66 aa, Glycine max
  Coding DNA Sequence Number=SeqID_11910
MEKSDKKYFKDKKEKKAYITWEDNDMDSSIDSKNEIINLGLMAKDYESKEEMHSMTSKKNLSNLPN

SEQ ID NO: 128689 - protein, 85 aa, Glycine max
  Coding DNA Sequence Number=SeqID_11911
MEEFDALVAWPRDQPYSSGEGGASAAQEPVTEEPPAPAPSLGAGEKETTPDQTPKPSPSSAPAPKETQPSALDLNEDQPQEEQDV

SEQ ID NO: 128690 - protein, 68 aa, Glycine max
  Coding DNA Sequence Number=SeqID_11912
MAKFDPDIVLEFYVNAWPTKEEVRDMRSWVRGQWIPFDADALSQFLGDPLVLEEGQECEFSQRRNRAD

SEQ ID NO: 128691 - protein, 44 aa, Glycine max
  Coding DNA Sequence Number=SeqID_11913
MVGHITLPPSPFFVIPKLVEVRISSKNKDLDLGIQAFGFECEKT

SEQ ID NO: 128692 - protein, 142 aa, Glycine max
  Coding DNA Sequence Number=SeqID_11914
MNDSHQIKLGYDRDKTETDYHCIHNELAADFEGHDGALWQIAKVMAGERERRARNLVGDDGELIKVDKEALLPRETSSSFWNGFIIGLVIGIEFEFAWGLKRFLRPKALLEAIARSFKEKSSTRRIKVMAWTDVITVAVALW

SEQ ID NO: 128693 - protein, 202 aa, Glycine max
  Coding DNA Sequence Number=SeqID_11915
  Gene Ontology: Mol. function=L-aminoadipate-semialdehyde dehydrogenase activity; Cellular component=nucleus; Biological process=antibiotic biosynthetic process
  Homolog annotation: Hit_ID=Q70LM4; Match level="QueryCoverage=99%, HitCoverage=75%, E-value=3e-40, Identity=41%"; Hit description =Linear gramicidin synthetase subunit D [Includes: ATP-dependent tryptophan adenylase ...
  Homolog annotation: Hit description=(TrpA) (Tryptophan activase); ATP- dependent D- leucine adenylase (D-LeuA) (D-Leucine activase); Leucine racemase [ATP-hydrolyzing] (EC 5.1.1.-); ATP-dependent tryptophan adenylase ...
  Homolog annotation: Hit description=(TrpA) (Tryptophan activase); ATP- dependent glycine adenylase (GlyA) (Glycine activase); Linear gramicidin--PCP reductase (EC 1.-.-.-)]
  Pfam annotation: Domain name=AMP-binding; Domain location=1-171; Score=-104.8; E_value=0.0037; Accession=PF00501.18; Description=AMP -binding enzyme
MWPGLRTMIVMGDAPPADVVTWWAERTRLCNGYGPTEASIATSLCEYRPGVPWNCIGKPLKNYRCHILDPHHNPLPVGFEGELCIAGSGLAHGYLHQEALSAEKFITCRLPYMAAEERLYQTGDIAKWDEQGNIIFVGRRDHQVKIRGVRIEMGEVESAVRSHPLVDSACVVARSQPSGKILAAFVQPASPELTIDALRHAL

SEQ ID NO: 128694 - protein, 113 aa, Glycine max
  Coding DNA Sequence Number=SeqID_11916
  Gene Ontology: Mol. function=hydrolase activity, acting on ester bonds; Cellular component=nucleus; Biological process=biosynthetic process
  Homolog annotation: Hit_ID=Q35DM5; Match level="QueryCoverage=92%, HitCoverage=33%, E-value=2e-16, Identity=42%"; Hit description=Amino acid adenylation
MADIVSSQIIVQRADIGMQLRGRQIKRRTADQRAIDVPAEGVETQRGDGQHATALRQANEIAVVLRHVAQALTPYHDAFGFAGRPGGIADVGQCVSRLRELLRMDVQRTVVNA

SEQ ID NO: 128695 - protein, 97 aa, Glycine max
  Coding DNA Sequence Number=SeqID_11917
MACYSLWKSEDDMLKTAGWLLPAILALAGCSSSGQRHEQTLSQALTALGQDKALIGASSGVMVRDAESGTVLYQAQAEQRLAPASNMKMFTSLAAFG

SEQ ID NO: 128696 - protein, 192 aa, Glycine max
  Coding DNA Sequence Number=SeqID_11918
MSLIETTLKKWDRAAIVRSRPRRLLNEQDSQSTLFFPLERLPLCLHPRVAALGEQALRYIQVQTLYHYLNGIANIELDIINDSSYKLYKNAVGVDFPLEMRLDALTVVVDESYHALVALDLINQVEQMTSIAPLPMPKDTEASYALAQSLAMGDERLRELLRLVCVSLSEQALTTDLIDVINNEDIFPTFYL

SEQ ID NO: 128697 - protein, 59 aa, Glycine max
  Coding DNA Sequence Number=SeqID_11919
MSKCPRCGVSRYKLKDDKECSSDENLNKGPPSEDDAKDLTWHANGRNCDRMLHHLADSS

SEQ ID NO: 128698 - protein, 54 aa, Glycine max
  Coding DNA Sequence Number=SeqID_11920
MDGKPKPCRLCMMMDCPLYIGAGSGICVDVGGITGAEEGTGAVEEEGAGVSGGA

SEQ ID NO: 128699 - protein, 95 aa, Glycine max
  Coding DNA Sequence Number=SeqID_11921
MACPEGQKVAFGTYTLVEEAEYWWENTHQCLDDKGQDVTWDVFVNIASTNKALFQDSLKIKPCLKTKGFNVMQGSGNRLPGSVIDYQEGRMKKSC

SEQ ID NO: 128700 - protein, 85 aa, Glycine max
  Coding DNA Sequence Number=SeqID_11922
MSDKENACALLVMGKLGGVDGDPVLRGTWIRATWECVNSVKRWATGDEWYLKICRGGQETLGTSGGVLLPKTKLDQSRPNPGIVS

SEQ ID NO: 128701 - protein, 155 aa, Glycine max
  Coding DNA Sequence Number=SeqID_11923
MVWNYLCAKDRAIGLGAENALDEDDIMSKEANEEETIHSVSIDLEGSSSATRKKIRPSKSGEKERMISSMKEVAESLKEFVKVTKKKMKNKKKMEIKEAQEVVHEVVNELDNIPNFNGALQHRAINWLTENPIRFVIIKALPLDEKEDYISSFMP

SEQ ID NO: 128702 - protein, 103 aa, Glycine max
  Coding DNA Sequence Number=SeqID_11924
  Subcellular localization annotation: CTP_CleavageSite=45; ConfidenceScore=5.61e-01
MNLLPSVVHVSSTFESRAPRIHCLAMFANSPFSTFIRRPMNSLPSAVHVSSTIESGARRIDCLALFANSPFSNLIWRPMNSLPSAVHVSSVIKRGASEKKKKE

SEQ ID NO: 128703 - protein, 243 aa, Glycine max
  Coding DNA Sequence Number=SeqID_11925
HPRKILMKDLTTLAQVWSVLSYSNLAPTSHTSDLTLDRARLIFGLVSQLDMNVGALISGQITSMAQSNSSTLGFPALITTLCRSRGVASNSLVFERLSPVINLAYIRKNCWIPTDLAVTIRGARRARTRPAKALSTSATPPLARTSAAPSTPSFYRLSTGVRIAICPLGPSRSFLQKTVASGGSNLARLGELGGKLLPYFAINRGRSEEENGSAFLALLPLLKLLRKIVSVKKIQAEELPLQR

SEQ ID NO: 128704 - protein, 124 aa, Glycine max
  Coding DNA Sequence Number=SeqID_11926
MSISPCESISWDHAQQTPSGPREVQQGPGVSSSGYGPLSILQGARPPQRGIASARHPVDPKKSNRVLGFPAWITGLCQFYGVPVAPSKVIRPSINRTFIEKNSAPSRRRVRHHSSGQQAHRHHL

SEQ ID NO: 128705 - protein, 58 aa, Glycine max
  Coding DNA Sequence Number=SeqID_11927
PIPSQASLLGTLEDFKVPTREPLNVGGLVPPHCSLKSVVSDDACPGACFVQRDATTLS

SEQ ID NO: 128706 - protein, 91 aa, Glycine max
  Coding DNA Sequence Number=SeqID_11928
MWNRHRLKGALKLGVFTPEVYTLKSPSESLPPDSGQNTKTSRILKFINQFSSEHQLFYPDKFWVSREKEKLNARDISSTEDFIFKIPMVVL

SEQ ID NO: 128707 - protein, 72 aa, Glycine max
  Coding DNA Sequence Number=SeqID_11929
  Homolog annotation: Hit_ID=Q6JJ63; Match level="QueryCoverage=89%, HitCoverage=9%, E-value=7e-14, Identity=53%"; Hit description =Putative tnp2 transposase
MGRLQRLYASTECATPKRWHVQNRTNTRVICHPSNEIAWKHFDSVYPDFATDPGNSIISRCSSAQGPLKQFT

SEQ ID NO: 128708 - protein, 71 aa, Glycine max
  Coding DNA Sequence Number=SeqID_11930
MEAMKDQMTAMMEAMLSMKKIMESNAAAVATTSVAAEVDPTHPSGLNQVNPPIPNMVRVRTRQMHRIAQVV

SEQ ID NO: 128709 - protein, 58 aa, Glycine max
  Coding DNA Sequence Number=SeqID_11931
MSTSTPLESVAQFGAFVMIPTLGFVQKLVAWKPEDEYQVKANFKSKGLKHLSQMLLEV

SEQ ID NO: 128710 - protein, 134 aa, Glycine max
  Coding DNA Sequence Number=SeqID_11932
MVIDYQRLISRYQPRYIAGQPPHKPPCFVDFVLLLVDCQELACLGRLTLPRFLTSSLLDYGAPVICGTRWRSGDDANQLSHFHKSNINTPSPVAHLQIELTHSYVALILVPLSTRSPSTPPSFHNIPTIQFQLS

SEQ ID NO: 128711 - protein, 240 aa, Glycine max
  Coding DNA Sequence Number=SeqID_11933
MRTSMTTLTQMWMTLLLSNVLPNDHNSDLPLPKCQLVYAILTRMSVHVAQLIADAIYLFAGMPPTRHPLDPDKSNRALGFPALITGLYQSFGVPVTPSKVIRSPITRAFIEKYCTPRQAQDDAPQAADASPPPHQADLAGSLGMARHLQHLVCQQAANHRGQVQIHECLYQLSLNQQGQSFSPFACPTPDQFRAEVAWPRDWPEAQAGEAPARAPGDAEEARMDEEMTNLLDFLGGNGAT

SEQ ID NO: 128712 - protein, 141 aa, Glycine max
  Coding DNA Sequence Number=SeqID_11934
MRRYLTVIRTLLSSRGGGPDDKQRPMWSFCTLVSSRGGEPDDKQRPMWSSTPMCHPEAAGPMTRRDKIWSFCTLVSSRGGGPDDTRRYLTIIRTLLSSRGGGPDDKQGPMWSFCTLRQSRPTSPLTCGDLHHLPHLQDLSH

SEQ ID NO: 128713 - protein, 319 aa, Glycine max
  Coding DNA Sequence Number=SeqID_11935
  Gene Ontology: Mol. function=DNA binding
  Homolog annotation: Hit_ID=Q1RUD8; Match level="QueryCoverage=95%, HitCoverage=75%, E-value=4e-20, Identity=28%"; Hit description=IMP dehydrogenase/GMP reductase
MGSSQAPSLKKRFYQVKIKGLGVASLKELGQLMGQLQRQAFRKAYGKIWDLTMAEVSTEAIASLAQYYDQPLRCFTFGDFQLTPTVEEFEEILGCPLGGRKPYLFSGFYPSLGRISKIVKISTQELDRGKQVENGVVGGTKEMFGSKGESLGKSRGMGPVHGHPETLDLWGGPLSKCGWNNARIVCCTPALYVWLVSHFFCQEMRHVCPLEGHRSCTEKKEANWDRLLASKEGVSVNWFPRWKEGRTGILILCGKFPNVPLMGTRVFNSTNTGVLQRVHKAWEMLQRKDKELRGSSNGLIGGYHRWLKAYAQDLDWLPS

SEQ ID NO: 128714 - protein, 68 aa, Glycine max
  Coding DNA Sequence Number=SeqID_11936
MLCRDDSRGTPSPGPRESHLTDLSSLAHEAPGFVFVARTRRPGARGAVVIPSLPTVHLRKPCYDFSFL

SEQ ID NO: 128715 - protein, 292 aa, Glycine max
  Coding DNA Sequence Number=SeqID_11937
  Gene Ontology: Mol. function=sequence-specific DNA binding; Cellular component=intracellular; Biological process=DNA mediated transformation
  Homolog annotation: Hit_ID=Q6D003; Match level="QueryCoverage=63%, HitCoverage=55%, E-value=9e-60, Identity=68%"; Hit description =Hypothetical protein smf
  Pfam annotation: Domain name=SMF; Domain location=46-185; Score= -14.2; E_value=3.6e-09; Accession=PF02481.6; Description=SMF family
RPSVHHGASGRQPHDDAWLQQHGLDDTQRQQFLALCPRQLEKTQRWLQQAQHHLIACSDAHYPARLREISRYPAALYIAVVTVHRMAENGAAGQNPGRAGQRAESSLSEKPSAAGTGDYRQRRRAGFRTAAVNGAPCASLKSGSLVTARYALEQNRNVYALPGALGNPGCEGTHWLIQQGALLVAHPNNILEDLHSALQWLPASISETIYSQLSDDVPLPFPSVLANVGDEVTPVDVVAERAGQPVPVIAAQLLELELAGWIAAVPGGYTYIHNEAEMRVDQDKLTDDLTDA

SEQ ID NO: 128716 - protein, 189 aa, Glycine max
  Coding DNA Sequence Number=SeqID_11938
  Gene Ontology: Mol. function=structural constituent of cell wall; Biological process=cellulose and pectin-containing cell wall organization and biogenesis
  Homolog annotation: Hit_ID=Q9M1H0; Match level="QueryCoverage=75%, HitCoverage=40%, E-value=2e-10, Identity=42%"; Hit description =Extensin-like protein
GCTPSPWVLVTLTVRGLHVLALRGLHVLTIRGLHALTSRGLHVLALRGLHALTLGTTYPHRQRTTRPRLERTTRPHHQRAARPHLQRTISPRLERATRPHLGGLHVLAVKGSCAFTFVGLHALTFRGLHVLTFRGLHVLAIRGLHVPHFQRGACPHLQRIARPCHHRTTLPRLRKATRPELQRATRPRL

SEQ ID NO: 128717 - protein, 237 aa, Glycine max
  Coding DNA Sequence Number=SeqID_11939
MGETEEVQERMKADTEAMKEQMATMMEAMMSIKKIMEVNVAAVTATIAVAGVDPTPPSGLKQINHPTSDVGGPHFVQIHNKHAFPPYDLPSNYTPPNLAHTPIENVNNSTPIPIESQQPQSDHAHVSQPMGETHEVPHHNLVDIEPCLGYTIEGQAVGGVPLPNTLEGPQISPQPQPLHFAVGRVPPAMVKTEKLDHLEERLRAVEGGGDYASANLEELFLVPNFVIPPKFKVPYFD

SEQ ID NO: 128718 - protein, 78 aa, Glycine max
  Coding DNA Sequence Number=SeqID_11940
MDKTFRIYNKIIMIIEESIHVAFDETNPIRPRKETFDDIPYSLEGMHIHGDGHKGKGKGNDEDFQIDETKTSTDLPRE

SEQ ID NO: 128719 - protein, 52 aa, Glycine max
  Coding DNA Sequence Number=SeqID_11941
MVVGGGGGSRERPQAHILFFNHHRVPMIEESHEDEPKTILMRKVVKELVLRD

SEQ ID NO: 128720 - protein, 173 aa, Glycine max
  Coding DNA Sequence Number=SeqID_11942
MASIAQYYDQPLRCFIFGDFQLSPMVEEFEEILGCPLGGRKPYLFSGESSFQMWMGWWTWQRSTFFSPIIKESPVVAMLADLYDTFDRRCEESNARIVCCTPALYVGLVSHLFLQEGRPVYPLQGYRSCVEKGKANWDQLLASMGRRLLIGSLARRKEESGFYLHAKDVQMFP

SEQ ID NO: 128721 - protein, 197 aa, Glycine max
  Coding DNA Sequence Number=SeqID_11943
MASRKLSAKRSRRDATAEGTSAAPEFDNHHFRSAEHLQRFEAIKGWSFHRERRVPLRIGVRDMRSWVRGQWIPFDADALSQFLGHCPTVMHTGSGFCPDRCREAGADHAHQHDHLDPDVDDVAAQQCTPLDPDKSNRALGFPALITGLCQSFGVPITPSKVIRPPITRAFIEKYCTPRQAQAVFTALGLPTGGQPQG

SEQ ID NO: 128722 - protein, 52 aa, Glycine max
  Coding DNA Sequence Number=SeqID_11944
MTPMQKQDVLMMPKDQRIPEHKGRVVPVWFRLSKRSFTKRVEISSGLLEDWT

SEQ ID NO: 128723 - protein, 350 aa, Glycine max
  Coding DNA Sequence Number=SeqID_11945
  Homolog annotation: Hit_ID=Q1SFS3; Match level="QueryCoverage=27%, HitCoverage=18%, E-value=5e-09, Identity=37%"; Hit description =Lambda repressor-like, DNA-binding
IATVVKDSARGLDRIKQTRNGIAGLPQKYLEDKARGMANQGDWVPFMDVLALLIFGVVLFPNVDGLVDLAAIDAFLAYHHSKESPVVAVLADLFDTFDRRCEKSSARIICCLPALCEVEQSVGSPRWKEGKERVLFSMWEGYPKHSAGDFGAQNSKTIQRIHKAWETPLRKDQELRGIRNGIIGGYHEWLKVHIRGLDWLPKLKVVSKESFEAPEEDEEVQALKSELGKAKLAKEKFKLAATHVRKECAGLREENAITARALEQETKRARKEEYGRNKFRGALWGSNNELKLRREERDQSRAHSVVLKEELIACSRSKRSLSQRLCETETNMLAIIAKYQEELGLATAHE

SEQ ID NO: 128724 - protein, 137 aa, Glycine max
  Coding DNA Sequence Number=SeqID_11946
  Homolog annotation: Hit_ID=Q84UT5; Match level="QueryCoverage=43%, HitCoverage=37%, E-value=2e-07, Identity=45%"; Hit description =Hypothetical protein OsBLE3
  Pfam annotation: Domain name=DUF588; Domain location=2-98; Score =43.9; E_value=5.3e-10; Accession=PF04535.3; Description=Domain of unknown function (DUF588)
MDKTRKACHLLLRFLVFLATLAAVILMATSHETATIFTVTFEAKYTNSPAFKYFVTAYSVITVYGFLVLFLPAKSLLWKLVVALDLERNSNPFYFFLVKNLEQHGAPLPRQGKPSGVRIKKYLQIFFHLPHPRKRDE

SEQ ID NO: 128725 - protein, 131 aa, Glycine max
  Coding DNA Sequence Number=SeqID_11947
  Gene Ontology: Cellular component=anchored to membrane
  Homolog annotation: Hit_ID=Q9M0I0; Match level="QueryCoverage=90%, HitCoverage=71%, E-value=1e-36, Identity=57%"; Hit description =Putative GPI-anchored protein
MWVLISWSHFQTCGVEFENKNYTVLTSQCKGPQYPPKVCCEAFKQFACPFSNEVNDMTTDCATVMFSYINIYGKYPPGLFANQCKEGNQGLDCSQVTPTNTSSNTIHVAAPPHFFSLATISAFLGFLFHLF

SEQ ID NO: 128726 - protein, 94 aa, Glycine max
  Coding DNA Sequence Number=SeqID_11948
MEGSQQNTHYPKEKLPKIITHKWKFGNLLEAPNTLPMKGLFVTKLESNEVLLSPIALKVVGPLLQDSNSSRDGPNPPSNSLYGNPQTRKQRDKQ

SEQ ID NO: 128727 - protein, 153 aa, Glycine max
  Coding DNA Sequence Number=SeqID_11949
  Gene Ontology: Mol. function=protein binding; Cellular component =integral to membrane; Biological process=defense response to fungus
  Homolog annotation: Hit_ID=Q1SWI6; Match level="QueryCoverage=78%, HitCoverage=61%, E-value=2e-26, Identity=54%"; Hit description =Leucine-rich repeat, plant specific
  Pfam annotation: Domain name=LRRNT_2; Domain location=27-67; Score =53.1; E_value=9e-13; Accession=PF08263.3; Description=Leucine rich repeat N-terminal domain
MNSSSIYILVFVQLWLLSLPCRESVCIPSERETLLKFKNNLNDPSNRLWSWNPNNTNCCHWYGVLCHNVTSHLLQLHLNSAFYEKSQFGGEISPCLADLKHLNYLDLSGNGFLGEGMSIPSFLGTMTSLDSPQPLSYWIQGEDFLLRLGISQI

SEQ ID NO: 128728 - protein, 150 aa, Glycine max
  Coding DNA Sequence Number=SeqID_11950
  Subcellular localization annotation: CTP_CleavageSite=92; ConfidenceScore=5.01e-01
MGPQSTLRLMRTLGPSLVSLAQSTWSLLSNALLCTNPDLGCCPLSITLPTLVGTLNISHNHFIDNIPFSLKTFLVTISLNLHYNNLTREIPQVEFPWNPMAPKSSASINYQMQSYPPRALDRRLQEDLAKDAREGPRVLMSLRVDFGPMG

SEQ ID NO: 128729 - protein, 87 aa, Glycine max
  Coding DNA Sequence Number=SeqID_11951
MAVAKAIDEAGIGDELKDEEDDDKDKDAKEFNVANDNMRSGFGNDVSSIGACRSRIFFINGFICFLEDECQRNGEGRERGDATSRRI

SEQ ID NO: 128730 - protein, 343 aa, Glycine max
  Coding DNA Sequence Number=SeqID_11952
  Gene Ontology: Mol. function=hydrolase activity, hydrolyzing O -glycosyl compounds; Biological process=carbohydrate metabolic process
  Homolog annotation: Hit_ID=P29126; Match level="QueryCoverage=78%, HitCoverage=30%, E-value=5e-10, Identity=22%"; Hit description =Bifunctional endo-1,4-beta-xylanase xylA precursor
MGKWDHRPSRRFFRRRRSPVRPPTFYDINAPLPEYWQDGIPLWEKKYCTIVGLVPWQKIVDSKMFVYCHSNVFDWNDSAAEEALQNAKNHYWAKINSLPCDISLPDPDTYNDQIDWNPYIDPDMIKEIDKAFFTVPDEEQETAIKNKRTKTSVNDENPLECSDTPLSRALENNEVQRWNQGNSGDVDNTDNPWECSVTHGNGRLTDNAWEGGPVKSWGWNEGRDHNQCKDWNSENLQDKGWGKARDSSWCQQQSNNLANFGNSSWQCKSSQQNVTPLKTGWRNSGANGSGWKQQEKADVSRRNYGGWTAQNKGNQWREGSHWHTLGSNGSQFQRDGCQTGHYW

SEQ ID NO: 128731 - protein, 91 aa, Glycine max
  Coding DNA Sequence Number=SeqID_11953
MWLSLTWEGINELEYDVDLGGCLVWNLYVAHVDHMGWSLLARLSSLLHVLPSFFHKFFPVPRAYEKRLFKGMMRDISRMTLLSTGYNKYFL

SEQ ID NO: 128732 - protein, 104 aa, Glycine max
  Coding DNA Sequence Number=SeqID_11954
  Subcellular localization annotation: CTP_CleavageSite=97; ConfidenceScore=5.19e-01
MKCQKCQLSLPHQWAKCASTAKRSFIALRATEESGRASASRSRAKREISALSAAGYNAQGTKFHRHHSAYFRKIALEAARGAAFAEIPRFCKLFIVRVSSVMAG

SEQ ID NO: 128733 - protein, 78 aa, Glycine max
  Coding DNA Sequence Number=SeqID_11955
MDQLKHLSIPSGMLRFSNHASYPRLGHSTRSVHSTPPGHTLHTTYDRGQKLVPKTLEGQCIVPPTIIHNIQRMNVAKS

SEQ ID NO: 128734 - protein, 50 aa, Glycine max
  Coding DNA Sequence Number=SeqID_11956
MTQLVSRGHLRVGPLRFLEARLMSQVYESKKDHVEGRGLDSRMFEKESTM

SEQ ID NO: 128735 - protein, 86 aa, Glycine max
  Coding DNA Sequence Number=SeqID_11957
  Homolog annotation: Hit_ID=Q09JM0; Match level="QueryCoverage=66%, HitCoverage=98%, E-value=2e-08, Identity=58%"; Hit description=10 kDa putative secreted protein
MNRKLGYGAQLRANLDPTKGVGRLRQQDGGHGSRNPLRRRGGRCKTQGASPGGAVVGADLGGSSNIQMRTLKAEEGKVPCERHLHM

SEQ ID NO: 128736 - protein, 111 aa, Glycine max
  Coding DNA Sequence Number=SeqID_11958
  Subcellular localization annotation: CTP_CleavageSite=31; ConfidenceScore=5.12e-01
HFVSKRPFRGNTGSNKNRRKSLKVYQSHTVCGEKVASAQDFVGNQRERTTLGRGFLFLVHLGEDCHSQVYDKLGFWLKACRTAGHDICQGLASGSGIKGMSYIISMIHMQQ

SEQ ID NO: 128737 - protein, 224 aa, Glycine max
  Coding DNA Sequence Number=SeqID_11959
MVQKAIDKGRLKSEEKPMKVDTDPFHIQANYIKPMQTMMMGALIGMPRVSTLLSEEEVNQALEEFEKEEESVFLPTRETLVGFLLKKQKAEKEVMLCHRCSVVFDKSTKAFEALEIRKSFQKIYEIDVKGKEKQNINMTESSLKVQFSFQSIRSDLALRRGGTTEGSKKGYYEYQNPPWIVGLGSSSSIDFFASWKMNGSGMEKEEKEETPLQGEDESRRSSPP

SEQ ID NO: 128738 - protein, 126 aa, Glycine max
  Coding DNA Sequence Number=SeqID_11960
MENMFMQFMETSQARFKANQNSIQNLEIEDGKSYSMENCWWEKELQPYNQYEEERISNLDNLLMQLMETSEATQHTIQNLEIQVGKLAKQVAKLPLVTREENFVEVEAYEESLVEEHDSREKDEGK

SEQ ID NO: 128739 - protein, 63 aa, Glycine max
  Coding DNA Sequence Number=SeqID_11961
MRKLIKERMENKVVNFVGLNKVKWWLDRNIEMAITEATGLQMRGFQNEVKGLVFKVNLGSRIT

SEQ ID NO: 128740 - protein, 70 aa, Glycine max
  Coding DNA Sequence Number=SeqID_11962
MTTVCYFRYMLYIQGEVVIKHPKHGSIPHNLQQLQKKLWDGINEALGLNPELGLDLKRADYFILQNFILS

SEQ ID NO: 128741 - protein, 94 aa, Glycine max
  Coding DNA Sequence Number=SeqID_11963
MQDGGSSQYCIIIMILQRILLGERAVYAMMLVFPPEFSPLKTILFGNPSQDTIEPLMEALEEDYKDGNEINESRQFIGGVLDLEKRINRLDTLT

SEQ ID NO: 128742 - protein, 124 aa, Glycine max
  Coding DNA Sequence Number=SeqID_11964
  Gene Ontology: Mol. function=cysteine-type peptidase activity; Cellular component=cytoplasm; Biological process=fucose metabolic process
MKESHISNEYENGVEQFLQFTERNAPSMDGKFFCPCVKCVDGRCQSKILLEDNTLLKDQYKAKKILCPVGMEYQKIHSCPNDCILYENQFVEMCKCPTCGVSQYKVKDEECCDDKATNNDHPTK

SEQ ID NO: 128743 - protein, 74 aa, Glycine max
  Coding DNA Sequence Number=SeqID_11965
MQKGSQSEPFDVEMGDRLEDKIRDLGQESFQQAHVPMYDTLQSDLKKPLYLVSKKSLTLLSIVLSLVNVKARYG

SEQ ID NO: 128744 - protein, 104 aa, Glycine max
  Coding DNA Sequence Number=SeqID_11966
  Subcellular localization annotation: CTP_CleavageSite=53; ConfidenceScore=5.30e-01
MTMQNMQFQQETRASIQSLTNQMGQLATQLNQQQSQNSDRLPSQSVQNPKNVSAITLRSGKQCESSTGNSDLQKQHIPLPFHPRAISNKKWKRQRRRYWKHLEK

SEQ ID NO: 128745 - protein, 175 aa, Glycine max
  Coding DNA Sequence Number=SeqID_11967
IIYNFLTNEITLTHLGTKFVLHPQTPSPVAKDQLTKKDKRDKEEKLEKQKKKKDSKALSLKANGKEKEEKDSSKNIVKKENHFVTKGDIKRALLLKQSFYLLLSRETSLSTAIPLELKVIPQVKELLDEGLVHKSLTPCALLVLKIGVPTNPKRIKVILEWPTPPSIRKIGASMT

SEQ ID NO: 128746 - protein, 104 aa, Glycine max
  Coding DNA Sequence Number=SeqID_11968
  Gene Ontology: Mol. function=RNA-directed DNA polymerase activity; Cellular component=membrane; Biological process=RNA-dependent DNA replication
MVVKYNNLTTHLVDLEEVFDQLRKYNMRLNPKMCVFGGIHANLDKCQAILEMKSPRNVKETQRLVDRITSLSRFLPRIAEKARPIMNLLKTKNFVWDEWCEESF

SEQ ID NO: 128747 - protein, 207 aa, Glycine max
  Coding DNA Sequence Number=SeqID_11969
  Gene Ontology: Mol. function=RNA-directed DNA polymerase activity; Biological process=RNA-dependent DNA replication
  Subcellular localization annotation: CTP_CleavageSite=7; ConfidenceScore=5.05e-01
MIRRRACSHALQYTPQSSLTQCPRRSCFNPLPRNEVPVRSRDNHNCAHQPKDNQRILHWQPLAMSSYKGGAPEVVHCVETRTKIKEVEELELDPGTNDDNRVKPVEETPTFQLGPKEGQVIQEHMDLFAWSVTNMFEIDPSFHCHKLAICKDAKPVTQRKRKMGKERLHKSKSSMLEGCILTPKHRLTGRWSSQTQDVEFFGCLFRL

SEQ ID NO: 128748 - protein, 677 aa, Glycine max
  Coding DNA Sequence Number=SeqID_11970
  Gene Ontology: Mol. function=protein serine/threonine kinase activity; Cellular component=cell surface; Biological process =protein amino acid phosphorylation
  Homolog annotation: Hit_ID=Q1T003; Match level="QueryCoverage=99%, HitCoverage=99%, E-value=1e-160, Identity=74%"; Hit description =Protein kinase; Concanavalin A-like lectin/glucanase
  Pfam annotation: Domain name=Lectin_legB; Domain location=24-249; Score=259.7; E_value=6.1e-75; Accession=PF00139.10; Description =Legume lectin domain
  Pfam annotation: Domain name=Pkinase; Domain location=343-618; Score =159.6; E_value=8e-45; Accession=PF00069.15; Description=Protein kinase domain
  Pfam annotation: Domain name=Pkinase_Tyr; Domain location=343-618; Score=125.6; E_value=1.4e-34; Accession=PF07714.7; Description =Protein tyrosine kinase
  Pfam module annotation: Pfam domain module=Lectin_legB::Pkinase::Pkina se_Tyr; Domain location=24-249::343-618::343-618
  Subcellular localization annotation: CTP_CleavageSite=13; ConfidenceScore=5.45e-01
MSPLQTSFFVFFLCFLNASSSIFATTQFDFGTLTMSTLKLLGDAHLNNNTVSLTGDPAVPNSAAGRALYSAPVRFRQPGTPSPASFSTFFSFSVTNLNPSSVGGGLAFVISPDSSAVGDPGGFLGLQTAGGGNFLAVEFDTLMDVEFSDINGNHVGLDLNSVVSTQVSDLGGIGVDLKSGDSVNAWIEYDGNAKGLRVWVSYSNVRPKDPILKVDLDVGMYVNDFMYVGFSGSTQGSTEVHSVEWWSFNSSFDSAAAPAASSAPSATSEQKESRSSRKSTVGAVAGVVTAGAFVLALFAGALIWVYSKKVKYVKKLDHSIESEIIRMPKEFSYKELKLATKGFSANRVIGHGAFGTVYKGVLPESGDIVAVKRCNHSGQGKNEFLSELSIIGSLRHRNLVHLQGWCHEKGEILLVYDLMPNGSLDKALHESRMPLSWPHRLKILLGVSSVLAYLHHECENQVIHRDIKTSNIMLDEGFIARLGDFGLARQTEHDKSPDATVAAGTMGYLAPEYVLTGRATEKTDVFSYGAVVLEVASGRRPIEKDAPAAGNGKVGISSNLVEWVWSLHQEGKLLTAADPRLEGEFEEGEMRKVLLVGLACSHPDSMARPTMRGVVQMLLGEAEVPIVPRAKPSTSYSTSQLLMNLQDSESECNNGMITISTSSSESSFNGRDSLMEV

SEQ ID NO: 128749 - protein, 116 aa, Glycine max
  Coding DNA Sequence Number=SeqID_11971
MDALNEGSSKACLKTHFYMWTNRRPNMRHLFTENEEINGSIVPWNVEIKEVRVRDPLTYASSNKNCQKVARELDVNGSLRLQDSHGNLERYKAKLFAKGFTQKDGVDYKDSFSPFS

SEQ ID NO: 128750 - protein, 87 aa, Glycine max
  Coding DNA Sequence Number=SeqID_11972
  Gene Ontology: Mol. function=glutamate decarboxylase activity; Biological process=carboxylic acid metabolic process
  Homolog annotation: Hit_ID=Q1S578; Match level="QueryCoverage=99%, HitCoverage=14%, E-value=2e-28, Identity=95%"; Hit description =Pyridoxal-dependent decarboxylase
MVLSKTASESDVSVHSTFASRYVRTSLPRHCWKIKRFTLTPQCKVQDGGGVDTEGGSIPDHKRRVDVGWEPKVEFGIICDDLDGARV

SEQ ID NO: 128751 - protein, 115 aa, Glycine max
  Coding DNA Sequence Number=SeqID_11973
MTNANCPQESLHLVSNGNLRGTTEVDGICDNQEGLGCEYTSQPTASATSRPDLLSGPHVPAKGVSVYDEGVFDVSSIGACRPRIFFINGFLCFLEDEWQRNGEGRERGDATSRRI

SEQ ID NO: 128752 - protein, 341 aa, Glycine max
  Coding DNA Sequence Number=SeqID_11974
  Gene Ontology: Mol. function=oxidoreductase activity, acting on paired donors, with oxidation of a pair of donors resulting in the reduction of molecular oxygen to two molecules of water; Cellular component=endoplasmic ...
  Gene Ontology: Cellular component=reticulum; Biological process=fatty acid biosynthetic process
  Homolog annotation: Hit_ID=Q949X0; Match level="QueryCoverage=99%, HitCoverage=95%, E-value=1e-131, Identity=62%"; Hit description =Palmitoyl-monogalactosyldiacylglycerol delta-7 desaturase, chloroplast precursor
  Pfam annotation: Domain name=FA_desaturase; Domain location=110-326; Score=191.8; E_value=1.6e-54; Accession=PF00487.14; Description =Fatty acid desaturase
  Subcellular localization annotation: CTP_CleavageSite=43; ConfidenceScore=5.21e-01
MALLTSQPKNPILHRFTTLHCPLPRLHRTVLGLGSFSHNMTAKANANAAFGEGFKEEGASRHRKILLSEVEVKRERRVFFGRKWNSLDFGTAGIVLAMHLLCVFAPFHFNWPAFWVAVALYIVTGLFGITLSFHRNLSHRSFKLPKWLEYFFAYCGVLALQGNPIDWVSTHRYHHQFCDSERDPHSPTEGFWFSHMSWLFDTNSVLERCGEANNVGDLEKQSFYRFLRSTYLAHPFALGALLYAAGGFPFLVWGMGVRIVWVYHITWFVNSACHVWGNQAWNTRDLSRNNWWVALLAFGEGWHNNHHAFEYSARHGLEWWQIDMTWYVVRFLQAIGLATDV

SEQ ID NO: 128753 - protein, 109 aa, Glycine max
  Coding DNA Sequence Number=SeqID_11975
  Gene Ontology: Mol. function=sucrose synthase activity; Biological process=sucrose metabolic process
  Homolog annotation: Hit_ID=Q9FX32; Match level="QueryCoverage=98%, HitCoverage=11%, E-value=3e-26, Identity=49%"; Hit description =Sucrose synthase, putative
MASSPLLRGKEFVTSGMPDDAMRRSRYHVKRCFAKYIEKGRRTIKLHNLMEEMEHVIDDNNERNQLLEGNLGFLLSCTQEVAVDPPYVAFAVRPNPGVWEFVRVSSEDL

SEQ ID NO: 128754 - protein, 261 aa, Glycine max
  Coding DNA Sequence Number=SeqID_11976
  Gene Ontology: Mol. function=sucrose synthase activity; Biological process=sucrose metabolic process
  Homolog annotation: Hit_ID=Q9FX32; Match level="QueryCoverage=98%, HitCoverage=30%, E-value=1e-116, Identity=74%"; Hit description =Sucrose synthase, putative
  Pfam annotation: Domain name=Sucrose_synth; Domain location=1-261; Score=120.0; E_value=7e-33; Accession=PF00862.10; Description =Sucrose synthase
MGTRSEILQAPDAVNLEKFFSRVPTIFNVVIFSIHGYFGQADVLGLPDTGGQVVYILDQVRALEAELLLRIKQQGLNVKPQILVNYASILLAMTGILRQWVSRFDIYPYLERFTKDATAKILNLMEGKPDLIIGNYTDGNLVASLMANKLRITQGTIAHALEKTKYEDSDVKWKELDPKYHFSCQFMADKIAMNESDFIITSTYQEIAGSKDRPGQYESHAAFTLPGLCRVVSGINVFDPKFNIAAPGADQSVYFPYTDKD

SEQ ID NO: 128755 - protein, 47 aa, Glycine max
  Coding DNA Sequence Number=SeqID_11977
METEIKTVQKRLQKGIAIASAHTQYPLDSEHRVVNNLIINILGYLYD

SEQ ID NO: 128756 - protein, 213 aa, Glycine max
  Coding DNA Sequence Number=SeqID_11978
  Gene Ontology: Mol. function=sucrose synthase activity; Biological process=sucrose metabolic process
  Homolog annotation: Hit_ID=Q9FHU4; Match level="QueryCoverage=99%, HitCoverage=27%, E-value=7e-84, Identity=67%"; Hit description =Sucrose synthase
  Pfam annotation: Domain name=Glycos_transf_1; Domain location=1-169; Score=22.9; E_value=4.9e-05; Accession=PF00534.10; Description =Glycosyl transferases group 1
MARFDVVKNLTGLVEWYGKNQRLRKMVNLVIVGGFFDPLKSKDREEMAEIRKMHDLVEKYQLKGQFRWIAAQTDRYCNGELYRFIADTTGAFVQPALYEAFGLTVIEAMSCGFPTFATNQGGPAEIIVDGISGFHIDPHNGEESSNKIADFFEKCLQDSTHWNKISAAGLQRINEWWVNNEQKEAKQRYIKMFYNLMYKNLVKTIPVPNHEPQ

SEQ ID NO: 128757 - protein, 125 aa, Glycine max
  Coding DNA Sequence Number=SeqID_11979
MYMHVQFLATHKGTLMVGFYYATKKLAWEIFDIDGRIKYKIEVPWQNIMGMQAIVEESKSEILQIELAKAPPFFRHIDPNPRSHPQWEPSKDFTGGHALKYRRHYLGFALGDLSKNYQKLIQSDN

SEQ ID NO: 128758 - protein, 77 aa, Glycine max
  Coding DNA Sequence Number=SeqID_11980
MYHILCEYSACEDWYNGAVSQPQLALADLIEVLFPTENYTTTYFRNIAKAEVPINIGLEMCDRDTSTAMEPTIVACG

SEQ ID NO: 128759 - protein, 676 aa, Glycine max
  Coding DNA Sequence Number=SeqID_11981
  Gene Ontology: Mol. function=DNA binding; Biological process =regulation of transcription
  Homolog annotation: Hit_ID=Q9FFI5; Match level="QueryCoverage=80%, HitCoverage=90%, E-value=5e-96, Identity=40%"; Hit description=NAM (No apical meristem)-like protein
  Pfam annotation: Domain name=NAM; Domain location=6-134; Score=315.7; E_value=8.1e-92; Accession=PF02365.6; Description=No apical meristem (NAM) protein
MAPVSLPPGFRFHPTDEELVSYYLKRKINGRKIELEIIHEVDLYKCEPWDLPGKSLLPGKDLEWYFFSPRDRKYPNGSRTNRATKSGYWKATGKDRKVNSESRAIGMKKTLVYYRGRAPHGCRTGWVMHEYRLDETQCETNSGLQDAYALCRVCKKTAVIPPKVGDQHYVNVPSHVNQITSDQSSSIDIEIYSEGRGEVLESSNYLMPWDTCPSPNINIGSALNININGGTRDNNIGTWSHFLAEDLPNLPTSASSFPNYGSMSYPPSKVDIALECARMQHRFTMPPLEVQDFPQVGISELKMAQASGSNMCGGSRNNETDILQEILSVAHASHELINQSNYSSHSQALGANENNYAAPHESDFTFMVGNNYNRVNDMNTMGFVDKAWEDPNARSIEIGDLDDGFKTERMVENLRWVGMSSKNMEKGFMEEQKIVPIEHISNFQTNREENEVQVGSQQHNNNKELNDTDIDDFSMGFINGDDHNENFIDEGNINYSNSTNFEVVEETKVSHGMFVSTRQVADTFFHQIAPSQTVKVQLNPLMAEDQSIENAVMVNQGPPFFRKFKAYVMGKLTKSSNTIASALVFLFALLLMHCVFLKEQVEDLKSDPKCFDGANSMKKIMRQPAENIIWNEQENFWSVGIKCGKGFSVVLKKIGIFLTISLALCTMWANHVIVDS

SEQ ID NO: 128760 - protein, 322 aa, Glycine max
  Coding DNA Sequence Number=SeqID_11982
  Gene Ontology: Mol. function=RNA-directed DNA polymerase activity; Biological process=RNA-dependent DNA replication
MILNVEMRWVVAEQSNKRSLFQLMDSAPSCSWLQAFSFLALVWLFNCGCVHGATPAVKVGNFSKVEDAGNFHIYYGQTFKVIKNSAEGQSYLLLQLLGLVESLKGITSDYVASPCVLKLYEGGQIELFNNSDYQKLAEFSSYFLSDTDQQPACNFATFVPFIEDIPLQRAEWIKFMGAFANVEARANQVYTAVKANYLCLAKIATSRTTFKPTVAWMRYKNGLWSFTQEKYQLKYVQDAGGEILGANKNTYNVSDPDDLEEFHAILCTVEVVIDETLTSDPVNYTFSTFIQNLNVEDRSCFSFISNTSLWRYDKRVYNSVAL

SEQ ID NO: 128761 - protein, 850 aa, Glycine max
  Coding DNA Sequence Number=SeqID_11983
  Gene Ontology: Mol. function=nucleic acid binding; Cellular component= beta-galactosidase complex; Biological process=DNA integration
  Homolog annotation: Hit_ID=Q1S1G2; Match level="QueryCoverage=93%, HitCoverage=85%, E-value=1e-104, Identity=44%"; Hit description =Integrase, catalytic region; Zinc finger, CCHC-type; Peptidase aspartic, catalytic
  Pfam annotation: Domain name=zf-CCHC; Domain location=202-219; Score =9.3; E_value=0.029; Accession=PF00098.13; Description=Zinc knuckle
  Pfam module annotation: Pfam domain module=RVT_2::Retrotrans_gag::zf -CCHC; Domain location=480-700::26-131::202-219
MAFLLGTILIPSVKEPLYSAWERCNTLIMSWLLNSLSPSIAQSVIFLEYATDIWNDLRECFSQGDLLRIAELQEEIYGLSQGNRLLSDFYTALKTLWEELDNYRPFVTCSCEAKKCHQQDFVIRFLKGLDECFFVVRSQILFMDPLPTVNRVFSMVVQHECQLSVVPPSSVEPNSFVNASNGFGKGRSVSSSLSTNKNASNKKCSYCHRTGHTINVCWGKHDYPSGHPHYLGRPRFNNRDSSSSANSTASIDPVERPTASSCPITLTQAQYQSLMALIQQPNSASNATGNNLVQPNSANLIQVPKEAQRDPLPMPTNAQNLHEENPIQMPNLDLTPTYTTQQPNFIPSPNRHLPSFFSPSLQSQLPSTSPQLSSHQFRTPGSPSFTIDTHLHHSPTPTSTPFVPRRSSRPIKPNVCLADYICSIETQPNQSSSTCLYPLQSVLSYSNISESERHYIMNLSSGIEPQSYQEAILSPYWVEAMKDEIEALKLNNTWEIFDTLAVEGIDFFETFSPVVKMTTIRVILTLASANKWQLQQLDVSNALLHGDLSEEVYMTIPQGLQGHGSSQCCKLKKSLYGLKQASRKWYEKLSDLLISSGYQQSHADHSLFIKHNGYKFTTLLIYVDDIVLSGNFAAEMAQIKNILHSNFRVKDLGALKYFMGLEINHSADGIYVSQCKYYLELLVDFGMMGCKPCSTPMDSSLRLHQDDSSDLLDDPLSYRHLVGHLIYLSTTRPDIVFATQQLSQFMAHPTKSHLGAARRVLRYLKGSPSKGLQFKRDTLIHLIGFSDSDWATCVDTRKSITEKAQAGLMRLLPVPSSHQLADMFTKALPPHLFKSNVSKLKLIDLYTPPA

SEQ ID NO: 128762 - protein, 843 aa, Glycine max
  Coding DNA Sequence Number=SeqID_11984
  Gene Ontology: Mol. function=zinc ion binding; Cellular component =membrane; Biological process=defense response
  Homolog annotation: Hit_ID=Q84RS2; Match level="QueryCoverage=98%, HitCoverage=83%, E-value=0.0, Identity=65%"; Hit description=ZR1 protein
  Pfam annotation: Domain name=DZC; Domain location=791-826; Score =74.9; E_value=2.5e-19; Accession=PF08381.1; Description=Disease resistancezinc fingerchromo
  Pfam annotation: Domain name=FYVE; Domain location=420-488; Score =45.9; E_value=1.4e-10; Accession=PF01363.12; Description=FYVE zinc finger
  Pfam annotation: Domain name=RCC1; Domain location=152-199; Score =8.9; E_value=0.076; Accession=PF00415.9; Description=Regulator of chromosome condensation (RCC1)
  Pfam annotation: Domain name=RCC1; Domain location=203-251; Score =25.2; E_value=0.00023; Accession=PF00415.9; Description=Regulator of chromosome condensation (RCC1)
  Pfam annotation: Domain name=RCC1; Domain location=265-314; Score =46.0; E_value=1.3e-10; Accession=PF00415.9; Description=Regulator of chromosome condensation (RCC1)
  Pfam annotation: Domain name=RCC1; Domain location=317-364; Score =16.4; E_value=0.012; Accession=PF00415.9; Description=Regulator of chromosome condensation (RCC1)
  Pfam annotation: Domain name=RCC1; Domain location=368-417; Score =38.6; E_value=2.1e-08; Accession=PF00415.9; Description=Regulator of chromosome condensation (RCC1)
  Pfam module annotation: Pfam domain module=DZC::FYVE::RCC1::RCC1::RCC1 ::RCC1::RCC1; Domain location=791-826::420-488::152-199::203-251::265- 314::317-364::368-417
MKVHSVCASPTLSLSERCFSDGLSCTSDNFYSSSSFLSNTHGVTDNSVPSSPYIDPDNHSNIESTRIDKEHKKNLSYRYLMHSTSPHVGKNNVLKDVMIWGGGIGCLVGIVNERFVQPRIYSLVPKLLESTAMLDVHNIALGGKHAALATKQGEVFCWGHDLLIEGRTRSQWIPQKLGGSLDGISISSVACGEWHTAIVSSCGRLFTYGDGTFGVLGHGDLRSYSSPKEVESLSGLRVRSAACGSWHTAAIVEVMFDRFRYNSASGKLFTWGDGDEGRLGHVDNGSKLVPTRVTQLVDYDFVQVSCGRMLTVALTNMGKVFAMGSAKYGQLGNPHARDKAVMVEGQLKQEFVKVISTGSYHVAVLTSGGSVYTWGRGENGQLGLGDTEDRYTPCFVEALRDRQVNTITCGPSFTAAISLHKPISISDQSTCTGCRLPFGFTRKKHNCYSCGLLFCRACSSKKITNAPLAPSKSKAFRVCDQCFDKRQGGTHPVMASKSRNHNSQQLLKHQHKIADVTEDRGETTVTQGPLLSLGQSCYRKSMPSGRKDWKSNQESQQDVEDSSPMLGGMPQWGQVPCPAIFKINSTENPVAHVSSSKNKLATVSPFNVESTTYNFSNVETDATKSDKVLLEEVHRLRAEAKRLEEQCELKNHKIQECQQKIEESWFVAREEAAKCKAAKEVIKALALRLHTISGKDNVGQEGKAGPNEFVPNVAPIHTEMKSPRDVNVDSLSNSPIVFSDTLKSKFGRSLFPKIDNSNRAESQQDNIDGLKAEWVEQYEPGVYITFTTLQCGKKGLKRVRFSRKRFSEKEAEKWWEENQGTVYHKYGIEGYINNNTSQSQVKG

SEQ ID NO: 128763 - protein, 440 aa, Glycine max
  Coding DNA Sequence Number=SeqID_11985
  Homolog annotation: Hit_ID=Q07Q13; Match level="QueryCoverage=38%, HitCoverage=27%, E-value=1e-20, Identity=34%"; Hit description =Hypothetical protein precursor
RAHAVEIFTTNYDLLFEQAFEAANAPYFDGFTGGHAPFFDPVTVAGNDLPPRWSRIWKLHGSLGWKISNQVVIRTGNRESADLVYPDHLKYDLTQKQPYSALFERLKQFLLTPDTVLLSIGFSFRDAHISAVVGEALAMNSNAAVLAFQYQALANEEPARKLAFEHPNLSVYASDAAVIGGVEGAWRPGDLPKNWGEIRASFWGSRQKDEAQSFLLGDFGRFCRFCALSSSADISLPVPVAPIRLAESLSSGLAMIDGHTYRVGQVGSFVRIPLGYQSLYGVVSEIGAELSLGDARSNMASGSGRWMKVELAGEAIGGRFERGLSQHPNVNDAVHLVTQRDLLNIYGDESEDQVPIGTLSSAENIAVRLSLDALVTRHSAVLGSTGSGKSTTVASLLRSIVQSSESLEQSGARVLLLDLHGEYSSALNDIAKIFSATPQP

SEQ ID NO: 128764 - protein, 97 aa, Glycine max
  Coding DNA Sequence Number=SeqID_11986
  Homolog annotation: Hit_ID=Q84RS2; Match level="QueryCoverage=69%, HitCoverage=6%, E-value=3e-28, Identity=88%"; Hit description=ZR1 protein
  Subcellular localization annotation: CTP_CleavageSite=59; ConfidenceScore=5.09e-01
MEIAKIMYGLINSSPFTDKICKDKAQAASWFVGLKAVISRCQHPRAFSSLRSCKGVQSCASSPAGILRRKKNLGLLDDTSQFTQVSYIFFVRFSVYN

SEQ ID NO: 128765 - protein, 61 aa, Glycine max
  Coding DNA Sequence Number=SeqID_11987
MEPTRGPFCDESDGQKFPAKLVVGLGMKAMRVGSKVMLSFVRGAVILCECSVCPLHLLVAS

SEQ ID NO: 128766 - protein, 172 aa, Glycine max
  Coding DNA Sequence Number=SeqID_11988
MQIGGCHICGGAHELGQCIAQEDSSKEVNYMGAQSRHGFQGYNQGGPSGFNQGMNLTQGSSWRNHPGNQFNKEQKSQPAQNSNQGIDLYKKTNKLQETLNQFMQIFMSNYRSMESSIKNLEIQVRQLAKQMAERPTSSFGANIEKNLKEERRGVLTRSQMRAQGEKEKAKGE

SEQ ID NO: 128767 - protein, 65 aa, Glycine max
  Coding DNA Sequence Number=SeqID_11989
MMREKKAFPKVEFSNFGCVLECSEIRCLPVFVLSACCSLSVVPVFTLCAPLPRLASMLVFTLSVP

SEQ ID NO: 128768 - protein, 53 aa, Glycine max
  Coding DNA Sequence Number=SeqID_11990
MEGDNGIAPRQYKWRLQSLLVLSNVWEPYKSNQRRNLRNLKKLLEMPISLSED

SEQ ID NO: 128769 - protein, 79 aa, Glycine max
  Coding DNA Sequence Number=SeqID_11991
  Gene Ontology: Mol. function=protein-tyrosine kinase activity; Biological process=protein amino acid phosphorylation
  Homolog annotation: Hit_ID=Q8LDB7; Match level="QueryCoverage=82%, HitCoverage=18%, E-value=9e-15, Identity=51%"; Hit description =Somatic embryogenesis receptor-like kinase, putative
FGIFLLELASGRRPVVKLSSTVKQSIVDWALPLVCKKKFSELADPRLNGNYVEEELRRVALISCTCMCSGSIWEETNHA

SEQ ID NO: 128770 - protein, 256 aa, Glycine max
  Coding DNA Sequence Number=SeqID_11992
  Gene Ontology: Mol. function=cysteine-type peptidase activity; Cellular component=nucleus; Biological process=proteolysis
  Pfam annotation: Domain name=Transposase_21; Domain location=82-254; Score=195.0; E_value=1.8e-55; Accession=PF02992.5; Description =Transposase family tnp2
MLPKSYYQAKKILYPMGMEYQKRHACPNDCILYKYEYEEMHKFPRCEVSRYKVKDDDECRSDESTTKGPPTKRLFANVDDAKNLTWHANGRNCDAMLCHPIDSSQWKKINHLYLNFEKEARNLSLGLATNGMNPYGNLSIQHSPWPVLLVICNLPPWLCTKQKYMMLSMMILGSRQPGNDINVYLSPLIEDLTKFWDEGVVMFDGYQNETFKLHAMQFCTINDFLAYGNLSGYSVNDYHACSICEEDTTYVQLKHG

SEQ ID NO: 128771 - protein, 119 aa, Glycine max
  Coding DNA Sequence Number=SeqID_11993
MTLKSKKSITGITLKQGEGKWSSMENRSPPCRITSPLVWESLQSYNSLIWETNTEVHKTHRHVKSPDNAPDYIRLAAFPFSLGGKAKNWLGGWSSRSIITWDRCSLASLKKFSPTTKSA

SEQ ID NO: 128772 - protein, 188 aa, Glycine max
  Coding DNA Sequence Number=SeqID_11994
  Gene Ontology: Mol. function=RNA-directed DNA polymerase activity; Biological process=RNA-dependent DNA replication
MYLSFYFIFFIKYLKSIKIGDHIIPQVTRFKYLGSVIQDDEEIEGDVNHRIQAGWMKWRKASGVLCDAKVPIKLKGKFYRTAVRPAILYGTECWAVKSQHENKVGVAEMRMLRWMCSKTRQDKIRNEAIRERVGVAPIVEKMVENRLSWVGHVERRPGEFSVDEESLVANAGEARGAVLIRFLCGTRL

SEQ ID NO: 128773 - protein, 226 aa, Glycine max
  Coding DNA Sequence Number=SeqID_11995
  Gene Ontology: Mol. function=DNA binding
  Homolog annotation: Hit_ID=Q1S6E0; Match level="QueryCoverage=100%, HitCoverage=67%, E-value=1e-46, Identity=52%"; Hit description =Ubiquitin system component Cue; UBA-like
  Subcellular localization annotation: CTP_CleavageSite=27; ConfidenceScore=5.07e-01
MSAAVCGSKRSFFEELPPSPPLSKRLRCSSSPIRFPPPSPVDQLRPLFPHMDDLFLLILSNLLPFFPFFVSFGSIPNCMSSNGSLLTVSPFMESGVNGALGTCEGQVLERALQECGNDIDAAIKRLNELCLGTADRNGIAEELEVVINLDAGNLEGDGNASVSEEQPALNNHLPADGAEWIDFFVREMMVATSVEDARARAARMLEVLEKSISERAKAEATDVLQK

SEQ ID NO: 128774 - protein, 405 aa, Glycine max
  Coding DNA Sequence Number=SeqID_11996
  Gene Ontology: Mol. function=protein dimerization activity; Cellular component=nucleus; Biological process=regulation of transcription, DNA-dependent
  Homolog annotation: Hit_ID=Q1S6D5; Match level="QueryCoverage=88%, HitCoverage=75%, E-value=5e-53, Identity=51%"; Hit description=Zinc finger, BED-type predicted; HAT dimerisation
  Pfam annotation: Domain name=zf-BED; Domain location=54-105; Score =47.7; E_value=4e-11; Accession=PF02892.5; Description=BED zinc finger
MESATYCCPSDVPFFMFSRVTRAIMEFVACANPDNNDEISDSETQPNKWMRKKSMVWDYFTVETVGAGCTRAYCKQCKKSFSYITDSKLTGTSHLKRHISLGICRVLREKNQQRSYPKTGGSLDTANPLKKGPRATPGFAGNGISFYQEHCNHDVAKMIILHDYPLHIVKQQGFIDFVWMLQPQFNPFCLNSVEADCVAMHLRKNEAVMGNLRGLLFVKNPAILNSQLLNQNGYARALSHFAADALLATRETISKVRKTVMHVKSSESHKRKFIELKQHLQVPSMVDLSIDDQYKWNTTYHILVAACELKEVFTCLDTIYPDYRMTLTMGDLSKVQVELTYAAFSQDPFLSTMDPRHKMKLVKFPFAKIFGENAEAWIKIDEDVFGRHGVGEEMEGSEVGIYGIR

SEQ ID NO: 128775 - protein, 377 aa, Glycine max
  Coding DNA Sequence Number=SeqID_11997
  Gene Ontology: Mol. function=heat shock protein binding; Cellular component=chloroplast thylakoid membrane; Biological process =response to heat
  Homolog annotation: Hit_ID=P92424; Match level="QueryCoverage=99%, HitCoverage=97%, E-value=7e-86, Identity=44%"; Hit description=DnaJ homologue precursor
  Pfam annotation: Domain name=DnaJ; Domain location=65-126; Score =134.2; E_value=3.5e-37; Accession=PF00226.21; Description=DnaJ domain
  Pfam annotation: Domain name=DnaJ_C; Domain location=248-373; Score =62.0; E_value=1.9e-15; Accession=PF01556.9; Description=DnaJ C terminal region
  Pfam module annotation: Pfam domain module=DnaJ::DnaJ_C; Domain location=65-126::248-373
  Subcellular localization annotation: CTP_CleavageSite=59; ConfidenceScore=5.76e-01
MAILSLQFHALPFPLPTSSSSSYFDAIHLRSNNKNLVFIAYPLFSISSSSSRRRFATLVASASGDYYGTLGVSKSASAREIKASYRRLARQYHPDVNKEPGATEKFKQISTAYEVLSDDKKRAMYDQYGEAGVKSTVGGASAAYTTNPLDLFETFFGSRMGGFSGMDPTEFGTWEQCTTVTKGQDIRGLYNLIGTSVDKLTFIVSVCPNCGGDDEVISEYCTNCRGEEQIQIKKNIKVKVPPGVSSGSILRVAGEGDAGPRWGPSGDLYVYLDVEEISGIQRDGINLRSTISISYLDAILGAVVKVKTVKGISELQIPPGTQPWRCPNPSKESTMEQRSTEGPATQNVESTVATVAEPTAQPEDQNDAWKKLKDIAG

SEQ ID NO: 128776 - protein, 483 aa, Glycine max
  Coding DNA Sequence Number=SeqID_11998
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=P49972; Match level="QueryCoverage=97%, HitCoverage=97%, E-value=0.0, Identity=89%"; Hit description=Signal recognition particle 54 kDa protein 2
  Pfam annotation: Domain name=CbiA; Domain location=104-284; Score= -34.2; E_value=0.053; Accession=PF01656.13; Description=Cobyrinic acid a,c-diamide synthase
  Pfam annotation: Domain name=MobB; Domain location=102-222; Score= -38.7; E_value=0.065; Accession=PF03205.4; Description=Molybdopterin guanine dinucleotide synthesis protein B
  Pfam annotation: Domain name=SRP54; Domain location=100-296; Score =410.4; E_value=2.5e-120; Accession=PF00448.13; Description=SRP54 -type protein, GTPase domain
  Pfam annotation: Domain name=SRP54_N; Domain location=2-88; Score =100.4; E_value=5.3e-27; Accession=PF02881.9; Description=SRP54-type protein, helical bundle domain
  Pfam annotation: Domain name=SRP_SPB; Domain location=327-417; Score =133.8; E_value=4.8e-37; Accession=PF02978.9; Description=Signal peptide binding domain
  Pfam module annotation: Pfam domain module=CbiA::MobB::SRP54::SRP54 _N::SRP_SPB; Domain location=104-284::102-222::100-296::2-88::327-417
MVLAELGGSISRALQQMSNATIIDEKVLNDCLNDITRALLQSDVQFKLVRDMQTNIKSIVNLDDLAAGHNKRRIIQQAVFNELCKILDPGKPSFTLKKGKPSVVMFVGLQGSGKTTTCTKYAFYHQKKGWKPALVCADTFRAGAFDQLKQNATKAKIPFYGSYMESDPVKIAVEGVERFKQENCDLIIVDTSGRHKQEAALFEEMRQVSEATKPDLVIFVMDSSIGQAAFDQAQAFKQSVAVGAVIVTKMDGHAKGGGALSAVAATKSPVIFIGTGEHMDEFEVFDVKPFVSRLLGMGDWSGFMDKIHEVVPMDQQPELLQKLSEGNFTLRIMYEQFQNILKMGPISQVFSMLPGFSAELMPKGREKESQAKIKQLDSSNPKLINESRMMRIARGSGRPVREVMEMLEEYKRLAKIWSKMKGLKIPKKGEMSALSRNMNAQHMSKVLPPQMLKQIGGMGGLQSLMKQMGSAKDMMGMFGGGDN

SEQ ID NO: 128777 - protein, 738 aa, Glycine max
  Coding DNA Sequence Number=SeqID_11999
  Gene Ontology: Mol. function=methyltransferase activity; Cellular component=intracellular; Biological process=protein kinase C activation
  Homolog annotation: Hit_ID=Q1SV65; Match level="QueryCoverage=96%, HitCoverage=82%, E-value=0.0, Identity=81%"; Hit description=Asp/Glu racemase; Tetratricopeptide-like helical
  Pfam annotation: Domain name=PPR; Domain location=200-234; Score =44.4; E_value=3.7e-10; Accession=PF01535.11; Description=PPR repeat
  Pfam annotation: Domain name=PPR; Domain location=235-269; Score=3.2; E_value=3.1; Accession=PF01535.11; Description=PPR repeat
  Pfam annotation: Domain name=PPR; Domain location=270-304; Score =14.1; E_value=0.16; Accession=PF01535.11; Description=PPR repeat
  Pfam annotation: Domain name=PPR; Domain location=332-366; Score =49.9; E_value=8.5e-12; Accession=PF01535.11; Description=PPR repeat
  Pfam annotation: Domain name=PPR; Domain location=433-467; Score =40.2; E_value=7e-09; Accession=PF01535.11; Description=PPR repeat
  Pfam annotation: Domain name=PPR; Domain location=468-502; Score=4.0; E_value=2.5; Accession=PF01535.11; Description=PPR repeat
  Pfam annotation: Domain name=PPR; Domain location=504-538; Score =11.8; E_value=0.3; Accession=PF01535.11; Description=PPR repeat
  Pfam annotation: Domain name=PPR; Domain location=570-604; Score=3.2; E_value=3.1; Accession=PF01535.11; Description=PPR repeat
  Pfam annotation: Domain name=PPR; Domain location=99-133; Score=33.9; E_value=5.6e-07; Accession=PF01535.11; Description=PPR repeat
  Pfam module annotation: Pfam domain module=PPR::PPR::PPR::PPR::PPR::PP R::PPR::PPR::PPR; Domain location=200-234::235-269::270-304::332 -366::433-467::468-502::504-538::570-604::99-133
MKLCLPIPLSFSLATLTLSLSWFPKRMISHCFGESPISLLEKCKSMYQLKQIHSHTIKMGLSSDPLFQKRVIAFCCAHESGKMIYARQVFDAIPQPTLFIWNTMIKGYSRINHPQNGVSMYLLMLASNIKPDRFTFPFLLKGFTRNMALQYGKVLLNHAVKHGFDSNLFVQKAFIHMFSLCRLVDLARKVFDMGDAWEVVTWNIMLSGYNRVKQFKKSKMLFIEMEKRGVSPNSVTLVLMLSACSKLKDLEGGKHIYKYINGGIVERNLILENVLIDMFAACGEMDEAQSVFDNMKNRDVISWTSIVTGFANIGQIDLARKYFDQIPERDYVSWTAMIDGYLRMNRFIEALALFREMQMSNVKPDEFTMVSILTACAHLGALELGEWVKTYIDKNSIKNDTFVGNALIDMYFKCGNVGKAKKVFKEMHHKDKFTWTAMIVGLAINGHGEEALAMFSNMIEASITPDEITYIGVLCACTHAGMVEKGQSFFISMTMQHGIKPNVTHYGCMVDLLGRAGRLEEAHEVIVNMPVKPNSIVWGSLLGACRVHKNVQLAEMAAKQILELEPENGAVYVLLCNIYAACKRWENLRQVRKLMMERGIKKTPGCSLMELNGNVYEFVAGDQSHPQSKEIYAKLENMMQDLIKAGYSPDTSEVFLDLGEEDKETALYRHSEKLAIAYALISSGPGITIRIVKNLRMCVDCHHMAKLVSEAYNRELIVRDKTRFHHFRHGSCSCNNFW

SEQ ID NO: 128778 - protein, 98 aa, Glycine max
  Coding DNA Sequence Number=SeqID_12000
  Gene Ontology: Mol. function=hydrolase activity; Biological process =aromatic compound metabolic process
  Homolog annotation: Hit_ID=Q1S6D2; Match level="QueryCoverage=85%, HitCoverage=22%, E-value=1e-36, Identity=83%"; Hit description =Alpha/beta hydrolase fold
MEVVKKNYFVPTLLEAARKANFKGTFSEIAAGFATDRWDKPILLAWGLSDKYLPQSVAEQFQKGNPAQIQLKLIEGAGHMPQEDWPEKVVDTFRVFFF

SEQ ID NO: 128779 - protein, 81 aa, Glycine max
  Coding DNA Sequence Number=SeqID_12001
MVVKILHDSIVQVGGGLCEARREARRKGEMKKGKKERNEGRKKEKKKGWWGTVGANKKEKGYFDLFHVTNRKFGGPTSTLQ

SEQ ID NO: 128780 - protein, 256 aa, Glycine max
  Coding DNA Sequence Number=SeqID_12002
  Gene Ontology: Mol. function=DNA binding; Cellular component=nucleus; Biological process=regulation of transcription, DNA-dependent
  Homolog annotation: Hit_ID=Q0PJI0; Match level="QueryCoverage=94%, HitCoverage=85%, E-value=6e-86, Identity=70%"; Hit description=MYB transcription factor MYB173
  Pfam annotation: Domain name=Myb_DNA-binding; Domain location=60-105; Score=58.0; E_value=3e-14; Accession=PF00249.21; Description=Myb-like DNA-binding domain
MAIQDQNGFNRSQGGPPIGGGVSLSSGVHSVTHIQLSDQFSCGNDYALKVRKPYTITKQRERWTDEEHKKFLEALKLYGRAWRRIEEHVGTKTAVQIRSHAQKFFSKLLRDPTGNNTNTVESIEIPPPRPKRKPVHPYPRKLVETPNKEILIPEQLMKSNSLKSSDFDQENQSPKSVLSGVGSDSLGSSDSDTPYGSLSPMSSISGIHTSSFTRAEHKTTSDEAGMDTDSAHDEKPLMVLPNPFHFIDYNIITRVS

SEQ ID NO: 128781 - protein, 340 aa, Glycine max
  Coding DNA Sequence Number=SeqID_12003
  Gene Ontology: Mol. function=protein binding; Cellular component =cytoskeleton; Biological process=signal transduction
  Homolog annotation: Hit_ID=Q2HSQ0; Match level="QueryCoverage=98%, HitCoverage=100%, E-value=4e-85, Identity=53%"; Hit description =Ankyrin
  Pfam annotation: Domain name=Ank; Domain location=165-197; Score =20.5; E_value=0.0062; Accession=PF00023.20; Description=Ankyrin repeat
  Pfam annotation: Domain name=Ank; Domain location=207-239; Score =27.2; E_value=5.7e-05; Accession=PF00023.20; Description=Ankyrin repeat
  Pfam annotation: Domain name=Ank; Domain location=240-272; Score =36.4; E_value=1e-07; Accession=PF00023.20; Description=Ankyrin repeat
  Pfam annotation: Domain name=Ank; Domain location=273-305; Score =33.9; E_value=5.6e-07; Accession=PF00023.20; Description=Ankyrin repeat
  Pfam module annotation: Pfam domain module=Ank::Ank::Ank::Ank; Domain location=165-197::207-239::240-272::273-305
MGSWATSSVLANQFIPWSTTNSESAIDSKLGVVFYKMYRNTNKRQLSLAFAWDNCKVRSIGAIKSYKDVSYFQNELVGTWEEPDTGSDSEGDDEEYEEVENENFGFESGSGEEGMKTSVVTDVNITSGDNYEELIKKEIEQLLEPGERAILKQNVTPNLEKISTAKWSPLHTLVLSMQMSCVDKLLENGVDIDLPDKVGLFISGIQEGLTALHKAIIGKKEAVISHLLRRGASPHVMDKDGATPLHYAVQVGAKMTVKLLIKYKVDVNVEDNEGWTPLHVAIQSRNRDIAKILLVNGADKTRKNKDGKTALDLSLCYGKDFKSYDLAKLLKTVPADSDLF

SEQ ID NO: 128782 - protein, 60 aa, Glycine max
  Coding DNA Sequence Number=SeqID_12004
MSKPLKINTNRMKNEERMKNGVEVDYGRNLAEPLPSDPLPLFIGNDETWLIWSSPRRAVT

SEQ ID NO: 128783 - protein, 222 aa, Glycine max
  Coding DNA Sequence Number=SeqID_12005
  Gene Ontology: Mol. function=UTP:glucose-1-phosphate uridylyltransfera se activity; Cellular component=ribonucleoprotein complex; Biological process=metabolic process
  Homolog annotation: Hit_ID=Q9LKG7; Match level="QueryCoverage=88%, HitCoverage=84%, E-value=1e-65, Identity=79%"; Hit description=UTP- -glucose-1-phosphate uridylyltransferase
  Pfam annotation: Domain name=UDPGP; Domain location=1-200; Score =71.4; E_value=1.8e-22; Accession=PF01704.8; Description=UTP--glucose- 1-phosphate uridylyltransferase
LDPFEQHVEWSKIQTPTDQVVVPYDTLAPIPDEVKNLLDKLVVLKLNGGLGTTMGCTGPKWVNLKAVKRLVEADALKMEIIPNPKEVDGVKVLQLETAAGAAIRFFDKAIGINVPRSRFLPVKATSDLLLVQWDLYTLQDGLVIRNQARANPENPSIELGPEFKKVSYFLSRFKSIPSIVELDSLKVAGDVWFGVGAILKSELRDSTLGAQKSLQRVLFFKI

SEQ ID NO: 128784 - protein, 92 aa, Glycine max
  Coding DNA Sequence Number=SeqID_12006
MARSLDKIKSINGSKETLKLSVRISNLWFIGTPNKSEQAEMVFVDSYGDEIHVVCKQDQLKECVLENIPFRKYRFAGFADIVAGQFEPGLLV

SEQ ID NO: 128785 - protein, 62 aa, Glycine max
  Coding DNA Sequence Number=SeqID_12007
MEERSLLSEIARDVPSLVLSQTQVDVPSTCTTKDVPSNVLRQRSQAVKPLILCEWGYRRILR

SEQ ID NO: 128786 - protein, 84 aa, Glycine max
  Coding DNA Sequence Number=SeqID_12008
MVVRAFCQPGANELVDAQRLTSSSASFVIQGKQVGWQAEIHYGRSYLSSTKANEFDGFCSRRPETFKPDDARDSSLLSGDDQVR

SEQ ID NO: 128787 - protein, 105 aa, Glycine max
  Coding DNA Sequence Number=SeqID_12009
  Homolog annotation: Hit_ID=Q9SD67; Match level="QueryCoverage=41%, HitCoverage=5%, E-value=7e-11, Identity=75%"; Hit description=FtsH metalloprotease-like protein
MHVCVHYGKILPTPYVGGNVLKIMTRPCLKGIEEKTANLKGSEKALVARHEASNAVVGTAVANLLAGQPHVEVWTLEYLILEFIDLVLWWEIKEKYKSVMCDIQR

SEQ ID NO: 128788 - protein, 151 aa, Glycine max
  Coding DNA Sequence Number=SeqID_12010
  Homolog annotation: Hit_ID=Q1S6C9; Match level="QueryCoverage=97%, HitCoverage=9%, E-value=7e-67, Identity=82%"; Hit description=TPR repeat
AAAPSLVDIIVVTPYDTQIVLKGISTDKILDVRKLLAVKVETCHFTNYSLSHEAKGQRLNDRVEVVTLKPCLLRMVEEDYTDEAQAIAHVRRVLDIVACTTRFGRPKRSVSSPESRPKKNGKAQHQNKMSLSPPGTPNGESRVGSPSSEAP

SEQ ID NO: 128789 - protein, 1426 aa, Glycine max
  Coding DNA Sequence Number=SeqID_12011
  Gene Ontology: Mol. function=binding
  Homolog annotation: Hit_ID=Q1S6C9; Match level="QueryCoverage=99%, HitCoverage=82%, E-value=0.0, Identity=69%"; Hit description=TPR repeat
  Pfam annotation: Domain name=PAM2; Domain location=1150-1167; Score =10.4; E_value=0.35; Accession=PF07145.5; Description=Ataxin-2 C -terminal region
  Pfam annotation: Domain name=PAM2; Domain location=1239-1256; Score =16.9; E_value=0.039; Accession=PF07145.5; Description=Ataxin-2 C -terminal region
  Pfam annotation: Domain name=TPR_1; Domain location=648-681; Score =19.7; E_value=0.01; Accession=PF00515.18; Description=Tetratricopepti de repeat
  Pfam annotation: Domain name=TPR_1; Domain location=732-765; Score =8.3; E_value=0.55; Accession=PF00515.18; Description=Tetratricopeptid e repeat
  Pfam annotation: Domain name=TPR_2; Domain location=606-639; Score =3.7; E_value=12; Accession=PF07719.7; Description=Tetratricopeptide repeat
  Pfam annotation: Domain name=TPR_2; Domain location=648-681; Score =24.6; E_value=0.00035; Accession=PF07719.7; Description =Tetratricopeptide repeat
  Pfam annotation: Domain name=TPR_2; Domain location=690-723; Score =1.7; E_value=21; Accession=PF07719.7; Description=Tetratricopeptide repeat
  Pfam annotation: Domain name=TPR_2; Domain location=732-765; Score =16.5; E_value=0.1; Accession=PF07719.7; Description=Tetratricopeptide repeat
  Pfam module annotation: Pfam domain module=PAM2::PAM2::TPR_1::TPR _1::TPR_2::TPR_2::TPR_2::TPR_2; Domain location=1150-1167::1239 -1256::648-681::732-765::606-639::648-681::690-723::732-765
MKAFLERNKFGNLPYGFRANTWLVPPSVAESPSNFPALPAEDENWGGNGGGHQRNGALDHRSWATDFAILASLPCKTEEERVVRDRKAFLLHSQFVDTSIFKAVAAIQHVMESKSNIKSELNSSPGSVLHEDLTGDLSIIVKRDIQDGNTKYDSILDESSMHEGDAQKNLIKGLTADESVIVHDTSSLAVVVVHHCGYTATVKVVGNVNVRKPEVRDIEIDDLPDGGANALNINSLRVLLHKSGAETLEGTLSSLSNSDDLDASKVLVKKVVQECMEKIKGEPSASKRSIRWELGSCWIQHLQKHETSTDSSSKNKEDGKDVDQAVKGLGKQFKLLKRREKKSNNLDGADFKEQNDSRLANMDDVADKVEPNNDDLSNSNELEKLLSEESFLRLKESGTGLHTKSVDELISMAHKFYDEVALPKLAMDFGSLELSPVDGRTLTDFMHLRGLQMRSLGKVVKLAENLPHIQSLCIHEMITRAFKHLLKAVIASVENVADLSSAIASTLNFLLGGSRTEDTSDQSLSDDHNLRIQWLHLFLSKRFGWTLNDEFQHLRKLSILRGLCHKVGLELFPRDYDMESSKPFGENDIISLVPVCKHVGCSSIDGRNLLESSKIALDKGKLEDAVTYGTKALAKMMAVCGPYHRNTASAYSLLAVVLYHTGDFNQATIYQQKALDINERELGLDHPDTMKSYGDLSVFYYRLQHIELALKYVNHALFLLHFTCGLSHPNTAATYINVAMMEEAMGNVHVALRYLHEALKCNKRLLGADHIQTAASYHAIAIALSLIDAFSLSVQHEQTTLKILQAKLGSEDLRTQDAAAWLEYFESKALEQQEAAKNGTPKPDASIASKGHLSVSDLLDFISPDPKGNDARSKQRRAKILSTSDDNSQEHDDAIANESILFDNSKDAPSMTEVKIEETNGKLDSQVQKENGDFTRYGPVTSEPVYEASSDEGWQEANSKGRSGNAANRKFGHRKRPHLSKLSVNGSNNYIYREGSSRNEITSPPQRGVPKVMLDMSSPSRQSKSRNLTLNEDSVNHSTKASVSKISSPALSSLASKSISYKEVALAPPGTVLKPLLEKAEMDKVNAEDEICGNIAVTSINEGTCQSSITNTVSQNDETEETHEIEPQQESSGSELEKVCASDQEKPTETNGSKLSAAAKPFNPGMLSMSHHLNSASFTSMYDTDVSQGMHVEPVLPPAVARVPCGPRSPLYYRTNYTFRMKHGSTKGQTSIKERSGFGSPRIMNPHAPEFIPRSASQIEAKDANSNVSNEHNPLSDEGMPEKNKLDENFVEIKGSSTKNSISESEKSEIARQILLSFLVKSVKENIDYVDESKDDEGKIENLESCSDEITKDRAVINIMYGNEEKNKTVPHSSDSVEPEKLGVTENKNGDGEGFIVVSKRRKNRQKITNGVTELYNQQSICASVR

SEQ ID NO: 128790 - protein, 463 aa, Glycine max
  Coding DNA Sequence Number=SeqID_12012
  Homolog annotation: Hit_ID=Q6RUF8; Match level="QueryCoverage=42%, HitCoverage=42%, E-value=4e-84, Identity=74%"; Hit description =Glycerol kinase
  Pfam annotation: Domain name=Chromo; Domain location=204-255; Score =33.1; E_value=9.7e-07; Accession=PF00385.14; Description='chromo' (CHRromatin Organisation MOdifier
  Pfam annotation: Domain name=FGGY_C; Domain location=244-442; Score =88.7; E_value=1.8e-23; Accession=PF02782.6; Description=FGGY family of carbohydrate kinases, C-terminal domain
  Pfam module annotation: Pfam domain module=Chromo::FGGY_C; Domain location=204-255::244-442
  Subcellular localization annotation: CTP_CleavageSite=58; ConfidenceScore=5.02e-01
MAAHLTHLLTTPQLVWSIEAQTAFQQLKDVVSSVPTLQLPNFSLSFMVETYASGTGIRAILSQSVPHFAFLDQLKPELAIHPEFIELKWNIREPHLVAQWPQLYPVIVDGVPYVTYGRAHGNQENFAALGGEFFTSRRKPPSIPQYLTGSSPVAVVDDMLTSREAIFDSGSWSSSDLTVNFQLPEPFIRNLSKDYMVCDHQPVISPLTIVDTRWDDLKGEPHLMVLVQWEGLHPKDTSWEVWTNLKADFHLEDKVLPDGVGIDRPTVKHQLGPNAPTNYALEGSVAIAGAAVQWLRDSLGIISSASEIEEMALQDARGVCIGITRFTSKAHIARAVLESMCFQVKDVLDSMHKDSGESESQKKLLLRVDGGAAVNNLLMQIQADLVGCPIIRPADIETTALGAAYAAGLAIGIWKEDYVFNTEEKLKNANVFRPLMTEELRKKKVDSWCKAVSKTFDLADLAL

SEQ ID NO: 128791 - protein, 299 aa, Glycine max
  Coding DNA Sequence Number=SeqID_12013
  Gene Ontology: Mol. function=RNA-directed DNA polymerase activity; Cellular component=chromatin; Biological process=RNA-dependent DNA replication
MEELALHREKGLCFNYDEKFSRDHIVEDDGSSPQDLLLSIELKGQQVWILIDGGSTHNFIQESLVLALGLPTQPTQPLRVMVSNWHELEYHQWCRDIALQVQDQQFLVNFHVLPLCVLTDYNDLTTEFLLDGIVVELKGGFYVEEWSYQTKHEPLLLSGLTALNTIIIKDRFLIPMMDEFLDELGGEQWFLKLDLLQGYHQILMKEEDISKMAFHTHHRHYKFRVMPFGLCNAPSLFQATMNDTFRPYLCKFVIDQFFLKMSKCSFAQSHIEYLGHLVSMRGVEPVQDKNQAIQQWPIP

SEQ ID NO: 128792 - protein, 104 aa, Glycine max
  Coding DNA Sequence Number=SeqID_12014
MQANLGREGFSTLCFISNLYREKQILGRTAIILYNVVAAKFLIVVKTQTFLPMKGEFFHRQSFEWDGRRFWRHRQEARVVACTIVKGCKAWTSFWISSANPETK

SEQ ID NO: 128793 - protein, 116 aa, Glycine max
  Coding DNA Sequence Number=SeqID_12015
MLKVDENTKAMVAQLKAMKVEVSKTKELGLELSKKQQVKDLGKKTEDLTSEKKIAEEGLRVAKDKIAQMKETVAKMESQLQKKERVEFALKAELDEAKRLIVLNHREDFMSLCETS

SEQ ID NO: 128794 - protein, 137 aa, Glycine max
  Coding DNA Sequence Number=SeqID_12016
KPAKLVEKHVEGGGAEVEIVYQDGPEVANKGLKEGNTAEDKKVGTIKKSAASKKEKVVDVAKKSTSIGFRDNMSTGIPQMNKVVLHHHKGKLHHLDHVSMAPNIVSLWNANLSSPKFVQSFAFLSQTDHKMMDYVGP

SEQ ID NO: 128795 - protein, 1065 aa, Glycine max
  Coding DNA Sequence Number=SeqID_12017
  Gene Ontology: Mol. function=metalloexopeptidase activity; Cellular component=chromosome; Biological process=proteolysis
  Homolog annotation: Hit_ID=Q1S4Z9; Match level="QueryCoverage=95%, HitCoverage=96%, E-value=0.0, Identity=78%"; Hit description =Peptidase M24
  Pfam annotation: Domain name=Peptidase_M24; Domain location=202-443; Score=-25.0; E_value=2.8e-06; Accession=PF00557.14; Description =metallopeptidase family M24
  Pfam annotation: Domain name=Rtt106; Domain location=846-1004; Score =96.4; E_value=8.9e-26; Accession=PF08512.2; Description=Histone chaperone Rttp106-like
  Pfam annotation: Domain name=SPT16; Domain location=552-706; Score =263.4; E_value=4.7e-76; Accession=PF08644.1; Description=FACT complex subunit (SPT16CDC68)
  Pfam module annotation: Pfam domain module=Peptidase_M24::Rtt106::SPT1 6; Domain location=202-443::846-1004::552-706
MADHRNGSAQAANGKASAAGTAYSIDLNAFQTRLRSFYKHWDAHKTDLWGSSDAIAVACPPPSEDLRYLKSTALNLWLLGFEFPETIMVFSKKQIHILCSQKKASILESVKKTAREAVDADLVLHVKPRNDDGTALMDAIFRALSKSDGRDTPTVGYISREAPEGKLLEMWTEKLKNTKFQLNDVANGLSSLFAAKNNEELTSIKRAAYLTTSVMKNFVVPKLENVIDEEKKVSHSTLMEDTEKAILEPSKVNCKLKADNVDICYPPIFQSGGEFDLKPSAVSNDELLHYDSASVILCAIGARYKSYCSNIARTFLIDADPLQSRAYGVLLKAHEAVIGSLKPGNRLSATYQAAVSVVENEAPDLISYLTKSAGTGIGIEFRESGLNINAKNEQIVKEGMVFNVSLGFQNVQRESTKSKSKHFSLLLADTVIINKDKTEVVTSMSSKALKDIAYSFNEDEEEENPSAKADANGAEPLMSKTTLRSDNHEMSKEELRRQHQAELARQKNEETARRLAGGGNETGDNRSSSRTSAELVAYKNINDLPPPREMMIQIDQKSEAVLLPINGSMVPFHVAFIRTVSSQQDTNRNCYIRIIFNVPGTPFSPHDSNSMKFQGSIYLKEASFRSKDSRHISEVVQSIKTLRRQVVARESERAERATLVTQEKLQLANNRFKPIRLSDLWIRPAFGGRGRKIPGTLEAHVNGFRYSTTRQDERVDIMFGNIKHSFFQPAENEMITLLHFHLHNHIMVGNKKTKDVQFYVEVMDMVQNVGGGKRSAYDPDELEEEQRERDRKNKINVEFQTFVNRLNDLWGQPQFNGLDLEFDQPLRELGFPGVPHKSSVFIVPTSACLVELIETPFLVVTLSEIEIVNLERVGLGQKNFDMTVVFKDFKRDVLRIDSIPSTSLDGIKEWLDTTDIKYYESRLNLNWRQILKTITDDPQSFIEGGGWEFLNLEATDSESENSEESDKGYEPSDVEPESDSEDEASDSESLVESEDDGEEDSEEDSEEEKGKTWEELEREASNADREKGNESDSEEDRKRRKAKSFVTLCMLLPAVAAFAFVGVVS

SEQ ID NO: 128796 - protein, 978 aa, Glycine max
  Coding DNA Sequence Number=SeqID_12018
  Gene Ontology: Mol. function=metalloexopeptidase activity; Cellular component=chromosome; Biological process=proteolysis
  Homolog annotation: Hit_ID=Q1S4Z9; Match level="QueryCoverage=99%, HitCoverage=92%, E-value=0.0, Identity=80%"; Hit description =Peptidase M24
  Pfam annotation: Domain name=Peptidase_M24; Domain location=115-356; Score=-18.5; E_value=1.1e-06; Accession=PF00557.14; Description =metallopeptidase family M24
  Pfam annotation: Domain name=Rtt106; Domain location=759-917; Score =95.5; E_value=1.6e-25; Accession=PF08512.2; Description=Histone chaperone Rttp106-like
  Pfam annotation: Domain name=SPT16; Domain location=465-619; Score =262.5; E_value=8.6e-76; Accession=PF08644.1; Description=FACT complex subunit (SPT16CDC68)
  Pfam module annotation: Pfam domain module=Peptidase_M24::Rtt106::SPT1 6; Domain location=115-356::759-917::465-619
MKKQIHILCSQKKASILESVKKSAREAVGADLVLHVKPKNDDGSALMDAIFRAIRALPKSDDHDSSTVGYISREAPEGKLLETWTEKLKNTKFQLIDVANGFSYLFAAKSNEELTSIKRAAYLTTSVMKNFVVTKLENVIDEEKKISHSTLMEETEKVILEPSKVNCKLKADNVDICYPPIFQSGGEFDLKPSAVSNDELLHYDSASVIICAVGARYKSYCSNIARTFLIDADPLQSRAYEVLLKAHEAVIGSMKPGNKLSVAYQAAVSVVERDAPDLISYLTKSAGTGIGIEFRESGLNLNAKNEQIIREGMVFNVSLGFQNLQCENSKSKNKQFSLLLADTVIITKDKTEIVTSTSSKALKDVAYSFNEDEEEERPSTKSDAKKAEPFMCKTTLRSDNHEVSKEELRRQHQAELARQKNEETARRLAGGGSETGEARSSARTSAELMAYKNINDLPPPREMMIQIDQKNEAVLLPINGSMVPFHVAFIRTVSSQQDTNRNCYVRIIFNVPGTPFSPHDANSMKFPGSIYLKEASFRSKDSRHISEVVQSIKTLRRQVVARESERAERATLVTQEKLQLANNRFKPIRLSDLWIRPAFGGRGRKIPGTLEAHVNGFRYSTTRQDERVDIMFGNIKHAFFQPAENEMITLLHFHLHNHIMVGNKKTKDVQFYVEVMDMVQNVGGGKRSAYDPDELEEEQRERQRKNKINVEFQTFVNRVNDLWGQPQFNGFDLEFDQPLRELGFPGVPHKSSVFIVPTSACLVELIETPFLVVTLSEIEIVNLERVGLGQKNFDMTVVFKDFKRDVLRIDSIPSTSLDGIKEWLDTTDIKYYESRLNLNWRQILKTITDDPQSFIEGGGWEFLNLEATDSESENSEESDKGYEPSDVEPESDSEDEASDSESLVESEDDDDDEDSEEDSEEEKGKTWEELEREASNADREKGNESDSEEDRKRRKAKGFGKSRGASLSSSMPKRSKLR

SEQ ID NO: 128797 - protein, 370 aa, Glycine max
  Coding DNA Sequence Number=SeqID_12019
METENYHTVGTTSLDISVGIVCHYQFENGSSQFAFMDVESERGASLDHSLSFSTENFVQTLAFCNGLILLSGFSGDQSCYHVFNPLTKHNVMIPQTSTQGGVVRVGLAYDGDQFEVVLVEAGSSNSNGLKLHVFSSDTGQWRCHYPTNITSAPSLQELEFQELGTPPLYANSAIHWEICGYLLVYQVQGSHCALYELPNYFDDWSWQSTLSYRRSLCESGGEVYYCYTDFDGFHIWKLLNEEEHPGFFNYCDYKRFPWKLVHSVMHQVLMPKHQNFFGSSFVWEPYKVAPIAYSEQAQIIYLQLPGIVVAYNFDTGTMGSVCTYSYPGINFNCCSFFSSTASGPHHAQRDSTNGQSELNLPIAEMEKLTL

SEQ ID NO: 128798 - protein, 41 aa, Glycine max
  Coding DNA Sequence Number=SeqID_12020
MATIKLGAPNIIAGAPSTLREKLIRNKIADQLDPQVTCGST

SEQ ID NO: 128799 - protein, 76 aa, Glycine max
  Coding DNA Sequence Number=SeqID_12021
MKVKVPIFGVAVVVVCGEFGYVFYVCVKNFDLLLRWTKISECMKVFDSREDVLRWARSVAYENRFVAVIERSDTNT

SEQ ID NO: 128800 - protein, 116 aa, Glycine max
  Coding DNA Sequence Number=SeqID_12022
  Subcellular localization annotation: CTP_CleavageSite=48; ConfidenceScore=5.68e-01
MEKAGSNSPKSALKFVKNTSQSAAQWSSTNSRGMTKDVLKDKFYDKTKASRRSPPKESNMASPRSPPRENTKPQEFKLHTQERAVKRAMFNYAVTTKFYIMELQKKQEEKLQKVGT

SEQ ID NO: 128801 - protein, 116 aa, Glycine max
  Coding DNA Sequence Number=SeqID_12023
MTLSKILFVPVEFRRGLIELSGSLFLSGIFDVEVGGGTCKRNSVEQVSGALRCLYVYNWNEKNVPDGGCVILGVTLANRPSMCRADFMDCMFMDYTVHKPSRHAQVAGPRCVKRSD

SEQ ID NO: 128802 - protein, 138 aa, Glycine max
  Coding DNA Sequence Number=SeqID_12024
  Subcellular localization annotation: CTP_CleavageSite=43; ConfidenceScore=5.10e-01
MSNKAMSFPALVTCLYQFYGVQVTPTKHIRPPINRSFIGKYCMPSIARNLALTLSLLPNSLEPLLPGLETSLFFRRKQDLQMLKELPTKMEEELRKMKTWRIWLMISLEETQRLSHDLQKLMNLSLCLFIAFVDKGSS

SEQ ID NO: 128803 - protein, 93 aa, Glycine max
  Coding DNA Sequence Number=SeqID_12025
MIELQRTQTVHSELENLGVSARKRVVGGDMARNRTSVRTSHRKARGEYGRCGFKRVRKGLRDSLDFIHLEEQVGPTRLPCELCARNYANCFMS

SEQ ID NO: 128804 - protein, 1195 aa, Glycine max
  Coding DNA Sequence Number=SeqID_12026
  Gene Ontology: Mol. function=protein binding; Cellular component =membrane; Biological process=primary shoot apical meristem specification
  Homolog annotation: Hit_ID=Q1S365; Match level="QueryCoverage=94%, HitCoverage=100%, E-value=0.0, Identity=88%"; Hit description =Lissencephaly type-1-like homology motif; CTLH, C-terminal to LisH motif; WD40-like; ...
  Homolog annotation: Hit description=Quinonprotein alcohol dehydrogenase-like
  Pfam annotation: Domain name=LisH; Domain location=68-94; Score=19.0; E_value=0.008; Accession=PF08513.1; Description=LisH
  Pfam annotation: Domain name=WD40; Domain location=1070-1108; Score =8.3; E_value=3.9; Accession=PF00400.22; Description=WD domain, G -beta repeat
  Pfam annotation: Domain name=WD40; Domain location=408-446; Score =3.0; E_value=16; Accession=PF00400.22; Description=WD domain, G-beta repeat
  Pfam annotation: Domain name=WD40; Domain location=514-554; Score =36.1; E_value=1.2e-07; Accession=PF00400.22; Description=WD domain, G-beta repeat
  Pfam annotation: Domain name=WD40; Domain location=558-598; Score =24.1; E_value=0.00051; Accession=PF00400.22; Description=WD domain, G-beta repeat
  Pfam annotation: Domain name=WD40; Domain location=648-687; Score =8.7; E_value=3.5; Accession=PF00400.22; Description=WD domain, G -beta repeat
  Pfam annotation: Domain name=WD40; Domain location=893-930; Score =6.3; E_value=6.8; Accession=PF00400.22; Description=WD domain, G -beta repeat
  Pfam annotation: Domain name=WD40; Domain location=934-973; Score =9.7; E_value=2.7; Accession=PF00400.22; Description=WD domain, G -beta repeat
  Pfam annotation: Domain name=WD40; Domain location=977-1015; Score =36.8; E_value=7.3e-08; Accession=PF00400.22; Description=WD domain, G-beta repeat
  Pfam module annotation: Pfam domain module=LisH::WD40::WD40::WD40::WD4 0::WD40::WD40::WD40::WD40; Domain location=68-94::1070-1108::408 -446::514-554::558-598::648-687::893-930::934-973::977-1015
MSQQHGTITLVLELKDSFSRERASRLVHFREERESARIGREREREFTVAHFSVYLIEDEGVPMSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANNPLLGALPKAGGFPPLGAHGPFQPTPAPVPTPLAGWMSNPTTVAHAAVSGGGAIGLGAPSMPAALKHPRTPPTNPSVDYPSGDSDHVAKRTRPMGISDEVNLPVNVLSATFPGHGQHSQAFNAPDDIPKTVVRTLNQGSSPMSMDFHPMQQSLLLVGTHVGDIALWEVGSRERLVSRNFKVWDLSACSMPFQAALVKDPGVSVNRVIWSPDGALFGVAYSRHIVQIYSYHGGDEIRQHLEIDAHVGGVNDLAFSHPNKQLCVITCGDDKTIKVWDAASGAKQYTFEGHEAPVYSVCPHYKENIQFIFSTALDGKIKAWLYDNLGSRVDYEAPGRWCTTMAYSADGTRLFSCGTSKDGESSIVEWNESEGAVKRTYQGFRKRSLGVVQFDTTKNRFLAAGDDFSIKFWDMDNVQLLTTVDADGGLPASPRIRFNKDGTLLAVSANENGIKILANGDGIRLLRTLENSLYEASRASEALTKPTINPISAAAAAATSAALAERASSVVAIAGMNGDTRNLGDVKPRISEESNDKSKIWKLTEINEQSQCRSLKLPENVRVTKISRLIYTNSGNAILALASNAIHLLWKWQRNERNSSGKATATLQPQLWQPSSGILMTNDIADSNPEDAVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADAQICVWNTDGWEKQKSRFLQLPPGRTPPAQSDTRVQFHQDQIQFLVVHETQLAIYEATKLEGLKQWFPRDSSAPISYATFSCDSQLVFASFLDATICVFSASNLRLRCRINPSSYLPASVSSNIQPLVIAAHPQEPNQFALGLSDGGVHVFEPLESEGKWGVPPPIENGSASNVAATSVGPSDQAQR

SEQ ID NO: 128805 - protein, 112 aa, Glycine max
  Coding DNA Sequence Number=SeqID_12027
MGERMNGKDGSSLSSSSPTMVKCKLCTIRREGFGDVHIGMNQVLVDFFNGLVILRLTITCLQKGVGRFLVVVFLNLEKSKEEDFKCFREKIDEKIEEKVERIGQLAQRAIQA

SEQ ID NO: 128806 - protein, 42 aa, Glycine max
  Coding DNA Sequence Number=SeqID_12028
MNKEVDFKKCVAIGVQNGPVNVVEGGTEGATHDGNEGALIGV

SEQ ID NO: 128807 - protein, 110 aa, Glycine max
  Coding DNA Sequence Number=SeqID_12029
  Gene Ontology: Mol. function=nucleic acid binding; Biological process= DNA integration
MRKKAIRKEEVERTSIHHALTVRRRIIQKIFAGSGLELNVGPAISLVMWRSGCTNHMTHDAIFKELDQTYFSKVTIGNGDHVDVKGKKELLLLKLLRVSNMSPMFYLCPS

SEQ ID NO: 128808 - protein, 105 aa, Glycine max
  Coding DNA Sequence Number=SeqID_12030
  Gene Ontology: Mol. function=nucleic acid binding
  Homolog annotation: Hit_ID=Q1SDY9; Match level="QueryCoverage=83%, HitCoverage=15%, E-value=3e-27, Identity=66%"; Hit description =Peptidase S8 and S53, subtilisin, kexin, sedolisin; Zinc finger, CCHC- type
MASSSSSLSPPPIFAKNPTVAQIRSHNDEMAKESKALVIIQAELHDDIFMKIRTLETAKEAWDQLKEEFQGNERGKRMQGLNLRRELEAVKMKERESAKEFSVRL

SEQ ID NO: 128809 - protein, 165 aa, Glycine max
  Coding DNA Sequence Number=SeqID_12031
  Gene Ontology: Mol. function=protein serine/threonine kinase activity; Cellular component=chromosome, telomeric region
MAGDSFATPNQTVVTLDSNTWMHNIYFMLMEGYGYLFSKPVLNIGRISNLLSGLEMVELDIFIVLIDLSLCFNQNEGSESQGKEEICEARESSGSEKEDASDNGESNEDTLQNEAELVKNLSKQRRHAIAKAHKGRKTVAARNSYKDKGGRSSHNSKIQKQLSSW

SEQ ID NO: 128810 - protein, 85 aa, Glycine max
  Coding DNA Sequence Number=SeqID_12032
MTVVVSDTMTLIVPMITTTIIMIMTHGSHDGDTDDDYCNDNHDADEGNIPLGEDVPRMYVLFISILSDLGNKSRRVIGFLRSEGG

SEQ ID NO: 128811 - protein, 76 aa, Glycine max
  Coding DNA Sequence Number=SeqID_12033
MAKLISDYFKDGTISVYIMEIVNWIDELVMSLFLTEEEVDFNSDSILKTNDEIGIQLDWLSTEFLNNIRCSRLPDH

SEQ ID NO: 128812 - protein, 81 aa, Glycine max
  Coding DNA Sequence Number=SeqID_12034
QKNAMHLLVVERAVQNEFCIVFCLCPVFLAVMVGNRGWWVYARFVDVENLLCTIARPPPSTTCDGVVPGDMSRGSGDLGDV

SEQ ID NO: 128813 - protein, 63 aa, Glycine max
  Coding DNA Sequence Number=SeqID_12035
MVQVEEVGGHCHEIDGVAYGIWINLKKSETLIWLDFVECPKPMVQVEKVGTLIWIWWSSQRFV

SEQ ID NO: 128814 - protein, 145 aa, Glycine max
  Coding DNA Sequence Number=SeqID_12036
MAPTRHPLDPDKSNRSLGFLALITGLCQSFGVPVAPSKRQAQGDAPQAADAPPPHQAGPAGSFDTEQYLRHLMSLSLQSQGFTSFLCPTPDQFRAEVAWPGDWPEARAGEVPAEAPAEAPDEADEAREDEEMDDLLDFLGGSGAT

SEQ ID NO: 128815 - protein, 165 aa, Glycine max
  Coding DNA Sequence Number=SeqID_12037
  Gene Ontology: Mol. function=RNA-directed DNA polymerase activity; Biological process=RNA-dependent DNA replication
MEIPHGLPPSRGIEHQVDLLPEASLPNRPTSNSKPQETQHKDAQTKVTYVKRLYDQVKVQIAKKNESYVKQAHKKRKEVVLEHGDDPEHLRTNVFQEGGNDENHETGQIQAKGPSNPCGVYPDLSSFTGSGVYPDLSSFIGSGVYPDLSSLTGSGVYPDLSSFTG

SEQ ID NO: 128816 - protein, 110 aa, Glycine max
  Coding DNA Sequence Number=SeqID_12038
MTLLLSNILPSDHNADHDIGKYACGSTEVSVGLSRHDIGIAPTRHPVDLEEPNKVLGFLALITGLCQFYGVFVAPNKVIRPPTNRAFIKKYCAPRQAQGETPQQPGDDRQ

SEQ ID NO: 128817 - protein, 225 aa, Glycine max
  Coding DNA Sequence Number=SeqID_12039
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=7e-30, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=62; ConfidenceScore=5.41e-01
MWSPLKVRTRSPLKARACSPLKSRKCHLLKARACSPRKVRACSPLKARACSPLKAKMCNPLTARAFSPLKVRACSPQKVRTCSPLKVRKSSPPKVRTCSPLKVKACSSLKARVCSPLKARACSPLKVRKCSPLKARACSPLKVRTCSPLMARTCSPLKVRTCSPLKARACGPLKARTSNPLKARACSPLKPRTRSPLKARACSSLKVRMCSSLTARACSPLNVRT

SEQ ID NO: 128818 - protein, 191 aa, Glycine max
  Coding DNA Sequence Number=SeqID_12040
  Pfam annotation: Domain name=P68HR; Domain location=148-182; Score =2.6; E_value=9.1; Accession=PF08061.2; Description=P68HR (NUC004) repeat
  Pfam annotation: Domain name=P68HR; Domain location=17-51; Score=9.8; E_value=0.83; Accession=PF08061.2; Description=P68HR (NUC004) repeat
  Pfam annotation: Domain name=P68HR; Domain location=98-132; Score =6.7; E_value=2.3; Accession=PF08061.2; Description=P68HR (NUC004) repeat
  Pfam module annotation: Pfam domain module=P68HR::P68HR::P68HR; Domain location=148-182::17-51::98-132
LVSAEDDVNHHVSTGLSAAIDEGFSSYRQQKVYTNNHSGISGRQRDSKVSMTDLVSAEDDEKVYTNNHSGISARQRDSKVSMTDLVSAEDDGAEDDVSLCVLSGFSSYRQQKVYTNNHSGISARQRDSKVSMTDLVSAEDDGAEDDVSLCVLSGFSSYRQQKVYTDNHSGISARQRDSKVSMTDLVSAEDD

SEQ ID NO: 128819 - protein, 106 aa, Glycine max
  Coding DNA Sequence Number=SeqID_12041
MEANAIAITATSTVAKVNLTLPSGLNQMNHPTSVMVGKDLGTGKNPHAMAEMGKLDHLEERLRAIEGRKDYAFAILEELFLVPNIITPPKFKVLDFDKGTTCPRTI

SEQ ID NO: 128820 - protein, 82 aa, Glycine max
  Coding DNA Sequence Number=SeqID_12042
YGKAENSKQYPPLQRHAFVKWWSQFDTSKDAPEQSQLAAFLASSKSKESLAQNLKEVLQLLQQEEEEEPPKKEAESSENNDD

SEQ ID NO: 128821 - protein, 102 aa, Glycine max
  Coding DNA Sequence Number=SeqID_12043
LITSLCQSFGVPVTPSKTANHKGQVQTHECLYQLSLSLQSQGFAPFACPTPDQFRAEVAWPGDWPEAQAGEAPAEAPGDADEARMDEEMTDLLNFLGGSGAT

SEQ ID NO: 128822 - protein, 61 aa, Glycine max
  Coding DNA Sequence Number=SeqID_12044
MESHEDGTNGGFNPFSFSLTFGNPIRAIREKLEESQEISRDVVIVVRTYVSPLRVCDKLNL

SEQ ID NO: 128823 - protein, 115 aa, Glycine max
  Coding DNA Sequence Number=SeqID_12045
MDEFDSHVAWPGDQPSSSGGGGASTAQEPVTEEPPAATEDEDKLTPAEPFDFDAGRHTTQEEEAIPELIPEPSPAPAHAPDDATLVVEPEQTIHDSLAAPALDLNENQPQEEQDV

SEQ ID NO: 128824 - protein, 62 aa, Glycine max
  Coding DNA Sequence Number=SeqID_12046
MSPVNEFIEVESISRLQDLRGGVEEVNPNFVVIWKFVKQQFGQPWPTWGAIPKDHRIFFPVF

SEQ ID NO: 128825 - protein, 98 aa, Glycine max
  Coding DNA Sequence Number=SeqID_12047
MYIHQAWPKIHHQAWPTKTYHPTYSQNNSKAPKFLKGRVRSWLIWLEAYKNKMPKSSPNMHVKQEVSTRVKPRLLCKQSMGQNTPNKIDDDGSNSHQG

SEQ ID NO: 128826 - protein, 182 aa, Glycine max
  Coding DNA Sequence Number=SeqID_12048
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=99%, HitCoverage=36%, E-value=1e-67, Identity=86%"; Hit description=NADH -plastoquinone oxidoreductase subunit 2
  Pfam annotation: Domain name=Oxidored_q1; Domain location=1-114; Score=-71.0; E_value=0.00069; Accession=PF00361.10; Description=NADH- Ubiquinoneplastoquinone (comple
MILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSGRLIFLSFNRTPYECCFYLLLFKNNQVINDWTKPRNNSSRAKLSKAPFKIKQFHRIKYDCMCDSIYYTRNFNEPYY

SEQ ID NO: 128827 - protein, 69 aa, Glycine max
  Coding DNA Sequence Number=SeqID_12049
MTPTHDALLYYNRRWNMPRQREFVGYLFTGKNPKKFDIPSGCTMDELKDLIKQVAPHGIPPYGIHETQT

SEQ ID NO: 128828 - protein, 306 aa, Glycine max
  Coding DNA Sequence Number=SeqID_12050
MTIGCGTTWMLWKLGRIDGDPALRGTRIRATWEYVSSVGGGQQGMCGRVRLPAFIVDHKVVPGDMSRGSGDLGDVRRAPGSQQIKGTKTTKQGGLLENEVKKLGGLLVIDYQGASGNRLPGCVIDYTEEHATGNRLPIAMAAQLIHDRVEMECLEGAWETLEGNARCRFRGTIRFTATSLVHPDEPARMLQRTVEWILPTPTPYRLVEPVQVIEVTSSEEDPEELPPEPAVDALDFLEGDEDPLLEVDSPEDVMSASEADSTEDSGPREMAISVRNVKEDDVILTRSGSFDIGYRDLDDATSSEGR

SEQ ID NO: 128829 - protein, 226 aa, Glycine max
  Coding DNA Sequence Number=SeqID_12051
  Gene Ontology: Mol. function=ATP binding; Cellular component =membrane; Biological process=defense response
  Homolog annotation: Hit_ID=Q14WI2; Match level="QueryCoverage=67%, HitCoverage=87%, E-value=3e-34, Identity=50%"; Hit description =Resistance protein-like
  Pfam annotation: Domain name=NB-ARC; Domain location=1-212; Score= -37.1; E_value=6.4e-08; Accession=PF00931.13; Description=NB-ARC domain
VGKTTLAKQVYDQVRNNFECHALIKVSQSFSAEGLLRHMLNELCKEKEEDPPKDVSTIESLTEEVRNRLRNKRYVVLFDDVWNETFWDHIESAVIDNKNGSRILITTRDEKVAEYCRKSSFVEVHKLEKPLTEEESLKLFCKKAFQYSSDGDCPVKVIGVIIIVMEILRSTNISHHFLMRILKLAKYRLKAQVEKDEGPSGEGQSLRAEKDEGLETETLSRLLIVA

SEQ ID NO: 128830 - protein, 53 aa, Glycine max
  Coding DNA Sequence Number=SeqID_12052
MRLSPTVALSAHQVLSEQPNAGAKRDVKHEGAETVTRAKPGYAPSARSNRSTG

SEQ ID NO: 128831 - protein, 87 aa, Glycine max
  Coding DNA Sequence Number=SeqID_12053
  Gene Ontology: Mol. function=catalytic activity; Biological process =cellular metabolic process
  Homolog annotation: Hit_ID=O49260; Match level="QueryCoverage=51%, HitCoverage=12%, E-value=7e-09, Identity=61%"; Hit description=G5bf protein
MATAPCHVRATRGGILGYLGELADLAKVFIQVLGNEKATKEVFNISREKYVTFDGCAKTGLGVEFYIGLTPQPMQNGQNSKTVGQPM

SEQ ID NO: 128832 - protein, 63 aa, Glycine max
  Coding DNA Sequence Number=SeqID_12054
MKMKANKTRNELKVSDSNTYRLKNEERMKNGQRTVKNGGKSSQICSQKRLGRKKGGACRPEAS

SEQ ID NO: 128833 - protein, 87 aa, Glycine max
  Coding DNA Sequence Number=SeqID_12055
MKVKVGDELINFVSELVEGIIEGDDNVLTLMPCQQGSYVMLQCFLSTEKSNLMDVISFILGSGAQLKDLIYTFDNHEKEQKGQRFCQ

SEQ ID NO: 128834 - protein, 209 aa, Glycine max
  Coding DNA Sequence Number=SeqID_12056
  Gene Ontology: Mol. function=RNA-directed DNA polymerase activity; Cellular component=chromatin; Biological process=chromatin assembly or disassembly
  Pfam annotation: Domain name=RVP_2; Domain location=89-205; Score= -38.2; E_value=0.00095; Accession=PF08284.2; Description=Retroviral aspartyl protease
MAQAAGLAWLQEEKLLDARRQVRNRFGPPYLPHSSHPSSMYHRGHKCPSRAFLLIGDEDEAPFEDSVTRDQPPDLPDEPNPTPAQISFHSISGHIAPETLHLLGYIDAHPVVILVDGGSTHNFIQAPLAKSLGLPSRVTTPLNVMVGNSQHLHCDKLCQGVKLLIQNTTFMVDLHLLPLSGANVVLGVQWLKALGPILTYYNTLSMKFF

SEQ ID NO: 128835 - protein, 299 aa, Glycine max
  Coding DNA Sequence Number=SeqID_12057
  Gene Ontology: Mol. function=RNA-directed DNA polymerase activity; Cellular component=chromatin; Biological process=chromatin assembly or disassembly
MLQKGLIRPSISPFSSPVLLVKKHDRSWRVCVDYRALNTITIKDRYPIPTVDELLDELGAASWFSQLELLQGYYQIRMHEPDVAKTVFRTHHGHYEFKVMLFGLCNAPSSFQATMNDIFRPYLRRFIIVFFNDILIYSHTLPEHLIHLEKAFEGVTSIALKSTISNNFPSRKPQELYEAFWVLPVFIAGSSKALKEALTSAPVLILLDFSLPFTLETNASRVGMGAVLSQKGHPIAFFSKPFSPKLLQASTYVHELCAITTAVKKWRLMGYDYCIQYRSSNTNLVVDALSRLKEGSEGT

SEQ ID NO: 128836 - protein, 95 aa, Glycine max
  Coding DNA Sequence Number=SeqID_12058
  Subcellular localization annotation: CTP_CleavageSite=39; ConfidenceScore=5.00e-01
QAQLVTASAELSELHSMSSHNLVKFLLSVATTTPEQSLEATSEPSAQVVNLPSPQPASHPSTPLLQIPEDPTTPVLVVDTSPPTTPVLQLTNQED

SEQ ID NO: 128837 - protein, 180 aa, Glycine max
  Coding DNA Sequence Number=SeqID_12059
  Gene Ontology: Mol. function=RNA-directed DNA polymerase activity; Cellular component=chromatin; Biological process=chromatin assembly or disassembly
  Pfam annotation: Domain name=zf-H2C2; Domain location=4-45; Score =19.5; E_value=0.00093; Accession=PF09337.1; Description=His(2) -Cys(2) zinc finger
MEYHSTPTGGHMGVAKTLARITENFYWPGIRKDVKQFVAACVDCPQTKYETKKAAGLLCPLPVPLQPWEDLSLDFITGLPSFRGNTTILVVVDRFSKGIHLGSGVSPFEVTYGRKPPSWPQYITGSSKEEIAEGSSNHEAGSRQEALRGDVPYQQYGHGPAPATQTSFHYGPTPRIFQAQ

SEQ ID NO: 128838 - protein, 34 aa, Glycine max
  Coding DNA Sequence Number=SeqID_12060
MASSNAEATNEVAQTKRLKRTSWIYVQILPTHKC

SEQ ID NO: 128839 - protein, 182 aa, Glycine max
  Coding DNA Sequence Number=SeqID_12061
MEVVLVMVVVIAMSVMLVWSSGGSSVGDGCSDVSGGDGDESGIVVVGSSGDSNDNGDSDINSGGGNNISSDGDVSDNDSDSNNGVNGVCNDISDGSTGNNDGDGGGDNGYDTNDSVDGGSNEASYDGDNNSCVVIVVMTEVILMVIVIATKNIIIKCEISNNLMMITRGGDNETGINNNLMK

SEQ ID NO: 128840 - protein, 44 aa, Glycine max
  Coding DNA Sequence Number=SeqID_12062
MDAHSCQDGIYQLTLRQREIGVMIARQDIAEQQCHPHLGQVGHA

SEQ ID NO: 128841 - protein, 490 aa, Glycine max
  Coding DNA Sequence Number=SeqID_12063
  Gene Ontology: Mol. function=heat shock protein binding; Cellular component=integral to membrane; Biological process=protein folding
  Homolog annotation: Hit_ID=O23230; Match level="QueryCoverage=31%, HitCoverage=12%, E-value=9e-26, Identity=38%"; Hit description =Trichohyalin like protein
MEESQRIGIDLMRGFPRRRSVENRSSSRRRRSIFSGAGNSESVDADDFADVFGGPPRTLLAHKFSSSGSFYEEVFRPPEFTCPAPKDGRSLPVFRIPARNEGFYSDIFGSDDDRRSRDRSRSLSKENSSSAMSSEELSPRRPAIADDVALSGFASKLSNGILSVPNDCYRPINIPWRWNPSTVMPEAEEYPSKLGVPLFACKDQSFEIQHQDNEYKENFRSPHLGSSRRVSSPETISLESNSYQSTKVFTDDWELNSPFSVVSSLYQEPEAKFSVHDRVLSEQIIEGDDNDDDDDIMNSYVIELNSNLRREECGESAIDEAIAWAKEKFQSQSSDEESSMRNDGKEQTVGIGSSDASEYHDNGIGIVQTQEKRQTETEKLDSDIRLWSSGKETDIRLLLSTLHHILRPESGWYAIPLKSLLESSQVKKAYQKARLCLHPDKLQQRGATLLQKYVAEKAFSILQFCLEICGQTPSLTFGMSGVFVVDKQYI

SEQ ID NO: 128842 - protein, 96 aa, Glycine max
  Coding DNA Sequence Number=SeqID_12064
MMTCSVDLNNKDLDISFYVFKPTVVIVDHLVHGLQQFSLLTQNLGCVQSSIFRSIHGNTIIWYGAWQKRSSDEKDKLTANLLSSRITMQNLLTSSF

SEQ ID NO: 128843 - protein, 107 aa, Glycine max
  Coding DNA Sequence Number=SeqID_12065
  Gene Ontology: Mol. function=hydrolase activity
  Homolog annotation: Hit_ID=Q9SY39; Match level="QueryCoverage=79%, HitCoverage=24%, E-value=5e-12, Identity=53%"; Hit description =Putative hydrolase
MFYSHFEKWGWTGRTVGSSYIGCVGKDSSLLLDIHLTLQQTGSPNVHFCLPQTLETVKRLCPKQTLLIGMNHKFDHHKDNEFLMEWSRREGLSVQLAHDGLRVPINL

SEQ ID NO: 128844 - protein, 88 aa, Glycine max
  Coding DNA Sequence Number=SeqID_12066
  Subcellular localization annotation: CTP_CleavageSite=52; ConfidenceScore=5.29e-01
MKLRRRVGFIGDVACFIIRTSIPRKRRKFRRGMTRNMSTKEAFMANCWNMVVATGVMSKLEDVVSLTNFFQNTRGISVEEKRHIFLPT

SEQ ID NO: 128845 - protein, 69 aa, Glycine max
  Coding DNA Sequence Number=SeqID_12067
MVQPTNPSIMRHVKHEGHVTQFGTPLRLRLIIVREGGVACARQGDLDTYYLVFLNESVVWTRLGYFLDE

SEQ ID NO: 128846 - protein, 82 aa, Glycine max
  Coding DNA Sequence Number=SeqID_12068
  Gene Ontology: Mol. function=protein transporter activity; Cellular component=mitochondrial inner membrane; Biological process=protein transport
  Homolog annotation: Hit_ID=Q10QJ0; Match level="QueryCoverage=75%, HitCoverage=31%, E-value=7e-22, Identity=77%"; Hit description =Mitochondrial import inner membrane translocase subunit Tim17/Tim22/Tim23 family protein, putative, expressed
  Pfam annotation: Domain name=Tim17; Domain location=1-82; Score=-9.4; E_value=0.022; Accession=PF02466.9; Description=Tim17Tim22Tim23 family
MERSAGLIKKKGFKGSFIEAGSNAKTFAILSGVDSLVVCILGRLRGKDDAINAGVAGCCAGLATSFPGISLLLIIDELSSFT

SEQ ID NO: 128847 - protein, 85 aa, Glycine max
  Coding DNA Sequence Number=SeqID_12069
MAKLRVELVGVATYRSTGGRRDSHGMRLPREEGARSCHQRLFEENVKKIGTCGLRTLIVKGSRVVFTHGEGISTPCVRHKGGSLQ

SEQ ID NO: 128848 - protein, 61 aa, Glycine max
  Coding DNA Sequence Number=SeqID_12070
MSNSAVAAGRRREAVSDGVEEGPTDFILNDDANLLRGIHKVKTLAYMNHWLISIELNHSVK

SEQ ID NO: 128849 - protein, 135 aa, Glycine max
  Coding DNA Sequence Number=SeqID_12071
  Gene Ontology: Cellular component=integral to membrane
  Homolog annotation: Hit_ID=Q6R8G0; Match level="QueryCoverage=98%, HitCoverage=19%, E-value=7e-14, Identity=36%"; Hit description=PHO1 -like protein
MEALVALRVKVKSPDTGLKQIISSPEETMDESHQQKDSMVGPEDNPLQHANRNTHYEEQAEANNNYITKDPFEILQHVKVDNVPQSPISTIKKAFTDSSDNELSFSKEELRKVKEQLRLVFVEFYQKLLHLKDYR

SEQ ID NO: 128850 - protein, 609 aa, Glycine max
  Coding DNA Sequence Number=SeqID_12072
  Gene Ontology: Mol. function=protein binding; Cellular component =membrane; Biological process=defense response
  Homolog annotation: Hit_ID=Q1SW19; Match level="QueryCoverage=96%, HitCoverage=62%, E-value=1e-137, Identity=45%"; Hit description =Disease resistance protein
  Pfam annotation: Domain name=LRR_1; Domain location=270-292; Score =5.1; E_value=31; Accession=PF00560.23; Description=Leucine Rich Repeat
  Pfam annotation: Domain name=LRR_1; Domain location=294-315; Score =12.0; E_value=1.6; Accession=PF00560.23; Description=Leucine Rich Repeat
  Pfam annotation: Domain name=LRR_1; Domain location=317-338; Score =12.6; E_value=1.2; Accession=PF00560.23; Description=Leucine Rich Repeat
  Pfam annotation: Domain name=LRR_1; Domain location=459-481; Score =7.1; E_value=13; Accession=PF00560.23; Description=Leucine Rich Repeat
  Pfam annotation: Domain name=LRR_1; Domain location=483-509; Score =1.1; E_value=1.7e+02; Accession=PF00560.23; Description=Leucine Rich Repeat
  Pfam annotation: Domain name=LRR_1; Domain location=532-554; Score =4.5; E_value=41; Accession=PF00560.23; Description=Leucine Rich Repeat
  Pfam annotation: Domain name=NB-ARC; Domain location=1-155; Score= -89.4; E_value=0.00014; Accession=PF00931.13; Description=NB-ARC domain
  Pfam module annotation: Pfam domain module=LRR_1::LRR_1::LRR_1::LRR _1::LRR_1::LRR_1::NB-ARC; Domain location=270-292::294-315::317 -338::459-481::483-509::532-554::1-155
DEKVAEYCRKSSFVEVHKLEKPLTEEESLKLFCKKAFQYSSDGDCPEELKDISLEIVRKCKGLPLAIVAIGGLLSQKDESAPEWGQFSRDLSLDLERNSELNSITKILGLSYDDLPINLRSCLLYFGMYPEDYEVESDRLIRQWIAEGFVKHETGKSLEEVGQQYLSGLVRRSLVQASSLRIDDKVKSCRVHDLIHDMILRKVKDTGFCQYIDGPDQSVSSKIVRRLTIATHDFSGSIGSSPIRSILIMTGKDEKLSQDLVNKFPTNYMLLKVLDFEGSVLLSDVPENLGNLCHLKYLSFRNTFIESLPKSIGKLQNLETLDIRGTYVSEMPEEISKLKKLRHLLAYSRCSIQWKDIGGITSLQEIPPVIMDDDGVVIGEVGKLKQLRELLVTEFRGKHQKTLCSSINEKPLLEKLLIAAADESEVIDLYITSPMSTLRKLFLFGKLTRFPNWISQFPNLVQLYLGGSRLTNDALKSLKNMPRLMLLFLSDNAYEGETLNFQCGGFQKLKQLHLAGLVQLKCILIDRGALCSVEKIVLQDLSQLKTVPSGIQNLEKLKDIYIKDMPTEFVQRIAPDGGEDQWIIQDVPHVGIWSKYAKEPSHIFGRSHH

SEQ ID NO: 128851 - protein, 392 aa, Glycine max
  Coding DNA Sequence Number=SeqID_12073
  Gene Ontology: Mol. function=oxidoreductase activity, acting on paired donors, with oxidation of a pair of donors resulting in the reduction of molecular oxygen to two molecules of water; Cellular component=membrane; ...
  Gene Ontology: Cellular component=Biological process=fatty acid biosynthetic process
  Homolog annotation: Hit_ID=P48631; Match level="QueryCoverage=33%, HitCoverage=31%, E-value=2e-43, Identity=66%"; Hit description=Omega- 6 fatty acid desaturase, endoplasmic reticulum isozyme 2
  Pfam annotation: Domain name=FA_desaturase; Domain location=187-358; Score=30.4; E_value=1.2e-08; Accession=PF00487.14; Description=Fatty acid desaturase
  Pfam annotation: Domain name=zf-CCHC; Domain location=90-107; Score =7.3; E_value=0.061; Accession=PF00098.13; Description=Zinc knuckle
  Pfam module annotation: Pfam domain module=FA_desaturase::zf-CCHC; Domain location=187-358::90-107
MAAETPSTNPLIELATVSSLPTNMRGLGHAFHEFSASIRECDSPFTTNYTNGSHASSTHGQINPRSHNSSTSTDPPNNNTQWGNVSHSVPACQYCGRCDHTAKTCYKLHGIGTPLIIISTKQICHNMITVLIPIGCLICDLGNLSVSFFNTLAPPLYFGMVAFYLGRPEEFKITVSRPFSFLAWPIYWAVQGCILTGVWVIAHECGHHAFSEYQLLDDIVGLVLHSGLLVPYFSWKYSHRHHHSNTGSLERDEVFVPKQKSCIKWVCVDTVYDAEAIVSLPISEIQYVRDAVNSFIGWPRHLVKPLSYDSDLNVRKPVEHSSDAKLAGESDPLGELMKILFYVYQNPVEVSWEAHQFGLPEIGAKFYITHADLAEIISGDKCLNIAILQLWT

SEQ ID NO: 128852 - protein, 59 aa, Glycine max
  Coding DNA Sequence Number=SeqID_12074
MVLTKTSKTNFVKAVETLHGRGYEFLDEKLMEEKKKKRLEQANQSGSSEAIVDPPSPIR

SEQ ID NO: 128853 - protein, 82 aa, Glycine max
  Coding DNA Sequence Number=SeqID_12075
MSEHCHYTIVDYWTLALVVICPNDNVVAWFYFLHNKSDKYFKGIVNRFNDKQGSKSKTNVKWIPVKCNKQRGSTECDYYVMH

SEQ ID NO: 128854 - protein, 51 aa, Glycine max
  Coding DNA Sequence Number=SeqID_12076
PVPLESAPSPSTFKRTRKATRLKSLSARPVGLERPLVHVDPNIESATGSYK

SEQ ID NO: 128855 - protein, 50 aa, Glycine max
  Coding DNA Sequence Number=SeqID_12077
  Subcellular localization annotation: CTP_CleavageSite=37; ConfidenceScore=5.09e-01
MDALGQCRFFVYPFKIFMYRSTSFSETKDTTTGTTTMSSMATTTMMRDNV

SEQ ID NO: 128856 - protein, 317 aa, Glycine max
  Coding DNA Sequence Number=SeqID_12078
  Gene Ontology: Mol. function=protein binding; Cellular component =membrane; Biological process=defense response
  Homolog annotation: Hit_ID=Q1SW20; Match level="QueryCoverage=77%, HitCoverage=29%, E-value=4e-37, Identity=36%"; Hit description =Disease resistance protein; AAA ATPase
  Pfam annotation: Domain name=NACHT; Domain location=134-258; Score= -31.5; E_value=0.017; Accession=PF05729.3; Description=NACHT domain
  Pfam annotation: Domain name=NB-ARC; Domain location=98-317; Score =3.8; E_value=1.6e-10; Accession=PF00931.13; Description=NB-ARC domain
  Pfam module annotation: Pfam domain module=NACHT::NB-ARC; Domain location=134-258::98-317
MAETAVSLAGQHALSKILEAVKMLRDLPKEVRDITDELESFQDFINDADKMAEAEEDDGRRHRIKERVMRLREAAFRMEDAIDEYNISCEDKQPDDPRCAALLCEAVDFIKTQILRLQSAYKIQDVKSLGREKRTVISVVGIPGVGKTTLAKQVYDQLCKEKKEDRPKDVSTIELLTEEVRNRLCNKRYVVLFDDIWNGKFWDHIESAVIENKNGSRILITTRDEKVAEYCRKSSFVEVHKLEKPLTEEESLKLFCKKAFQYNSDGDCPEELKDISLEIVRKCKGLPLAIVAIGGLLSQKDESASEWGQKFRLGEEF

SEQ ID NO: 128857 - protein, 209 aa, Glycine max
  Coding DNA Sequence Number=SeqID_12079
  Gene Ontology: Mol. function=ATP binding; Biological process=defense response
  Homolog annotation: Hit_ID=Q8LJZ9; Match level="QueryCoverage=76%, HitCoverage=20%, E-value=2e-11, Identity=28%"; Hit description =Putative stripe rust resistance protein Yr10
MYPEDYEVGQQYLSGLVRRSLVQVSSFRIDGKVKKCRVHDLIHDMILIKVKDTGFCQYIDGCDQSVSSKIVRHLTIATDDFSGSIGSSPIREISKLKKLRHLLSGYIPSIQWKDIGGMTSLQEIPPVIIDNDGVVIREVGKLKQLRELTVIDFTGKHKETLSSLINEMPLLEKLLIDTADESEEACPMGDVNKVSKLDFTVPKPELELE

SEQ ID NO: 128858 - protein, 119 aa, Glycine max
  Coding DNA Sequence Number=SeqID_12080
  Gene Ontology: Mol. function=long-chain-alcohol O-fatty -acyltransferase activity
  Homolog annotation: Hit_ID=Q84XY9; Match level="QueryCoverage=54%, HitCoverage=18%, E-value=3e-18, Identity=63%"; Hit description=Wax synthase isoform 1
MIIRAYDYREKLHPHFILVLYCCHMYLGIELVLALSAIPIRTLLGFEIEQQFNEPYLFTSLQDFWGPSHVLFCASRCAHCGEDDDKEGDAPSWVAVASRCIRTARGGVLGGHRKVPHTS

SEQ ID NO: 128859 - protein, 290 aa, Glycine max
  Coding DNA Sequence Number=SeqID_12081
  Gene Ontology: Mol. function=RNA-directed DNA polymerase activity; Cellular component=chromatin; Biological process=chromatin assembly or disassembly
LVKLPCPQGDNPHIIDPNSPTRCHPGIALPIAPTLPKALVLKLADNLIWLAKGVMTVKNRMYADFFRKFQAVCHGSYAFKNLKWSVESLSQLAHDCLCYLYTVLCFEKLLANDLKCFFSVGQHFVNCIQSGRTRDIFKKIKGFASECDLIYGVGVAVGDQAVREAVNLAHDFQEQQGYRMGCVPVMKSRDKSSQGRWGTGRGHSNPAALCVSELSFSQSPCDLPWVLYDTPPVMWESGADVNTQDDPPIGGAVLQRKEGTGHKGSCTDGDGGGVGEEDDERMGGVHQFSE

SEQ ID NO: 128860 - protein, 207 aa, Glycine max
  Coding DNA Sequence Number=SeqID_12082
DSLEEQASKGSFVPYGRQDLLTAAIGRSKHPSCVRAAGFGIQSQGLAFPPEPEVGPSTARVSTKGSCVDPSMTDLDTGDLDKCELYIEENPSHLVALEIVYEGSTVVHNILLLHGQVKVGVEEVKDADAPVLVPTDDVILVGQALNTFLAWPTHLVKRLLEQVVVSLAKPTDGLDPQVTWDVTMFGVFNQDFPLYIKHEDLSEIAHD

SEQ ID NO: 128861 - protein, 109 aa, Glycine max
  Coding DNA Sequence Number=SeqID_12083
  Pfam annotation: Domain name=Transposase_21; Domain location=1-96; Score=-120.1; E_value=0.00023; Accession=PF02992.5; Description =Transposase family tnp2
MMLSMMISSPRQPGNDIHVYLRHLIEDLAKLWDEGVAVFDVNKFLSGLRTSILLQHALLRASEARLTGALSKGGKMRGVATNVYLWETSEKSKETGQNENSKFGSCIYV

SEQ ID NO: 128862 - protein, 701 aa, Glycine max
  Coding DNA Sequence Number=SeqID_12084
  Gene Ontology: Mol. function=protein binding; Cellular component =membrane; Biological process=defense response
  Homolog annotation: Hit_ID=Q1SW22; Match level="QueryCoverage=99%, HitCoverage=79%, E-value=1e-154, Identity=43%"; Hit description =Disease resistance protein; AAA ATPase
  Pfam annotation: Domain name=LRR_1; Domain location=385-406; Score =7.1; E_value=14; Accession=PF00560.23; Description=Leucine Rich Repeat
  Pfam annotation: Domain name=LRR_1; Domain location=408-429; Score =11.0; E_value=2.5; Accession=PF00560.23; Description=Leucine Rich Repeat
  Pfam annotation: Domain name=LRR_1; Domain location=431-452; Score =12.8; E_value=1.1; Accession=PF00560.23; Description=Leucine Rich Repeat
  Pfam annotation: Domain name=LRR_1; Domain location=574-596; Score =7.0; E_value=14; Accession=PF00560.23; Description=Leucine Rich Repeat
  Pfam annotation: Domain name=LRR_1; Domain location=598-624; Score =5.6; E_value=25; Accession=PF00560.23; Description=Leucine Rich Repeat
  Pfam annotation: Domain name=LRR_1; Domain location=647-669; Score =4.8; E_value=37; Accession=PF00560.23; Description=Leucine Rich Repeat
  Pfam annotation: Domain name=NB-ARC; Domain location=1-270; Score =157.2; E_value=4.2e-44; Accession=PF00931.13; Description=NB-ARC domain
  Pfam module annotation: Pfam domain module=LRR_1::LRR_1::LRR_1::LRR _1::LRR_1::LRR_1::NB-ARC; Domain location=385-406::408-429::431 -452::574-596::598-624::647-669::1-270
MDPLFIEEDDVVGLDGPRDTLKNWLTKGREKRTVISVVGIPGVGKTTIAKQVYDQVRNNFECHALITVSQSYSAEGLLRRLLDELCKLKKEDPPKDVSNMESLTEEVRNRLRNKRDEKVAGYCKKSSFVEVLKLEEPLTEEESLKLFSMKAFQYSSDGDCPEELKDISLEIVRKCKGLPLAIVAIGGLLSQKDESAPEWGQFSRDQCLDLERNSELNSITKILGLSYDDLPINLRSCLLYFGMYPEDYEIKSDRLIRQWIAEGFVKHETGKTLEEVGQQYLSGLVRRSLVQVSSFRIDGKVKRCRVHDLIHDMILRKVKDTGFCQYIDGRDQSVSSKIVRRLTIATDDFSGRIGSSPIRSIFISTGEDEEVSEHLVNKIPTNYMLLKVLDFEGSGLRYVPENLGNLCHLKYLSFRYTGIKSLPKSIGKLLNLETLDIRDTGVSEMPEEISKLKKLRRLQASNMIMGSIWRNIGGMTSLQEIPPVKIDDDGVVIGEVGKLKQLRELLVLDFRGKHEKTLCSLINEKPLLEKLVIETADESEVIELYITSPMSTLRKLVLFGKLTRLPNWISQFPNLVQLSLNGSRLTNNALKSLKNMPRLLFLDLSDNAYEGETLHFQCGGFQKLKRLYLGNLDQLKCILIDRGALCSVEEIVLEDLSQLKTVPSGIQHLEKLKDLIIDVMPTEFEQRIAPDGGEDHWIIQD

SEQ ID NO: 128863 - protein, 38 aa, Glycine max
  Coding DNA Sequence Number=SeqID_12085
MGKVQRSKQGGSFSYNGVSRTEVTTWSLKLKRLCFPAC

SEQ ID NO: 128864 - protein, 128 aa, Glycine max
  Coding DNA Sequence Number=SeqID_12086
  Pfam annotation: Domain name=zf-CCHC; Domain location=24-41; Score =13.9; E_value=0.005; Accession=PF00098.13; Description=Zinc knuckle
MIATRGRRGGRNSKGGRSERGGRPQCSYCKRMGHTQENCYSLHGFPDKVAKVAQTEKSESKFSDEEYQEYLKLKSEKSSSRASSSSVPCYSTACISQSIDGPSPWILDSGASDHISGTWHGSTDWRRT

SEQ ID NO: 128865 - protein, 63 aa, Glycine max
  Coding DNA Sequence Number=SeqID_12087
  Homolog annotation: Hit_ID=Q6ZDG9; Match level="QueryCoverage=70%, HitCoverage=6%, E-value=5e-07, Identity=54%"; Hit description =Putative SEC23
MKQDFLNTIISEFSLYTLIKEIGERFIGDGDVVEEVIVLEVEGTNLDLGGNVDDAKGVEDRAT

SEQ ID NO: 128866 - protein, 350 aa, Glycine max
  Coding DNA Sequence Number=SeqID_12088
  Gene Ontology: Mol. function=zinc ion binding
  Homolog annotation: Hit_ID=Q2QSD0; Match level="QueryCoverage=37%, HitCoverage=8%, E-value=6e-14, Identity=36%"; Hit description=PHD -finger family protein, expressed
  Pfam annotation: Domain name=PHD; Domain location=60-110; Score=23.9; E_value=0.00023; Accession=PF00628.19; Description=PHD-finger
MPKQTLKVYFRRKGKVPVQTGFQYRFLTGFIPVLESSGFLESPDRSPDRFPVEPAGPVTVCDICGDQGFEEYLAICNKCPDGAEHIYCNDEKLEKVPDGDWWTCEDCRKSPGNELPTLGSQTEIEHAQCSPLLNSEFNGQLTNREVEKNVAIHDTRKRKNLGLLSKSVSFDNASSVKLNGKCSEVIAANDSAYTPVSNPLKCRMNRDMVGVREIGESDAMDTRSSGDRILLGGGDNFNSGCSDSRQSLDGKKVTPESVPEDGPCMSVENVGDNPSKDVKSKMPMEENNNADNGKLHGKRPMDEKNDADRLESSLSPASSEDLRDWEGLETLSTLLWLRKISGPFVYTGSQ

SEQ ID NO: 128867 - protein, 108 aa, Glycine max
  Coding DNA Sequence Number=SeqID_12089
MEEKSTSCNVCDTWCSFSLYVHIEQVAATAVWELMTLLIKPIRESEPSCEDIELLLNVREAQSRGRSGDTPKGNIHCRSASDDNFPVVAGIHFHEADCNHRDSQNSAE

SEQ ID NO: 128868 - protein, 69 aa, Glycine max
  Coding DNA Sequence Number=SeqID_12090
MHCHIPILMRLSNLTISKGKGNSREIMHCITTILFLHLIESLRLRLYPHHHLTPLPHVLTQRHRQFHLC

SEQ ID NO: 128869 - protein, 225 aa, Glycine max
  Coding DNA Sequence Number=SeqID_12091
  Gene Ontology: Mol. function=transcription regulator activity; Cellular component=nucleus; Biological process=regulation of transcription
  Homolog annotation: Hit_ID=O81348; Match level="QueryCoverage=79%, HitCoverage=48%, E-value=1e-40, Identity=53%"; Hit description =Symbiotic ammonium transporter
  Pfam annotation: Domain name=HLH; Domain location=2-40; Score=15.7; E_ value=0.0031; Accession=PF00010.16; Description=Helix-loop-helix DNA -binding domain
MRRRKISQKLIALSALIPDLKKMDKVSVLGEAIRYVKQLKEQVKVLEEQSKRKNEESVVFAKKSQVFPADEDVSDTSSNSCEFGNSDDISTKATLSLPEVEARVSKKSVLIRILCEKEKAVLVNIFREIEKLHLSVVNSSALSFGSSVLDTTIVAEMEDEFNMGVKELARNLRVGLMQFIRRNNCYVGRKKNEQQHHAESVRGRQFSDRDGRTIKEYDPLSEIGI

SEQ ID NO: 128870 - protein, 50 aa, Glycine max
  Coding DNA Sequence Number=SeqID_12092
MTIWNFIDDDELGMLMRVFGSVSFFEEASFEEANEVITKLKDVIDQIAVI

SEQ ID NO: 128871 - protein, 331 aa, Glycine max
  Coding DNA Sequence Number=SeqID_12093
  Gene Ontology: Mol. function=hydrolase activity, acting on glycosyl bonds; Biological process=metabolic process
  Homolog annotation: Hit_ID=Q8PJD6; Match level="QueryCoverage=83%, HitCoverage=40%, E-value=1e-139, Identity=83%"; Hit description =Alpha-glucosidase
  Subcellular localization annotation: CTP_CleavageSite=65; ConfidenceScore=5.38e-01
MVGSAFFAGITLHTYSMPFAGPSPCSAAFRCCAPPPERGLGRYSGAQAGRRSTDRREVNGLPTARCQYQRHCIGAGHLAGFACERERVAAEISALAIAVDLGAIAHAGFQEAQRHRQHAAVFIGDAAEEPVAAVAVAAHDRHVVAHLAIEHAALLPVHRHVFDEAERLAMLQVVLGQVGGHLDRAVQHHVQRQLARQRAGNGLAVAALQAEDAGGVIHRPGQHPGEHQVDLVLRRVRRLAPGVVLHAACAFARDPIGVGAAQAGVLDRLMRVHRQVPARGLLHHLQVMAGHELPVVPLAPERAASRISPVDLAIVADVAGLELVHPQPCVQ

SEQ ID NO: 128872 - protein, 116 aa, Glycine max
  Coding DNA Sequence Number=SeqID_12094
MGSALQNDAPESDYTPANGIEYVCRVIPAKNALPTIAATTAATASHVHGENVEPQAQRAEHRAGRCPGADAGVCTVHAEHHHAGRHRRHQPGYGAGHRHPPRHRKRDRDQAGRHLG

SEQ ID NO: 128873 - protein, 594 aa, Glycine max
  Coding DNA Sequence Number=SeqID_12095
  Gene Ontology: Mol. function=binding; Biological process=cell adhesion
  Homolog annotation: Hit_ID=UPI00005F8097; Match level="QueryCoverage =90%, HitCoverage=53%, E-value=2e-68, Identity=30%"; Hit description =COG3468: Type V secretory pathway, adhesin AidA
MAHFRLSPLSYSCALALLVASGAQAASAWQALDGAKVAATSGYESRSARDYPLLASGAGSLLTTAVPGLNFVTTGSLLYAAQALNGGRIELDGAHLATDGVMAHGANLSDGQLVMRGGSISTLGDSSAGVMASGDSEVTLTDVTLSSRGRDATGVTLSQGQLTLRDSRISASGENGGGLALGGGGRGNARAALSDVTIELSGAGTRAAIELGNGTLNGSQVAINVSDRHRGIEIYNPQGSSGRGSVTLSDSQIVTDAGDGVYTLGGDVLLNNVTVDTQSGMAVNVNNRSTATLLGGSFNTHADNAHTLWIASESASAHAQDSRFSSEGNNAHAFHAQFGNATLDNVALSTQGAGSYGLYSEAQVDAQHLTVETHGSGAIGVFAARGGNINLANTQVRTTGDSATGLLAYPGSAISGKQVDVKTEGAGAHGAWVRSGSMQLQHSTLSTAGQQAAGLQVNANSNGDSSTVTLDSTQIVSQQGAAIKVTNSSADITLTNGSQLQGGDALLDVASGTLPSEVTLNADNHVRLQGDVRADAASRVALALSNASQLSGSVQGADSLTLDASSQWQLSASSTLNTLHSDGNVSFAPQASGF

SEQ ID NO: 128874 - protein, 67 aa, Glycine max
  Coding DNA Sequence Number=SeqID_12096
MTLAEQACTNTATLTGGNKHMDDGWMHGGELTWAFHPYFREANMAHHVSPGLLYFDEPPMVCISLLW

SEQ ID NO: 128875 - protein, 76 aa, Glycine max
  Coding DNA Sequence Number=SeqID_12097
MSWIDGGGDSMIKWDKGSCEALCNFLTHKYVPIACYECTMQILLLEKLLSSNMAPQEGLMVMLKLPMHPLLKDDYA

SEQ ID NO: 128876 - protein, 134 aa, Glycine max
  Coding DNA Sequence Number=SeqID_12098
  Gene Ontology: Mol. function=transporter activity; Cellular component= integral to membrane; Biological process=transport
  Homolog annotation: Hit_ID=Q9AWM0; Match level="QueryCoverage=99%, HitCoverage=54%, E-value=3e-44, Identity=59%"; Hit description =Putative small basic membrane integral protein
  Pfam annotation: Domain name=MIP; Domain location=1-134; Score=-99.3; E_value=0.0026; Accession=PF00230.10; Description=Major intrinsic protein
MAVRFPAQAYGGAVGIKTLLLVMPSHYKDMLKGPFLKVDLHSGAVAEGLLTFIHNMAIFFVMFKGPRNPFVKVYLLSVTTAALAILGGGFTGPSMNPANAFGWAFVNNKHNTWEQFYVYWIGPFIGASSAALIF

SEQ ID NO: 128877 - protein, 86 aa, Glycine max
  Coding DNA Sequence Number=SeqID_12099
MKNLMNEYRKKSNVTVKDQIKLDYLECNSHVAKTIEACMTFAGPKISALELEDDKFGSEDLTQDGRSELLMSGNSHGSLSMMKESL

SEQ ID NO: 128878 - protein, 481 aa, Glycine max
  Coding DNA Sequence Number=SeqID_12100
  Gene Ontology: Mol. function=DNA binding; Cellular component=beta -galactosidase complex; Biological process=DNA integration
  Homolog annotation: Hit_ID=Q1SLU3; Match level="QueryCoverage=99%, HitCoverage=36%, E-value=1e-153, Identity=53%"; Hit description =Integrase, catalytic region
MATSSETEPKSFKEASQSDKWIKAMNAKIETLEANHTWILTDPPPNKSAIGCKWIYKVKHKADGSVERYKARLVAKGYTQIEGQDYLDTFSPVAKITIVRLLHVLAVVNNWHLKQLDVNNVFLHGDLNEEVFMTLSPSIHSTKSNQVCRLQRSLYGLKQASRQWYARLSTFLISHGYRQCSSDHSLFIKQHLQSFTALVVYVDDIVLLGNDLLEIKSITQLLDEVFKIKDLGDLKFFLGLEVACSMLGSKHVYTPIDYAVRLYQQFGIPLDDTTTSSYRSLIGHLIYLTNTRPDITYAAYRILRYLKAHPSSAHQQAAYRILRYLKASPGSGIFFSTSSILQLKAFSDSDWARCIDIRRSITGYSVYLGNSLISWKSKKQATISRSSFEAKYRALASATSLLFSDNRFALHIAANHVFHEHTKHIEIDCHIVREKLHSDLIKLLPIASAQQLADICTKALPPGAFNFLQCKLGMSNIHSLA

SEQ ID NO: 128879 - protein, 141 aa, Glycine max
  Coding DNA Sequence Number=SeqID_12101
GHGGGFGAGGGVGGGIGGSGGGGGGGGGGGGIGGGSGHGGGFGAGGGVGGGGGGGGGGGGGGGIGGGSGHGGGFGAGGGVGGGGVGGGGGRGGGGGIGIGIGIGVGVGVGAGAGEGFGVGVGGGGRGGDTILSADTCVEVV

SEQ ID NO: 128880 - protein, 260 aa, Glycine max
  Coding DNA Sequence Number=SeqID_12102
  Gene Ontology: Mol. function=RNA-directed DNA polymerase activity; Cellular component=mitochondrion; Biological process=RNA-dependent DNA replication
  Pfam annotation: Domain name=rve; Domain location=93-240; Score=27.9; E_value=2.8e-05; Accession=PF00665.16; Description=Integrase core domain
MAGEEEEPDWMTPYRNFLIRGVFPLDKNEARHLKQKVSYYIILDGKLFKRGLTTPFLKFLNNQQALNSTKKCKQCQEFADIPRTPPDNLHSLSSPWPFIMWGMDILRPLPKASGVVKYLLVVINYFTKWIKARPVWEITTIEVEKFTWKHLIYRYNLPYAIVMDNDIQFKAQTYEDLLTKLGIKHLVTSIEHPQINDATIPIEVGEPLTRRLLFQQQQNEESIKRIRGEAKKDPRAGKLGLNWEGPFRVITSLDNEAYRL

SEQ ID NO: 128881 - protein, 320 aa, Glycine max
  Coding DNA Sequence Number=SeqID_12103
  Gene Ontology: Mol. function=nucleic acid binding; Cellular component= mitochondrion; Biological process=DNA integration
  Homolog annotation: Hit_ID=O24438; Match level="QueryCoverage=99%, HitCoverage=29%, E-value=4e-76, Identity=39%"; Hit description =Retrofit
MRNCTWSLVPFPTNVNLVGCKWIFRIKRRSDGSIERHKARLVAQGFSQEAGIDYFDTFSPVIKPTTIRLVLSIAFSNGWCIRQLDINNAFLNGDLAETVYMKQPHGFEDSSHPSHVCRLHKALYGLKQAPRAWFNKLKHYLVTHGFKACKIQQFITQLHTTFALKDLSDLHYFLGLQIRRSPAGLTLSQEKYIHDILCRNNMTEASSISTPANPTSHLTSRGDPFHDPKLFRKIVGSLQYVVNRVNLCILLHLYTDAGWLLDTEDSSTEAKYCSLAYTAAELLWIKQLLQDLCVPLRRPPLLLCDNVSAIFLTKNPVIHT

SEQ ID NO: 128882 - protein, 383 aa, Glycine max
  Coding DNA Sequence Number=SeqID_12104
YDLGKNILLERKVEIYHTEFDDFKTELERRNLYKRLTNLADGTIDLALVKEFYANLYSFEGPSPKQARVRGYLVWSVLSYSNLAPTSPTSDLTVDRARLIFGLVSHMDMNIEALISSQMTSIAQSNSSRLGFPALITALCRAREVVSNSLTFERLSPVINLAYIRKNCWNLDYLSVSIQGARRARVRPADLPSTSAAPTLVSTSAAPSVLLRLILSALKLQSIHQGQIILLQSLQVVAPPGSIPSIEKFLERVAWPGAQPSLHMEDEGPTAQEPRQVHDASSGTTIPEPFTFQQDAGEEQVRLETATIPERSLEGTSEPPTSVVDLSSPQPTADPSTHVLDIPEDQTTPILALNTSPPATPVLNLTDEEDVQTQDTQDMSLEF

SEQ ID NO: 128883 - protein, 72 aa, Glycine max
  Coding DNA Sequence Number=SeqID_12105
MVVVVGETEGPPKCFQRVYHQLLALQWHIRAKARSQLDCGGEFHGSLPRFERYVPDQIELGGKPYDGKACSF

SEQ ID NO: 128884 - protein, 140 aa, Glycine max
  Coding DNA Sequence Number=SeqID_12106
  Homolog annotation: Hit_ID=Q1SKD7; Match level="QueryCoverage=84%, HitCoverage=31%, E-value=3e-10, Identity=32%"; Hit description =Ankyrin
MASKNLSAKRSRRDATAEGTSAAPKFDSHRFRSVVHQQIFEAIKGWSFHRERCVQLKEDEYSNFQEEIARRHWTSLVTPMAKFDPEVVLEFYVNAWPTEEGVRDMRSWVRGQECEFSQRRNMGRWVRRGGHCPAVMHTGA

SEQ ID NO: 128885 - protein, 359 aa, Glycine max
  Coding DNA Sequence Number=SeqID_12107
  Gene Ontology: Mol. function=transporter activity; Cellular component= integral to membrane; Biological process=transport
  Homolog annotation: Hit_ID=Q2KZR5; Match level="QueryCoverage=76%, HitCoverage=25%, E-value=1e-125, Identity=85%"; Hit description =Multidrug efflux system transmembrane protein precursor
IQFHAGHVRQVRHGAVGRGLEDDVAEFLFGLQAAARIHVQLQRHVAQGRGRADHAGGDLHVLLADGGDHFGGRHAALRHLLRVEPHAHRVVARAPHRHFTHAGDARQAVLDVQDRVVAQVGDVVAVVGRDQVHHQRQGGRALGGRDAQPLHVRRQARQRLRHAVLHQLLGLVRVHAQLEVDRQRQIAVAVGLRLHVQHVLHAVDGFLQRRGDGFGDDLGVGARILRAHHHRGRHHFRVFRDRQLEHGQQAAQQHQHGQHPGEDRPVDEEFRDIHERSRSALRFTGGLVGGRGLDRVALRRDHGHHGGAHGVAGAHALQAIDHDAFAGGQAGVHDPQAFLVGAQLHLAVVGVVLVVQHQH

SEQ ID NO: 128886 - protein, 98 aa, Glycine max
  Coding DNA Sequence Number=SeqID_12108
MAFLYDLKLGKFYLVIYISVTIRCHLSMVHVVKDLYFLVVQAPYGACRPWIFFINGVLCLLKINSSGMEKEKDDWRCYFKEKMSQEEAHHHRKPWIRA

SEQ ID NO: 128887 - protein, 108 aa, Glycine max
  Coding DNA Sequence Number=SeqID_12109
  Gene Ontology: Mol. function=helicase activity; Biological process =protein amino acid phosphorylation
  Homolog annotation: Hit_ID=Q5VR06; Match level="QueryCoverage=99%, HitCoverage=8%, E-value=1e-15, Identity=37%"; Hit description =Helicase-like protein
  Pfam annotation: Domain name=DUF889; Domain location=1-108; Score= -96.1; E_value=5.7e-05; Accession=PF05970.5; Description=Eukaryotic protein of unknown function (DUF889)
MRLLSNAPQQPNNEELKQFSDWLLDIGDGKIGQHNDGFSEITILDEFLIKDYDDYIHAIVEVTYPSLIDNYSDTDYLQKRVVLASKKEIVDKINDYVLSLIPNNEKEY

SEQ ID NO: 128888 - protein, 89 aa, Glycine max
  Coding DNA Sequence Number=SeqID_12110
MSIVLQLSLISVVGDDCRFGGCRGGLGRRGGGVGGGIGSGGGFGSGGAGQGGGVGGGVGGGIGGGGGGGLGGGSGHGGGFGAGGGVGGG

SEQ ID NO: 128889 - protein, 73 aa, Glycine max
  Coding DNA Sequence Number=SeqID_12111
  Gene Ontology: Mol. function=oxidoreductase activity, acting on single donors with incorporation of molecular oxygen, incorporation of two atoms of oxygen; Cellular component=plasma membrane; Biological process=...
  Gene Ontology: Biological process=methionine biosynthetic process
  Homolog annotation: Hit_ID=Q8H185; Match level="QueryCoverage=78%, HitCoverage=31%, E-value=4e-19, Identity=77%"; Hit description=1,2 -dihydroxy-3-keto-5-methylthiopentene dioxygenase 4
MDDSNEDQRLPHHRNPNELVALYQLAELRVLCWKLHPTIYENDQELTKIREDMGYNYMILLQLLPLQSSLINP

SEQ ID NO: 128890 - protein, 103 aa, Glycine max
  Coding DNA Sequence Number=SeqID_12112
  Gene Ontology: Mol. function=ribonuclease III activity; Biological process=RNA processing
MVIISLEETSTSLESKWKETKVSMTLAVRMAKALLFSSEKEACVVARQRRSMLLKVYLMEEDQSNKQHNEESESERSRTRVRQTKGLGSKPSFIKDPTTLIFK

SEQ ID NO: 128891 - protein, 177 aa, Glycine max
  Coding DNA Sequence Number=SeqID_12113
MTQYEYACGKVMTKDNKEHVVSRGIIPFDIKHCGGRDYQQQHITKRGKLYMRLHCYQASRRPNMTTDRPPLPMSYTDPGRQPHTKYKNTEKKVESPTVATHPSAGGQGEIEKRHLPRRRTCESRRQCLFEENVSKNQKERKMIYDTNDQLRFTLQEEKGLLMIEKGDEDAQNNKADP

SEQ ID NO: 128892 - protein, 136 aa, Glycine max
  Coding DNA Sequence Number=SeqID_12114
  Homolog annotation: Hit_ID=Q1SWX1; Match level="QueryCoverage=61%, HitCoverage=16%, E-value=2e-10, Identity=39%"; Hit description=IMP dehydrogenase/GMP reductase
MGSDQAPSFKKRFYHVKVKNLELASLRELGQRMDQVGHQAFSKAYGKIWELDMVEVFVEAIASLAQYYDQSLRCFTFRDFQLAPTIEEFEGILGCPLGERKLLDFPCSYFLVHFFFIQICSREIWFAGKRTGSSSI

SEQ ID NO: 128893 - protein, 433 aa, Glycine max
  Coding DNA Sequence Number=SeqID_12115
  Gene Ontology: Mol. function=hydrolase activity, acting on ester bonds; Cellular component=nucleus; Biological process=biosynthetic process
  Homolog annotation: Hit_ID=Q359S6; Match level="QueryCoverage=100%, HitCoverage=97%, E-value=1e-138, Identity=52%"; Hit description =Amino acid adenylation
  Pfam annotation: Domain name=AMP-binding; Domain location=1-165; Score=-53.5; E_value=2.5e-05; Accession=PF00501.18; Description=AMP -binding enzyme
  Pfam annotation: Domain name=PP-binding; Domain location=252-315; Score=75.2; E_value=2e-19; Accession=PF00550.15; Description =Phosphopantetheine attachment site
  Pfam module annotation: Pfam domain module=AMP-binding::PP-binding; Domain location=1-165::252-315
MCCGEALPAALVAEFYRRLPQAELHNLYGPTEAAVDVTAWHCSREADRVSVPIGRPIANTRIYLLDERGQPVPLGAVGELYIGGVQVARGYLHRPELTAERFLSDPFAPGGRMYRTGDVARYLANGDIEYLGRNDQQVKIRGFRIECGEIEAALATHPAVREAVVDARAVGDDKRLVAWVVPAADVAEETLAGALRQHVSAALPDYMVPSAWVVVAALPLSPNGKLDRRALPEPQGAQSQAAYEAPQGEHETLLAAIWRELLNVEQVGRHDNFFELGGHSLLAVKLMAQLRRAGWGANVQTLFSTPTLSALAQAMSAQGEIDIPENRILPGGASITPEMLPLATLSQPEIDAVVAQVPGGVANVQDIYALSPLQEGILFHHLLAERGDPYQLSAVLRFDSRARLDAWLAAMQQVIDRHDILRTAFITQGMSSP

SEQ ID NO: 128894 - protein, 86 aa, Glycine max
  Coding DNA Sequence Number=SeqID_12116
MLRQPPQPFYRKKGEEVAAQLAQATLARPGELGCFLRKQPSFKKQLWEFYGSITGVPEAPESLFPTKWGVWWPPSSPRRAQLAQAS

SEQ ID NO: 128895 - protein, 110 aa, Glycine max
  Coding DNA Sequence Number=SeqID_12117
MCRNLPYNGECGRKAKEASSKKENVWESPPTFIRGKTLEKTKRDLGILKRKGVALAPMYPQAKGHFGGLVAHPSKLRLTPEVTSSPKRAGAFTLKSFGGPGAPEASLSKL

SEQ ID NO: 128896 - protein, 395 aa, Glycine max
  Coding DNA Sequence Number=SeqID_12118
  Gene Ontology: Mol. function=serine carboxypeptidase activity; Cellular component=cellulose and pectin-containing cell wall; Biological process=proteolysis
  Homolog annotation: Hit_ID=Q6W6R6; Match level="QueryCoverage=79%, HitCoverage=64%, E-value=1e-148, Identity=81%"; Hit description =Putative serine carboxypeptidase
  Pfam annotation: Domain name=Peptidase_S10; Domain location=137-394; Score=310.7; E_value=2.6e-90; Accession=PF00450.12; Description =Serine carboxypeptidase
MVAAVKMTIVLMVTIAVVIVVVVSKHKKTLLHCLSLFMVYKVIETYDTEKPSNQVVNKMKKKLSLYAFLLNLSLLVLLPYSKATQADKLQDLILSKSSQKPPVTLSWAEEDALKTHSSAYVASQEGQKEADKIVALPGQPYGVNFDQYSGYVTVDPEAGRALFYYFVESSYNPSTKPLVLWLNGGPGCSSLGYGAFEELGPFRINSDGKTLYRNKYAWNVVANVLFLESPAGVGFSYSNTISDYEHSGDKSTAKDAYVFLINWLERFPEYKTRDFYITGESYAGHYVPQLAYTILVNNKFSQQNINLKGIAIGNAWIDDVTSLKGIYDYIWTHALSSDQTHELIEKYCDFTSENVSAICANATRTAFEENGNIDPYNIYAPLCQDSSLKNGSTGS

SEQ ID NO: 128897 - protein, 92 aa, Glycine max
  Coding DNA Sequence Number=SeqID_12119
  Homolog annotation: Hit_ID=Q1SPB9; Match level="QueryCoverage=98%, HitCoverage=16%, E-value=3e-08, Identity=35%"; Hit description =Transposase
MDAPGSVKDYPSQSEYKGRVKMFGIVCSPWEYFVEYVKNTWLIPHKECFVKVWMDKVMHLGNTISNRLKRLIQNSMRDLYKCWDAMNNFITL

SEQ ID NO: 128898 - protein, 209 aa, Glycine max
  Coding DNA Sequence Number=SeqID_12120
  Gene Ontology: Mol. function=chromatin binding; Cellular component =signal recognition particle, endoplasmic reticulum targeting; Biological process=chromatin assembly or disassembly
  Homolog annotation: Hit_ID=O22265; Match level="QueryCoverage=57%, HitCoverage=36%, E-value=1e-32, Identity=55%"; Hit description =Signal recognition particle 43 kDa protein, chloroplast precursor
  Pfam annotation: Domain name=Chromo; Domain location=91-136; Score =10.9; E_value=0.05; Accession=PF00385.14; Description='chromo' (CHRromatin Organisation MOdifier
MLLFVGGLNSKPCVKLLAKAGVNLDHCDQSGSLTVLHMAVGYVRPDMVKVFLNLNAYLEVADDHRRTMQFGHRIVLEGVIKVLEGEVFEYAEVQEILERRGKGENLEYLVRWKDGEANEFVAEDLLALSIESEREIMPHTTGGDRTRPTAFVRRRERCAVVDEEQEIYEGPEGVAPDNVVFGGGPEDKSILIEYADHVACKLWDGLVYQ

SEQ ID NO: 128899 - protein, 36 aa, Glycine max
  Coding DNA Sequence Number=SeqID_12121
MWLQLVMALFDYTLQKLNLPVYPQSNVTVDEILDDG

SEQ ID NO: 128900 - protein, 89 aa, Glycine max
  Coding DNA Sequence Number=SeqID_12122
  Gene Ontology: Mol. function=serine carboxypeptidase activity; Cellular component=cellulose and pectin-containing cell wall; Biological process=proteolysis
  Homolog annotation: Hit_ID=Q6W6R6; Match level="QueryCoverage=93%, HitCoverage=16%, E-value=2e-32, Identity=78%"; Hit description =Putative serine carboxypeptidase
MSGDTDSVVPVTSSRYSINTLKLPIQVPWRPWYSGNEVGGYVVKYNGVTFVTVRGAGHLVPSWQPSRTLTLIFSFLHGSLPPTSPWKGF

SEQ ID NO: 128901 - protein, 117 aa, Glycine max
  Coding DNA Sequence Number=SeqID_12123
MKKLKKNKDAYNPQKEKKEMRVKGRVRQKKGAVVETAYNKGFEEKLKPEDSCLACQTHLASSSRLARRSPHSVKKLLREPEVRKEKKTTIGSHSLSTYPSSFHFPSYFCWIEWPQNN

SEQ ID NO: 128902 - protein, 97 aa, Glycine max
  Coding DNA Sequence Number=SeqID_12124
  Pfam annotation: Domain name=Transposase_23; Domain location=2-55; Score=-16.3; E_value=0.07; Accession=PF03017.5; Description =TNP1ENSPM transposase
MADSKLLIYEGSTTIHNVPLCSDQVKVGVEEVRDADACVPIPTKEVQLVGQTLNTFLAWPTHLLQPFSEQGLEGPLKPVDRSDLDVDPLYLMTLTIA

SEQ ID NO: 128903 - protein, 49 aa, Glycine max
  Coding DNA Sequence Number=SeqID_12125
MPTYLSEKVFLNFFEFLEVKEKTIATRRSEIKTIIFPSANRRDFDDEQS

SEQ ID NO: 128904 - protein, 315 aa, Glycine max
  Coding DNA Sequence Number=SeqID_12126
  Homolog annotation: Hit_ID=Q6Q2Z9; Match level="QueryCoverage=9%, HitCoverage=2%, E-value=2e-07, Identity=100%"; Hit description =Phosphoenolpyruvate carboxylase
ASDVLAVELLQKDARLAAIGELGKACPGGAYVWTLGGTCISRTVFISTTSLKVDIQRRCLPQQRLRMPTFKDGVEVDWMDLLDPCSNDSQDGTSNLGPNCERSCPLAVAHRNNPGLHSKIHQGTGGMQKSLPFLQLHLLASPTSEKDNKLSCMASSETPAIFADLHSIGHGRGCPKSAESGNVDMRYWPLWPCNTSKELRCGGARVVLKGHLRRSVFAMIVSPKVYTAAPPSVLMITMMTIKDDDKGDEQKAQRSKNNSSESRTSQEFKNQEEFKTQEESLESRIKIQDSRSQESRSRFKTQDSRMKKRLNQDKY

SEQ ID NO: 128905 - protein, 68 aa, Glycine max
  Coding DNA Sequence Number=SeqID_12127
MQQAIWLRKEQDCRYNQIQRGAPQSPLTSETMLARLREYARERLNLPAYKDGRYKTRRWVIQFNDDAY

SEQ ID NO: 128906 - protein, 79 aa, Glycine max
  Coding DNA Sequence Number=SeqID_12128
MADGKLIEMKGRVNLGIQFGQFWMRARVISKICTYMQNFAVKKMLMHGWLWKGLYILGSGRFLADPNGPNVDLCTRDLQ

SEQ ID NO: 128907 - protein, 99 aa, Glycine max
  Coding DNA Sequence Number=SeqID_12129
MVKVGDLRLLLLTNKQNKRCRKPMELQGCRGSEEGGRGGVVEQNKRKKKPKLSSDVSAQGMRSFDVLVKDAENTQGEGQKGHSRQFFGPWLAQATLWLA

SEQ ID NO: 128908 - protein, 101 aa, Glycine max
  Coding DNA Sequence Number=SeqID_12130
MELIEILESAEVPVSLSLVHALSEIHPLSGTSARLASKRNLGENLPRQHVLSASPSNPTIFLSLLALSAPGSLSQNLHTHAKHESGAKRTFEDIKPFLSMK

SEQ ID NO: 128909 - protein, 291 aa, Glycine max
  Coding DNA Sequence Number=SeqID_12131
  Gene Ontology: Mol. function=RNA-directed DNA polymerase activity; Cellular component=intracellular; Biological process=RNA-dependent DNA replication
  Homolog annotation: Hit_ID=Q1SYR3; Match level="QueryCoverage=72%, HitCoverage=10%, E-value=1e-43, Identity=42%"; Hit description=RNase H, putative
GSKSSLLELLLSSEPHRVLLVKVLNKAHVAQDISVEGFESIVNNITANNYLTFVEEEIPVEGRGHNRALHVSVKCMNHIVAKVLINNGSSLNVMLKSTLDKLPFNAAHLRPSSMITFQVMDINPAYSCLLGRPWIHLVGVVPLTLHQKLKFVVEGRLVIVLGEEDILVSCPSSMPYVEATEESLEMAFQSYEVVSNASVESLPVRLHINGVDILVEFKENHRRFGLGYKPMRADVRKRALERKSKSMGQQQGSQVKTTPSCHISGNFVSAGWRYGGQVTMIHDEAPQEHSD

SEQ ID NO: 128910 - protein, 99 aa, Glycine max
  Coding DNA Sequence Number=SeqID_12132
MDKFDIFVPHPLVITSLLPLESGCKPLRECDTPSPSEDYTSSPSKVYMSSPSEDYTFSPSEDYTSSPLEVCTSSPSEDYTSSSSEGYTPRLQRIIHPRL

SEQ ID NO: 128911 - protein, 70 aa, Glycine max
  Coding DNA Sequence Number=SeqID_12133
MPKSSPNMHVKQEVSTRVKPRLLCKQSMGQNTLNTIDDNGSNSHQGEKQGFNSQNAKKLLFQKQLPFTCT

SEQ ID NO: 128912 - protein, 56 aa, Glycine max
  Coding DNA Sequence Number=SeqID_12134
METETKTSIAPISTSVHSEELAECNAVTVKFKYSVLLMFRKGWWMETVENKMDTII

SEQ ID NO: 128913 - protein, 73 aa, Glycine max
  Coding DNA Sequence Number=SeqID_12135
MVINEESMHRITRNHNSYPSQHIRKPYGEIHLKAQPSSTPGNLISIIRFLTIHESKLNEKQISVFMGMKRLYL

SEQ ID NO: 128914 - protein, 219 aa, Glycine max
  Coding DNA Sequence Number=SeqID_12136
  Gene Ontology: Mol. function=protein serine/threonine kinase activity; Biological process=protein amino acid phosphorylation
  Homolog annotation: Hit_ID=O81637; Match level="QueryCoverage=66%, HitCoverage=21%, E-value=1e-22, Identity=46%"; Hit description =Mitogen activated protein kinase kinase
MECFEFKSMGGAVVNVRNRFFITALAGNLLLGQQIKHYDHNRTIEAKLLHIYDPPVGKKPEALYKVDNTEVRQFVEKCLATVSLKLSARDLLDDPFLQIYDYGFDSKVVQYQRHFYEVNPLIRQPLNGIYSINNKLISGDTDNVGGYGPVSELDYHRDDFEASEIGLFGCEEDDNLVEVDTTIKGRREDDGIFLTLRIADKEDFNKERNKKGGQGQHKY

SEQ ID NO: 128915 - protein, 112 aa, Glycine max
  Coding DNA Sequence Number=SeqID_12137
  Gene Ontology: Mol. function=ubiquitin-protein ligase activity; Cellular component=ubiquitin ligase complex; Biological process =protein amino acid phosphorylation
  Homolog annotation: Hit_ID=Q2HTK4; Match level="QueryCoverage=72%, HitCoverage=12%, E-value=2e-14, Identity=46%"; Hit description =Protein kinase; U box
MGISAEQERIELANNSMYLHSFQVKPSETLYTDELNLTKIAEENIRKEKEELENMKSFRDKELEQKILSPVGLLQSYKNERDELQMQHENALREAEELRKKQGEAIQFKLCK

SEQ ID NO: 128916 - protein, 87 aa, Glycine max
  Coding DNA Sequence Number=SeqID_12138
MRKFGDDKSWIQLINFSYLHLNIRPNEEKSMILPLCMSNNGDFFMMKFTRNADDEYQTILYNQRDGSFRTLLWRNLKIFTKSLVIPY

SEQ ID NO: 128917 - protein, 104 aa, Glycine max
  Coding DNA Sequence Number=SeqID_12139
  Subcellular localization annotation: CTP_CleavageSite=68; ConfidenceScore=5.41e-01
MEAQTRTPQTRTRQCGCSHGSAAQFATNTNSGRRRNNKNALGLPFPGLFPFLLFFDLRNGKDDLHNVVAVTEAQTSLTQRRSQAEGERRRTIGFKRAGCAISEV

SEQ ID NO: 128918 - protein, 159 aa, Glycine max
  Coding DNA Sequence Number=SeqID_12140
MASDTHARAYHFGESSTCHPQQVTCAHEHPDKPPLRRLYKTQDKHVPGPMLDKPKEYRLIKNPRYALGNHISKTQGWPLIPKPKVRPWYTCLQNPRSTLGTYFYKTQDALLVRSHAAAMTTTIKGLSSTKQTITPLFGKTFNQLEAHTHSSQPSKEYFG

SEQ ID NO: 128919 - protein, 490 aa, Glycine max
  Coding DNA Sequence Number=SeqID_12141
  Gene Ontology: Mol. function=serine carboxypeptidase activity; Cellular component=cellulose and pectin-containing cell wall; Biological process=proteolysis
  Homolog annotation: Hit_ID=Q6W6R6; Match level="QueryCoverage=98%, HitCoverage=99%, E-value=0.0, Identity=74%"; Hit description =Putative serine carboxypeptidase
  Pfam annotation: Domain name=Peptidase_S10; Domain location=78-479; Score=702.7; E_value=2.6e-208; Accession=PF00450.12; Description =Serine carboxypeptidase
MKKLSLHACFLNLSLLVLLPYSKASQADKLEELILSRSSQKPPVTLSWAEEDALKTHSSAYVASQEGQKQADKIAALPGQPYGVNFDQYSGYVTVDPKAGRALFYYFVESPYNPSTKPLVLWLNGGPGCSSLGYGAFEELGPFRINSDGKTLYRNKYAWNEVANVLFLESPAGVGFSYSNTTSDYDHSGDKPTAKDAYVFLINWLERFPEYKTRNFYITGESYAGHYVPQLAYTILVNNKFSQQNINLKGIAIGNAWIDDVTGTKGIVDYLWTHALNSDQTHELIEKYCDYSSENISQICSNATRRALTEKGNIDFYNIYAPLCHDSSLKNESSSGSVYDFDPCSDYYGEAYLNRPEVQLALHAKPTNWSHCSDLIDWNDSPTTILPVIKYLTDSNIVLWIYSGDTDARVPVTSSRYAINTLKLPIQVPWRPWYSGNEVGGYVVKYKGVTFVTVRGAGHLVPSWQPARALTLIFSFLYGSLPPASPWKGY

SEQ ID NO: 128920 - protein, 44 aa, Glycine max
  Coding DNA Sequence Number=SeqID_12142
MKCYPRSFSFIATMLPSCDADVKERKMLGGQPPGKKVEMKWSGL

SEQ ID NO: 128921 - protein, 106 aa, Glycine max
  Coding DNA Sequence Number=SeqID_12143
MVNNIFTLSRYKENMVQPKPSVGLKGKPHQHALTFMSSCISTNKGLGPLGLSHVLAFILIFASCPHPKMAKIPLRHFTEHLVGALLGTNNRGMGAMWLAPSFQNTT

SEQ ID NO: 128922 - protein, 303 aa, Glycine max
  Coding DNA Sequence Number=SeqID_12144
MLATGNRLLPSGNRLPESKTLEKSPKECELNTETGDDDGYDRNFIMFMPDTDIPKPNLLSNPNSSPNPASSSEVVDGLQITQMFKEPNGENHKILCDALEKKVPHHKDGSVLEIASIVLHCRSGMRKRKLNQLMERRKSRNLDVLSWCEFSSQTCFDDVQKNLLDNERHHQKGEECGLCIVLMMSKRNHLIVIIKKGENVNKNQTRPLQRISICFKITSTNKALFQDSLKIKPCLKTKGFKVMQGSGNRLLEGKNEKELLKRVLNLNFEHCTLNQLQGLDLAGFEDASASEVLFTLCAHSNRV

SEQ ID NO: 128923 - protein, 129 aa, Glycine max
  Coding DNA Sequence Number=SeqID_12145
  Gene Ontology: Mol. function=cysteine-type peptidase activity; Cellular component=cytoplasm; Biological process=proteolysis
  Pfam annotation: Domain name=Transposase_21; Domain location=63-128; Score=-130.6; E_value=0.0018; Accession=PF02992.5; Description =Transposase family tnp2
MNDIRSHLNTLLKNHYEAKKILCPMDMEYQKIHACPNDCILYRNQFAEMRKCSTCGVSQYKVKDDECSDNATTSNGCPAKIVDRLFPNFGEESRNLRLGIASDDMNPFGNLSTNYSSWPILLMIYNLPP

SEQ ID NO: 128924 - protein, 88 aa, Glycine max
  Coding DNA Sequence Number=SeqID_12146
  Gene Ontology: Mol. function=RNA-directed DNA polymerase activity; Biological process=RNA-dependent DNA replication
MDLRGRENTDSCHKYLKIGYYQICMKEDDEWKTTFKTKYGFYELLVMPFGLTNAPGTLMSSNRISADEEKVKAIREWPVPKNANEGLY

SEQ ID NO: 128925 - protein, 114 aa, Glycine max
  Coding DNA Sequence Number=SeqID_12147
MENNNGLWWLMVAVGDGESAGNFRNGFGRKKEEEMTFFLSYTKAKAELRAHSRDLLKDPNGQIVEKCLVKLQTKVREDPTVNKGWAAFLPRQLHVAFSRSFIKRLPPEASSWLL

SEQ ID NO: 128926 - protein, 115 aa, Glycine max
  Coding DNA Sequence Number=SeqID_12148
MHLVNKCVNMGPPDGNFFFYGNRDKYSLVSTTETGAWITPLPAGDEDREKNSNNEDQEWKPGISWGVGSKEYSPLPYSRPTRLTSLLVKEVQTFSVRPYLIWTALEIEYFCKFNL

SEQ ID NO: 128927 - protein, 155 aa, Glycine max
  Coding DNA Sequence Number=SeqID_12149
  Gene Ontology: Mol. function=oxidoreductase activity
  Homolog annotation: Hit_ID=Q84RC3; Match level="QueryCoverage=87%, HitCoverage=41%, E-value=5e-31, Identity=50%"; Hit description =Gibberellin 2-oxidase 1
MAHEPPFLETYKTLVQKHQGDSRNGYSSCSIVERCDIPLIDLSRLSLEREECMREIAEAAREWGFFQVVNHGISHELLKSLQIEQKKVFYQPFVNKSSTQAKAYRWGNRFATDLRQLSWSEAFHFYLTDISRMDKHETLSKNIGMQQLNFQGTKI

SEQ ID NO: 128928 - protein, 52 aa, Glycine max
  Coding DNA Sequence Number=SeqID_12150
MQSKQKDLEPEANALISMGGKHQVLKIFTLPCRFLLTYYRMMKLLSFAVGGF

SEQ ID NO: 128929 - protein, 118 aa, Glycine max
  Coding DNA Sequence Number=SeqID_12151
MHLHGEKSPLKDLIEAQRSSLHRSSTSKLPSSGIKIEWNFEVYLIRLSFIKVTTSVTHASIYRLGSYLAHGLEIYPKAHKNPRAFPWISSPIYLESSTQCPCGIGLHHVGSVCVNSQP

SEQ ID NO: 128930 - protein, 141 aa, Glycine max
  Coding DNA Sequence Number=SeqID_12152
MLSKRKTLDEGSLLSSKSETQHVHRFTSTPYFPMDPGIGPFLFNSPCVQKGVGASPVESPIVATYPSAGGQCETHGCVFHGMKLRGVAINVYSRKTSEKSEKCGLRTLSVKGSGVVLRTEKILAPHASVTRDGNLQSSVKI

SEQ ID NO: 128931 - protein, 169 aa, Glycine max
  Coding DNA Sequence Number=SeqID_12153
MAYSFASTTLIMVPTIVSTPEETLMVMTTSFIWQQIDLGIHNIMYQLSRQLAEIVKPMVQNKMHQSKELKARKAHVSNNYALFVPINLEVMNRETSPNTVLAGMFNTIQLIGNQIRACRPWIFFINGVLHFLRSMAVEWRRRKGDWRRHFKEKMSQEQAHHHRKSWIRA

SEQ ID NO: 128932 - protein, 96 aa, Glycine max
  Coding DNA Sequence Number=SeqID_12154
MDENTPECGSEPQFNHCRDVIFIAGHGIFLTVSSPQIKVDASTTSFHSASNSNHDTNRVPFQLRNVKLKFPRFYGIHALEWAYYYGTPDHERLTIE

SEQ ID NO: 128933 - protein, 48 aa, Glycine max
  Coding DNA Sequence Number=SeqID_12155
MTKARQKGVRKVNEMKIKILGTLCCTICKSRDASEVKRKQGYAIREIP

SEQ ID NO: 128934 - protein, 90 aa, Glycine max
  Coding DNA Sequence Number=SeqID_12156
GPTHIWFGDEDGPGCGQPHFSSDQLDRPVQHFQAQAYRQQDAWPGDQPSIDRGEEPSGATATEDHAVDEDLMADLAGADWGPWANLGGGN

SEQ ID NO: 128935 - protein, 135 aa, Glycine max
  Coding DNA Sequence Number=SeqID_12157
  Homolog annotation: Hit_ID=Q1M2Y1; Match level="QueryCoverage=38%, HitCoverage=23%, E-value=6e-13, Identity=71%"; Hit description=D-3 -phosphoglycerate dehydrogenase precursor
MSIYMNHMEQWRVFNVKSKTKNPCCKLDIAPSQTLRSGTKVTREVFEAGEGRLKVVGRAGVCIDSVDLQAATEFGYGGEPRITAICRCKFLIPLFYTYVKEEEYAAHLFLQCEFSYQLWIKVFGWLGVSIYGADY

SEQ ID NO: 128936 - protein, 71 aa, Glycine max
  Coding DNA Sequence Number=SeqID_12158
MMKSIQGGDPSPEPWLEDSRKIGSGMQEKALSLAAPKKNLTLRTLLLSVYFHKTKVHDHHRYQPHGTKLQG

SEQ ID NO: 128937 - protein, 737 aa, Glycine max
  Coding DNA Sequence Number=SeqID_12159
  Gene Ontology: Mol. function=nucleic acid binding; Cellular component= intracellular; Biological process=DNA integration
  Homolog annotation: Hit_ID=Q1T010; Match level="QueryCoverage=71%, HitCoverage=47%, E-value=1e-119, Identity=37%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=391-562; Score =97.9; E_value=3e-26; Accession=PF00665.16; Description=Integrase core domain
  Pfam annotation: Domain name=zf-CCHC; Domain location=171-188; Score =26.2; E_value=4.8e-05; Accession=PF00098.13; Description=Zinc knuckle
  Pfam module annotation: Pfam domain module=rve::zf-CCHC; Domain location=391-562::171-188
MEKELRQEYVLWNFLSCCCCNNSSTDVFAKFHMLFLPKSVDNAHFEKIVGAKTSSEAWKILEKGNEGAEQLKKVTGLTIVEKVLHTLNPKFDHIVVAIEESRNMEILKVEELQGSLEAHEQRLLERSAKDILERNNETQEHFRIEQDVPESSRRRGYKGYGKKKKDDRKTLKCFNCGRIGHFSSECQYPIQNQNNGRQGNEANMTKEADSKDDVLLLMMNDMKGSGGSEIWYLDSGCSNNMTSHREWLIHFDKSRKSQIRFADNRIIQAEGTGDILIRRKDGNKAMIKDVLYVPAMKSNLISIGQLIEKSFSMNLHQGILELYDPKHRKVLKTPLSANRAFQVTIGTLKSQCLSVESKMNDSWIWHMRYGHLNFKDLSMLHTKNLVNGLPQIKNPQAIYVCGPFEVSSLGGNKYFVSFVDEFSKKLWTYDYPLKAKSEVFDTFKVFKILEEKQSGKSLKIIRTDDGGEFTSKEFENFCRDNGILHEIIALYTPQHNGVAERRNRTIMNMVRSMIKGTNLPPSFWAEKTISSTSQGLWNLMLHYVPDQKRRKLDDKSEADAILPRKGPVTRAMSKRLQEDWARAAEEGPRTHLLLEVASPLSLPFSISLSFIFQEAKESIDEEDPRPTSSNGASIRSHDFYWLSPYRDNQKEQAIVSVQMPMENSVRHQDEPIPYGEGNAEQITERIRSGRMRSMLARLRDYHMFPNSAITDEGVFVNIALMAATKPIKFQDAVKEKV

SEQ ID NO: 128938 - protein, 58 aa, Glycine max
  Coding DNA Sequence Number=SeqID_12160
MSLKSNNRQQSGSRGEIRTRISKGLEWAIEANQCTYITCNPTPTKDAQSTAESGGPNY

SEQ ID NO: 128939 - protein, 72 aa, Glycine max
  Coding DNA Sequence Number=SeqID_12161
MTLPTSRPLLSCRRGIMDRIVRIDVEMSNAHAATVAQNTNVAASSIDVGLLTKLKGMEAMSALFFPSQMIWH

SEQ ID NO: 128940 - protein, 394 aa, Glycine max
  Coding DNA Sequence Number=SeqID_12162
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=99%, HitCoverage=36%, E-value=1e-114, Identity=45%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MNEEIRAIERNKTWDLVTLPIGKTPIAVKWVYKTKLKPDGNIASRLVVKGFMQKEGEDYSEIFALVARFETVRLLVSLANWKNCKILQLDVKSAFLNGPLDEEVYIQQLPGYEVIGSEDKHGIYVKATKDGGVLLICLYVDDLLIIGSNPAEIEKLKGNLKSEFEMSDLGLLSYFLGIEFAETKDGIVMHQKKYIKEVLKRFSMDQCHKVDTPVEGNLKLDTDDHEASVDATLFRQLVECLRFVCHSRPEISYGVGLKEKGELYLIAYSDSDWCGDKVERRSTSGYVFLLCAEYISACSAACQALWILSLISKLNLKTSDFMELQVDNKFVIDLARNHVSHGHSKHIETKFHFLRDQVKKGKIRLKHCGTDLQLADIMTKVLKADKFKLLRNML

SEQ ID NO: 128941 - protein, 73 aa, Glycine max
  Coding DNA Sequence Number=SeqID_12163
MENKESKKAWMEKKTERRRRQREGDETYLCMVAKEKKQRLVTMLECNDDDARVRRTRCLDADRDGFARRRLEE

SEQ ID NO: 128942 - protein, 68 aa, Glycine max
  Coding DNA Sequence Number=SeqID_12164
MTKLYILLLELCEDKERKYSTSSLRLNKLLHQKKGTPTPSPKPVRDRGSNTSNMVNKLRLKLEAQGKA

SEQ ID NO: 128943 - protein, 61 aa, Glycine max
  Coding DNA Sequence Number=SeqID_12165
MVKMVKKGFFDGSSLKVEKFFEISEGYAPRKTLAALMIRNLDWTAWERIQNTVGVGCRVVE

SEQ ID NO: 128944 - protein, 589 aa, Glycine max
  Coding DNA Sequence Number=SeqID_12166
  Gene Ontology: Mol. function=protein binding; Cellular component=DNA replication preinitiation complex; Biological process=regulation of progression through cell cycle
  Homolog annotation: Hit_ID=Q9LSG6; Match level="QueryCoverage=99%, HitCoverage=99%, E-value=0.0, Identity=63%"; Hit description=CDC45 (Cell division cycle 45)-like protein
  Pfam annotation: Domain name=CDC45; Domain location=24-589; Score =296.7; E_value=4.5e-86; Accession=PF02724.5; Description=CDC45-like protein
MREQNVESFYAKLRESALSSSSSPVLIFPSTSDVDSLCALKIIFHILESDSIQYACYPVSSFHEIHKYTSSSSSNDEPLSVVLVNWGNHRDLSKTLNLAPNARVFVVDSHRPIHLRNLSDQNDAVLVLFTKDDENQSDLASDFNLATLANAAPTVDSDSQSDSESESDSDSDSGSERNGSRKRRKKNPEDDDEDPIKLYRKLKKGYYRLGTFHGKPSGCLMYELADKLRKNTNELLWLACISLTDQFLHDRLSDERYHDGVMELEQHINSSGNLDVVTLVTLKDGTKIRAPNLSRITYEDQPRLMLLQEWSLFDSMMCSSYIATKLKTWSENGMKKLKLLFGTMGFALGDCQQKFQHMNVEVKRNMKKEFERFLPEYGLTDFYYRSFIRTLKYSSKISAADVVYGVTALLESFVRSDGSCASKQFGVAYDALSLNNIDNLRTGMQHAIKIQRAILRQGSAAITKIGCIRSGRSFRWLKLEDSNDAMLLGYPQALTKFCLFIMDALREKGAKMKPLICVCVSQEPGKVLIVGVCGRPRLGGAQANAFGIAFRTAAEEIGTEFFHELFESSWIVLDASAVNSFMVRLTKKL

SEQ ID NO: 128945 - protein, 191 aa, Glycine max
  Coding DNA Sequence Number=SeqID_12167
MGKVQFYQLVSELQSRSFGTVNGDEGECENGDTHGSHGEGERGESRLSSIEGMTQRLAAAWEKQSLESSVHADDSIGGNKGNATHGDNWWKTLEMPIFKGEDSMGWLTKIESSRVVPIPNHSWEGFKITISQRFQPFKLGNPFRALLVLKQEETMQEFMGHFEKHVEMVKGLEESFSGGGVSQGAKKRDQH

SEQ ID NO: 128946 - protein, 77 aa, Glycine max
  Coding DNA Sequence Number=SeqID_12168
MGAKYLEAVKQRLHAIKEWSPDEIREPIGKITKKPYFPLTGGSVLDNGGCMNSARTHEWQSIHGAPDLMVEDARTAL

SEQ ID NO: 128947 - protein, 182 aa, Glycine max
  Coding DNA Sequence Number=SeqID_12169
MKALGGLDDIHYVALINKPLWEHNVYHVPSLPDNNTSTMNLKAMKVDIQRNQPIPLVDEEAIKTRRATKLVIVVHEEAKEGFLAREARTKTRHEKSLASNQPYLVVACPKTVEKQPKSKEHVLTSEVPRRRKNRATCLNKAFTKKEIAPPLLDGSSAFENEAAPSPQQPSTPLESKKRPLAF

SEQ ID NO: 128948 - protein, 203 aa, Glycine max
  Coding DNA Sequence Number=SeqID_12170
MSGIATNDYLKENVRKTKRGLRILERRVRELFTHREVDKGVALAPTYPQTSKRSDVGNDPRLRFGGASASLFPSSLPFLTFLLLSQTFRTFCPFPFIAIYRKKPFGVGEARLGELELAQVSQLLRSEGISSPRRAGYLRLKTFDGPGEPDASLGELGPRKFHKMTTLSISLCFSFLDPTINLSDPSSLCCNQCQTIKAFPGRN

SEQ ID NO: 128949 - protein, 69 aa, Glycine max
  Coding DNA Sequence Number=SeqID_12171
MFLLHLLLLYNNFFLLLLLMGRLFGLDLSLLLPKDPFNLYSKAKSFQSLVFISNSLGHKQCKLTFSNHY

SEQ ID NO: 128950 - protein, 161 aa, Glycine max
  Coding DNA Sequence Number=SeqID_12172
MWTTTGEKLAAQLTQASKVASSKKQQPSGGRIWKAQVGLIAISFEEVTKTHGLRKTPPFDFRHLTEFSRIAVPSISKRPIKGCISSNNNPQTKLGYDNKLQRLRQGSMSAEEYRQQMELLLLRSGLREEKRTSIARFLSGLNMEVRDKVELLPYRDLDELV

SEQ ID NO: 128951 - protein, 131 aa, Glycine max
  Coding DNA Sequence Number=SeqID_12173
  Subcellular localization annotation: CTP_CleavageSite=26; ConfidenceScore=5.02e-01
MAMTMVLSPPTIVVPTPTTNQGRYLLLTNRWSQHRGFRSGACQRLYGSLHHHRKHSSSSSDLPAWFLSNETSIHSYHKKGKSIQCSDHQEKGVWCLTYAHMSRSSRKGLLNGNLMAPKATRSNIAQIGRIH

SEQ ID NO: 128952 - protein, 114 aa, Glycine max
  Coding DNA Sequence Number=SeqID_12174
  Gene Ontology: Mol. function=protein binding
  Homolog annotation: Hit_ID=O49527; Match level="QueryCoverage=73%, HitCoverage=10%, E-value=5e-22, Identity=57%"; Hit description =Pollen-specific protein - like
  Pfam annotation: Domain name=Rep_fac-A_3; Domain location=1-89; Score= 67.9; E_value=3.3e-17; Accession=PF08661.1; Description=Replication factor A protein 3
MDTSNPAVFVNAQLIPNFIGKKVRTVVQVSQCDGGVATAKSTDDCQLTIKGLPQVPLMNYIEVIGIAESNNSIDAEIWTDFGSTFGTMFLSIWYPQRSRAHVLCRNCSIISDVS

SEQ ID NO: 128953 - protein, 348 aa, Glycine max
  Coding DNA Sequence Number=SeqID_12175
  Gene Ontology: Mol. function=ribonuclease H activity; Cellular component=nucleus; Biological process=RNA metabolic process
  Homolog annotation: Hit_ID=Q53QG3; Match level="QueryCoverage=86%, HitCoverage=94%, E-value=1e-114, Identity=69%"; Hit description =Ribonuclease HII, putative
  Pfam annotation: Domain name=RNase_HII; Domain location=16-226; Score= 225.3; E_value=1.3e-64; Accession=PF01351.8; Description=Ribonuclease HII
MGSKILPKWASKPCVMGIDEAGRGPVLGPMVYGCLYCSQSYLKTLSTLSFADSKTLKEEKREELFETLKLNDSIGWDVDVIDPRELSAKMLKKNKINLNEISHSSAMGLIDRVLKMGVLLTEVYIDTVGDAGKYEMKLSNSFPSIKFVVAKKADSLYPVVSGASIVAKVTRDRALREWVLDETAENMQRNFGSGYPGDPQTKSWLEDHKHHIFGFPSLVRFSWGTCNSYFKDAAEVLWATHPGYGPSPLSLIYCVYVPRESDNLDEDGGGSNNKNGKRQLKLSNVGFTTSKRSEEIESSGKGRSQPDKILGCLNGVVELLSVSRFGSEPGERDTSSLQQACTRHLLAL

SEQ ID NO: 128954 - protein, 133 aa, Glycine max
  Coding DNA Sequence Number=SeqID_12176
  Homolog annotation: Hit_ID=Q1T2D5; Match level="QueryCoverage=99%, HitCoverage=9%, E-value=3e-16, Identity=37%"; Hit description=Chromo
MADNTRMKEIYAELKKDADAITRVSEDFHRQIERLEGANHAHMERMEAIQIANESQITQLNSAMTQILQRLQSIPVSPHGASNSNKEQTRTPFQVRSVKLDFPRFDGNNVMDWIFKAEQFSITMLLLMLIDYS

SEQ ID NO: 128955 - protein, 216 aa, Glycine max
  Coding DNA Sequence Number=SeqID_12177
  Gene Ontology: Mol. function=amino acid binding; Cellular component =chloroplast thylakoid membrane; Biological process=metabolic process
  Homolog annotation: Hit_ID=Q2QXL3; Match level="QueryCoverage=68%, HitCoverage=53%, E-value=1e-61, Identity=78%"; Hit description=ACT domain-containing protein, putative, expressed
  Pfam annotation: Domain name=ACT; Domain location=138-195; Score =23.3; E_value=0.00087; Accession=PF01842.15; Description=ACT domain
MDCPMFLSILVLEKNIPQVQSLERFPGASRVLFSPTLARADLNRAYKARAVLICKLSLLVFTDLFDVHIVRDTGRKVEDPDMLERIRLTIINNLLKYHPESSELLAMGEVFGIKAPKKKLDDDIKTRIQVKEDGPKRSLLYIETADRPGLLVEIIKVIADVNIDVESAEIDTEGLVAKDTFHVSYGGAALNSSMAQVLVNCLRYYLRTPETDIDSY

SEQ ID NO: 128956 - protein, 78 aa, Glycine max
  Coding DNA Sequence Number=SeqID_12178
MGLHLSNLGGCTHQIGVRSRNLITKQPRGGCTHQIGGCAQEALSLSNLEGGCIHQIGGCTQKTSLRSLWAATTSIFLL

SEQ ID NO: 128957 - protein, 1322 aa, Glycine max
  Coding DNA Sequence Number=SeqID_12179
  Gene Ontology: Mol. function=binding; Cellular component=microtubule; Biological process=beta-tubulin folding
  Homolog annotation: Hit_ID=Q8L5R3; Match level="QueryCoverage=93%, HitCoverage=99%, E-value=0.0, Identity=62%"; Hit description=Tubulin folding cofactor D
  Pfam annotation: Domain name=HEAT; Domain location=1021-1057; Score =5.2; E_value=9.9; Accession=PF02985.12; Description=HEAT repeat
  Pfam annotation: Domain name=HEAT; Domain location=1206-1242; Score =4.3; E_value=13; Accession=PF02985.12; Description=HEAT repeat
  Pfam annotation: Domain name=HEAT; Domain location=462-497; Score =26.2; E_value=0.00012; Accession=PF02985.12; Description=HEAT repeat
  Pfam annotation: Domain name=HEAT; Domain location=590-624; Score =1.9; E_value=25; Accession=PF02985.12; Description=HEAT repeat
  Pfam annotation: Domain name=HEAT; Domain location=702-738; Score =1.8; E_value=26; Accession=PF02985.12; Description=HEAT repeat
  Pfam annotation: Domain name=HEAT; Domain location=794-830; Score =19.6; E_value=0.011; Accession=PF02985.12; Description=HEAT repeat
  Pfam annotation: Domain name=HEAT; Domain location=837-872; Score =12.4; E_value=1.3; Accession=PF02985.12; Description=HEAT repeat
  Pfam module annotation: Pfam domain module=HEAT::HEAT::HEAT::HEAT::HEA T::HEAT::HEAT; Domain location=1021-1057::1206-1242::462-497::590 -624::702-738::794-830::837-872
MAGHQVAASEATVASHRHRDPHGLGWEATVGGFAEKYWKVDGWLLQSELELENPTISVVLFSWKLAFQIPPKSLWTPEVTMEANQATVTMNQEDDELESKESVLQKYFLQEWNIVKSLLHDIVSKSRVSDPSSVHRLRSILDKYQEQGQLLEPYLETIVSPLMNIIRSRTLELGVASDEVLEIIKPICIIVYTLVTVCGYKSVIKFFPHQVSDLELAVSLLEKCHNTNSVTSLRQESTGEMEAKCVTLLWLYILVLVPFDISSVDTSIANNDNLTEFELSPLVLRIIGFSKDYLSTAGPMRTMAGLVLSRLLTRPDMPKAFTSFVEWTHTVMSSVTEDLLHHFQLLGVVEALAAIFKAGSQNLLLDSIPVVWNDASMLYKSLDASRSPLLRKYLMKLTQRIGLTALPHRLPAWRYMGRVAKLNVSLNTSNKIDQSNLGVNSNDSNSNEMSDREEDEDMDVPENVEEIIEMLLSGLRDMDTVVRWSAAKGIGRISSHLTSSFSEEVLSSVLELFSPGEGDGSWHGGCLALAELARRGLLLPASLPKVVPFIVKALHYDVRRGPHSVGSHVRDAAAYVCWAFGRAYYHTDMRSILKEFAPHLLTVACYDREVNCRRAAAAAFQENVGRQGNYPHGIDIVNTADYFSLSSRVNSYLHVAVSIAQYEGYLFPFVDDLLDRKICHWEKSLRELAAEALSFLVKYDPQYFASTVMEKLIPCTLSSDLCMRHGATLATGELVLALHQCNFALPSDKQKSLAGVVPAIEKARLYRGKGGEIMRAAVSRFIECISIYKVVLSEKIKKNLLDTLNENLRHPNSQIQNAAVKGLKHFIRAYLHASDNKGMSDVIAKYLSMLTDPNVAVRRGSALAIGVLPYELLASQWRNVLLQLCGSCKIEENPENRDAEVRVNAVKGLTLACETLINGREDTATAFVEDDFSLFILIKNEVMMSLFKALDDYSVDNRGDVGSWVREAALDGLEKCTYMLCKIDKSVCLSGRSDGNEIEPIAHPSIDSMLKNNQELSLFDENLATNLVGGICKQAVEKMDKLREAAANVLYRILYNQIIHIPYIPFREKLEEIIPKEANAQWGVSLYRSFISLRDVLSGLVISIGGLQDSLKRVSLSALLEYLEEVESEDPNTRTSRLYMLSADILWVLQQYKKSDRVIVPTLKAHTPAFCGAVLDSVSFEVKGSKDFSKLYAGIAILGYVAAVQEPINMRAFSQLLNFLGHRYPKIRKASAEQLYLVLLENGNLVAEDKIDKALEIISETCWDGDMDSAKHQRLKLYEIVGLEVGSLGNNSDGTSRKTSSKKPANLDENASYSSLVESSGF

SEQ ID NO: 128958 - protein, 114 aa, Glycine max
  Coding DNA Sequence Number=SeqID_12180
  Gene Ontology: Mol. function=chromatin binding; Cellular component =chromatin; Biological process=chromatin assembly or disassembly
  Homolog annotation: Hit_ID=Q1T2D5; Match level="QueryCoverage=94%, HitCoverage=6%, E-value=3e-13, Identity=38%"; Hit description=Chromo
  Pfam annotation: Domain name=Chromo; Domain location=5-59; Score =44.1; E_value=4.9e-10; Accession=PF00385.14; Description='chromo' (CHRromatin Organisation MOdifier
MGPVMQPVRILANRKLLRGTTQIDQILVQWENGVQEEATWEDIEDIKASYPTFNLEDKVDSKGEGNVTASGARAGHESKDDESRIVEGRNNKLPDDAELGRGKRVRRPSWKLTE

SEQ ID NO: 128959 - protein, 77 aa, Glycine max
  Coding DNA Sequence Number=SeqID_12181
MEASSLRVFKAGEIWSIPNQALVLIERPQPPPPSQDLAKHELKAAYEFEKGALKRWLEEVDTQTLPEHQKRNRKIDQ

SEQ ID NO: 128960 - protein, 111 aa, Glycine max
  Coding DNA Sequence Number=SeqID_12182
MEVNEKMRKVECFTCEEKYNPAHVRKNKQSRLMIMEEEEGDPKKNQWEDREEEKIKVILKAEPKLIKAAINMKMIRGTKLESDKGFMVELKTIEGENSEEAILDLVVQVLK

SEQ ID NO: 128961 - protein, 70 aa, Glycine max
  Coding DNA Sequence Number=SeqID_12183
MPPAVPLPASHCHCPYGCLASSASDAGGWTHHPLWWFPSYCIIWRLAYAYALYTPCWISDLLGGVSLTCE

SEQ ID NO: 128962 - protein, 231 aa, Glycine max
  Coding DNA Sequence Number=SeqID_12184
  Gene Ontology: Mol. function=histone-lysine N-methyltransferase activity; Cellular component=nucleus; Biological process=chromatin modification
  Homolog annotation: Hit_ID=Q9LHS8; Match level="QueryCoverage=89%, HitCoverage=93%, E-value=8e-42, Identity=46%"; Hit description=LOB domain-containing protein 33
  Pfam annotation: Domain name=DUF260; Domain location=18-119; Score =205.6; E_value=1.1e-58; Accession=PF03195.5; Description=Protein of unknown function DUF260
  Subcellular localization annotation: CTP_CleavageSite=38; ConfidenceScore=5.09e-01
MSIKSVKNFGTTTGFGSSCGACKFLRRKCTSDCVFAPYFSYDQASTHFAAVHKIYGASNVSKLLSHLPIHNRSDAAITISYEALARMQDPIYGCVAHIYALQHQVASLQEEIDALGSLMANSTVSVVNCGSDQEPMTSNNGTQYNILQHDATRTQYCQNNLANFLSQEAISATVFKSLDSQMDIELPSAHVEEPSSFGDFNSNPLEQFLSGIDQEVFVNHPWFKHNADIKN

SEQ ID NO: 128963 - protein, 75 aa, Glycine max
  Coding DNA Sequence Number=SeqID_12185
MKCDISWVKHGVKENVCYGCIPLRGALGIVKELGYISRVNMLWKLAPMWWVLRSFGDALNELVEDNDALEMPNYA

SEQ ID NO: 128964 - protein, 92 aa, Glycine max
  Coding DNA Sequence Number=SeqID_12186
  Gene Ontology: Mol. function=DNA binding; Cellular component=nucleus; Biological process=regulation of transcription
  Homolog annotation: Hit_ID=Q8GW75; Match level="QueryCoverage=72%, HitCoverage=67%, E-value=3e-22, Identity=70%"; Hit description =Putative myb-related protein
  Pfam annotation: Domain name=Myb_DNA-binding; Domain location=13-62; Score=28.9; E_value=1.7e-05; Accession=PF00249.21; Description=Myb -like DNA-binding domain
MASNSHNNNKENSSSWTRMQNKQFESALALYDQDTPDRWQNIAKVVGDKSAEEVKRHYEILLEDLSHIESGRVPIPSYKSTDNNEERIEEEN

SEQ ID NO: 128965 - protein, 80 aa, Glycine max
  Coding DNA Sequence Number=SeqID_12187
MENNDDLWWLMVALREHSRNLLKDPNGQIVDKCLVKPQTKFREDPTVNEGWEMLLSRQLHVASSRSFIKRLPQEASPWLL

SEQ ID NO: 128966 - protein, 65 aa, Glycine max
  Coding DNA Sequence Number=SeqID_12188
  Subcellular localization annotation: CTP_CleavageSite=48; ConfidenceScore=5.05e-01
AWMLDKEIGNRNQMGICSQQKTPFRTKISTRRLGTRRLQRVVLQWLTTIKELWRLEDYPKKVILK

SEQ ID NO: 128967 - protein, 658 aa, Glycine max
  Coding DNA Sequence Number=SeqID_12189
  Homolog annotation: Hit_ID=Q9FMQ6; Match level="QueryCoverage=90%, HitCoverage=47%, E-value=4e-78, Identity=36%"; Hit description =Arabidopsis thaliana genomic DNA, chromosome 5, P1 clone:MWD9
MAGNTRFDLIAAKSDELAFKGSFTNGQRGNLMNDTLDRSASFREGNEGQMFISGANMSRGNSTSAGDLASVAQCLMLDPITMGDQKYTRSGELRRVLGISFGNTLEDYAFGTANLKPPPPVAMEELKRFKASVQEASVRARYRSKRLDESLDKLNKCWEAVSIKKQLRNDLVPNERLGGSNFSKMGTQTHRSPSEFVNQRPEDRPKNVILNKRIRTSVAETRAEGLSNSFARQPLPMGKDRDNIKDGSRGCDIVEEKIRRLPAGGETWDRKMKRKRSVGTVVARSIDGEGEQKKVMHLRLANESGSQGSDAQGLRSGYSGSNSKLDGASLPATSNACTTGNNEQEKVSRGSVDGSNKERVVLKGNKLNVRDNNYTGGIHTLTKGKVSRPPRTGALMAGNSSSVPRSSEILDAEEQPSNVNKPHSVSGTINRKRPLPVGSSSSPMAQWVGQRPQKISRTRRANVVSPVLSSDEVHTLLEGCSPSDVSTRMTSATTSGLPISNGAINGGIHPGKMKHESVSSPTKLSESEESGAGENGESKLEKGLESNEVDGRAINNSHNTSSSMLTSKKKKIPNKEEVGDGLRRQGRGSRGSSVLKNGISPMKEKLETPTLMKPIKNMKPASEKNGSKSGRPPLKKSCDRKAINCIGHPSTHNSPDIA

SEQ ID NO: 128968 - protein, 135 aa, Glycine max
  Coding DNA Sequence Number=SeqID_12190
  Pfam annotation: Domain name=DUF1677; Domain location=35-100; Score= -3.6; E_value=4.3e-06; Accession=PF07911.4; Description=Protein of unknown function (DUF1677)
MSAPMIIDPMVISAPETQSAAASILVAQSELEFGAVKDEIVRFDKLVCIEEAMAKHMNLTNKLKASRPPPNPALHLISAMRQILRRTLDSPKLKRTWDDAAPVVELCKVSKFDRGVQLTLFVFKLIKLVQCTNAE

SEQ ID NO: 128969 - protein, 266 aa, Glycine max
  Coding DNA Sequence Number=SeqID_12191
  Gene Ontology: Cellular component=membrane; Biological process =hypersensitive response
  Homolog annotation: Hit_ID=Q8GYN5; Match level="QueryCoverage=91%, HitCoverage=100%, E-value=1e-34, Identity=42%"; Hit description=RPM1- interacting protein 4
  Pfam annotation: Domain name=NOI; Domain location=192-261; Score =55.3; E_value=2.1e-13; Accession=PF05627.2; Description=Nitrate -induced NOI protein
MDEKQLFYHFRFKVKQIPVYYMQRSNVPMLGKSEENVSDTAHSDKAQKGQPGSKMINPNDTKENSDVVSSAGLPHSKPRVHSEDPSGKGSVRSIHELQMSREDGDPKQFTDSPARHGGSDSAYRGHGVGSADNRKRPSRQSTGSEHSIDRSPLHRQAKTPGRDSPSWEGKNSYDSSHGTPGRSRLRPPNRGDETPDKGAAVPKFGEWDESNPASADGYTHIFNKVREEKQVGAGHVPVTPNGRQYAARNQPADDKAQSCCFCWGKK

SEQ ID NO: 128970 - protein, 135 aa, Glycine max
  Coding DNA Sequence Number=SeqID_12192
MWKLQQVGKMRGGVSSIQLQPLTLEASTLVKAAITVGFTLPLSCAMIFNDHNDENLKILCDALEQKPPQPKKTAKEIASIVLLSHEESKYKRLGDEFGGSYLQRFGEAVNENPHRFFFMEYLEQVDDFSKQGVKQ

SEQ ID NO: 128971 - protein, 356 aa, Glycine max
  Coding DNA Sequence Number=SeqID_12193
  Gene Ontology: Mol. function=iron-sulfur cluster binding; Cellular component=phycobilisome; Biological process=lipoate biosynthetic process
  Homolog annotation: Hit_ID=Q8LSZ8; Match level="QueryCoverage=81%, HitCoverage=76%, E-value=1e-152, Identity=87%"; Hit description =Lipoic acid synthase
  Pfam annotation: Domain name=Radical_SAM; Domain location=112-269; Score=78.2; E_value=2.6e-20; Accession=PF04055.11; Description =Radical SAM superfamily
  Subcellular localization annotation: CTP_CleavageSite=32; ConfidenceScore=5.44e-01
MIRQSLYNPPSIPFSTPSMKRHRFSPPSWRIRCDASSVSVEQKVVGPHTGRDPNVKKPEWLRQKAPQGERFQEIKESLSHLKLNTVCEEAQCPNIGECWNGGGDGIATATIMVLGDTCTRGCRFCAVKTSRNPPPPDPMEPIYTAKAIASWGVDRDDLPDGGSGHFAQTVKAMKNLKPEIMVECLTSDFRGDLKAVEILVHSGLDVFAHNIETVKRLQRIVRDPRAGYEQSLSVLKHAKHSKEGLITKTSIMLGLGETDDEVKEAMADLRAIDVDIVTFGQYLQPTPLHLTVKEYVTPEKFAFWKEYGESIGFCYVASGPLVRSSYRAGELFVKTMATPTDEVFSTFIAKEKTVKC

SEQ ID NO: 128972 - protein, 651 aa, Glycine max
  Coding DNA Sequence Number=SeqID_12194
  Homolog annotation: Hit_ID=Q9FMQ6; Match level="QueryCoverage=95%, HitCoverage=47%, E-value=4e-56, Identity=29%"; Hit description =Arabidopsis thaliana genomic DNA, chromosome 5, P1 clone:MWD9
MPVEEDDREELLAAANFASNASYIGCSSSFWKKLEPIFSPVSLEDMSYMKQLVKTTEVDLRRLSQMHGIGSDTLDRLTHTESPLSQSSISRERERIVVNQTGSKEISSMNDMVDQHLDVSILCRQMDSEVNKVVPLYQRVLTALIIDDQYDEETVEDGNMPSLCERDDSSQAACYVQDVENQSSIRMEYEFNFDKVSCNGNATFTSCTNIHDQELSVFQQMNQGSLHPETERLSMLSENGNDESMGMHGISCSSSFSRHFEQMRMEDKLLLELQSVGLYPEPVPDLADGDCEAINQDIIQLQKGLFQQVNKKRECFMKLIKAVEQDREMEQGALEQVAMDKLVELAYKKKLATRGTSAARYGLSKVSRPVALAFMKRTLARCRKFEGTGKSCFLEPLFKDVLFAAPAHDNTGSAVAANLSLTRNSQQESAPSGYFPCREHDVLGNLDHPSDQDFARTGPILNRGKKKELLLDDVGASPSLRSASTPGSSLIGGAKGKRSERDRDKDSSGRNSVSKGGRSSAKGERKTKAKSKPKTAQLSSSGNGSLSKLMVNTNSENQLACGSNEFVSGDGNRKSKVGSVSHNYNANDLSIGTEEPIDITLDSIELGVGNELDGPQDLDSWLLNIEEDGLQDDAFGLDIPMDDLSGLNMLL

SEQ ID NO: 128973 - protein, 70 aa, Glycine max
  Coding DNA Sequence Number=SeqID_12195
MMSIKFNLRLWGYNGSLPCGGLPSLFSKKLLWSHLLEWDEWKARIIETNAQQKLEVGAKMVVLVGLREPL

SEQ ID NO: 128974 - protein, 407 aa, Glycine max
  Coding DNA Sequence Number=SeqID_12196
MEAQFQPLIDWTMFPLKVEEEEAFEKDSPKGIKVLPPPKWKRLHLKASNPSSLAAQHQNVYKINYGACRQKVSYDKNTISWIFQIDSQDIDPSSDDFLSPFLSPQHVQLFTPMSKFVPLDFGHQALSPMKDDNDAMLFYYKYMYKNSRLASISDCDKEDNSYHKRMMCFLRQEGDNEFYQCLIHDTLHSEFVFNLHKYPEDAMRKAIITAWARFLAIKELLYSSNQNPWVPGQGMTAELQRKQDKLNCNVVEPHLFEVTSQPPQVVEDTLATVSISSTPLTTIALSQLGRDYGKKIIVERIETNLLIKNALKSSLKSFNNFVLYNMNLMMQQRLPPFVQHQYAPIPQPPPPTPTTIVQLHPEVLTTMVPALEAAILDDPMPALESSYVQVTLDRTKSLSPYGFDVNN

SEQ ID NO: 128975 - protein, 154 aa, Glycine max
  Coding DNA Sequence Number=SeqID_12197
  Gene Ontology: Mol. function=nutrient reservoir activity; Cellular component=apoplast; Biological process=auxin mediated signaling pathway
  Homolog annotation: Hit_ID=Q9SR72; Match level="QueryCoverage=86%, HitCoverage=68%, E-value=1e-39, Identity=54%"; Hit description =Germin-like protein subfamily 3 member 2 precursor
  Pfam annotation: Domain name=Cupin_1; Domain location=55-154; Score =43.6; E_value=6.8e-10; Accession=PF00190.13; Description=Cupin
  Pfam annotation: Domain name=Cupin_2; Domain location=77-152; Score =31.6; E_value=2.7e-06; Accession=PF07883.2; Description=Cupin domain
  Pfam module annotation: Pfam domain module=Cupin_1::Cupin_2; Domain location=55-154::77-152
MINKVAVLLVVLLFIIAALASDPDPVIDFCIAKSPDNSFSCKNSSTATVEDFTYSGIKSPGNFKQTGFSSMAVNSNVFPDFGVGGVNVPHFHPRATEVAFALEGKIYSGFVDTKNKVFAKVLEKGEVMVFPRGLVHFQMNVGDGPATILGSFDS

SEQ ID NO: 128976 - protein, 166 aa, Glycine max
  Coding DNA Sequence Number=SeqID_12198
  Subcellular localization annotation: CTP_CleavageSite=53; ConfidenceScore=5.04e-01
MHKRNNCDKDQTDNNYMVVNTGRPSSFWPDSLLAPHKWVSPARLAKQNGLSFLARPVSSWPTWPILYCPLSLLVTSRDCEGLRVRLSKSNRRREANGALACELVQPDPSLTHRACGLNGVGLNGLRVSNSNPVQLFWRTGRTSPSGLTRFGTPNKNQIEKSGTCKD

SEQ ID NO: 128977 - protein, 170 aa, Glycine max
  Coding DNA Sequence Number=SeqID_12199
  Gene Ontology: Mol. function=acyltransferase activity; Cellular component=integral to membrane; Biological process=metabolic process
  Homolog annotation: Hit_ID=Q1SYU3; Match level="QueryCoverage=100%, HitCoverage=32%, E-value=1e-65, Identity=71%"; Hit description =Phospholipid/glycerol acyltransferase
MESVVCELEGTLLNDKDAFSYFMLVSFEASGLVRFALLLTLWPMIRFLDMIGMKDASLKLMIFVAVAGVPKSELESVARAVLPKFYMDDLDMDTWRLFSNYDKRVVLTKTPKIMVERFVKEHLRADEVIGTELSFNRFGFATGFVRGDSNNTISERVANFFNNEAPTLVM

SEQ ID NO: 128978 - protein, 66 aa, Glycine max
  Coding DNA Sequence Number=SeqID_12200
MTRHEYACVKVMTNDNKEYMELLATTYHQKRKTLDEASLLSSESETQHDHRSTSTSYVSHRPGYRA

SEQ ID NO: 128979 - protein, 268 aa, Glycine max
  Coding DNA Sequence Number=SeqID_12201
  Pfam annotation: Domain name=zf-CCHC; Domain location=119-136; Score =26.8; E_value=3.8e-05; Accession=PF00098.13; Description=Zinc knuckle
MPYYALYQKKNIPTFTTLEVPSRCGTSWLLPMKGPLRNKEREVTSPSTQRPKHNFTSKESLCKALVVNDTSEEEPNDDDSDEGDDKLSLITRMMWKIKHSSRFNNSSKRSFHKKEKSPIICYQCKKLGHLKSECPDLEKSKDKKKKFFKSKKKSLVSTWEDPNDSSSDEDNEEEANQCLMVDASTSKAEPTLDAISNDKDPEPNDIVNSYGQGLMDKKVSIGQEILLKDFQDLEERDVRNYLYEEIGILRDNLGKFVGGHEAINKIIK

SEQ ID NO: 128980 - protein, 37 aa, Glycine max
  Coding DNA Sequence Number=SeqID_12202
MAFLKNRVTVPLPMDYEPSAKALVFLGLDVEAASSTE

SEQ ID NO: 128981 - protein, 51 aa, Glycine max
  Coding DNA Sequence Number=SeqID_12203
MSIILSLSAKCNKCHSCNKMSHYGHSRFRFVWNILHADPSIWSGMKRIADL

SEQ ID NO: 128982 - protein, 129 aa, Glycine max
  Coding DNA Sequence Number=SeqID_12204
  Gene Ontology: Mol. function=structural constituent of ribosome; Cellular component=ribonucleoprotein complex; Biological process =translation
  Homolog annotation: Hit_ID=P46301; Match level="QueryCoverage=71%, HitCoverage=66%, E-value=1e-26, Identity=72%"; Hit description=40S ribosomal protein S25
  Pfam annotation: Domain name=Ribosomal_S25; Domain location=1-127; Score=227.5; E_value=2.9e-65; Accession=PF03297.5; Description=S25 ribosomal protein
MAPKKDKAPPPSSKPAKSGGGKQKKKKWSKGKQKEKVNNMVLFDQGTYDKLLSEAPKYKLITPSILSDRLRGQKVLCIWLGFKSWHLVGHIHINGSLARKAIRELMARGSIRMVSAHASQQIYTRATNT

SEQ ID NO: 128983 - protein, 290 aa, Glycine max
  Coding DNA Sequence Number=SeqID_12205
  Homolog annotation: Hit_ID=Q1S065; Match level="QueryCoverage=98%, HitCoverage=97%, E-value=8e-67, Identity=51%"; Hit description =Arabidopsis conserved protein
  Pfam annotation: Domain name=DUF241; Domain location=47-287; Score =125.0; E_value=2.1e-34; Accession=PF03087.5; Description=Arabidopsis protein of unknown function
MAANMKTSLHNRSNSVPSAPHPFISQYEEQLHRLKASEATSSSSISSKFDGLHALHEYTDKILQLPTIQQALAKESCKTQVDELLEGSLRLLDICRATKGVLLQSTESRNGLQLSVRRRGGEAAFKVEGGKYMPSRKKAKKTIQKALEKIKEFKKGLILTSSNTDNETLSMIRNFKEAEAATLVQLESLLSFISGSRGKPKERRWLIVSKLMQPNRVHCDSDQSNTNEFEELDRVLQSLFHKPCSNMSVETFQNHIENLELCIQGLEAGIERLERQLIRKRVSLLNIYNH

SEQ ID NO: 128984 - protein, 136 aa, Glycine max
  Coding DNA Sequence Number=SeqID_12206
  Homolog annotation: Hit_ID=Q1S066; Match level="QueryCoverage=91%, HitCoverage=42%, E-value=5e-23, Identity=48%"; Hit description =Arabidopsis conserved protein
MPVSAPLLQKADSSPYMFSFDCSRQYLAILQTSKSFKDTYSNSSIHLSLQCHDKDYWVTGNWINLSVQSCTSCNPMSFWLMNIMTKKRRLENPSIYLNDPQIVAQGGEVQYASCCCEDAENSLYLSAIFSTWQKEF

SEQ ID NO: 128985 - protein, 161 aa, Glycine max
  Coding DNA Sequence Number=SeqID_12207
  Gene Ontology: Mol. function=protein binding; Cellular component =protein complex; Biological process=biological_process
  Homolog annotation: Hit_ID=Q53RJ2; Match level="QueryCoverage=74%, HitCoverage=34%, E-value=5e-40, Identity=67%"; Hit description=Tat binding protein 1(TBP-1)-interacting protein (TBPIP), putative
  Pfam annotation: Domain name=TBPIP; Domain location=33-161; Score =97.8; E_value=3.2e-26; Accession=PF07106.3; Description=Tat binding protein 1(TBP-1)-interact
MAPKSDSAEGTISLSHFAVSLSEPNLTSLFHFAAIVLNFVNEQNRPVNAQNVADALQKFNLKKAAIQKALDNLADGGRISFKEYGKQKIYLARQDQFQIPNTEELNQMKEQNAELQKQLEDQKKATSEVEAEIKSLQSNLTLEQIFEREVNLRLEVADVDA

SEQ ID NO: 128986 - protein, 180 aa, Glycine max
  Coding DNA Sequence Number=SeqID_12208
  Gene Ontology: Mol. function=helicase activity; Biological process =viral genome replication
  Homolog annotation: Hit_ID=Q1SRJ5; Match level="QueryCoverage=98%, HitCoverage=22%, E-value=2e-35, Identity=42%"; Hit description =Probable helicase [imported]-Arabidopsis thaliana-related
MSFLQDDREFVEAIKKAKDWGTTNYLRKLFVLMLLTGVITKLEELLNQTWNWLAEDIAYHYKKTTVNTELHIDDEKLKNLTLLEIEKLQHANQKSLKDYPTMPYPEGANPAWCLENSLILSELNYNNDEARLEFENLFSSMTDEQKQIYQKIMQAVNNNEGDMFFLYGYGGTGKTYIWRH

SEQ ID NO: 128987 - protein, 298 aa, Glycine max
  Coding DNA Sequence Number=SeqID_12209
  Homolog annotation: Hit_ID=Q1S062; Match level="QueryCoverage=98%, HitCoverage=97%, E-value=1e-109, Identity=72%"; Hit description =Arabidopsis conserved protein
  Pfam annotation: Domain name=DUF241; Domain location=55-295; Score =180.3; E_value=4.7e-51; Accession=PF03087.5; Description=Arabidopsis protein of unknown function
  Subcellular localization annotation: CTP_CleavageSite=38; ConfidenceScore=5.45e-01
MAFTPFSPKSHHQSRSKSLPCRPHPLILQCNQHLGSLEASASDNSTSSSSSLFRHKLTGLQTLHDCIEKLVLLTLTQEVLVQERQEKWVDELLDGSLRLLDVCTVAKDALLHTKECARELQSIMRRKRGGEMEVTAEVRKFLASRKVVKKAILKALENLQATVKKAKFSPSNKDHPTATLASLFKDVQVITLSILESLLNFISGPAQSKPSKWSMVSKLMHNKKVTTTQESDPNEFSNVDAALLSFVFHMTRKSDSVSHLQNQLEDLESVIQDFVEGLETLFKRFIKIRVSLLNILNH

SEQ ID NO: 128988 - protein, 91 aa, Glycine max
  Coding DNA Sequence Number=SeqID_12210
  Homolog annotation: Hit_ID=Q1S065; Match level="QueryCoverage=56%, HitCoverage=17%, E-value=5e-08, Identity=57%"; Hit description =Arabidopsis conserved protein
MAAIEKKTQSSLHLRSNSLLSAAHPLVSQFEEHLHPLVSQFEEHLQRLRGSEATSSLSSSSVCHKLNDMLDLHDYTDKLLQLPIEQVLAQE

SEQ ID NO: 128989 - protein, 292 aa, Glycine max
  Coding DNA Sequence Number=SeqID_12211
  Homolog annotation: Hit_ID=Q1S065; Match level="QueryCoverage=99%, HitCoverage=98%, E-value=6e-89, Identity=61%"; Hit description =Arabidopsis conserved protein
  Pfam annotation: Domain name=DUF241; Domain location=51-289; Score =155.6; E_value=1.3e-43; Accession=PF03087.5; Description=Arabidopsis protein of unknown function
METSTKNSLHIRCNSLPSAPHPLVSQFDEHLQRLKDSEATITSLSSSSITQKLIGLQDLHDYADKLLQLPTTQQAFGHKCSDKWVDVLLEGSLGLLDICSTAQDCLLQSKESVHMVQSVIRRKCPDTEFAVEGGKYLASRKKMKKAIQKALGNLKGMKNELMDSSSSNDSEVLFILGILKEAEAVTMRLLESLLMFVSDTKGQSKQRRWSIISKLMQSDRMTCDSQESETNEFAKVDTTLQSLISHKPLSIENFQCHMENLETCIEDLEVGVEHLSRKLIRTRVSLLNIFSH

SEQ ID NO: 128990 - protein, 330 aa, Glycine max
  Coding DNA Sequence Number=SeqID_12212
  Homolog annotation: Hit_ID=Q3LHL2; Match level="QueryCoverage=34%, HitCoverage=21%, E-value=1e-19, Identity=39%"; Hit description =Hypothetical protein PPS5
  Pfam annotation: Domain name=DUF292; Domain location=1-79; Score =17.7; E_value=8.9e-07; Accession=PF03398.5; Description=Eukaryotic protein of unknown function, DUF292
MKDQNMLDVYVRIEGYCNLLIERVHLIEQERECPEELKEAASGLLYAASRCGDFPEIQEIRAILTSRFGKEFAARSIELRNNCGVHPQMTQKLSTRMPSLESRMKVLKDIASENGIVLQLEETSVSVEEQSSVEKQNQHESEKKEENVSMLPNRGKDEKLTDSYKGRKKYKDVADAAQAAFESAEYAAAAARAALELSRSESHDPDDHYSPRLQPRKVEDGHDDVRPQLEEKEILSETQREDELEKSEDIISCNSTDEALKGATALVDGEIEADPLEEEVVFDNSDDETDNKQNRNQSPKWTSSGYGAGIVVNTTPQLDLQKRPISVRTR

SEQ ID NO: 128991 - protein, 284 aa, Glycine max
  Coding DNA Sequence Number=SeqID_12213
  Homolog annotation: Hit_ID=Q1S065; Match level="QueryCoverage=99%, HitCoverage=100%, E-value=1e-101, Identity=67%"; Hit description =Arabidopsis conserved protein
  Pfam annotation: Domain name=DUF241; Domain location=53-281; Score =155.7; E_value=1.2e-43; Accession=PF03087.5; Description=Arabidopsis protein of unknown function
MAAIEKKTQSSLHLRSNSLPSAAHPLVSQLEEQLQRLRGSEATSSLSSSSVCLKLNDMLDLHDYTDKLLQLPMEQQVSAQECNDRCVDDLLEGSLRLLDICSTTKDCLLQSKESMCDLMSVIRRKKSNETGFAVEGVKYLAARKNMKKQIRKALENLKQKDNNTSPMLNFLNEAEAITLCSLEQLLLFISGPKRHSKHSRWSAISMLMQPKRVICDSQEANTNEFEKVDAALQSLISHRPSSIENFHSHMENLEFCIQDLEIGVDQLSRKLIRNRVSLLNIFNH

SEQ ID NO: 128992 - protein, 292 aa, Glycine max
  Coding DNA Sequence Number=SeqID_12214
  Homolog annotation: Hit_ID=Q1S060; Match level="QueryCoverage=99%, HitCoverage=100%, E-value=3e-76, Identity=54%"; Hit description =Arabidopsis conserved protein
  Pfam annotation: Domain name=DUF241; Domain location=52-289; Score =221.3; E_value=2.1e-63; Accession=PF03087.5; Description=Arabidopsis protein of unknown function
  Subcellular localization annotation: CTP_CleavageSite=38; ConfidenceScore=5.17e-01
MAASQLNTKSNFHARSNSLPSRPHPLILQCNEHLERLRSSNEASSSSSSLSHKLGGLQDLHECVENLFQLSLTQEALHHECQENWVDELLNGSLRLLDVCTAAKDSLLHTKECMRELQSIMRRRKGGEVELKAEIKKFLTSRKVVKKAISKALANLKSTTKSCNISSTNKDNQLISLLENVEVVTLSTFQALLQLISGTTQSKSSSWSLVSKLMQSKKVSCSQLADENEFSQLDEALQSYMFSQTSKFENMNKLQTQLEKVESLVQDLEEGFEFLFRRLIKTRVALLNILNH

SEQ ID NO: 128993 - protein, 153 aa, Glycine max
  Coding DNA Sequence Number=SeqID_12215
  Homolog annotation: Hit_ID=Q1S066; Match level="QueryCoverage=84%, HitCoverage=43%, E-value=7e-44, Identity=70%"; Hit description =Arabidopsis conserved protein
  Pfam annotation: Domain name=DUF241; Domain location=1-150; Score= -25.9; E_value=0.00024; Accession=PF03087.5; Description=Arabidopsis protein of unknown function
MVEGEKYLVVRKKMKKKIRKVLENLKQKDNNTSPMLSFLNETEVITLSSLEQLLRFISGPKGHSKQSRWSAISKLMQPKRVICDCDPQESNTNQFEKVDAALQSLISHKPSSENFHSHMENLELCIQDLEIGVDCLSRKLIRNRVFLLNIVNH

SEQ ID NO: 128994 - protein, 155 aa, Glycine max
  Coding DNA Sequence Number=SeqID_12216
  Homolog annotation: Hit_ID=Q1S060; Match level="QueryCoverage=76%, HitCoverage=52%, E-value=7e-18, Identity=41%"; Hit description =Arabidopsis conserved protein
GGEVELKAEIKKFLTSRKVVKKAISKALANLKGTSKNCNISSANKDNQLISLLENVEEKVSCSQLAYESEFAQLDEALQSCMFAKTSKFESMNKLQNQLEKVESLTHDLEEGLEFLFRRPRLATDTALPPPPSPPAPVAKSAIDLSDTCKSEKWK

SEQ ID NO: 128995 - protein, 86 aa, Glycine max
  Coding DNA Sequence Number=SeqID_12217
  Subcellular localization annotation: CTP_CleavageSite=27; ConfidenceScore=5.19e-01
MTKSKTKQSMDTDENPKTVQVQGPMTRSKTKQSMDTLQQLGPMTRSKTKQLMDTLQKMVADILSKAQVEKDEALEWRRMKPPSGEG

SEQ ID NO: 128996 - protein, 289 aa, Glycine max
  Coding DNA Sequence Number=SeqID_12218
  Homolog annotation: Hit_ID=Q1S060; Match level="QueryCoverage=99%, HitCoverage=100%, E-value=7e-66, Identity=50%"; Hit description =Arabidopsis conserved protein
  Pfam annotation: Domain name=DUF241; Domain location=54-286; Score =192.8; E_value=8.2e-55; Accession=PF03087.5; Description=Arabidopsis protein of unknown function
MEASQLNTKYHFHARSNSLPSRPHPLILQCNEHLESLRSSNEASSSSSSSSLCYKLGGLQDLHECVEKLFQLPLSQEALNHEFQENRVDELLNGSLRLLDVCTAAKDSLLHTKECMRELQSVIRRRKGGEVELKAEIKKFLTSRKVVKKAISKALANLKGTSKNCNISSANKDNQLISLLENVEEVTLSTFQALLQLISGTTQSKSSSWSLVSKKVSCSQLAYESEFAQLDEALQSCMFAKTSKFESMNKLQNQLEKVESLTHDLEEGLEFLFRRLIKTRVALLNILNH

SEQ ID NO: 128997 - protein, 76 aa, Glycine max
  Coding DNA Sequence Number=SeqID_12219
MNIYVWKVMADVDNSQSPISQESAYQPISERGMKEWETGFFDAENARKELAKAIIMLDYPLSIMDHLGFRRFMAAL

SEQ ID NO: 128998 - protein, 141 aa, Glycine max
  Coding DNA Sequence Number=SeqID_12220
MGCWGCFRFTFQRIHEVLMDLRLKLNVGLIIQVCVCVCVCEQHKMDFKDNRSMDPKKYTFSITGRKPISLEDKRKLGQGYIPLLQTSKPEKMETLTSHFCVRVGGLKVNFGLHGLVTMLQLVETLLELYVSSSKLFIITTK

SEQ ID NO: 128999 - protein, 66 aa, Glycine max
  Coding DNA Sequence Number=SeqID_12221
MARRLEAFLVPRSVSRSSPNKETKKKKKKKKTTKTKVLAVTKKKKKKKKLYLGNVATRHGREEAVQ

SEQ ID NO: 129000 - protein, 399 aa, Glycine max
  Coding DNA Sequence Number=SeqID_12222
  Gene Ontology: Mol. function=methyltransferase activity; Cellular component=spindle pole body; Biological process=rRNA processing
  Homolog annotation: Hit_ID=Q1RY42; Match level="QueryCoverage=90%, HitCoverage=41%, E-value=1e-171, Identity=80%"; Hit description =Ribosomal RNA methyltransferase RrmJ/FtsJ
  Pfam annotation: Domain name=FtsJ; Domain location=22-203; Score =273.6; E_value=3.9e-79; Accession=PF01728.9; Description=FtsJ-like methyltransferase
MGKAKGKHRLDKYYHLAKEHGYRSRASWKLVQLNSKFGFLESARAVLDLCAAPGGWMQVVVQRVPVDHLVIGVDLAPIAPVRGAIAIQEDITRPECKSRIKKLMNDHGCRAFDVILHDGSPNVGGAWAQEAMSQNALVIDAVKLATQFLAPKGKFVTKIFRSQDYSSVVYCLKQLFEKVEVDKPAASRSESAEIYVLGLGYKAPAKIDPRLLDVKHLFQGSVEPQPKVVDVLRDTKQKRHRDGYEDGNTTLRKVSSAANFIWSNSPLEILGSVTSITFTDPADSLIKDHDLTSEEVKSLCDDLRVLGKQDFKHLLKWRIQVRKALSPTQKPDSTTTELMDNEPKVVDEEDRILNEMEELTYVMDRKKKRAKKLLAKRRAKVFSFSAATDLVGTWDWPHT

SEQ ID NO: 129001 - protein, 749 aa, Glycine max
  Coding DNA Sequence Number=SeqID_12223
  Homolog annotation: Hit_ID=Q9SIW6; Match level="QueryCoverage=44%, HitCoverage=63%, E-value=4e-33, Identity=33%"; Hit description =Expressed protein
MMPQSDDIAAAQARYDGERVEAQAMHRNQSAWMAHWKQTDYKSTTPACNRLRIDCEVKEEKEDNGAEQRDLLGGLDSSMHAGAVGEAARATSVTFTNEADDEKSKKESSDSKSFPTFKFSRKLDGGLSLQREQHDREGGKSETEPCSGDEDDNISLNRTGTSGAGLSSTSAHASPKIETLAKECQVLSQEVLPTALLMKSPWDVEQKNLAVSTSLWNDFVKSDSDIVPNRCDKGKTVIPQFTHEPFEICQSSYNLASRGRFTSTKYHTFSSLLISEKKMSSLLDPQKSSFPRWMQGGTAHLPHNSMASSDDRYFIRGQHHEIEKYVANPNITCQTESLESAKPQNLYGLSSVAAQMPCSIHDVGCMKIYTGIDSVEESSRGRPKISQTTHHFLMSKNTDVNFSDSQSFREPIAPIKFKGSAFNEILDFSPPTNGHALKGLKLEALGSSMKSEVKENVQDFKYPTCLKNESSAETDTMDINALHKNNLPGDVPLQTNKCSKDSQNSRTSQGATISAREKTIAKSVNTTIPDINQEPQELLAEESPVVDRETSTSRTHSLDLDHFLSHSDEHARSSSGNSTLRIDPSSRWVKRLKLCTLGSAHGTGSTKIGETSSHEKVNNIYGKIMKDSRTSLEPKMVHHAEGQMVPDLPATVSTNGKSSLTEAKKTVEITLSHPWIQRWSHDRATSSRKRHELGELHEPKSSNTVLEEFQKKQFPSIAAMAMMGKAMNSLNPSELTKKGPVIVWNMKGF

SEQ ID NO: 129002 - protein, 193 aa, Glycine max
  Coding DNA Sequence Number=SeqID_12224
  Gene Ontology: Mol. function=transcriptional repressor activity; Biological process=regulation of nitrogen utilization
  Homolog annotation: Hit_ID=Q1S084; Match level="QueryCoverage=95%, HitCoverage=82%, E-value=1e-66, Identity=56%"; Hit description=NmrA -like
  Pfam annotation: Domain name=NmrA; Domain location=6-191; Score=74.6; E_value=3.1e-19; Accession=PF05368.3; Description=NmrA-like family
MEKSKILVIGATGNLGYDLAEANLKFCHPTFALVGDSAFSDPIKAQELPFSKVRWKMTEAVRVRVSVLEDGYNFYAPKVEISRLVEAEGIPYTFISCNFFMRILLPSLAQPGLDAPPRDKVTIFGDGNTKGVFMKESDVAAFTINAVDDPRNVCSLNELVEMWEIKIGKKLETLHVSEVELLQKIKVCLDGEI

SEQ ID NO: 129003 - protein, 445 aa, Glycine max
  Coding DNA Sequence Number=SeqID_12225
  Gene Ontology: Mol. function=diphosphomevalonate decarboxylase activity; Cellular component=cytosol; Biological process=isoprenoid biosynthetic process
  Homolog annotation: Hit_ID=Q944G0; Match level="QueryCoverage=93%, HitCoverage=99%, E-value=0.0, Identity=76%"; Hit description =Mevalonate disphosphate decarboxylase
  Pfam annotation: Domain name=GHMP_kinases_C; Domain location=247-340; Score=30.4; E_value=6.2e-06; Accession=PF08544.3; Description=GHMP kinases C terminal
  Pfam annotation: Domain name=GHMP_kinases_N; Domain location=115-173; Score=52.1; E_value=1.8e-12; Accession=PF00288.16; Description=GHMP kinases N terminal domain
  Pfam module annotation: Pfam domain module=GHMP_kinases_C::GHMP _kinases_N; Domain location=247-340::115-173
MASESQNWVFMVTAQTPTNIAVIKYWGKRDETLILPVNDSISLTLDPSHLCTTTTVAVSSAFHQDRMWLNAKEISLSGGRFQSCLREIRARACDVEDENKGIKITKEDWAKLHLHIASYNNFPTAAGLASSAAGFACLAYALGKLMDVKEDESQLSAIARQGSGSACRSLFGGFVKWIMGKEDNGSDSLAVQLADEKHWDDLVIVIAVVSSRQKETSSTSGMCESVETSLLLQHRAKEIVPKRILQMEEAIKNRDFASFSQLTCADSNQFHAVCLDTSPPIFYMNDTSHRIISIAEKWNRSEEAPQVAYTFDAGPNAVLIARNRKAATSLIQRLLYYFPPNSDDLSSYIIGDKSIAKDAGINGIQDVEALPPPPEIKDNIPPQKYKGDVSYFICTRPGRGPVLLSDSSQALLNGETGLPKTLSRKPVCYPWHDDSFLPSSQYVFV

SEQ ID NO: 129004 - protein, 60 aa, Glycine max
  Coding DNA Sequence Number=SeqID_12226
MAKPKLHLLSFLLCTILLSFFHCTFSLINPEDETSWIDMETEDINVVQSLFFNGFPCYGF

SEQ ID NO: 129005 - protein, 109 aa, Glycine max
  Coding DNA Sequence Number=SeqID_12227
  Homolog annotation: Hit_ID=Q6H7X0; Match level="QueryCoverage=96%, HitCoverage=29%, E-value=3e-18, Identity=40%"; Hit description =Putative pentatricopeptide (PPR) repeat-containing protein
  Pfam annotation: Domain name=PPR; Domain location=2-36; Score=21.2; E_ value=0.0037; Accession=PF01535.11; Description=PPR repeat
  Pfam annotation: Domain name=PPR; Domain location=37-71; Score=13.7; E_value=0.18; Accession=PF01535.11; Description=PPR repeat
  Pfam module annotation: Pfam domain module=PPR::PPR; Domain location =2-36::37-71
MKSHMVLQSAYSKMGNVNKCEEILNQMCKSGLKLNTYVLKSMLNLYGRLGQFGKMEEVLRVMEKGSYVWSSRIIERMEDFFQLLPSKGLKPDVVTWTSRMGAYSKKSFT

SEQ ID NO: 129006 - protein, 125 aa, Glycine max
  Coding DNA Sequence Number=SeqID_12228
  Gene Ontology: Mol. function=binding; Cellular component=plastid chromosome; Biological process=protein amino acid phosphorylation
  Homolog annotation: Hit_ID=Q6H7X0; Match level="QueryCoverage=96%, HitCoverage=56%, E-value=4e-41, Identity=41%"; Hit description =Putative pentatricopeptide (PPR) repeat-containing protein
  Pfam annotation: Domain name=PPR; Domain location=42-76; Score=39.4; E_value=1.2e-08; Accession=PF01535.11; Description=PPR repeat
  Pfam annotation: Domain name=PPR; Domain location=7-41; Score=33.2; E_ value=9.2e-07; Accession=PF01535.11; Description=PPR repeat
  Pfam annotation: Domain name=PPR; Domain location=77-111; Score=51.3; E_value=3.2e-12; Accession=PF01535.11; Description=PPR repeat
  Pfam module annotation: Pfam domain module=PPR::PPR::PPR; Domain location=42-76::7-41::77-111
MNNPSAVVYNAYINGLMKGGNSDKAEEIFKRMKKDACKSTTETYTMLINLYGKAGKSFMALILFHEMTTHKCKPNICTYTALVNAFVREGLCEKAEEVFEQMQEAGLEPDVYAYNALMETYSLIP

SEQ ID NO: 129007 - protein, 114 aa, Glycine max
  Coding DNA Sequence Number=SeqID_12229
  Subcellular localization annotation: CTP_CleavageSite=41; ConfidenceScore=5.10e-01
MSRGSGDLGDARWGAIAQNQAWPILTQPGHSQSVRTCDVPKQASSWQSTNKRTKVHEARRFVWRLASYLSWVVYEKFPLVPMCKGYGNSFLGTGNRLLTLVIDYQRGKLLKKTF

SEQ ID NO: 129008 - protein, 523 aa, Glycine max
  Coding DNA Sequence Number=SeqID_12230
  Gene Ontology: Mol. function=nucleic acid binding; Cellular component= intracellular
  Homolog annotation: Hit_ID=Q5UDB6; Match level="QueryCoverage=48%, HitCoverage=47%, E-value=6e-87, Identity=64%"; Hit description =INDETERMINATE-related protein 9
  Pfam annotation: Domain name=RS4NT; Domain location=85-122; Score =17.8; E_value=0.015; Accession=PF08071.2; Description=RS4NT (NUC023) domain
  Pfam annotation: Domain name=zf-C2H2; Domain location=100-122; Score =20.5; E_value=0.0061; Accession=PF00096.16; Description=Zinc finger, C2H2 type
  Pfam annotation: Domain name=zf-C2H2; Domain location=127-148; Score =15.8; E_value=0.16; Accession=PF00096.16; Description=Zinc finger, C2H2 type
  Pfam annotation: Domain name=zf-C2H2; Domain location=24-46; Score =26.0; E_value=0.00013; Accession=PF00096.16; Description=Zinc finger, C2H2 type
  Pfam module annotation: Pfam domain module=RS4NT::zf-C2H2::zf -C2H2::zf-C2H2; Domain location=85-122::100-122::127-148::24-46
MVTTDPDAEVIALSPKTLMATNRFICEVCNKGFQREQNLQLHRRGHNLPWKLKQKTTKEPKRKVYLCPEPTCVHHDPSRALGDLTGIKKHYSRKHGEKKWKCDKCSKKYAVQSDWKAHSKTCGTREYRCDCGTLFSRRDSFITHRAFCDALAQESARQPPSLSGGGIGSHLYGSTTNMALNLSQVGSQIQDPSNAQPTELLRLGATSGRTGHFDHILGSPFRPSNQQQQPFFMSEQPNQTYHHPDQNKPFQQGLMQQLSDHHHLNNNNSPFNLPFLSSNTANASFSEHFNNANGGGNNNNNNEGTNYFATSSAPSLFSNSANANANALSHMSATALLQKAAQMGATSSNGTASLLKSFGSASSSSGGGSKSEQQHRVPPLVNAANYVGGMFGGNHVNEQQSNSNLQDLMNSFAVGGNSSIFEAGGFEAYDHSNNNNNRDPKVLAMSGSNSVGGSDRLTRDFLGVGQIVRGMSGSGGVAQREQQQQHGFNLSSLEAERNNNNNNSNNAAPSSGQAFGGGGGNFQ

SEQ ID NO: 129009 - protein, 96 aa, Glycine max
  Coding DNA Sequence Number=SeqID_12231
  Gene Ontology: Mol. function=structural constituent of ribosome; Cellular component=ribonucleoprotein complex; Biological process =translation
  Homolog annotation: Hit_ID=Q2PMP7; Match level="QueryCoverage=93%, HitCoverage=41%, E-value=8e-39, Identity=97%"; Hit description =Chloroplast 30S ribosomal protein S3
  Pfam annotation: Domain name=Ribosomal_S3_C; Domain location=11-92; Score=103.5; E_value=6.4e-28; Accession=PF00189.10; Description =Ribosomal protein S3, C-terminal domain
MGFPKFLIEEFIAGQLKNRVSFRKAMKKAIELTEQAGTKGVQVQIAGRIDGKEIARVEWIREGRVPLQTIRAKIDYCCYYSSNYLWGIRDQSLDIF

SEQ ID NO: 129010 - protein, 271 aa, Glycine max
  Coding DNA Sequence Number=SeqID_12232
  Gene Ontology: Mol. function=transferase activity, transferring hexosyl groups; Cellular component=integral to membrane; Biological process=metabolic process
  Homolog annotation: Hit_ID=Q1S2F8; Match level="QueryCoverage=83%, HitCoverage=60%, E-value=8e-50, Identity=42%"; Hit description=UDP -glucuronosyl/UDP-glucosyltransferase
MHGVDVTVMTTPAIAAIFQTSIDRDSTRGSRLPDWLRAPNGYTRLKKMMQESEKKSYGSLFKSFYEFEGHKAGSGHANEEEEEGLLTWLDSKKEESVLYVSFGSMNKFPSTQLVEIAHALEDSGHDFDFIWVHNFLYWSCGDSLFESAIAGLPMVTWPIFAEQFFNEKFLVDVLRIGVSVGAKEWKSLNEFGSEVVKREDIGKTIALLMGGGEESVEMRRVKALSDTAKKAIQVGGSSHNNLKDQIEELKSLKLQKVKHKMEVIEKGDRNA

SEQ ID NO: 129011 - protein, 505 aa, Glycine max
  Coding DNA Sequence Number=SeqID_12233
  Gene Ontology: Mol. function=transferase activity, transferring hexosyl groups; Cellular component=integral to membrane; Biological process=metabolic process
  Homolog annotation: Hit_ID=Q1S2F8; Match level="QueryCoverage=97%, HitCoverage=98%, E-value=1e-136, Identity=48%"; Hit description=UDP -glucuronosyl/UDP-glucosyltransferase
  Pfam annotation: Domain name=UDPGT; Domain location=2-499; Score= -93.9; E_value=6.8e-06; Accession=PF00201.9; Description=UDP -glucoronosyl and UDP-glucosyl transferase
MDPRLSLMESSSDEMVLKGIFLPFISPSHLVPVVDIARIFAMEGVDVTIITTPANAAVFQSSIDRDCIRGRSIRTHVVKFPQVPGLPQGLESFNASTPADMVTKIGHALSILEGPFRQLFRDIKPDFIVSDMFYPWSVDAADELGIPRLIYVGGTYFAHCAMDSLERFEPHTKVGSDDESFLIPGLPHEFEMTRSQIPDRFKAPDNLTYLMKTIKESEKRSYGSVFKSFYAFEGAYEDHYRKIMGTKSWNLGPISSWVNQDASDKASRGSRDNKAKEEQVEEGKDGSWLAWLDSKKEGSVLYVCFGSMNNFPTTQLGEIAHALEDSGHDFIWVVGKTDEGETKGFVEEFEKRVQASNKGYLICGWAPQLLILEHPSIGAVVTHCGMNTVIESVDAGLPLVTWPLFAEQFFNERLLVDVLKIGVAIGAKKWNNWNDFGDEIVKREDIGKAIALLMGGGEESEEMRKRVKALSDAAKKAIQVGGSSHNSLKDLIEELKSLKLQKLNA

SEQ ID NO: 129012 - protein, 189 aa, Glycine max
  Coding DNA Sequence Number=SeqID_12234
  Gene Ontology: Mol. function=transporter activity; Cellular component= integral to membrane; Biological process=transport
  Homolog annotation: Hit_ID=Q9I1Y5; Match level="QueryCoverage=89%, HitCoverage=19%, E-value=1e-34, Identity=43%"; Hit description=Usher CupA3
WQASGSVSGAVAVHSGGITLGHTVSDTFAIVEAKGAEGATVLNGQNIKIDSSGYAIVPSLMPYRRNNVNLDAPEGKSADVDIIDSHQVVTPYAGSVNRVVFKTRQGIPVMMQLKRRDGSYVPLGADIFDSSGNSVATVSQAGNTYLRLENREALSARWGSAQDEQCVIHYAPVNATPVKALNYVTALCE

SEQ ID NO: 129013 - protein, 674 aa, Glycine max
  Coding DNA Sequence Number=SeqID_12235
  Homolog annotation: Hit_ID=Q8A9R8; Match level="QueryCoverage=21%, HitCoverage=83%, E-value=2e-17, Identity=29%"; Hit description =Putative phosphatidylinositol-4-phosphate 5-kinase
  Pfam annotation: Domain name=MORN; Domain location=517-539; Score =15.5; E_value=0.054; Accession=PF02493.10; Description=MORN repeat
  Pfam annotation: Domain name=MORN; Domain location=540-562; Score =28.8; E_value=1.9e-05; Accession=PF02493.10; Description=MORN repeat
  Pfam annotation: Domain name=MORN; Domain location=563-583; Score =0.9; E_value=6.7; Accession=PF02493.10; Description=MORN repeat
  Pfam annotation: Domain name=MORN; Domain location=611-633; Score =8.5; E_value=0.53; Accession=PF02493.10; Description=MORN repeat
  Pfam annotation: Domain name=MORN; Domain location=634-656; Score =13.3; E_value=0.11; Accession=PF02493.10; Description=MORN repeat
  Pfam module annotation: Pfam domain module=MORN::MORN::MORN::MORN::MOR N; Domain location=517-539::540-562::563-583::611-633::634-656
MGCYSLKPFRFEGLKRQDEVKALMQKLKENTHLLIEIDIDALLEKDLLTLDEAMKTANDAVLLAIKAVSVLKSEMHKKFIDRLNDGMKEASSSEINKILESYKEAGIGFGAAYNIKASILQSIFDSPFLGVRLKDPNSLVICTLACSEPINDSDIAIFLHTFRQTTKYTRDIIISTIHDHAVEPNLFITTVLTLGCLNVQRSSQNGGILSRLALHFPLIFSFWGRHNQQQVGTGKQTEVFPHEVMSSDDIDERTNRITSDNIDNNLDKYYEEPALRNNSSKLPTSRDSGKNGEDLSDTTSNYNILYDSITEGGDSAFQREQLENWNLGPGFEVAKEWAQEKAADATPAVDNLSIFHLPVGVRHSEDLKDCLEISFLTKQLEPDTDNDVKTQTLNGGMSPWSAATDASLEAVMEFASSLLKGKNANKSKKDGVLSVRAASMLVIMSLKFVDVHAYTTERESEEYSVTTFQRNNSQDCNTSGVYLAQGNFKFFEVKEAERDLSKKWSPVVEMQYRGGRYKGRCQGGLPEGKGRLVLRDGSIYDGLWRYGKRSGPGSFYFKNGDMFQGSWRDDVIHGKLKIRQKVIVLEFFIIDMAYLYINYMGWFYFRTGDRWFANFWKGKANGEGRFYTKSGDAFFGNFKDGWRHGQFLCINANGTRLITVEREMLNGPQLQRDN

SEQ ID NO: 129014 - protein, 109 aa, Glycine max
  Coding DNA Sequence Number=SeqID_12236
MSELDPKRHGAAFVSRTPLVWHGSWQSVHHEQQSIHQSEPAYNPTTPKVYACQMRMVVATVFSELFVMGVVELSDVGISAPPVVSVVLPYTTSCQPTPPLFSLEHTDSN

SEQ ID NO: 129015 - protein, 131 aa, Glycine max
  Coding DNA Sequence Number=SeqID_12237
  Gene Ontology: Mol. function=DNA binding; Biological process =regulation of transcription
  Homolog annotation: Hit_ID=Q8LFS2; Match level="QueryCoverage=78%, HitCoverage=28%, E-value=5e-33, Identity=63%"; Hit description =Regulatory protein
DADIMWFRDPFPQFDLHADFQIACDHFTGGFDDVQNRPNGGFNYVKSNNRSIEFYKFWYSSRETYPGYHDQDVLNFIKVHPFITDIGLKMRFLDTTNFGGLCEPRLETLFILATKFEEVVSCFLEGSSEMQ

SEQ ID NO: 129016 - protein, 142 aa, Glycine max
  Coding DNA Sequence Number=SeqID_12238
MECRVPNGGTFRVALVEHVAASNGVLGFRILVSCRLSKQCLHVLLCSHSLWCLKANDDIEIILSHPPPLSHHTKGHHVWEAFNWRWKLNKVKVGIPLLTWCKKLNSGLPVAPLLNVYWVEKEVVVMTDDGESNVAPCRACRP

SEQ ID NO: 129017 - protein, 140 aa, Glycine max
  Coding DNA Sequence Number=SeqID_12239
  Subcellular localization annotation: CTP_CleavageSite=47; ConfidenceScore=5.35e-01
MHGSRHQHLFKKNIRKTKKDIRKTKKGSANFKNMGSGVVLRVGKRFPCSYVSSSAMRNSDLRSVEAKLHDDDKGNDKRLKGQSKIFKIESRTLQDSRDQDLKNQDSRDQDFKNQESRDQDSRIKRRLHQDKYEKVFSKIE

SEQ ID NO: 129018 - protein, 166 aa, Glycine max
  Coding DNA Sequence Number=SeqID_12240
  Gene Ontology: Mol. function=DNA binding; Biological process =regulation of transcription
  Homolog annotation: Hit_ID=Q8H883; Match level="QueryCoverage=73%, HitCoverage=23%, E-value=2e-32, Identity=56%"; Hit description =Putataive InsB from Escherichia coli
MGKQTSNEYPLEKILNDAAMKDRTVILTTLNEAWATPNSVIDLFLESFRIGDRTSTFLNHLVIIALDQKAFARCQVIHTHCFSLVSEEADFHEEAYFMTPRYLMMMWKRIDFLRTVLEMGYNFVFTPWKHSQSCEVYCFFVIDFHMIMLNGKKFLVYDWGNELLMS

SEQ ID NO: 129019 - protein, 299 aa, Glycine max
  Coding DNA Sequence Number=SeqID_12241
  Gene Ontology: Mol. function=zinc ion binding; Cellular component =endoplasmic reticulum; Biological process=ER to Golgi vesicle -mediated transport
  Homolog annotation: Hit_ID=Q9M081; Match level="QueryCoverage=52%, HitCoverage=14%, E-value=3e-66, Identity=76%"; Hit description =Putative protein transport protein Sec24-like At4g32640
  Pfam annotation: Domain name=zf-Sec23_Sec24; Domain location=145-184; Score=70.5; E_value=5.4e-18; Accession=PF04810.5; Description =Sec23Sec24 zinc finger
  Subcellular localization annotation: CTP_CleavageSite=66; ConfidenceScore=5.69e-01
MVAPPPPVPGPSQAPRMFGMPPPLPNQSMTTTISPAVGQTGAPMAGPSKIDPNQIPRPTPGSSVILHETRQGNQATIPPPATSEYIARDTGNCSPRYMKCTINQIPFTADLLTTSGMQLAMLVQPLALPHPSEEPIQVVDFGESGPVRCSRCKAYINPFMKFIDQGRRFICNLCGFTNRAKNKTLAPIQITIEQILHEKIVNSTELGKYRLQKHKEFKDIFSMFDGTSVCGLVEEITLQTCAFHFGRKCWRWIINKNHTLWLKYVEVEVETKNKFINHARNFWDRVVMLLLRVYHVRNV

SEQ ID NO: 129020 - protein, 113 aa, Glycine max
  Coding DNA Sequence Number=SeqID_12242
  Gene Ontology: Mol. function=zinc ion binding; Cellular component =COPII vesicle coat; Biological process=ER to Golgi vesicle-mediated transport
  Homolog annotation: Hit_ID=Q9M081; Match level="QueryCoverage=91%, HitCoverage=7%, E-value=2e-32, Identity=66%"; Hit description =Putative protein transport protein Sec24-like At4g32640
MERFSDETPRDYHCNLGPDGRRRDADERPELCRGTVEFVATKEFMDHRMISFHEKVLLHYFITGLIIPEVREPMPAVYFFLIDVSMNAVQTGATAAACSAISRVIKDKDLPFV

SEQ ID NO: 129021 - protein, 161 aa, Glycine max
  Coding DNA Sequence Number=SeqID_12243
QAKRTMSHYSICKSIGSRPTSQYDTRRFHSLDAWNRYTDNVLGRNILPERKVELYHTEFDDFKTELERHNLHKCLTNLVDGSIDVALVKEFYANLYSSEGPSPKQAREGIGHILDLTPIEEKRKESLKRLTLNSHTSMVSYPNFVRGPLLDDMRPFFGPCE

SEQ ID NO: 129022 - protein, 86 aa, Glycine max
  Coding DNA Sequence Number=SeqID_12244
MELPIISPKTQYPRKSCEKEVYPNLKFEVPRRSGALHDSENGFLSRFGAEMVSKGWSFDGASMVEEKGRKSNVREREKLLHFWLSE

SEQ ID NO: 129023 - protein, 258 aa, Glycine max
  Coding DNA Sequence Number=SeqID_12245
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=72%, HitCoverage=14%, E-value=5e-71, Identity=65%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MDIRVAFEMYNDTKNEVTLSKKGNRNEEKARVMKQAQPNTGAKRASGATMKTQKPTSATIDRKPKKSHFLAAKRVLRYVKGTMQYGVMFPSSVDGAEMKLIGYSDADWCGDRTDRRSTSGYLFKFGGAAVSWSSKKQPVTALSSCEAEYISGSFAACQAIWLKSLLDELKCEVQMPLSLLIDNKSAISLAKNPVSHGRSKHIETRFHFIREQVNNGVLKLIYCPTEDQLADLLTKAVKPDRFIKLREEIGVICFEDLN

SEQ ID NO: 129024 - protein, 585 aa, Glycine max
  Coding DNA Sequence Number=SeqID_12246
  Gene Ontology: Mol. function=carbohydrate binding; Biological process= DNA integration
  Homolog annotation: Hit_ID=Q1S9U8; Match level="QueryCoverage=82%, HitCoverage=97%, E-value=0.0, Identity=68%"; Hit description =Carboxypeptidase regulatory region
  Pfam annotation: Domain name=Rhamnogal_lyase; Domain location=1-148; Score=178.0; E_value=2.4e-50; Accession=PF06045.2; Description =Rhamnogalacturonate lyase family
MELKMYLDVVWNEPGKHGMFQRIRGTDFSVIAANENIVEISFLRTWTASMKGSSVPMNIDKRYILRRGDYGFYSYAIFNRPSGLPAVEIDQIRIVFKLDETRFHYMAISDTRQRNMPSVRDRASGQPLAYPEAVLLTNSSEQQFKGEVDDKYQYSSENKDNTVHGWITQDGLAPVGFWLITPSNEFRHAGPVKQDLTSHVGPTTLSMFVSTHYAGKEVTMAFGEGETYKKVFGPVFVYLNSVPNKSQFRSLWSDAVEQLSNEVRRWPYDFVGSKDFLPPNQRGTVTGRLLVQDGGKRDQPANNAYVGLALPGDTGSWQKESKGYQFWIQADKAGHFLIKNIVPGDYNLYAWVPGFIGDYRYKTKITIERGGNINLNSLVYNPPRNGPTLWEIGIPDRSAAEFYMPDPNPKLVNRLFQNDKQDKFRQYGLWERYTELYPNHDLVYTVGVSDYHNDWFYAQVTRSTPEKSYMPTTWQIQFQLKNIIMPGNYTFQVALASTTNARLEVRFNDLNAKLPHFSTGLKGDDNAIARHGIHGLYRLHTIAVGSNHLVNGKNTIYLTQSKGISPFMGVMYDYVRLESPPIKST

SEQ ID NO: 129025 - protein, 126 aa, Glycine max
  Coding DNA Sequence Number=SeqID_12247
  Gene Ontology: Mol. function=DNA binding; Cellular component=nucleus; Biological process=regulation of transcription, DNA-dependent
  Homolog annotation: Hit_ID=Q0PJH6; Match level="QueryCoverage=66%, HitCoverage=86%, E-value=8e-26, Identity=63%"; Hit description=MYB transcription factor MYB142
  Pfam annotation: Domain name=Myb_DNA-binding; Domain location=13-62; Score=33.3; E_value=8.3e-07; Accession=PF00249.21; Description=Myb -like DNA-binding domain
MASSSLSKQKASDSSWTPKQNKLFEKALAKYDKDTPDRWQNVAKAVGGKSADEVKRHYEILLEDLRHIESGHVPLPKYKSTGSSTNVEEEERLFQISMNYPILETAQVLNQDILPIQPLSTPFKKD

SEQ ID NO: 129026 - protein, 110 aa, Glycine max
  Coding DNA Sequence Number=SeqID_12248
  Subcellular localization annotation: CTP_CleavageSite=40; ConfidenceScore=5.91e-01
MASAVRLASRSFFANRSRSFVKSSTTPFVFSSSSASRISRASRVLSVVISVESLMPLHSAIANARLTSNIAFDSTCWSSLSRGKKKLTLIAWNLESPLPPFLQAMVIPSL

SEQ ID NO: 129027 - protein, 624 aa, Glycine max
  Coding DNA Sequence Number=SeqID_12249
  Gene Ontology: Cellular component=plastid chromosome
  Homolog annotation: Hit_ID=Q1SWR7; Match level="QueryCoverage=98%, HitCoverage=98%, E-value=0.0, Identity=74%"; Hit description =Mitochodrial transcription termination factor-related
  Pfam annotation: Domain name=mTERF; Domain location=248-593; Score =135.5; E_value=1.4e-37; Accession=PF02536.5; Description=mTERF
MFFSCKTYNLYLPCSSVPLRNSTSCTIFNCQNPNEHHSILRKHNSKSTAYLLHHLSHKDGAPNPIPIPKPSELQDPMPHEEKVKVLELSLVRKRTPQFPGSIYAQSPSDSDVGSSLPPLRTLFQSSDDKDEEEEEKEMIMRALDIRRKVTEEVFKEAMRKGKFGITYTTNLVGRLSGFIDYIMIEAANLKRLPEYSNSTFNLRAKIVIDDSKVVPLIRWLKHNALSYPRIAKLILMSSGKLEAVRSFVEWLKSVHVKGEFLGVVMVNAGENIFQRSHVELDEIVLYLESNGVRRDWMGYVISRCPQLLSYSLDEVKNRAQFYHDMGLNEKDFGTMVFDFPKVLGYYSLEEMNAKVNYLKEFGLQTKDVGRLLAFRPQLMACSIEEQWKPLVKYLYYYGITQDGMRRMLTIKPMVFCADLQMTIVPKVRFFEDIGVRNDAIGNMLVKFPPLLTYSLNKKIRPVVIFLMTKAGVSEKDIAKVVALGPELLGCNIAHKLDLNVKYFLSLGIRLRQLGEMIADFPMLLRYNPDVLRPKYIYLRKTMVRPLQDLIEFPRFFSYSLEGRIIPRHKVLVENQINIKLRYMLTSTDEEFNKMVKGIIRKRLRFESAVTNEDTTLILETTPQA

SEQ ID NO: 129028 - protein, 41 aa, Glycine max
  Coding DNA Sequence Number=SeqID_12250
MVLIMTIWYQHGSAVPVKLKHVLCKINGSATHAPQVEVTQD

SEQ ID NO: 129029 - protein, 309 aa, Glycine max
  Coding DNA Sequence Number=SeqID_12251
  Gene Ontology: Mol. function=phenylalanine-tRNA ligase activity; Cellular component=cytoplasm; Biological process=tRNA aminoacylation for protein translation
  Homolog annotation: Hit_ID=Q1SWR9; Match level="QueryCoverage=96%, HitCoverage=60%, E-value=1e-144, Identity=75%"; Hit description =Phenylalanyl-tRNA synthetase, class IIc; Aminoacyl-transfer RNA synthetase, class II
  Pfam annotation: Domain name=tRNA-synt_2; Domain location=147-294; Score=-208.7; E_value=0.06; Accession=PF00152.11; Description=tRNA synthetases class II (D, K and N)
  Pfam annotation: Domain name=tRNA-synt_2d; Domain location=62-301; Score=349.9; E_value=4.1e-102; Accession=PF01409.10; Description =tRNA synthetases class II core domain (F)
  Pfam module annotation: Pfam domain module=tRNA-synt_2::tRNA-synt_2d; Domain location=147-294::62-301
MQNIGSDEIKALKVRKLIVPQTWKGYSLKRGPNYAPKRKKVVTDLTRDNFQSGEWKELEFKEYNYSAKGQPLEGYMSALALNLHLNVLIGSFWNFDALFQPQQHPARDSHDTFFLETPSTTKILPEDYVQRVRQVHESGGYGSRGYAYDWKREEANKNLLRTHTTAVSSRMLYQLAQKPFAPKKYFSIDRVFRNEAVDRTHLAEFHQIEGMTKLKFKPAYNPYTEPSMEIFSYHEGFKKWVEVGNSGMFRPEMLQPMGLPEDVQVIAWGLSLERPTMILYGIDNIRDLFGHKVDLGLIKKNPICRLGID

SEQ ID NO: 129030 - protein, 121 aa, Glycine max
  Coding DNA Sequence Number=SeqID_12252
MSPYTDSTPNESIVMWEKIGLWSWIEPLLNNVESFSEMVFKCLKSFSAENTRFWLCASRWRRQFCTGWIDVVMEVQEKETLAMFKAMKWVEQLPFSVVIFESDCKGLVNQVKSRNNSTTEF

SEQ ID NO: 129031 - protein, 91 aa, Glycine max
  Coding DNA Sequence Number=SeqID_12253
  Gene Ontology: Mol. function=nucleic acid binding
  Homolog annotation: Hit_ID=Q6YNS1; Match level="QueryCoverage=55%, HitCoverage=28%, E-value=3e-13, Identity=72%"; Hit description =Putative glycine-rich RNA-binding protein
  Pfam annotation: Domain name=RRM_1; Domain location=1-70; Score=8.2; E_value=0.025; Accession=PF00076.12; Description=RNA recognition motif. (a.k.a. RRM, R
MVRSSPPRTSYKTFQKINSRSHRDLNSVINDRVTERSKGFEFVTFASEDLMRDAIEGMNKQNLDGRNAIVNEAQSRESRSGGDGNYGSGGG

SEQ ID NO: 129032 - protein, 89 aa, Glycine max
  Coding DNA Sequence Number=SeqID_12254
MSMLNRFGEDVKELSLHWWKKEDVVAVGIISDIGGIKEDDGGIYTNDKGFTGIRTTNVAIKNTHNDYVVLFVEAYKSVSSGAAGHRSNN

SEQ ID NO: 129033 - protein, 882 aa, Glycine max
  Coding DNA Sequence Number=SeqID_12255
  Gene Ontology: Mol. function=structural molecule activity; Cellular component=coated pit; Biological process=ER to Golgi vesicle -mediated transport
  Homolog annotation: Hit_ID=Q1S9H2; Match level="QueryCoverage=99%, HitCoverage=99%, E-value=0.0, Identity=85%"; Hit description=Adaptin N terminal region, putative
  Pfam annotation: Domain name=Adaptin_N; Domain location=25-534; Score= 493.5; E_value=2.5e-145; Accession=PF01602.10; Description=Adaptin N terminal region
  Pfam annotation: Domain name=Gamma-COP; Domain location=609-875; Score=392.0; E_value=9e-115; Accession=PF08752.1; Description =Coatomer gamma subunit appendage doma
  Pfam annotation: Domain name=HEAT; Domain location=102-137; Score =3.2; E_value=17; Accession=PF02985.12; Description=HEAT repeat
  Pfam annotation: Domain name=HEAT; Domain location=236-271; Score =3.0; E_value=18; Accession=PF02985.12; Description=HEAT repeat
  Pfam annotation: Domain name=HEAT; Domain location=272-308; Score =6.7; E_value=6.5; Accession=PF02985.12; Description=HEAT repeat
  Pfam annotation: Domain name=HEAT; Domain location=344-380; Score =1.7; E_value=27; Accession=PF02985.12; Description=HEAT repeat
  Pfam annotation: Domain name=HEAT; Domain location=456-492; Score =0.9; E_value=33; Accession=PF02985.12; Description=HEAT repeat
  Pfam annotation: Domain name=HEAT; Domain location=498-534; Score =10.5; E_value=2.2; Accession=PF02985.12; Description=HEAT repeat
  Pfam annotation: Domain name=HEAT_PBS; Domain location=122-148; Score= 6.3; E_value=13; Accession=PF03130.6; Description=PBS lyase HEAT-like repeat
  Pfam annotation: Domain name=HEAT_PBS; Domain location=256-288; Score= 3.4; E_value=33; Accession=PF03130.6; Description=PBS lyase HEAT-like repeat
  Pfam annotation: Domain name=HEAT_PBS; Domain location=477-501; Score= 15.4; E_value=0.21; Accession=PF03130.6; Description=PBS lyase HEAT -like repeat
  Pfam module annotation: Pfam domain module=Adaptin_N::Gamma -COP::HEAT::HEAT::HEAT::HEAT::HEAT::HEAT::HEAT_PBS::HEAT_PBS::HEAT _PBS; Domain location=25-534::609-875::102-137::236-271::272-308::344- 380::456-492::498-534::...
  Pfam module annotation: Domain location=122-148::256-288::477-501
MAQPLVKKDDDRDDEAEYSPFLGIEKGAVLQEARVFNDPQLDARRCSQVITKLLYLLNQGETFTKTEATEVFFSVTKLFQSRDLGLRRMVYLIIKELSPSADEVIIVTSSLMKDMNSKTDMYRANAIRVLCRITDGTLLTQIERYLKQAIVDKNPVVASAALVSGIHILQTNPEIVKRWSNEVQEAVQSRAALVQFHALALLHQQAGYKLNQGKCSLSFGSMPFGLLYKSGNNTQSGDRPFYDYLESCLRHKSEMVIFEAARAITELNGVTSRELTPAITVLQLFLSSSKPVLRFAAVRTLNKVAMTHPMAVTNCNIDMESLISDQNRSIATLAITTLLKTGNESSVDRLMKQITNFMSDIADEFKIVVVEAIRSLCLKFPLKYRSLMNFLSNILREEGGFDYKKAIVDSIVILIRDIPDAKESGLLHLCEFIEDCEFTYLSTQILHFLGVEGPKTSDPSKYIRYIYNRVHLENATVRASAVSTLAKFGAAVDALKVLLTSPRIFVLLRRCLFDSDDEVRDRATLYLNTLGGDGSVVETDKDVKDFLFGSFVIPLVNLETSLKNYEPSEEAFDIDSVPREVKSQPLAEKKAPGKKPTGLGAPPSGPPSTADAYERLLLSIPEFANFGKLFKSSEPVELTEAETEYAVNVVKHIFDRHVVFQYNCTNTIPEQLLEDVIVIVDASEAEEFSEVFSKPLRSLPYDSPGQTFVAFEKPEGLPIAGKFSNVLKFIVKEVDPTTGETEDDGVEDEYQLEDLEVVTADYILKVGVSNFRSAWESMGPDCERVDEYGLGPRENLAEAVNTVINLLGMQPCEGTEVVPPNSRSHTCLLSGVFIGNVKVLVRLSFGLDGPKDVAMKLAVRSEDETVSDTIHEIFSSLIDSRV

SEQ ID NO: 129034 - protein, 251 aa, Glycine max
  Coding DNA Sequence Number=SeqID_12256
  Gene Ontology: Mol. function=nucleotide binding; Cellular component =membrane; Biological process=small GTPase mediated signal transduction
  Homolog annotation: Hit_ID=P31022; Match level="QueryCoverage=88%, HitCoverage=98%, E-value=1e-104, Identity=86%"; Hit description=Ras -related protein Rab7
  Pfam annotation: Domain name=Arf; Domain location=31-197; Score= -87.6; E_value=0.0052; Accession=PF00025.11; Description=ADP -ribosylation factor family
  Pfam annotation: Domain name=MMR_HSR1; Domain location=9-149; Score= -5.4; E_value=0.0031; Accession=PF01926.13; Description=GTPase of unknown function
  Pfam annotation: Domain name=Miro; Domain location=10-149; Score =37.1; E_value=6e-08; Accession=PF08477.3; Description=Miro-like protein
  Pfam annotation: Domain name=Ras; Domain location=10-199; Score =242.1; E_value=1.2e-69; Accession=PF00071.12; Description=Ras family
  Pfam module annotation: Pfam domain module=Arf::MMR_HSR1::Miro::Ras; Domain location=31-197::9-149::10-149::10-199
MPSRRRTLLKVIILGDSGVGKTSLMNQYPSVSVYILRVLYFAMQFAFYCLVLHFSNQYKATIGADFLTKEVQFEDRLFTLQIWDTAGQERFQSLGVAFYRGADCCVLVYDVNSMKSFDNLNNWREEFLIQASPSDPENFPFVVIGNKIDIDGGNSRVVSEKKARAWCASKGNIPYFETSAKEGINVEEAFQCIAKNALKSGEEEELYLPDTIDVGNSSQPRATGSTMIVAVMLRASVINSQQELLSDLLKY

SEQ ID NO: 129035 - protein, 435 aa, Glycine max
  Coding DNA Sequence Number=SeqID_12257
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q94G86; Match level="QueryCoverage=99%, HitCoverage=99%, E-value=1e-153, Identity=58%"; Hit description=Beta- 1,3-glucanase-like protein
  Pfam annotation: Domain name=Glyco_hydro_17; Domain location=29-321; Score=270.0; E_value=4.6e-78; Accession=PF00332.9; Description =Glycosyl hydrolases family 17
  Pfam annotation: Domain name=X8; Domain location=345-430; Score =163.4; E_value=5.8e-46; Accession=PF07983.3; Description=X8 domain
  Pfam module annotation: Pfam domain module=Glyco_hydro_17::X8; Domain location=29-321::345-430
MATLSNPSFLLHLSLIITAMCFAVSQPFIGVNYGQVADNLPAPEASAELLKSTTVGKVRLYGADPAIIKSLANSGIRIVIGAANGDIPSLASDRLGDSVMSSGDESLVSQLLPAMQNVQNALNSAPKIKVSTVHSMAVLTHSDPPSSGSFDPALVNTLQQLLAFQKDNESPFAFNPYPFFSYQSDPRPETLAFCLFQPNSGRVDTGSGKVYSNMFDAQVDAVHAALSSMGFKDMEIVIAETGWPSRGDSNEVGASVENAKAYNGNLIAHLRSLVGTPLMPGKSVDTFIFALYDEDLKRGPASERAFGLFKTDLTMAYDVGLDKSGSTHKNSPTSPITPAPKTGTQWCIPKVEVTEAQLQANIDYICGSQVVDCGPIQPEGACYEPNTISSHAAFAMNLYYQKFGRNPWNCDFSQTAMLTSQNPSYNACVYPGGST

SEQ ID NO: 129036 - protein, 854 aa, Glycine max
  Coding DNA Sequence Number=SeqID_12258
  Gene Ontology: Mol. function=metal ion binding; Cellular component =nucleus; Biological process=regulation of transcription, DNA -dependent
  Homolog annotation: Hit_ID=Q53K34; Match level="QueryCoverage=89%, HitCoverage=79%, E-value=1e-102, Identity=33%"; Hit description=Myb -like DNA-binding domain, putative
  Pfam annotation: Domain name=Myb_DNA-binding; Domain location=201 -246; Score=51.5; E_value=2.7e-12; Accession=PF00249.21; Description =Myb-like DNA-binding domain
  Pfam annotation: Domain name=SWIRM; Domain location=1-68; Score=3.8; E_value=0.037; Accession=PF04433.7; Description=SWIRM domain
  Pfam annotation: Domain name=ZZ; Domain location=141-185; Score=28.6; E_value=2.2e-05; Accession=PF00569.8; Description=Zinc finger, ZZ type
  Pfam module annotation: Pfam domain module=Myb_DNA-binding::SWIRM::ZZ; Domain location=201-246::1-68::141-185
MLPSFFSGKTENRTSDVYMEIRNWIMKKFHSNPNVQIELKDMSQLNVGDSDARQEVMEFLDYWGLINFHPFPSMDSSVATASDDGEAEKSLLLEKLYHFETLQLCPPVQRSSQMTPATTSGLFPESTIAEELVKQEGPAVEMLEYHCNSCSADCSRKRYHCQKQADFDLCTDCFSNRRFGSGMSSLDFILMEPAEVAGVNGGKWTDQETLLLLEALELYKENWNEIAEHVGTKTKAQCILHFVQMPIEDTFVDCDDDVDAGCKETADPVATKSDSSMDKDASECIENHTSDGIKDSEKTSKAEDLEVKVNQKETPKLQEGSDEKASEETSKSEDAVKVKIDQEADNDCAINALKEAFAAVGYSPGPEGPSSFADVGNPVMALATFLAHLVGSDAAVASAHSSIKSMTRNSPGTELAARCCFLLEDPPDSKKEPTSSERDSKSEGDQDEVNVNQDKSTLEDKDLPTDHNNKKIESNALEDKGKPASADDGASEIPISSKEQAVVNNECGLDKCHDLNNAKLPNDQAPGTLHNSGGSTSKAEIPSSSDKAQEETLIEEPCPSVKDRHVSDSLPSETSKDAEMVSDAIPSTKSKPQNPESTNPAHESLETTDSVMDVDGVSNSLPLEKIDSQPLITSKSSQCNGTEKDVEVMSPSNPVRSNSSAENGPNTGKDNADNGAKVEDDGTKTKQDSSFEKVKRAAVSTLAAAAVKAKLLANQEEDQIRQLTSLLIEKQLHKLETKLAFFNDVENVVMRAREHVERSRHKLYHERALIIASRLGIPPSSSRGVPPSIPTNRIPTNIANSLPRPQMMMNPPRPLISRPAGTVATIQNPLTPSTAAGNSVRPSNQEKLSSVGTK

SEQ ID NO: 129037 - protein, 522 aa, Glycine max
  Coding DNA Sequence Number=SeqID_12259
  Gene Ontology: Mol. function=signal transducer activity; Cellular component=heterotrimeric G-protein complex; Biological process =signal transduction
  Homolog annotation: Hit_ID=Q8LJQ7; Match level="QueryCoverage=79%, HitCoverage=97%, E-value=0.0, Identity=66%"; Hit description=G protein beta subunit
  Pfam annotation: Domain name=WD40; Domain location=126-164; Score =20.0; E_value=0.0085; Accession=PF00400.22; Description=WD domain, G- beta repeat
  Pfam annotation: Domain name=WD40; Domain location=175-214; Score =35.2; E_value=2.2e-07; Accession=PF00400.22; Description=WD domain, G-beta repeat
  Pfam annotation: Domain name=WD40; Domain location=222-262; Score =31.7; E_value=2.5e-06; Accession=PF00400.22; Description=WD domain, G-beta repeat
  Pfam annotation: Domain name=WD40; Domain location=267-305; Score =46.9; E_value=6.8e-11; Accession=PF00400.22; Description=WD domain, G-beta repeat
  Pfam annotation: Domain name=WD40; Domain location=314-352; Score =15.8; E_value=0.16; Accession=PF00400.22; Description=WD domain, G -beta repeat
  Pfam annotation: Domain name=WD40; Domain location=383-421; Score =11.8; E_value=1.5; Accession=PF00400.22; Description=WD domain, G -beta repeat
  Pfam annotation: Domain name=WD40; Domain location=55-122; Score =20.1; E_value=0.0081; Accession=PF00400.22; Description=WD domain, G- beta repeat
  Pfam module annotation: Pfam domain module=WD40::WD40::WD40::WD40::WD4 0::WD40::WD40; Domain location=126-164::175-214::222-262::267 -305::314-352::383-421::55-122
MSVTELKERHSAATDTVNNLRHRLKQKRLSLLDTDVSGYARSQGRTPVTFGPTDLVCCRTLQGHTGKSTTVAAYHFSVCGSLNDYGIISSNVNEFEVYSLDWTSEKSQIVSASQDGRLIVWNALTRQKIHAIKLPCAWVMTCAFSPTGQSVACGGLDSVCSIFNLNSPTDKDGNLPVSRMLSGHKGYVSSCQYVPDEDTHLITGSGDQTCVLWDITTGLKTSIFGGEFQSGHTADVLSISINGSNSRMFVSGSCDATARLWDTRVASRAVRTFHGHEGDVNAVKFFPDGNRFGTGSDDGTCRLFDIRTGHQLQVYYQQHSDNDITPVTSIAFSASGRLLFAGYTNGDCYVWDTLLAKVLGALAKHTTTSGSIVSGCTVIEVVLNIGSLQDSHEDRISCLGLSADGSALCTGSWDTNLKSNDVDATDYTGYGVFGVMGISSVLCPMSIIRRVSKASLCQGGPVSRWAWSKENLWGGESDLGGNCGRGVPVRGRGEWGSGDGGGTFHFSLASIAAACLCSCARV

SEQ ID NO: 129038 - protein, 133 aa, Glycine max
  Coding DNA Sequence Number=SeqID_12260
  Gene Ontology: Mol. function=serine-type endopeptidase activity; Cellular component=mitochondrion; Biological process=proteolysis
  Homolog annotation: Hit_ID=O49081; Match level="QueryCoverage=98%, HitCoverage=36%, E-value=6e-40, Identity=66%"; Hit description=Clp -like energy-dependent protease
  Pfam annotation: Domain name=CLP_protease; Domain location=1-132; Score=7.9; E_value=5.2e-09; Accession=PF00574.13; Description=Clp protease
ASQGALLLAGGEKGMRYAMPNARITIHQPQSGCGGHVEDVRRQVNEAVQSRHVSLSSFDLHNSNNLYNFNAPMIFITLKIDFLLTHKKIDKMYSVFTGQPLEKVQQYTERDRFLSVSEALEFGLIDGVLETEY

SEQ ID NO: 129039 - protein, 277 aa, Glycine max
  Coding DNA Sequence Number=SeqID_12261
  Gene Ontology: Mol. function=zinc ion binding; Cellular component =endoplasmic reticulum; Biological process=ER to Golgi vesicle -mediated transport
  Homolog annotation: Hit_ID=Q9M291; Match level="QueryCoverage=85%, HitCoverage=20%, E-value=1e-95, Identity=74%"; Hit description =Protein transport protein Sec24-like CEF
  Pfam annotation: Domain name=Sec23_trunk; Domain location=4-242; Score=264.2; E_value=2.7e-76; Accession=PF04811.5; Description =Sec23Sec24 trunk domain
MSWKGLLMEWLTRKVEWSIVEGPRTLVGVATFDSTIHFYNLKRALQQPLMLIVPDVQDVYTPLQTDVIVPLSECRQHLELLLESIPTMFQNNRTSESAFGAAIKAAFLAMKDTGGKLLVFQSVLPSIGIGALSAREAEGRTNISAGEKFLYILQRNPILVEFQEAHKLLQPADKAFKELAVEFAEYQVCVDVFVTTQTYVDIASISVIPRTTGGQVYYYYPFSALSDTAKLYNDLRWNITRPQGFEAVMRVRCSQILDVTICMCIGNLEHIYICVRA

SEQ ID NO: 129040 - protein, 105 aa, Glycine max
  Coding DNA Sequence Number=SeqID_12262
MAQERVASLPLFGNLWDNIYGSLSPVESPTVATCPSRASEGEARGCAFQRRKDAWSRQQRLFVENVGKTEGNRSKMKILSSGVVFTLEEGISTSYVYLERQQPYF

SEQ ID NO: 129041 - protein, 41 aa, Glycine max
  Coding DNA Sequence Number=SeqID_12263
MAAPERKSNLKGGSVTFNAFVVFKRHRLLRFISSTLISNVF

SEQ ID NO: 129042 - protein, 251 aa, Glycine max
  Coding DNA Sequence Number=SeqID_12264
MEDADAYAVGMNPWEQHSGVIKLPRYDYNSPSSLLFSSLLRNSHSDFLITCTISSVNSLTSLHSHSSPSNLPFHFFNSSFHSATKEAISILHKFVAYDSSNNPKEEGTSSKKRKLCTQDTADEYYTMSMILMAGVKAEGEKDGVACLSLVKLTRNGLLLLNFPSNTPPNTVNIVSNIIQALESGTVTLPVIQSLSNKREIVSSDFRIKKIEYARADVPQPRKIPLPPSYKPKLKVLGSNCKVQDLNPTLEI

SEQ ID NO: 129043 - protein, 56 aa, Glycine max
  Coding DNA Sequence Number=SeqID_12265
MWQQQKQVMQNLSLHVKKRLSFELQKVVVGLSSAVELSAYPPLSAASVHLAQRRIC

SEQ ID NO: 129044 - protein, 44 aa, Glycine max
  Coding DNA Sequence Number=SeqID_12266
MLLVLVIPCPCRDLNGIGFLLKRFNNDELRKGSFRCWIKWPQNN

SEQ ID NO: 129045 - protein, 105 aa, Glycine max
  Coding DNA Sequence Number=SeqID_12267
MPESAEVVAKAGSVVMVVMVLEERQKEWRELTALSLSLKCVSVIMMEMAEGKGKGRNAGNSWPNGMMGYETVQRTLNKMRPWALLASDRIGVETAQASRPPVPLA

SEQ ID NO: 129046 - protein, 60 aa, Glycine max
  Coding DNA Sequence Number=SeqID_12268
MEGPTIHEKNVIRVFFFPLESSYMEWNYGFEEGISTPMVYWSFRQKIHHDFKKAKREGVS

SEQ ID NO: 129047 - protein, 39 aa, Glycine max
  Coding DNA Sequence Number=SeqID_12269
MEEDDSDAGGDGGGHMLIPLNRVFLKRTGMTKLRHHISL

SEQ ID NO: 129048 - protein, 466 aa, Glycine max
  Coding DNA Sequence Number=SeqID_12270
  Gene Ontology: Mol. function=DNA binding; Biological process =regulation of transcription, DNA-dependent
  Homolog annotation: Hit_ID=Q1S9D7; Match level="QueryCoverage=75%, HitCoverage=79%, E-value=2e-19, Identity=35%"; Hit description =Transcriptional factor B3; Cupredoxin
  Pfam annotation: Domain name=B3; Domain location=256-355; Score=32.2; E_value=1.8e-06; Accession=PF02362.12; Description=B3 DNA binding domain
  Pfam annotation: Domain name=B3; Domain location=372-465; Score=42.8; E_value=1.2e-09; Accession=PF02362.12; Description=B3 DNA binding domain
  Pfam annotation: Domain name=B3; Domain location=4-70; Score=13.1; E _value=0.0024; Accession=PF02362.12; Description=B3 DNA binding domain
  Pfam module annotation: Pfam domain module=B3::B3::B3; Domain location=256-355::372-465::4-70
MEVACQIQCLSSLYGNEWKVNWTKQNGEVWFEKGWKEFVEHYSLDQGRLIFFKYEGTSQIDVLILDQSALEIDYPCDTCDENDNLDHTHEAPDIIFGEWPYQKAGQMTEAYSLDLDHLLVFKYVGRSEFQVVILDQSGLEMSYPLTEATLDGEDNGNSLPQSKRASSPLPFSPSTKKVKTNTRKETNAYPLQDEDVETKCAQSKRNKAKKRGGRRVMYANRRFSKSKAIQNEELLQNTESSTALERANYFHSENPFFIREMHKSYIKYHILAMPGNFITEDQQKENDHVFLWISEERTWNVKFYPNRCSGQIILGAGWMEFLKDNNLKIGDLCVFEQIKKPGISFRVVIFRDREQSSASQVSRCNNEMLENDFTLSVKPNQNYMSIPIEFARNHGMENITKVILRVGNRSWPVKLNYYSKHNYCRLTSGWSEFMSQCKLKSGDVCHFELIDKGKFVFEVRVTGCID

SEQ ID NO: 129049 - protein, 326 aa, Glycine max
  Coding DNA Sequence Number=SeqID_12271
  Gene Ontology: Mol. function=protein binding; Cellular component =nucleus; Biological process=mRNA processing
  Homolog annotation: Hit_ID=Q9ZVX7; Match level="QueryCoverage=99%, HitCoverage=100%, E-value=1e-108, Identity=61%"; Hit description =Expressed protein
  Pfam annotation: Domain name=SYF2; Domain location=153-319; Score =300.5; E_value=3.2e-87; Accession=PF08231.2; Description=SYF2 splicing factor
MSDERAVHPDCRNASNPYHECSDYCFRVIAEAKIRSQQQESEVGQASGGSNSKQAIPDESYLGEEIHDDRPDLEENSDSDPDQPALQEAEQEEVDYTKLSARQKKWMELRAKMKTKTEDALFSWQQEAKKRNQIEIAAEKKRMEAPTESRGVSKQKWLEDRKKKIGKLLDANGLDMTKAYMLDTQEAAEEKYKKWEKDPAPFGWDVFNQKTLYNAYKKRTKNVEVDVEEYNRMKEADPEFYRDASSLQYGKAPKISEEKIDKMVQELKNRDEKRNSFSRRRRFHEEKDIDSINDRNEHFNKKIERAFGKYTLEIKNNLERGTALPD

SEQ ID NO: 129050 - protein, 474 aa, Glycine max
  Coding DNA Sequence Number=SeqID_12272
  Gene Ontology: Mol. function=DNA binding; Biological process =regulation of transcription, DNA-dependent
  Homolog annotation: Hit_ID=Q1SCZ2; Match level="QueryCoverage=98%, HitCoverage=94%, E-value=2e-44, Identity=28%"; Hit description =Transcriptional factor B3
  Pfam annotation: Domain name=B3; Domain location=222-321; Score=16.0; E_value=0.0011; Accession=PF02362.12; Description=B3 DNA binding domain
  Pfam annotation: Domain name=B3; Domain location=381-473; Score=26.0; E_value=7.9e-05; Accession=PF02362.12; Description=B3 DNA binding domain
  Pfam annotation: Domain name=B3; Domain location=9-104; Score=31.1; E_ value=3.8e-06; Accession=PF02362.12; Description=B3 DNA binding domain
  Pfam module annotation: Pfam domain module=B3::B3::B3; Domain location=222-321::381-473::9-104
MSSHGRNIHFFKRIEEDTIRKGELRIPRSFVNKYWEGISNPVLLLLPKGAEWNVKWKKLDADIWLIDEWKKFAEFCSLDQEHLLVFKYVGKSRFQVVTFDQNGLEMQYPLMSETLLDGNSICQRKRAKSPFSHSPSIKKVKTNPRKEPANYPSHDVKTEPAQSQRANVELSKNFHADDLVKAKPKKRGGRRRIMCSKSKAIQNTESSTALERANSFRSENPFFICAMRKTYIQRSVLFMPGNFITEDQQREDDHVFLWISSERAWHVKFYPSHSSGQILLSIGWMDFVKDNNLKIGDVCVFDQIKKPGISFRVVIFRDTEESSPSKFPAYDKDGANGSKQTGLQNVIAKRGSDGIPKKYSENNNFDDSEFRRCNNEVSENDFTLSISKPCQFYCMYVPKKFIRSHEMDHINEVKLQVGKRSWNVKLDCYGRFTSGLHDFLSQCNVEAGDVCHFELIDKKKFVFEVRVTRCISID

SEQ ID NO: 129051 - protein, 440 aa, Glycine max
  Coding DNA Sequence Number=SeqID_12273
  Gene Ontology: Mol. function=oxidoreductase activity, acting on the CH-OH group of donors, NAD or NADP as acceptor; Cellular component =peroxisome; Biological process=metabolic process
  Homolog annotation: Hit_ID=Q93XV7; Match level="QueryCoverage=87%, HitCoverage=98%, E-value=0.0, Identity=85%"; Hit description =Hydroxypyruvate reductase
  Pfam annotation: Domain name=2-Hacid_dh; Domain location=31-359; Score=60.0; E_value=7.9e-15; Accession=PF00389.20; Description=D -isomer specific 2-hydroxyacid dehydr
  Pfam annotation: Domain name=2-Hacid_dh_C; Domain location=128-327; Score=232.6; E_value=8.5e-67; Accession=PF02826.9; Description=D -isomer specific 2-hydroxyacid dehyd
  Pfam module annotation: Pfam domain module=2-Hacid_dh::2-Hacid_dh_C; Domain location=31-359::128-327
MAKPVSIEVWNPSGKYRVVSTKPMPGTRWINLLIQNDVRLEICTEKKTILSVEDIIALIGDKCDGVIGQLTEDWGEELFSALSKAGGKAFSNMAVGYNNVDVDAANKYGVAVGNTPGVLTETTAELAASLTLAAARRIVEADEFMRAGLYDGWLPHLFVGNLLKGQTVGVIGAGRIGSAYARMMVEGFKMNLIYYDLYQSTRLEKFVTGMFLPTYAAFLKANGETPVTWKRAATMDEVLQEADIISLHPVLDKTTYHLVNKERLAKMKKEAILINCSRGPVIDEAALVEHLKHNPMFRVGLDVFEEEPYMKPGLAELKNAIVVPHIASASKWTREGMATLAALNVLGKVKGYPVWFDANKVEPFLNENARPPAACPSIVNAKALECRWHCAYKDCDVNKHHLHRCLMILHTSKQNVNKSITAEHNISTMTDHERTLKLTN

SEQ ID NO: 129052 - protein, 452 aa, Glycine max
  Coding DNA Sequence Number=SeqID_12274
  Gene Ontology: Mol. function=DNA binding; Biological process =regulation of transcription, DNA-dependent
  Homolog annotation: Hit_ID=Q1SCZ2; Match level="QueryCoverage=89%, HitCoverage=88%, E-value=1e-32, Identity=25%"; Hit description =Transcriptional factor B3
  Pfam annotation: Domain name=B3; Domain location=237-330; Score=45.0; E_value=2.6e-10; Accession=PF02362.12; Description=B3 DNA binding domain
  Pfam annotation: Domain name=B3; Domain location=358-451; Score=38.7; E_value=2.1e-08; Accession=PF02362.12; Description=B3 DNA binding domain
  Pfam annotation: Domain name=B3; Domain location=38-122; Score=21.9; E_value=0.00024; Accession=PF02362.12; Description=B3 DNA binding domain
  Pfam module annotation: Pfam domain module=B3::B3::B3; Domain location=237-330::358-451::38-122
MSSHVSDIHFFKRIEEETLRIGELILEAVVSKLKCGYIFSYKGIPRSFVNKCWEGISNPVVLVLPNGAEWKVNWKRLDLDVWLIDEWKKFAQVLSLDKDHLMVFRYVGNSQFQVVILDQSGLEVGYPLINATLDGEETGNVFHQRKKRAKSPLPISPSTKRVKTNPRKEPTNPGQDVETRHAESERTKAKKRGRRRMMYANKRCSKSKAFQSEELLEDNESSTALERANSFRFENPFFIRQMYPSYIQKHFMAMPGNFISEGQRMEFDSVTLWSSEEKTWHVNFYLNRSSKQIILGAGWGDFVKDNNLKIGNVCVLEQIKKPGISFRVVIYRYLEESNPSKFPDSEFRRCNKEMSENCITLFIKPNQSNMIIPMKFVRNHDMENVAKVILRVGNGSWPVRLDHCPKHSYCRLTFGWSNFMSACKLKAGDVCNLELVNKDRFVFQVRVARCIH

SEQ ID NO: 129053 - protein, 182 aa, Glycine max
  Coding DNA Sequence Number=SeqID_12275
KWALAANKDSVDDTVYEKYDISRMCGKRHRPSISKTLPPTCCLMGKKLEKTSQSGSTKAVIDPSSSIRRHVKWKLACTKKTGQMTSEAAKEIAEKILRFFGEAGATGFLCPLWTSGSPNYCPWFFLHVSRRTRAADSTNQGPAGGVNHRKSDSTANVIPSARCSPKLQFTDLITGTCTGSRA

SEQ ID NO: 129054 - protein, 87 aa, Glycine max
  Coding DNA Sequence Number=SeqID_12276
MSRDFIYCATKDAKYLKAANQRLHVINCYTENKRGYISCGSVQVEGTSTWLFKEDKGGYIPCGSLACKGFYKVERNLQNRWLLGDMM

SEQ ID NO: 129055 - protein, 202 aa, Glycine max
  Coding DNA Sequence Number=SeqID_12277
  Gene Ontology: Mol. function=RNA-directed DNA polymerase activity; Cellular component=intracellular; Biological process=RNA-dependent DNA replication
MTIYRKSHLVQGKFTQASWSSPRRASCLGLRVSARPDEESKDEEDISLELLRLVEQETKNIHPHEQPVDIINFGTKDEKKDVKVDTLISKNECNKLIKLLHEYTDVFAWSYRDMQGLYISLKIREEVKKQLNTGFVVVAKYPQWVANIVPIPKKDGKVQMSVDCRDLNRASQKDDFPLPHIDVLVDNTSQHSFFSFMDGYSE

SEQ ID NO: 129056 - protein, 266 aa, Glycine max
  Coding DNA Sequence Number=SeqID_12278
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=4e-30, Identity=33%"; Hit description= UPI00006A17C9 related cluster
MSSPSGDYTSLTSEDYTSFPSEDYTSSPSEDYKSSPSVDYMSSPSEDYRSLPLADYTSSPSESYTPWPSEDYMSTPSEDYTSTPSEDYTSSPSEDYTSTPSEDYTSSPSEDYTSSPSEDWTTKRPRPQRTDVLTFRRLHALTFRGLYVLSLRGPHVLAIRGLHALTFRGLYVLPFRGLHALAFRRLLALIFRGEHVVSFRGLHVLAIRGLHALTIRGLHILAIRGLHILTIRGLHVLAFRGLHVLAFRGLQVLTFRGLHVLTFRGL

SEQ ID NO: 129057 - protein, 197 aa, Glycine max
  Coding DNA Sequence Number=SeqID_12279
YPELRRSEFLIGGYVGAKASLFVDHTAFCYHDPRAGSPRRHLTVIRTSSVINKRRPIWSSAPFPEMIRRSKSLAFVGRPTSSVILTLRDKIGSFCTLCHPEAAGPMTSRDKIWSFCTLVSSRGGGPDDTRRYLTVIRTLCHPEAAGPMTSRDKIWSFCTLVSSRGGGPDDTRRYLTVIRTLLSSRGGGPDDTRRYLT

SEQ ID NO: 129058 - protein, 328 aa, Glycine max
  Coding DNA Sequence Number=SeqID_12280
  Homolog annotation: Hit_ID=Q6U5M1; Match level="QueryCoverage=34%, HitCoverage=38%, E-value=3e-25, Identity=53%"; Hit description =Putative cytoplasmic protein
  Pfam annotation: Domain name=Transposase_31; Domain location=1-102; Score=-78.3; E_value=3.2e-08; Accession=PF04754.3; Description =Putative transposase, YhgA-like
MAALTLLQKHIHRRDLADLLDRLAATLLAGHLTGQQLVSLINYLVQAGETDDAEAFVRNLALRVPQHEDELMTIAQQLEQKGREKGRMEGKMEVARNLLAKGIPLESVRELTGLKFMSTALYKLLDDGAQMLSSFLPAELRTLLNAGAQLFSPLIEKNLMGSPLGWLLVAAVWVQGLAMIGVIMGSATPSVKKQGAPETSAIIENSIHSTTISSTLACKSGHGDGVEKAPGGCAAHDGDPVKTRQHHDAGNAENGGILDKFVMQRTIQALRAGCVCPKGWCSNASSPVFHIVKRDPSDCAGDSKPRQGNCRFAARQPEKARGQNRNQQ

SEQ ID NO: 129059 - protein, 68 aa, Glycine max
  Coding DNA Sequence Number=SeqID_12281
MGALSTRRDNVLAGQTGCALDVQISDLSSSRVFYPLSELDASLSRCISLSQFVSLSESSTTLTFSYLA

SEQ ID NO: 129060 - protein, 173 aa, Glycine max
  Coding DNA Sequence Number=SeqID_12282
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=2e-13, Identity=33%"; Hit description= UPI00006A17C9 related cluster
YLSPSEGYTITFRGLHALTFRGLHALTFKGLHVLAFRGLHVLAFRRRHALTIRDLQVLAFRGLHILTFEGLHALAFRGPHVLAIRGLHAFTSRGLHVLVIRGLHTLTFKGLHRAARPHLQKTTRPHLQRAARPHHQRAARPHHQRAPRPHLYRTTHPHHERAARPDLQRNYTS

SEQ ID NO: 129061 - protein, 77 aa, Glycine max
  Coding DNA Sequence Number=SeqID_12283
MAELCLVPGVVIHPKFIVPDFDKYKGTTCPKNHLMMYCKKMGAYVKDEKLLMHFFQESLAGAAITWYTNLESSRVHS

SEQ ID NO: 129062 - protein, 100 aa, Glycine max
  Coding DNA Sequence Number=SeqID_12284
MKVDMEIMKELMTTMMEAMMSMRKTIEDNTATVVAMSTAIKMDPIHPVDFNQVNHPVSDVVGQGGEATKNACGPHHVQIQRKHSFLLYGLPLNYTLPTVV

SEQ ID NO: 129063 - protein, 152 aa, Glycine max
  Coding DNA Sequence Number=SeqID_12285
  Gene Ontology: Mol. function=protein serine/threonine kinase activity; Cellular component=cell surface; Biological process =protein amino acid phosphorylation
  Homolog annotation: Hit_ID=Q9M020; Match level="QueryCoverage=84%, HitCoverage=18%, E-value=9e-28, Identity=44%"; Hit description =Receptor like protein kinase
  Pfam annotation: Domain name=Lectin_legB; Domain location=20-151; Score=16.1; E_value=1.7e-11; Accession=PF00139.10; Description =Legume lectin domain
MAPKNLFGLLIFLILLVTCTAFSFQFHGFHNSERNLTREGDSNVTPQGILQLTKRENNIVGHAFYNKPIKILEKTNSSVPQTKFSSFSTCFVFSIVPPNSGLGGFGLAFTIAPTTQFPEAEGGHFLGLFNNSNDMNTSNHILVVEFDTVNGY

SEQ ID NO: 129064 - protein, 118 aa, Glycine max
  Coding DNA Sequence Number=SeqID_12286
MDLVTKDEHRKAHIYACKADLPGQKEEEARAQSADGKVFKIVPWHHLEHSTSNSLSIQALSHDLTGLDRSYFLKLFMSLHAMFAFTQRGGFDQIDKDDSNLPLDTAPIKHVTQEILNL

SEQ ID NO: 129065 - protein, 96 aa, Glycine max
  Coding DNA Sequence Number=SeqID_12287
MESKTNEEVFRKCKRPNFSFSHKWQISHPIRICPTLSPHFSLQIPPTPSSPSPLIPLFIEIQGIDQETLPATNPMRAQWCSGCDCVGAQWLWRLHG

SEQ ID NO: 129066 - protein, 288 aa, Glycine max
  Coding DNA Sequence Number=SeqID_12288
  Gene Ontology: Mol. function=transcription factor activity; Cellular component=intracellular; Biological process=regulation of transcription, DNA-dependent
  Homolog annotation: Hit_ID=Q8U7E6; Match level="QueryCoverage=39%, HitCoverage=42%, E-value=5e-54, Identity=89%"; Hit description =Creatinine amidohydrolase
  Pfam annotation: Domain name=Fe_dep_repress; Domain location=187-235; Score=2.4; E_value=0.045; Accession=PF01325.10; Description=Iron dependent repressor, N-terminal DNA binding domain
  Pfam annotation: Domain name=MarR; Domain location=180-249; Score =63.4; E_value=7.5e-16; Accession=PF01047.13; Description=MarR family
  Pfam annotation: Domain name=TrmB; Domain location=175-246; Score= -9.1; E_value=0.033; Accession=PF01978.9; Description=Sugar-specific transcriptional regulat
  Pfam module annotation: Pfam domain module=Fe_dep_repress::MarR::TrmB; Domain location=187-235::180-249::175-246
MGVQHHEFAHPSFMFQLGDAEPALDGLIVSQRLRARHIHVFDGISDRLRWQEGDGQMTGQGGGKAGDDAFSNQSIGLEGQVGAMLFMRAERQHGNCACCVKMRVCYVFVVIMRGKRHSRMSKDKSGNKDKSAKKDKGGKKVKDAKKRDENFNPEELAQSITQAARSMRTALSHSLAESGLYAGQDGVILALAQEGSLTPGQIAQKLGVKAPTMTRTIGRMEAQGFVERSGDDGDGRVTLVKLTEAGLKSVEHINVSIANCGAKAVEGLSAKDIRNIVKLLKAIDANLQ

SEQ ID NO: 129067 - protein, 114 aa, Glycine max
  Coding DNA Sequence Number=SeqID_12289
MSFLTSVFQKTDVNVSSEQRKNNIHNRGKEKRSLVRVDVAKEGSKISHVRLRVAFVKRTRGDTCKIKDFDTEIIEYLPRDKEVTTYSNNGCLEITCQFGSSPAKRGTSMLMRQG

SEQ ID NO: 129068 - protein, 93 aa, Glycine max
  Coding DNA Sequence Number=SeqID_12290
  Gene Ontology: Cellular component=integral to membrane
  Homolog annotation: Hit_ID=Q1SGC5; Match level="QueryCoverage=82%, HitCoverage=30%, E-value=5e-20, Identity=55%"; Hit description =CD9/CD37/CD63 antigen
  Pfam annotation: Domain name=TMC; Domain location=6-91; Score=-55.9; E_value=0.041; Accession=PF07810.3; Description=TMC domain
MACRGCWECLLKLLNFILTLAGLAMVGYGIYLFVEYNKTPDNTLTVGDDQTLVQLGRPMLVAVSLSNSFLDDLPKAWYECCSSPANFWGVSNE

SEQ ID NO: 129069 - protein, 79 aa, Glycine max
  Coding DNA Sequence Number=SeqID_12291
  Gene Ontology: Cellular component=integral to membrane
  Homolog annotation: Hit_ID=Q9ZRD9; Match level="QueryCoverage=87%, HitCoverage=63%, E-value=4e-33, Identity=98%"; Hit description=GMFP4
MALLFVLALIVRAANRPTEYDSDEEYINPRQQARQPLLNRPAGPVSGAPATGTLDQRPSRNDAWSTRMREKGTYFSHLQ

SEQ ID NO: 129070 - protein, 353 aa, Glycine max
  Coding DNA Sequence Number=SeqID_12292
MSEVEEVQDQMKADMEAMKDQMAAMKDQMAAMMEVVLSMKKIMEGNAAVVTTTSVAIEVDPTHLSGLNQVNHPASDMVGQGGKLLRSMGGPHFVQVQNKHSFPQYGLPPNYTPLNVAHTPNEDDNNSASMPIESQHPQYDHAHVSQPIGETHEASRDHNLVDSEPCLEYFTEGQAFCGVPLPKSLEGPQYLPQPQPLPFVMGIVPLAMVEREKFNHIEERLRAIEGGGGHAFADMAELCLVPDVIIPPKFKVLDFDKYKGTTCPKNHLKIYNKKMGSYSKNEKLLMHFFQENLTGATVTWYANLEPSRVHSWKDLMVSFIRQYQYNSDMASNRMQLHNLCKKKHESFKEYAQR

SEQ ID NO: 129071 - protein, 130 aa, Glycine max
  Coding DNA Sequence Number=SeqID_12293
MRKKNKKKKDSKALSSKAKGKEKEEKDSSKKIVKKEIRFATKGDIKRALLLKQSFYLLLSRETSHSTATIPHRTLGYVGVKKEAKLELQKSSSWAKRITTAKRSLSALSANENLAEHQYQSHTLSARSVR

SEQ ID NO: 129072 - protein, 248 aa, Glycine max
  Coding DNA Sequence Number=SeqID_12294
  Homolog annotation: Hit_ID=Q47522; Match level="QueryCoverage=22%, HitCoverage=75%, E-value=2e-16, Identity=72%"; Hit description=LacZ protein
VPPVQLLTGWCVTAKAPPDISAGKCSGHAARRVPFAIQAAQLLGRAIGAGLFAITPAGERGMCCKAIKLGNARIRLFASKFGVPIYATRLVGGVMAVAFSRGLNKVRSETMKEIAALWLVIISSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 129073 - protein, 216 aa, Glycine max
  Coding DNA Sequence Number=SeqID_12295
  Gene Ontology: Mol. function=structural molecule activity; Cellular component=flagellin-based flagellum; Biological process=ciliary or flagellar motility
  Homolog annotation: Hit_ID=Q1LLE7; Match level="QueryCoverage=99%, HitCoverage=33%, E-value=3e-40, Identity=43%"; Hit description =Flagellin-like protein precursor
  Pfam annotation: Domain name=Flagellin_C; Domain location=151-216; Score=51.2; E_value=3.5e-12; Accession=PF00700.11; Description =Bacterial flagellin C-terminus
  Subcellular localization annotation: CTP_CleavageSite=45; ConfidenceScore=5.38e-01
MEVDNGGGSYQYYNAAVSATSDGTSNALSIVATSASSINSFSAVNSVTGTSYIRLDPANVDVRYTDVDGNSSNDVLKLDADGNYYMDVPNGNLDKTATFVRSDSSGNLMLKTLQGVGDVQIYFQAALSSVTDASTNFTTLRVAETGSEIRLKHPDDPLATLDRAIGQIDSQRTRLGAVANRLLSAQTLQGNATAAIAASRSRIEDADYATEASSLS

SEQ ID NO: 129074 - protein, 84 aa, Glycine max
  Coding DNA Sequence Number=SeqID_12296
  Subcellular localization annotation: CTP_CleavageSite=48; ConfidenceScore=5.54e-01
MPISPCGSISWSVPSRHRDRTHKTPSGPGKVQQGPGVSSSGYGPLSVLQGARTPPARSRHHRDRACETPSGPEEVQQGLGVVKL

SEQ ID NO: 129075 - protein, 81 aa, Glycine max
  Coding DNA Sequence Number=SeqID_12297
MTGDESKFTHISPKNSGHVTYGDNTKGKHDQEIKYVGHRTNYVYMINLDKTSNNAQCFLSKEDESWLWHKRIAHINMEHLK

SEQ ID NO: 129076 - protein, 102 aa, Glycine max
  Coding DNA Sequence Number=SeqID_12298
MSDSSASHIETLEIEQRKLSTYSNGHNYSHGGVSHIETLEIEQRKLSRYSNGHNFSHGGPIQAHNTSRCSKWNNGSSQEIQMVETFHTNVRFRRMTYLEARN

SEQ ID NO: 129077 - protein, 83 aa, Glycine max
  Coding DNA Sequence Number=SeqID_12299
MTDLVKVADKSEALAPTLEKSPSEDADISGKGAVATYPSAGGRRETRGRRVPRKEYARSRHQRLFEENVGKTGKDAIYKLLSE

SEQ ID NO: 129078 - protein, 169 aa, Glycine max
  Coding DNA Sequence Number=SeqID_12300
  Subcellular localization annotation: CTP_CleavageSite=41; ConfidenceScore=5.45e-01
MAEPSKKRKGSSSTAAAAAHRRHGPSETPTTSILPYLSSPRSSTLFSSDDQRLRYLSQFSSRIILDPKYLDVEFFNDETFDCYQVFQNSGLVDFMSLKLPYYPELVKVFYCNLKIQDGVIISEVHGIPMVIDQSLFFSLTNLPSQGAPFEGTIVDDWKFDYSSHDARRM

SEQ ID NO: 129079 - protein, 85 aa, Glycine max; identical to SEQ ID NO: 126814
  Coding DNA Sequence Number=SeqID_12301

SEQ ID NO: 129080 - protein, 167 aa, Glycine max
  Coding DNA Sequence Number=SeqID_12302
  Gene Ontology: Mol. function=hydrolase activity, acting on acid anhydrides, in phosphorus-containing anhydrides
  Homolog annotation: Hit_ID=Q665W1; Match level="QueryCoverage=98%, HitCoverage=78%, E-value=2e-65, Identity=73%"; Hit description=ADP -ribose pyrophosphatase
  Pfam annotation: Domain name=NUDIX; Domain location=12-153; Score =71.8; E_value=2.2e-18; Accession=PF00293.18; Description=NUDIX domain
MSGEVVREVFERGHAAVLLPYDPLRDEVVLIEQIRIPAFDSSPTPWLLEMVAGIIEPGETPEDVARREAVEEAGLKVGRVKPIVNYLASPGGTSERLSVLVGEVDASLAEGNHGLEEENEDILVHVVSREQAYRWVEEGIIDNAASVIALQWLALHHEKLRQEWKLK

SEQ ID NO: 129081 - protein, 106 aa, Glycine max
  Coding DNA Sequence Number=SeqID_12303
MYTYIHNLGLPLIIGKKKNKLLVSSKKDFGSTSNIGLPKFFQRPVVVKEGILKCNVAPCRACRPWIFFINGVICFLKINGNEIKKEERRFEMPLQGEDESRRSSPP

SEQ ID NO: 129082 - protein, 51 aa, Glycine max
  Coding DNA Sequence Number=SeqID_12304
MDTRLRVIGDPMNGVQRVATKLGGGHKPLFEDSPSECGGGATTVRYGLISK

SEQ ID NO: 129083 - protein, 340 aa, Glycine max
  Coding DNA Sequence Number=SeqID_12305
  Gene Ontology: Mol. function=receptor activity; Cellular component =endoplasmic reticulum; Biological process=intracellular protein transport
  Homolog annotation: Hit_ID=Q9FH68; Match level="QueryCoverage=55%, HitCoverage=83%, E-value=1e-11, Identity=27%"; Hit description =Arabidopsis thaliana genomic DNA, chromosome 5, TAC clone:K16E1
  Pfam annotation: Domain name=Bap31; Domain location=154-322; Score= -85.1; E_value=0.047; Accession=PF05529.2; Description=B-cell receptor-associated protein 31-like
MWVAFQEWKNIGVMGGKYYNLNEGQFLTTDVLVNLEGLAVYLNLPNEGLQLFHNNSFELVGTSRKDVVTHFIGKNNVDVKSKDLPPMGLKTFPLPNFVSFYFSHLFSASTSDGGILSLSLEINASKWQKGLCLFDLRRVLLFIKCKERKRMIQLLFMVIFVEGVLAFLLLVKIGPLRDLVIKSLDQLKMGKGPATVKTIAGTMSVILLSSLMSIVKIQNKGAKLGTMSPMDQVLWRTHLLEASLMASKEELENLKKETVQLKEKDEKASKEIKQLKEELSHLSKSLEKIKLESEEKDKKVETAEAHVASLQKQAADLLLEYDRLLEDNQNLQAQTLGHKS

SEQ ID NO: 129084 - protein, 155 aa, Glycine max
  Coding DNA Sequence Number=SeqID_12306
  Gene Ontology: Mol. function=translation initiation factor activity; Cellular component=cytoplasm; Biological process=translational initiation
  Homolog annotation: Hit_ID=Q1SC61; Match level="QueryCoverage=72%, HitCoverage=100%, E-value=9e-44, Identity=80%"; Hit description =Translation initiation factor SUI1
  Pfam annotation: Domain name=SUI1; Domain location=67-148; Score =144.4; E_value=3e-40; Accession=PF01253.13; Description=Translation initiation factor SUI1
MGWSMLISSFVWCVEDYFDAMINDTGLSNLVGRTFGLRESSFMSELDDQIPTAFDPFADANADDSGAGSKEYVHIRVQQRNGRKSLTTVQGLKKEFSYNKILKDVKKEFCCNGTVVQDPELGQVIQLQGDQRKNVSTFLVQAGIVKKEHIKIHGF

SEQ ID NO: 129085 - protein, 39 aa, Glycine max
  Coding DNA Sequence Number=SeqID_12307
MTDLKRELFPEALLKRRELTSMRLADQSGMEIWGTGILF

SEQ ID NO: 129086 - protein, 1105 aa, Glycine max
  Coding DNA Sequence Number=SeqID_12308
  Gene Ontology: Mol. function=RNA-directed DNA polymerase activity; Cellular component=chromatin; Biological process=chromatin assembly or disassembly
  Pfam annotation: Domain name=RVP_2; Domain location=203-322; Score= -51.7; E_value=0.011; Accession=PF08284.2; Description=Retroviral aspartyl protease
  Pfam annotation: Domain name=rve; Domain location=684-843; Score =44.0; E_value=5.2e-10; Accession=PF00665.16; Description=Integrase core domain
  Pfam module annotation: Pfam domain module=RVP_2::rve; Domain location=203-322::684-843
  Subcellular localization annotation: CTP_CleavageSite=25; ConfidenceScore=5.32e-01
MNGSLSPPSTWMVVPWSGTNGWPTMANSLPGQVASMPYKRDFADVANRRVGLPPHFLLSCFISRLNPDIRCEVQALQPLKLVQAAGLVRLQEKKLAETRRALRSRMPSFSTSTVPQTHTQISLPPSPRGLPAQLLSLVPLKRLTPEELASRRERGLCFKCNERYHRGHRCQARVNLLIVDDEERSTEDAVSLGLSPDPPDPTDPNEVQLNLHSLTSPLAPETFCFSGFVASKQVLILVDGGSTHNFIQDAMLAELGLSPCDTTPLKVMVGNGQYLHCNQICTAVLIVIQGVEFIIDLHVLPLCGANIVLGGRTIGFKGEDTSTLQPFSVNQVRCLVRTAGASACFLLSVTPLEPPSATTSPSTYPPKIHSLLNKFASLFQSPQALPPSHPTDHHIHLAPNSEPVNVCPYRYPHYQKAEIESQSIECSNDQDHFPIPTIDELLDELGGASSATLEDHVFHLEQAFQVLLQEQFILKLAKCIFAQPQWPKPRSARALRSFLGLAGFYRRFIYGYATIILTSTPVLRLPDFTLPFTVETDASGTGMGAVLSQQGHPIAYFSKNFPPKLLGASTYVRELFAIMTAVKKWRQYLLGQRFNILTDHCSLKELLTQEFKAQLDQFPDYIQLRQSIVDHPDQNPEFSITKDFILHKGRIWLPSNLPFLHTLLQEYHCTPTGGHMGVAKTLAHLTKNFYWTVVPTTGTLSAMGGLIPGFHHRAAGIPRQYYHLGMLPTHHTAYTVAILFMDLVGKLHGMPRSLVLDCDPLFLSKFWQELFCLSGGTKLQLSYAYHPQSNGQTEVLNRVIEQYLRAFVHKKPSSWGKLLGWVEWSYNTSWNSSSGLSPYEITFGKKPFNFSQYLAENSNIDVVNVMLTDREAIFTEIKKKLEKAQNRMEYLADKKRREAEYQVGDMVLVKLRPHRQISVSGQPSGHSKLAKRFYGPFRVVERIGFTTYKLQLPEEARIHPVFHCSLLKSYYSTEFDTNPHSTTLLWQGLSPEDMTWEKWDQLQADYHLEDKVLSKVARNDSNIGARPRRKSRAPTYLKDFTSRALTGGRRHVAAAAGGAAGGAGGAGSALQQSAEGRALHAGATGRALHAGASRRAVPEAPWFAP

SEQ ID NO: 129087 - protein, 76 aa, Glycine max
  Coding DNA Sequence Number=SeqID_12309
MKKDGMQLYHHRKVFLSLHNNPLALCNDDSENHGDADDDGIDEPDDEEEEEAAGGKEEDEEHNSLHGTKITNNAPH

SEQ ID NO: 129088 - protein, 198 aa, Glycine max
  Coding DNA Sequence Number=SeqID_12310
  Gene Ontology: Cellular component=membrane
  Homolog annotation: Hit_ID=Q5JLH8; Match level="QueryCoverage=65%, HitCoverage=16%, E-value=1e-44, Identity=65%"; Hit description =Putative ERD4 protein
  Pfam annotation: Domain name=DUF221; Domain location=1-197; Score= -174.1; E_value=0.025; Accession=PF02714.6; Description=Domain of unknown function DUF221
MALWKFIKSFLQDLLPGLALKIFFYILPTVLMIMSKIEGYIALSTLERKTAAKYYYFMLVNVFLGSIVTGTAFQQLHAFLHQSPTQILRTIGVSIPMKATFFMTYIMVDGWAGIAGEILRLKPLVIYHLKNMLSKKCVSISTRGVHRVEYQLPNLFVGAITKESLYSAFENGITAEQIDGNDLFLAMLLLGIRGLVLN

SEQ ID NO: 129089 - protein, 394 aa, Glycine max
  Coding DNA Sequence Number=SeqID_12311
  Pfam annotation: Domain name=Transposase_21; Domain location=1-128; Score=-138.8; E_value=0.0092; Accession=PF02992.5; Description =Transposase family tnp2
MAGPTQPENDINVYLALLIEDLRKLWEDRVDVWDANMQQTFTLHAMVGDYPNHPQSPTNGVKNLSSSEVDGSSSAIQENNESKQDNALPSGGHQHSWVLTSPNYSFGFVPPMLGTQLTQFEYQTHDASQLPSFIVHKQLDLTSYYAQFYRIGGDSDGRLSPFSSGGANTKYNGNITLHPAPTCQSTQETQAYMLCGTMSVKNHPGRSGVHNKTHHTMGLSGLKKHSNPVTPKAYTPKSSSGPLPPDSGSSIPSSSASPWFSLSSSDSTLSSSLFSKFSEAAGEDFSVMVQLHSIFLHLRKVRRMAGIRDAKSILVKLEWFLNWVTFVARSVPHILITAKLIKDTYKFEKGMELPLALLGMAGMNLLNIGLGIDLLKAFMRERRSQQGNLQHHRE

SEQ ID NO: 129090 - protein, 70 aa, Glycine max
  Coding DNA Sequence Number=SeqID_12312
MGRRGGGRIKGFRGGKGSDKGVQFGGHVLETFVEAHLVCCPNRKGIFLVMANKIKGYSLDIQFNNFQLSR

SEQ ID NO: 129091 - protein, 91 aa, Glycine max
  Coding DNA Sequence Number=SeqID_12313
MARSVSALCPYSRDLYGRELKGFLVIIPKVVISLLMVSRGESPTVATYPSTGGRRVTRRCVFQERNTRGVATNVYLRKTSKKIRKDVVYEL

SEQ ID NO: 129092 - protein, 81 aa, Glycine max
  Coding DNA Sequence Number=SeqID_12314
MKRRADGFIGNRDVPGAPPLVEVPARLPLVVAPGRVPSRIAVPDGLGERVGGGTKPGGGDAGARRRWRIWGGEGAEGGWKR

SEQ ID NO: 129093 - protein, 117 aa, Glycine max
  Coding DNA Sequence Number=SeqID_12315
MGTREVVGQLWKKKWFCESLVMASSKRSEFALERVDSAMSKDNESTNVRERERARLGFEGQCPPNTDKKAKQGTGLPGHHKPLHIIVEGFPEHLFNSQMLTIQNMPLDLPLLPFPPI

SEQ ID NO: 129094 - protein, 360 aa, Glycine max
  Coding DNA Sequence Number=SeqID_12316
  Homolog annotation: Hit_ID=Q01GH4; Match level="QueryCoverage=70%, HitCoverage=47%, E-value=3e-12, Identity=24%"; Hit description=[MO] KOG2459 GPI transamidase complex
FPLLWKSIEIYRAPLPFDRIDAFSSQIESKPLSFPCHFQAIFIGFDFDFKVSHDDVGAAIARKMSDLSHGGGCGGCGGNYSVAVAVDRGDINAFDFGEKLRGSDEDADELVKSVVSEYGGGNAYSVVVVNEEGEVRSVVGKYRHAWIVGRVEEEEAVLHVAEVFVKVFVNGGDVEGSVRSEFMPVGADGRIVLSFSLLNADPRDWIYDWNFREIDETLLRPVIEALQPIANITVESQVLYHTPKSSFSYWDDKHGSHMFRTEDLPFFVNSNEWHLDTSVAAGGRSKMWGGVVVWNPQSCIKDFESMDPVRHTISPQDLLKLFEVLMGQLRQLLGLKSDNLYVGESGTSILLGSERGFTEW

SEQ ID NO: 129095 - protein, 119 aa, Glycine max
  Coding DNA Sequence Number=SeqID_12317
  Gene Ontology: Mol. function=RNA-directed DNA polymerase activity; Cellular component=chromatin; Biological process=RNA-dependent DNA replication
MNAIFRPYLRHFIIVFFDDILIFSKTLEDHVEHLEKAFQILMKEQFFLRLSKCSFAQTQIDYLGHVVSSQGVAPVPAKTLAIRQWPTPHSARTLRSFLGLAGFYRRFIRGYASIVASLT

SEQ ID NO: 129096 - protein, 371 aa, Glycine max
  Coding DNA Sequence Number=SeqID_12318
  Gene Ontology: Mol. function=chromatin binding; Cellular component =chromatin; Biological process=chromatin assembly or disassembly
  Homolog annotation: Hit_ID=Q1SAV4; Match level="QueryCoverage=73%, HitCoverage=77%, E-value=7e-78, Identity=49%"; Hit description =Integrase, catalytic region
  Pfam annotation: Domain name=TRAPP_Bet3; Domain location=180-358; Score=56.3; E_value=1e-13; Accession=PF04051.6; Description =Transport protein particle (TRAPP) component, Bet3
  Pfam annotation: Domain name=rve; Domain location=1-105; Score=3.0; E_ value=0.0033; Accession=PF00665.16; Description=Integrase core domain
  Pfam module annotation: Pfam domain module=TRAPP_Bet3::rve; Domain location=180-358::1-105
MLFMDIVGKFHGMPRSLISDRDPLFMSHFWQDLFRLSGTTLRMSSAYHPQTDGQTEVLNRVIEQCLRAFMHQKPSSREKFLNWVEWSYNTSIHSGSGLSPYELTFGKKPLSIPQYLTSTSKLDAVDDILKTREEAFSVMRKKLIKAQDLMKKMADKDRRDVTFAEGDWVMVKLHPHKQSSVSGTYSKLTKRFYGPYKIVEHMGKAAYKLQLPEDARIHLVFHCSLLKPFHHSTAEHIDYSFGDFGYGFPPEETTWEDWTPLKDTVHLEDKVGFKMFLGVTASVTNWDADGTCCSIVLEDNPLVDFVELPDNCQGLYYCNILSGVIRGALDMVSMKTEVTWLRDVLRGDDVFELQVKLLKHVPEEYPYKDDE

SEQ ID NO: 129097 - protein, 102 aa, Glycine max
  Coding DNA Sequence Number=SeqID_12319
MKTRKVSSLTFVEEAIEVLQAKQRKSNQCCLLIFLLTELKALLLAFASQRKVFLALGENEGHAVMKEKRGSPIQIFINPPSQRKVFLALGENEGHAVMKEKR

SEQ ID NO: 129098 - protein, 104 aa, Glycine max
  Coding DNA Sequence Number=SeqID_12320
MELMRLNQHEENDKKKKGITLKASSSIQEGSDKEDLNEIDEDDDFSFFKAKKPYITWEDNDMDSSKDSENEVVNLSLMAKNYESNEEVIDYRISVIHYRFNNLN

SEQ ID NO: 129099 - protein, 1258 aa, Glycine max
  Coding DNA Sequence Number=SeqID_12321
  Gene Ontology: Mol. function=ATPase activity, coupled to transmembrane movement of substances; Cellular component=integral to membrane; Biological process=transport
  Homolog annotation: Hit_ID=Q9LHD1; Match level="QueryCoverage=99%, HitCoverage=98%, E-value=0.0, Identity=52%"; Hit description =Multidrug resistance protein 13
  Pfam annotation: Domain name=ABC_membrane; Domain location=14-307; Score=99.5; E_value=9.7e-27; Accession=PF00664.13; Description=ABC transporter transmembrane region
  Pfam annotation: Domain name=ABC_membrane; Domain location=689-965; Score=137.2; E_value=4.6e-38; Accession=PF00664.13; Description=ABC transporter transmembrane region
  Pfam annotation: Domain name=ABC_tran; Domain location=1041-1225; Score=210.9; E_value=2.9e-60; Accession=PF00005.17; Description=ABC transporter
  Pfam annotation: Domain name=ABC_tran; Domain location=381-565; Score= 211.1; E_value=2.6e-60; Accession=PF00005.17; Description=ABC transporter
  Pfam annotation: Domain name=SMC_N; Domain location=370-569; Score= -128.8; E_value=0.035; Accession=PF02463.9; Description=RecFRecNSMC N terminal domain
  Pfam module annotation: Pfam domain module=ABC_membrane::ABC _membrane::ABC_tran::ABC_tran::SMC_N; Domain location=14-307::689 -965::1041-1225::381-565::370-569
MGNNSMFRYADGVDKLLMFFGTLGCLGDGLQTPLMMYILSDVINAYGDKNSHLTKHDVNKFLKLPLAFFQYALKLFCAALGVGLSAFIEGICWTRTAERQASRMRMEYLKSVLRQEVGFFDTQIAGSSTTYQVVSLISSDANTIQVVLCEKIPDCLAYMSTFLFCHIFAFVLSWRLTLAAIPLSVMFIVPALVFGKIMLDLVMKMIESYGVAGGIAEQAISSIRTVYSYVGENQTLNRFSSALQKTMEFGIKQGFAKGLMLGSMGVIYISWGFQAWVGTFLITNKGEQGGHVFVAGFNVLMGGLSILSALPNLTAITEATAAVTRLFEMIDRVPSIDSEDKKGKALSYVRGEIEFQDIYFCYPSRPDTPVLQGFNLTVPAGKSVGLVGGSGSGKSTIIALLERFYDPVEGLILLDGHKTNRLQLKWLRSQLGLVNQEPVLFATSIKENILFGKEGASMESVISAAKAANAHDFIVKLPDGYETQVGQFGFQLSGGQKQRIAIARALLRDPKVLLLDEATSALDAQSERVVQAAIDQASKGRTTIIIAHRLSTIRTANLIAVLQSGRVIELGTHNELMELTDGEYAHMVELQQITTQNDESKPSNLLTEGKSSHRMSVPQSPTVSFRSSTVGTPMLYPFSQGFSMGTPYSYSIQYDPDDDSFEDNLKRTNHPAPSQWRLLKMNTPEWGRAMLGILGAIGSGAVQPVNAYCVGTLISVYFETDSSEMKSKAKVLALVFLGIGVFNFFTSILQHYNFAVMGERLTKRIREKILEKLMTFEIGWFDHEDNTSASICARLSSEANLVRSLVGDRMSLLAQAIFGSIFAYTLGLVLTWRLSLVMIAVQPLVIGSFYSRSVLMKSMAEKARKAQREGSQLASEAVINHRTITAFSSQKRMLALFKSTMVGPKEDSIRQSWVSGFGLFSSQFFNTSSTALAYWYGGRLLIDGKIEPKHLFQAFLILLFTAYIIADAGSMTSDLSKGRSAVGSVFAILDRKTEIDPETSWGGEKKRKLRGRVELKNVFFAYPSRPDQMIFKGLNLKVEPGRTVALVGHSGCGKSTVIGLIERFYDPAKGTVCIDEQDIKSYNLRMLRSQIALVSQEPTLFAGTIRENIAYGKENTTESEIRRAASLANAHEFISGMNDGYETYCGERGVQLSGGQKQRIALARAILKNPAILLLDEATSALDSVSEILVQEALEKIMVGRTCIVVAHRLSTIQKSNYIAVIKNGKVVEQGSHNELISLGREGAYYSLVKLQSGSSPR

SEQ ID NO: 129100 - protein, 197 aa, Glycine max
  Coding DNA Sequence Number=SeqID_12322
  Gene Ontology: Mol. function=phosphotransferase activity, alcohol group as acceptor; Biological process=carbohydrate metabolic process
  Homolog annotation: Hit_ID=P77570; Match level="QueryCoverage=52%, HitCoverage=28%, E-value=3e-47, Identity=85%"; Hit description =Anhydro-N-acetylmuramic acid kinase
  Pfam annotation: Domain name=UPF0075; Domain location=1-111; Score= -153.3; E_value=1.1e-07; Accession=PF03702.5; Description =Uncharacterised protein family (UPF0075)
REYFNFGWLERQLASFPALAPQDVQATLAELTAVSVSEQVLLSGGCERLLVCGGGSRNPLVMARLAGLLPGTEVTTTDAAGISGDDMEALAFAWLAWRTVAGLPGCSVYNQLLERMQTDTLEYRCDEKPLTVKLNNPRQEASFVYDNKLLTLKQGISASGARYTDGIYVFWSKGDSATVYKRDRIVLNNCQLENPKR

SEQ ID NO: 129101 - protein, 104 aa, Glycine max
  Coding DNA Sequence Number=SeqID_12323
RVVRQFGYTQTIPAPPVDSWVSYDDIHDKWMHYSDHIIPAGEVCTVPVCYEIAERLERHLNLGVVTPGSSTHEVIEECLRMARSVTQDQLVYVRSRHRRHTDWA

SEQ ID NO: 129102 - protein, 75 aa, Glycine max
  Coding DNA Sequence Number=SeqID_12324
  Gene Ontology: Mol. function=protein kinase activity; Biological process=protein amino acid phosphorylation
  Homolog annotation: Hit_ID=Q2R1R7; Match level="QueryCoverage=94%, HitCoverage=4%, E-value=7e-17, Identity=56%"; Hit description=AT hook motif-containing protein, putative
  Pfam annotation: Domain name=DUF889; Domain location=2-74; Score= -91.3; E_value=2.6e-05; Accession=PF05970.5; Description=Eukaryotic protein of unknown function (DUF889)
MVFGGDFWQILPVIPRRSRSDIVNATINSSYLWNHFHVLTLSKNMRLEANTDATDREETAAFAEWILNIGDGIAG

SEQ ID NO: 129103 - protein, 87 aa, Glycine max
  Coding DNA Sequence Number=SeqID_12325
MASERSLDPRGTSGCWQGARAGCRRCGLEPKEEVQLVREVHSQLPLRGTVEGRVDASSEDVTEVGQQGTKAFHDKEHCSGPWSKGLS

SEQ ID NO: 129104 - protein, 75 aa, Glycine max
  Coding DNA Sequence Number=SeqID_12326
  Gene Ontology: Cellular component=nucleus; Biological process =regulation of transcription, DNA-dependent
  Homolog annotation: Hit_ID=Q1EP20; Match level="QueryCoverage=96%, HitCoverage=5%, E-value=6e-16, Identity=56%"; Hit description =Transcriptional repressor protein-related
  Pfam annotation: Domain name=PAH; Domain location=18-64; Score=46.7; E_value=8.1e-11; Accession=PF02671.11; Description=Paired amphipathic helix repeat
MDALQYIQEVQYTFRDSREKLDKFTNVMKDYKFHRIDVGVVVAKMEEILKDHGDLILGFNKFLPKGYEILLLNEG

SEQ ID NO: 129105 - protein, 234 aa, Glycine max
  Coding DNA Sequence Number=SeqID_12327
  Gene Ontology: Mol. function=1-phosphatidylinositol-4-phosphate 5 -kinase activity; Biological process=phosphatidylinositol metabolic process
  Homolog annotation: Hit_ID=Q56YP2; Match level="QueryCoverage=78%, HitCoverage=37%, E-value=2e-46, Identity=70%"; Hit description =Phosphatidylinositol-4-phosphate 5-kinase 1 (EC 2.7.1.68) (AtPIP5K1) ...
  Homolog annotation: Hit description=(1-phosphatidylinositol-4 -phosphate kinase 1) (PtdIns(4)P-5-kinase 1)
  Pfam annotation: Domain name=PIP5K; Domain location=9-198; Score=6.8; E_value=3.4e-11; Accession=PF01504.9; Description=Phosphatidylinositol -4-phosphate 5-Kinase
LKPSDFDLKEKFWTRFPTEGSKITLPDQSVEFRWKDYCPMVFRQLRKLCIEEVIVMGNLFCSEYQIRRRFDLKGSSHGQTTYKTKEIDETTTLKDLDLNFVFRLQNNWFQDFIKQIEWDCEFLEAEGIMDYSLLVGLHFRDDDTYEKDGIVTISFPHREKFMRGYRFLEAELQDRDRVKSGRKYSLDDNTIDFIGHALALHSDDCHLAEPAQDTVKRMKWVLGEEEVNGMKGFF

SEQ ID NO: 129106 - protein, 88 aa, Glycine max
  Coding DNA Sequence Number=SeqID_12328
MSYQMSRHHVSEHAEYITDLYVQYFRARCPGHRIRHRGSCNFNAFSNSSIFGQDVLDIVSDIVDPAASMLLAIPVFSGRMSWTLYPTS

SEQ ID NO: 129107 - protein, 190 aa, Glycine max
  Coding DNA Sequence Number=SeqID_12329
MTLKKLLSRRARKITAGEGSSTTPPERRVQLAKGEYMEFQTEIARRHWTQHEGVMDKCSKVCGQWIPYDTDAINQFLGNPLILEEGQESNAPPPPPHQTPSLESISTHLQRIELQMHIYMRHLANQQVANHRGQMQLNDNFYHYTLHQHRQDPSPYPWPTLEQFRVIVAWPGDKPIFQEEERPIDAQGAA

SEQ ID NO: 129108 - protein, 234 aa, Glycine max
  Coding DNA Sequence Number=SeqID_12330
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=99%, E-value=9e-23, Identity=23%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=41; ConfidenceScore=5.25e-01
MTLNYLKAWIWSPLKVRTRSLLKVRTCNTLKLRTCHPLKVRACSPLKVRTYTPLWVRACSPMKARACGPLKERACNPLKARTSSPLKARKSSPLKARKSSPLKVRTCSPMKVRTCSPLKVKACSPMKVRTCSPLKVRACSSLKVRTCSHLKVRTHSPLMARACSPLKTRTSSPLKVRMCSPLKVRTCSPLMVRTCNPLMVRTCSPLKVRTCSPLKARTYSPLKVRTYSPLKARA

SEQ ID NO: 129109 - protein, 76 aa, Glycine max
  Coding DNA Sequence Number=SeqID_12331
MALGFPTLVTGLCQSYRVPVPPARSRHREIGKDRTRKTPSGPKEVQQGPRVSSSDYGPMSVLWSARHPQQGHQASY

SEQ ID NO: 129110 - protein, 174 aa, Glycine max
  Coding DNA Sequence Number=SeqID_12332
MAEQQKTKKTRKKSQKDEVQWELLTKEHKTKRRHEYATSVPICPSTLTSVPQRLKDLSETDDDDECLAFSLTGNKEYPAFSSSDSSIIRFHTSSSTSTIDSSSATKHCQDASILARTWNSTMSLTIYRSDPASSMAQYVKFKGQKEISKPHLSRSVHRTIKGSFARSGTSKIEF

SEQ ID NO: 129111 - protein, 42 aa, Glycine max
  Coding DNA Sequence Number=SeqID_12333
MELQRKIKAKRNIPRICQRHLSIFPLDATSMEGVMLAHGKLP

SEQ ID NO: 129112 - protein, 41 aa, Glycine max
  Coding DNA Sequence Number=SeqID_12334
MYADRVDGGTRRSVKERLDGNFSTGSTRQHRITGKRWCGVG

SEQ ID NO: 129113 - protein, 77 aa, Glycine max
  Coding DNA Sequence Number=SeqID_12335
MSNCSIAMGGRRREGSRVRLPWEENVRSRHQHLFEENVGKTRKVWSTNFKCERFESCIYARRRYILTEQKSFKALDH

SEQ ID NO: 129114 - protein, 107 aa, Glycine max
  Coding DNA Sequence Number=SeqID_12336
MVRLPRKENAWSRHQRLFEENVGKTQNGKGQGFTSFENEGLGVIYAEESKIGGGACRPTRPGELVAYSRSNLLAQGLRNVPEWTIFPYLEFLAHFLPKCRETLRIAL

SEQ ID NO: 129115 - protein, 87 aa, Glycine max
  Coding DNA Sequence Number=SeqID_12337
MDRKWPCNALVPGFARASVRHLIELENACHIRKVQEGVKRLDDEYIKSGIDWLEVNKGAPCMEDSFSLVAWWRLGLDTIAKKTFNDS

SEQ ID NO: 129116 - protein, 117 aa, Glycine max
  Coding DNA Sequence Number=SeqID_12338
  Gene Ontology: Mol. function=nucleoside-triphosphatase activity
  Homolog annotation: Hit_ID=Q40495; Match level="QueryCoverage=55%, HitCoverage=8%, E-value=2e-24, Identity=83%"; Hit description=N -ethylmaleimide sensitive fusion protein
MIGLHESTKCAQIIKVFEYSYKSPLSVIILDDIERLLEYVPIGPRFSNLISQTLLVLLKRFPPKGKNSWFYVLFYVELFCSYWIVLFYVGFFIACCFLKTIDGHGEATSLSMAKRRL

SEQ ID NO: 129117 - protein, 95 aa, Glycine max
  Coding DNA Sequence Number=SeqID_12339
MKFTRLHMFEIASEYDFLKPHNAKKSKKPILCHKSNKEQVHILFTLLKSQSLYGDPNDACGFEVETLGLEGEPKSLLPLDSTGGHVSVAAKSHVA

SEQ ID NO: 129118 - protein, 45 aa, Glycine max
  Coding DNA Sequence Number=SeqID_12340
MDDFLNALHEVTSALGASTDDHERCSFWLTASILLAAISVLDVVG

SEQ ID NO: 129119 - protein, 137 aa, Glycine max
  Coding DNA Sequence Number=SeqID_12341
MQSSKRDVYLGAYLNGEHWQMVAIVPKEHRVVWFSSLHIRLDSYLKEIINSALKGLDDAPQPKSKVPARWIIVKCNRQKGSTECGYCVMQWMSTIILGSFRNNWEAYFNDARPLEPERLKALRIQWVQYYLRVKDQS

SEQ ID NO: 129120 - protein, 96 aa, Glycine max
  Coding DNA Sequence Number=SeqID_12342
VASRLAEPVDPQMLPANATGGTNLRSSRQSNWWNQTWMHGSYDGWMMGCAMGYLASGIGGTLWVALRQHHWRKPWMHGNLHNQGFRQSKWRNTYIK

SEQ ID NO: 129121 - protein, 76 aa, Glycine max
  Coding DNA Sequence Number=SeqID_12343
MFQGEVFEDDDDELDLKEMRENEHPRNQLTYALTDNIPTSPSGFYTRDQRKMNSGQKGKIEAAAEPHRIGQEGEER

SEQ ID NO: 129122 - protein, 225 aa, Glycine max
  Coding DNA Sequence Number=SeqID_12344
MDKRVAKHDEKKSAPKNETQNLPQPLPSPWSTSTQIWHMPIPYDSVHQRRSFSNLYPMATAGFGQSSLLVSVDGSIQRASTELNNNLMGKGLQSQESRPSILKTNGEGLTRSATSKSRETTVVGHDVKNAGGATKFKIKDLPSVKPQQSSMMPLPGNGGGVQNVISNENRNAVHENRNIASDHFEANPTELNQKLTTAPNATGNNPHLKEKERGAICHVLKEYIR

SEQ ID NO: 129123 - protein, 290 aa, Glycine max
  Coding DNA Sequence Number=SeqID_12345
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9ZT82; Match level="QueryCoverage=99%, HitCoverage=16%, E-value=1e-130, Identity=76%"; Hit description =Putative glucan synthase component
MSLRHRQSPAAAASAVPGRDEEPFNIVPVHNLLADHPSLRFPEVRAAAAALHSVGDLRRPPFGQWRPNMDLLDWLALFFGFQRDNVRNQREHLVLHLANAQMRLTPPPDNIDTLDAGVLRRFRKKLLKNYTSWCSYLGKKSNIWISDHRRGEDLRRELLYVSLYLLIWGEAANLRFMPECICYIFHNMANELNRILEDFIDENTGQPVMPSVSGENAFLNLVVKPIYDTIKREVDSSRNGTAPHSAWRNYDDINEYFWSRRCFEKLKWPLDIGSNFFVTAGGGGKHVGKT

SEQ ID NO: 129124 - protein, 297 aa, Glycine max
  Coding DNA Sequence Number=SeqID_12346
  Subcellular localization annotation: CTP_CleavageSite=81; ConfidenceScore=5.78e-01
MSPKASGTSLRGGRSTGNGFRLALPKPTIKKSSSTTSWSPNQAGSSTQKPKIEGSSTQIISIKPESSAQESPKPSTSKQTKADYAFPIETLQALQEISITKLPKKTWVDVTSESDEDSEIDLQTMIQKTKNFKTIVNSKGKQTMSQPQTPPPKQTNSYNIETKIPSRLQRRYNKTEESKNFLSLQTHAFVKWWTQFDVSKVEPEQVKLWFIAHLEPLKAADPETSSLLNQKSQIATFLASSRSKESLAKNLKEVLQLLQQEEDEGSSSKKEETNSSKEDDPFYQNENDYFGISLNDD

SEQ ID NO: 129125 - protein, 94 aa, Glycine max
  Coding DNA Sequence Number=SeqID_12347
MPRIHDAILYYNGKWNMPPQNKFVGCAFTGKNPKKFQIPSTCTIDELKNLIKQVAPKGIPPLGIHESQTVRQLFFRQPARFEYSDEVSGTSLNN

SEQ ID NO: 129126 - protein, 171 aa, Glycine max
  Coding DNA Sequence Number=SeqID_12348
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=15%, E-value=4e-94, Identity=100%"; Hit description=DNA -directed RNA polymerase beta chain
  Pfam annotation: Domain name=RNA_pol_Rpb2_1; Domain location=14-170; Score=119.0; E_value=1.4e-32; Accession=PF04563.6; Description=RNA polymerase beta subunit
MLGDGNEGMSTLPGLNQIQFEGFCRFIDRGLPEGLFKFPKIEDTDQEIEFQLFVETYQLLEPLINEKDAVYESLTYSAELYVSAGLIWKSSRDIQEQTIFVGNIPLMNSLGTSIVNGIYRIVINQILQSPGIYYRSELDPSGISVYTGTIISDWGGRLELEIDRKARIWAR

SEQ ID NO: 129127 - protein, 140 aa, Glycine max
  Coding DNA Sequence Number=SeqID_12349
MTRRDKIWSFCTLVSSRGGGPDDTRRYLTVIRTLLSSRGGGPDDTRRYLTAAGPMTRKDKIRSFCTLVSSRGGGPDDTRRYLTVIRTLLSSRGGGPDDTQRQNLVILHPSSIAADKPVDMRRFTSSSAFTRSVTLTFESC

SEQ ID NO: 129128 - protein, 71 aa, Glycine max
  Coding DNA Sequence Number=SeqID_12350
MVKEECKEVSVSSNSKQGVPTNTKRIKVNPEWPTPPSVEERTPEFKEPLDLRSNPFQGGGNDAILPPKGIG

SEQ ID NO: 129129 - protein, 60 aa, Glycine max
  Coding DNA Sequence Number=SeqID_12351
MDLIENMTVVGCTICGGAHEFGCCIPIEEHPTREVNYMRNQPKNNFNAGRIFWIPTWPTI

SEQ ID NO: 129130 - protein, 81 aa, Glycine max
  Coding DNA Sequence Number=SeqID_12352
MYMVNNIFTPSRYKEIIMMQPKPSAGLKGKPHQHALIFMPSCVQNQRLGFLGLSHISAFTLTSASCPRIQKWQPWVLAQAS

SEQ ID NO: 129131 - protein, 79 aa, Glycine max
  Coding DNA Sequence Number=SeqID_12353
  Gene Ontology: Mol. function=DNA binding; Biological process=DNA integration
  Homolog annotation: Hit_ID=Q1S7S0; Match level="QueryCoverage=91%, HitCoverage=5%, E-value=5e-13, Identity=53%"; Hit description =Integrase, catalytic region; Peptidase aspartic, catalytic
MVIWKKGSPKIKLLPICRKCARETKTTKDSYNGNVIGMSIEFLIRSFVVKEGSKHTVYTSSGMNKSIGPKDKRRVRLTE

SEQ ID NO: 129132 - protein, 142 aa, Glycine max
  Coding DNA Sequence Number=SeqID_12354
MAVEWRRKRERRRHFKEKMSLEEAHHHRRPWIRAWRKKEMNEGRGREEHEILCSKRDVFDAKTFWSQIVWNDTLKALASGYDGCNNDDHHGFIQMLHLVKTYHFDACVCSTKDIDSSAFINKLKNLPTIFHETNYDLTMMDE

SEQ ID NO: 129133 - protein, 97 aa, Glycine max
  Coding DNA Sequence Number=SeqID_12355
MDKGEVHWPVMPYASGTELNGPSQSDDRLVIADQAMSIMTRIIEFPVINKGALKRNTLTGKFCQGKEQGLINNNWNIMHLRINNTILNFQVIIDDSN

SEQ ID NO: 129134 - protein, 76 aa, Glycine max
  Coding DNA Sequence Number=SeqID_12356
EGGDAEESGVVTAKGNLIGLQLALSGQWPRLANQLLLKCKDGCAKPNSKELKSREVFRLSVEHALSETTTANGQGL

SEQ ID NO: 129135 - protein, 85 aa, Glycine max
  Coding DNA Sequence Number=SeqID_12357
MAPPNHEVSLVMENSGGGNNMKGVTVLGLFLELVVKLRTFFGFWCKDWQSGGHLRYNLTGIVAVVFELLLLARVWNAGSVAWKAV

SEQ ID NO: 129136 - protein, 200 aa, Glycine max
  Coding DNA Sequence Number=SeqID_12358
  Gene Ontology: Mol. function=structural molecule activity; Cellular component=extracellular region; Biological process=keratinization
  Homolog annotation: Hit_ID=UPI0000D66BFF; Match level="QueryCoverage =90%, HitCoverage=85%, E-value=3e-20, Identity=28%"; Hit description =PREDICTED: similar to SPT transcription factor family member (spt-5)
  Subcellular localization annotation: CTP_CleavageSite=14; ConfidenceScore=5.24e-01
MVRTCNPLKVRTCSCLKVRARSLIKVRTCSPVKVMGCNPLKARTCSPLKVMVHSPLKVRTCSPLKVRASNPLNARTCSPLKVRSFSPLKVRKCCPLKVRARNALKVRARSPLKVMACNPLKAMTCNPLKVRACSPLEAMTCSPLKVRSCSPLKVRLRSPLKVRTCGPQRVRACNTLKPSEGEDVQSYEGEGVQPSKGEDV

SEQ ID NO: 129137 - protein, 204 aa, Glycine max
  Coding DNA Sequence Number=SeqID_12359
DSLEEQVTQGSFVPHGRQDILNTAIGRPEHGGRVRAAGSGVTITQYYGRASRTCSSSSTSISQQQLDEVVARLREDMTGQIREELRTQIKEELRTQLEEENKRSLEIMTNALKEAIKKELSNKGSPELLQIQPDIQQVAARVSTQGSNVVTNVQASQEHHADAIPLMGLYVQLKDGTTRLVAMGPIMEGDSVIHTVAYADDVVR

SEQ ID NO: 129138 - protein, 358 aa, Glycine max
  Coding DNA Sequence Number=SeqID_12360
  Gene Ontology: Mol. function=glycerophosphodiester phosphodiesterase activity; Biological process=glycerol metabolic process
  Pfam annotation: Domain name=GDPD; Domain location=64-294; Score= -29.2; E_value=0.0011; Accession=PF03009.8; Description =Glycerophosphoryl diester phosphodiesterase family
MQQSSRSRKAALRVRVPSRKLMILSLAIFAILPPIFFHFRLRRLQQLQLTKCRWLNDPPLVCAHGGDSSKASPNTMASYFHALQSRVDCIEIDVSRSSDGVLFALHDRDLQRLNGNTSSKVGYMNSEEIRKLSASHQSTSKFTDESILTIQDALMLTANSVRQIVLDVKVGPPFYEKKLAKDVLSIVSIILPFLTVHLLPSERAINTPGLRNVFVLKDSCESRLSGVGRSGSALPPLGVHSRSATWRVINGWVMEDSGPCIYEGGSHGKLDESWLSLVKQACKQLCQFTFLLDTVHGNIEIAWNLIGNEQRTDDSVGVSTMPIHLRRKKWQCDGGHLAEWCCEHHNPQWREGCVHTKP

SEQ ID NO: 129139 - protein, 390 aa, Glycine max
  Coding DNA Sequence Number=SeqID_12361
  Gene Ontology: Mol. function=transferase activity, transferring glycosyl groups; Biological process=sucrose metabolic process
  Homolog annotation: Hit_ID=Q5EEP9; Match level="QueryCoverage=99%, HitCoverage=46%, E-value=1e-142, Identity=59%"; Hit description =Sucrose-phosphate synthase 1
VKYVVKLARALANTKGIYRVDLLTRQIASPVEVDSGYGEPIEMLSCPSDGSDCGEAYIIRLPCGHRDNHIVNMARVLGEQVNGGKPTWPYVIPGHYADAGEVAAHLSGALNVPMVLSGHSLGRNKFEQLLMQGRLSREAINATYKIMRRIEAEELGVDATEMVVTSTRQEIEEQWGLYDGFDLKLERKLRVRRRRRVSCLGRHMSRMVAWTSAMPQHKTRWKIMRFFTNPHKPTILALSYPDPKKNVMNLLKAFGECQTLRKLANSTLILGNRDDIEEMSNNSSVVLTMVLKLIDKEFYQPNPDGTIWSHTDRALNNGLLIDPHDHKSIEEALLKLVADKNLWLECRKNGLKSIHRFSWPEHCRNYLSHVEYGRNSRSTSHLEITPIAEE

SEQ ID NO: 129140 - protein, 322 aa, Glycine max
  Coding DNA Sequence Number=SeqID_12362
  Gene Ontology: Mol. function=transferase activity, transferring glycosyl groups; Biological process=sucrose metabolic process
  Homolog annotation: Hit_ID=Q5EEP9; Match level="QueryCoverage=92%, HitCoverage=28%, E-value=1e-89, Identity=55%"; Hit description =Sucrose-phosphate synthase 1
  Pfam annotation: Domain name=S6PP; Domain location=36-268; Score= -70.4; E_value=1.1e-05; Accession=PF05116.4; Description=Sucrose-6F -phosphate phosphohydrolase
MDPVARQKQIIEAIMCRVSSTGNSNANCYFPGRRQRLVMVAADCYDSDGNIAEEAFQAVVINVMKVVRPGIRSGRVGVMLQTGLSFQETIEALNNFQVNMEEFDVVVCNGGSEMYYPWKDLMAYTDYEAYAEYAWPGENIRSTIPRFAKVDDGEENDIVEYASACSSRCYSYSVKPGAMIQKIDELRQRLRMRGLRCNLVYTHAGLRLNVIPLFASRKQALRYLSVKWGIDLSKVVVFVGEKGDTDYEELVSDIQKTLVLKGAVEYGSERLLRSEESYKREDVLSQDSPNIIYAEKSYEDCVIFQQFWSISKYHDFCFGNYF

SEQ ID NO: 129141 - protein, 438 aa, Glycine max
  Coding DNA Sequence Number=SeqID_12363
DGGSNSKVVVVPNRKGSFGFEMGKFWVGLSLVRVHGWWNCDVDANVHWVKVFVGSIWVMLINLCSSGMWFLVAIHSMGYWVMQPTLKWEGKKENAFHELDIDTWSFLEVVVLIHDIEYDVTDGLKMWWKGANADYEILKDLNNDHDAMDLVKYSFSHKCEVDIYVKFGINFEGYDLDMDYGVNDCFDRDIAMEYDDNYPLEMHYDSVPDPPSPQEDPYLDFREMHHLETCYETEELYSNVEFKDDTTKPGKEFLMFRKDTMCKVFKWTLGMNNHTCAISARKIALQQIKGDEVKQYTLLRRYNNELISRNANNTFKIHVNRLVPTLPPPFGSFYMGQMLVAMARDANDQYYPLASAVVETVNKDSWNRFLNELLVDIRPMEAMGSIILEQSTEVTTIRFETQVVGYAIPTQPTEVAIAGSKTKATRSDVRGGGLAILA

SEQ ID NO: 129142 - protein, 69 aa, Glycine max
  Coding DNA Sequence Number=SeqID_12364
MAFETMAACPGEPRLTLEVTGSPSSGLRVLSMLKEEMLLGGKWMLLEGKLLLMQAKAHFIRQGNNWSSS

SEQ ID NO: 129143 - protein, 107 aa, Glycine max
  Coding DNA Sequence Number=SeqID_12365
MEHLLKRKTRGSHHQRLFEENARKTKKRSANFENKGSRVVYAWGRLLKDSFYYCKQKEVVKALDLERSQMITKDDDKGKDKKLKGQSKNEFKIFKIESEHFKIQEES

SEQ ID NO: 129144 - protein, 347 aa, Glycine max
  Coding DNA Sequence Number=SeqID_12366
  Gene Ontology: Mol. function=RNA-directed DNA polymerase activity; Cellular component=chromatin; Biological process=chromatin assembly or disassembly
  Subcellular localization annotation: CTP_CleavageSite=71; ConfidenceScore=5.03e-01
VLMGAPSTPRIFHVGLDGTMHNITPSPRAHSHLHNTAGFGSNNQFPPPLVALHIIPPLTLPFVFQNFNSIPLMAKTPLTGESMSWFKWMHNNHQLTDWETFTHALEVRFRPSSYENHQVELFKLRQYSTVAEYQHRFEKLSNQLAVLKPFSIHHAIGLAKLVEAKLKDFKPKPNPKPPYPATSSNTTHLATPSLKHLTQAQYHEQRAKGLCYYCEEKYVPGHRCQASKFLLLLMDDDPVESTCQPMPPHEPLFEPQEEPTHHLQLSTYALMACITSCNPDALAAHLNLSISPTVAFPVMVGNGDHIYCSGLCSKVPLEIQDQVFEVPMYFFLSKVLTWFWVCNGSVL

SEQ ID NO: 129145 - protein, 119 aa, Glycine max
  Coding DNA Sequence Number=SeqID_12367
  Subcellular localization annotation: CTP_CleavageSite=54; ConfidenceScore=5.30e-01
MVDGGRPKFLHINTPLRPMALPLWASLLKLPMAFGKKSPCHSSMAPPFNNTAVDAMSLNPRNSLGVNPQTPLDESLVHWVTLLVLLVELIDVGEPVAINLILLGLIPLHYICPGPVASP

SEQ ID NO: 129146 - protein, 129 aa, Glycine max
  Coding DNA Sequence Number=SeqID_12368
  Gene Ontology: Mol. function=oxidoreductase activity, acting on the CH-OH group of donors, NAD or NADP as acceptor; Biological process =metabolic process
  Homolog annotation: Hit_ID=Q9C7T6; Match level="QueryCoverage=76%, HitCoverage=29%, E-value=6e-37, Identity=73%"; Hit description =Phosphoglycerate dehydrogenase, putative; 33424-31403
  Pfam annotation: Domain name=2-Hacid_dh_C; Domain location=5-95; Score=-37.6; E_value=1.7e-06; Accession=PF02826.9; Description=D -isomer specific 2-hydroxyacid dehyd
MEEIIADPDQFWEGTYHLYECFLLAVLTIFFLSDTDGGLLVNVARGGLVDYEAVINHLESGHLGGLGTDVAWTEPFNPDDQIFKFKNVIMTPHVAGVTEHSYRSMAKAVGDVVLQLHAGLPLTGIELVN

SEQ ID NO: 129147 - protein, 186 aa, Glycine max
  Coding DNA Sequence Number=SeqID_12369
MAIALLGSFCHAPTVMLANFIATPIELSLVVPFLRLGEVISGGSHFPLTSDALKKVLTGQASREVLLSVAHARRKSDCQPEFIANLLRGPASARVVAEVEPVRLYDVLVLHCHQRQPLPPSLSPAPSRSPMAARSLATTQCPLIYISTNVPGVPGLTALGRTAEGLVHTKPDLKFVTLNAALRLRW

SEQ ID NO: 129148 - protein, 84 aa, Glycine max
  Coding DNA Sequence Number=SeqID_12370
  Subcellular localization annotation: CTP_CleavageSite=8; ConfidenceScore=5.45e-01
MTNEERCRSRLRSQFGSASTSFFSSFFFFSVISQFLSMLDLGTLYSTSLTPIYSKRWLSQHALLRASEARLTGDFFADELDFAS

SEQ ID NO: 129149 - protein, 117 aa, Glycine max
  Coding DNA Sequence Number=SeqID_12371
  Homolog annotation: Hit_ID=UPI0000D9BA39; Match level="QueryCoverage =83%, HitCoverage=96%, E-value=2e-09, Identity=41%"; Hit description =PREDICTED: similar to Snf2-related CBP activator protein
  Subcellular localization annotation: CTP_CleavageSite=30; ConfidenceScore=5.50e-01
MPMMKLSCGAELWLDMALTPTKTRTLSPMKARTLSPLKVRTLSPMKARTLSPLKARTLSPLMARTLSPLKARTLSPLKARTLSPLKARTLSPLMARTLSPLNGEDFEPSKGEDFLAL

SEQ ID NO: 129150 - protein, 111 aa, Glycine max
  Coding DNA Sequence Number=SeqID_12372
MQSSQRDVYLGAYLNGPDNYLKGIINSALKGLDDAPQPKSKASARWIVVKCNRQKGSTECGYYVMHWMSTIILGTFKNNWEAYFNDPRPLEPERLKALRIQWAQFYLRVRD

SEQ ID NO: 129151 - protein, 72 aa, Glycine max
  Coding DNA Sequence Number=SeqID_12373
MRLNLEVLKVVVVLNSPFGLNAHRALSVTEESGKASISRSRAKCEISVLSVAVVFSQAQHMTGAKLKSTYSR

SEQ ID NO: 129152 - protein, 331 aa, Glycine max
  Coding DNA Sequence Number=SeqID_12374
MKLASTPPYLHISRATDIKMIVDRVYPCVQVWDAAEKKGFELYYKANMASRKMKIVWMDSQKASTFGNDGSDIVVPRNVFQALQPTRKYLFDDACVYFTKDVDNYSFIQRLLQLPFIPYQGTYNLKKMTKAQMIAHVTKIHEVQQKRRVDVVTVEIVAKEVATTVQAEAFGKVMDDTVVCGVLIDLTNTSDMDKTSEASNVAIADGVEPLILAPVSKQSTNSNEAISQDKGDHDVVIVYSTNSGPTPLNYAQPTIITRDQVQYMIRQAMESFVERQRQENGQFFLSMQNAITMQFSNLGVVLLQNIQQAQLSMLGAIVAPVFQPASLEPSP

SEQ ID NO: 129153 - protein, 69 aa, Glycine max
  Coding DNA Sequence Number=SeqID_12375
MIIIKTPKAFASTNNKLISGDTDNVSGYGPASELDYHRDDFEDDNLAEVDTTIKGRREDDGIFDTQNSR

SEQ ID NO: 129154 - protein, 85 aa, Glycine max
  Coding DNA Sequence Number=SeqID_12376
  Gene Ontology: Mol. function=acyltransferase activity; Cellular component=integral to membrane; Biological process=metabolic process
  Homolog annotation: Hit_ID=Q337H3; Match level="QueryCoverage=77%, HitCoverage=20%, E-value=3e-19, Identity=65%"; Hit description=1 -acyl-sn-glycerol-3-phosphate acyltransferase 1, chloroplast, putative, expressed
MIDSPNNNKARVSGMKGAFSVAAKTNAPVVPITLIGTGQIMPAGKEGIVNIGSVKVVIHKPIVGKDPDMLCKEARKTIASVLTQS

SEQ ID NO: 129155 - protein, 91 aa, Glycine max
  Coding DNA Sequence Number=SeqID_12377
MKVFGAKMMMKMIPPLFLFLRGLSCQRQSPAARATKHKQPPQHTTTIDDQLIILCLFIYMIVVQVIGGVKIEKCKKEEGNVNLRDKCDSGG

SEQ ID NO: 129156 - protein, 168 aa, Glycine max
  Coding DNA Sequence Number=SeqID_12378
  Gene Ontology: Mol. function=oxidoreductase activity, acting on the CH-OH group of donors, NAD or NADP as acceptor; Biological process =metabolic process
  Homolog annotation: Hit_ID=Q9C7T6; Match level="QueryCoverage=84%, HitCoverage=41%, E-value=3e-41, Identity=58%"; Hit description =Phosphoglycerate dehydrogenase, putative; 33424-31403
  Pfam annotation: Domain name=2-Hacid_dh; Domain location=18-147; Score=44.4; E_value=3.8e-10; Accession=PF00389.20; Description=D -isomer specific 2-hydroxyacid dehydr
MESNGNSVKDAEKQITRVLFCGPRFPASHEYTIEYLQNHSHIKVDVLPLEDVPKDIANYHVCIVKNMRLDSEIISRAVQMQLIMQYGVGLEGVDIDAATKHGIKVARIPGDVSGNSASCAEMAIYLMLGLLLAHLNEVARRKNNLVITPRLMMLKNMCFGYAFVMEML

SEQ ID NO: 129157 - protein, 100 aa, Glycine max
  Coding DNA Sequence Number=SeqID_12379
MGRCRYMTVSTGSASVSRGRAEVAWSGDWPDALVGEEPARATGGADESHMDKDMTDLFGFLGGSGATPTWAFQILPPEGCCFWRKQPCSPGQAKLAWANW

SEQ ID NO: 129158 - protein, 150 aa, Glycine max
  Coding DNA Sequence Number=SeqID_12380
  Homolog annotation: Hit_ID=Q40538; Match level="QueryCoverage=24%, HitCoverage=64%, E-value=8e-08, Identity=86%"; Hit description =Nicotiana tabacum (clone 5) activating factor DNA sequence
  Subcellular localization annotation: CTP_CleavageSite=25; ConfidenceScore=5.30e-01
MGLGLMREACPSVRIISFKRVLFVNLSSATNYPRLSTQNVMFKFVLKRGPLVNPRLLSDYQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 129159 - protein, 204 aa, Glycine max
  Coding DNA Sequence Number=SeqID_12381
NTETFSSLTSYPELRRSEFLIGGYVGARASLLSTTPPFVAMTQELRPMVVICAFFRRMLAFSDGDFSSLTSYLELRHVTCTLVSSRGGGPDDTRRYLTVIRTLLSSRGGGPDDKQRPKTKFGHSAPLYHPEAAGPMIRGDTLRLSAPFCHPEAAGPMTSRDQVWSFCTLVSSRGGGPDDTRRYLTVIRTLLSSRGGGPDDKQRP

SEQ ID NO: 129160 - protein, 97 aa, Glycine max
  Coding DNA Sequence Number=SeqID_12382
MVTRSVKFRNVAETKRKYCYAICPLRPSRFFLQKAVASGRSNLALLGELGGKLLPYFAINRGRNEEGRGSAFLALRILLKLLRKIVSVKKIQAEALP

SEQ ID NO: 129161 - protein, 411 aa, Glycine max
  Coding DNA Sequence Number=SeqID_12383
  Gene Ontology: Mol. function=RNA-directed DNA polymerase activity; Cellular component=intracellular; Biological process=RNA-dependent DNA replication
  Pfam annotation: Domain name=RnaseH; Domain location=217-337; Score =36.3; E_value=2.4e-08; Accession=PF00075.14; Description=RNase H
MTATCGPIFKLLRKDQGVVWTEDCQKAFDSIKNYLLEPPILIPPVEGRPLIMYLTVLEDSMGCVLGQQDETGRKEHAIYYLSKKFTDCESRYSLLEKTCCALAWAAKRLRHYMINHTTWLISKMDPIKYIFEKPALTGRIARWQMLLSEYDIEYRTRKAIKGSVLADHLAHQPIEDYQPIKFDFPDEEIMHLKMKDCDEPLLGEGPDPESRWGLIFDGAVNVFGNGIGAVIITPEGNHLPFAARLQFDCTNNMAEYEACILGIEKAIDLRIKNLDIYGDSALVINQIKGEWETRHPGLIPYKDYARRLLTFFNKVELHHIPRDENQMADALATLSSMYEVSHRNNLPTIRIQRLERPAHVFAVEEVVDDKPWFHDIKCFLQSQEYPPGASNKDRRTLRRLSETLTWYYSGV

SEQ ID NO: 129162 - protein, 106 aa, Glycine max
  Coding DNA Sequence Number=SeqID_12384
MQRKDRELTGSSNGIIGNYHKWLKTKTQELDWLSKLKASIEEEAKTPKESEEVQALKVELERAQEVKEKFKTTAIKVQKECNKLRGVNVATVEALERETKRARKEE

SEQ ID NO: 129163 - protein, 174 aa, Glycine max
  Coding DNA Sequence Number=SeqID_12385
MPCGKGFAARVMDQGLFEIGGARKGEQRPIPSKKPIPFPYKSAKVVAWRYAPQKPDERKDESVRNSLSSAKVTNIFGTSDMTREKMKKKKVAVVGVSLSEAYALSEQHTLSKALSSLSELGESAKHARVQRAISSPNRRSKGKQGKGAPKTSTFKRILGDNMPWKAKALVGNFC

SEQ ID NO: 129164 - protein, 102 aa, Glycine max
  Coding DNA Sequence Number=SeqID_12386
MDGGDDNGDNSSGDNGVTMATMVIIIMVTVTTMVIMRVMTVVCYKKKEYFRLPKFVGNLKNSSSVSVGHRFATRHLTTGHLVGHCLLPATSPAASEVVDVDK

SEQ ID NO: 129165 - protein, 178 aa, Glycine max
  Coding DNA Sequence Number=SeqID_12387
  Gene Ontology: Mol. function=transcription regulator activity; Cellular component=intracellular; Biological process=regulation of transcription
  Homolog annotation: Hit_ID=Q5MP56; Match level="QueryCoverage=39%, HitCoverage=31%, E-value=3e-23, Identity=77%"; Hit description =Barren stalk1
  Pfam annotation: Domain name=HLH; Domain location=43-90; Score=32.2; E_value=1.8e-06; Accession=PF00010.16; Description=Helix-loop-helix DNA-binding domain
  Subcellular localization annotation: CTP_CleavageSite=39; ConfidenceScore=5.61e-01
MDHHTPSTNPTLSQFSSSKSNKSLNKEKKGGARKCKGVRLSTDQQSVAARERRHRISDRFKILQSMVPGGSKMDTVSMLEEAIQYVKFLKTQIWLHQTMINFMDNDNNNNNNYESSSSLPSPLLHPNRDNCYYFPSEQFFSPQPNAVFDYDNMQDLAQCSFQGEDTTYIDASLKYWPA

SEQ ID NO: 129166 - protein, 114 aa, Glycine max
  Coding DNA Sequence Number=SeqID_12388
  Gene Ontology: Mol. function=ribonuclease H activity; Biological process=DNA integration
MKNAFDKKVHLCKFHEGDLVLKKMSHVVKDNRGKWAPNYEGPFIVKRAFSGGALVLTNMDGEELPSPEHNRLRQWSNARPDPKAETGQEARIMIDRSLSLAQCWTNGKRRWEAT

SEQ ID NO: 129167 - protein, 126 aa, Glycine max
  Coding DNA Sequence Number=SeqID_12389
  Gene Ontology: Mol. function=electron transporter, transferring electrons within cytochrome b6/f complex of photosystem II activity; Cellular component=integral to membrane; Biological process=electron transport
  Homolog annotation: Hit_ID=P56773; Match level="QueryCoverage=99%, HitCoverage=66%, E-value=6e-62, Identity=85%"; Hit description =Cytochrome b6
  Pfam annotation: Domain name=Cytochrom_B_N; Domain location=1-121; Score=147.2; E_value=4.5e-41; Accession=PF00033.9; Description =Cytochrome b(N-terminal)b6petB
MTEANFGWLIRSVHRWSASGFKKPRELTWVTGVVLAVLTASFGVTGYSLPWDQIGYWAVKIVTGVPDAIPVIGSSLVELLRGSSSVGQSTLTRFYSLHTFVLPLLTAVFMLMHFSMIRKQGISGPL

SEQ ID NO: 129168 - protein, 287 aa, Glycine max
  Coding DNA Sequence Number=SeqID_12390
MGDKLHRREGNSPDHQLRPLNDRSVIKEMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDE

SEQ ID NO: 129169 - protein, 94 aa, Glycine max
  Coding DNA Sequence Number=SeqID_12391
  Homolog annotation: Hit_ID=Q86AI8; Match level="QueryCoverage=89%, HitCoverage=13%, E-value=5e-07, Identity=34%"; Hit description =Similar to Homo sapiens (Human). Mucin 2
  Subcellular localization annotation: CTP_CleavageSite=62; ConfidenceScore=5.05e-01
MARTCNPLKVRACPTKVKAHDPLTARTCSPLKLKVHDPLKARTCSPLKAKVRACSPLKARTCGSLKVRACSPLLVRTCSPLKARTCSPLNGEGN

SEQ ID NO: 129170 - protein, 33 aa, Glycine max
  Coding DNA Sequence Number=SeqID_12392
MELTSGSVEVTQSCTRNSLSMVISPSLKGLPNR

SEQ ID NO: 129171 - protein, 101 aa, Glycine max
  Coding DNA Sequence Number=SeqID_12393
MECSICGVKIKSDGSVDIGAGSGICVGVGGITGAEEGTGAMEEEGVGVSGGAEMVGASDLLPLAFLGPLNVTVGSSRFQQFFLIYATLMVGLKLSRDLESD

SEQ ID NO: 129172 - protein, 108 aa, Glycine max
  Coding DNA Sequence Number=SeqID_12394
MQSLQGLGLPSIMSMEEFDAQEPASKEPIAATVEGEDELTPPEPFYFDGDAHMAQEEGTSTDQILESSFAPAPEEIQPSTPVIEPKQPIQDSSAAPALDLNEDQPQDE

SEQ ID NO: 129173 - protein, 128 aa, Glycine max
  Coding DNA Sequence Number=SeqID_12395
MLAGCVGRSGGANTRPLRVTPLSPVILVTLANNELISVAIPWHDSTHRYFIVVPVQVIEVSSSAEDPEELPPEPVVDALDLPEDDEDPLLDVDFPEDIMSVSEADSTKESGPGGTANSGDSSSKQMAP

SEQ ID NO: 129174 - protein, 113 aa, Glycine max
  Coding DNA Sequence Number=SeqID_12396
MCEKEHESFKEYTQRWRDLAAQVAAPMTKREMISMIVDTLPVFYYKKMVGYTPSSFADLVFADERIEVGLKRGKFNHPAWTNEKTGVNEEGKNEGEAHVVTVRGGNRPGQVRL

SEQ ID NO: 129175 - protein, 157 aa, Glycine max
  Coding DNA Sequence Number=SeqID_12397
  Homolog annotation: Hit_ID=UPI0000612705; Match level="QueryCoverage =70%, HitCoverage=93%, E-value=4e-09, Identity=26%"; Hit description =UPI0000612705 related cluster
MTGPLNESISCFLTRVDPWVLVPSPSEGYMPSPSEGYMPSPSEDYTSSPSEGCMSSPSEDYTFLAIRGLHVLTYRGLQTSPLEGCMPSPLEGCTPSPSEGYTSSPSEGYMPSPSEDYMMQCYPARALGRRLQVDWARDPREDPRVLMSLRVDFEPMG

SEQ ID NO: 129176 - protein, 149 aa, Glycine max
  Coding DNA Sequence Number=SeqID_12398
GSRPQDTQVDSEESNRALGFPALVTDLYQSYRVPVPPAGSCHRDIGIASVRHPMDPENSNRVLGVPIAPSKVIRPPTNRVFIKKYCAPRQARDRQVIARPTQDVKEALLGGSQELATKKLPAKWSKKGTIEEDSSVTPQADTGFEKHRF

SEQ ID NO: 129177 - protein, 94 aa, Glycine max
  Coding DNA Sequence Number=SeqID_12399
MTTLITACYQTLSLTDSEKVCAGYRIGRLRVPTDSQVTVAKGGAIDKSEAFAPTYPQFVARNSDLRSSQFCETKIVLVFFTLKCEHALVKKQNL

SEQ ID NO: 129178 - protein, 226 aa, Glycine max
  Coding DNA Sequence Number=SeqID_12400
  Gene Ontology: Mol. function=aminocarboxymuconate-semialdehyde decarboxylase activity; Cellular component=intracellular; Biological process=metabolic process
  Homolog annotation: Hit_ID=Q46SC2; Match level="QueryCoverage=100%, HitCoverage=79%, E-value=1e-53, Identity=46%"; Hit description =Amidohydrolase 2
  Pfam annotation: Domain name=Amidohydro_2; Domain location=7-225; Score=90.0; E_value=7e-24; Accession=PF04909.4; Description =Amidohydrolase
MAQYRAIQARLGIQRAVLVTPSTYGADNRPMLDALAQLGEQARGVAVIDGSESDAQLQALHDAGVRGIRLNLSLGVTSTIDQVLPLAARVAPLGWHVQLLMPPERLAQLDGLLSALPAPIVFDHMARISPAQAGAHPAHALVLRLLGQGRAWLKLSGGYLVSPRHSVEDPALDALARGYLDANPERIVWGSDWPHASASAGMQPMPDDARQLDRLADWAGSARLRQ

SEQ ID NO: 129179 - protein, 84 aa, Glycine max
  Coding DNA Sequence Number=SeqID_12401
MTKSNRTTLKGSSLRDLQKDRMSTLTFRGLHVLALRGLPALPLGTSYPHLERTTCPHNQRAARPHLQRTTCPRLERATCPHLGY

SEQ ID NO: 129180 - protein, 60 aa, Glycine max
  Coding DNA Sequence Number=SeqID_12402
MARSVFALCPLFKGPIWERSKKVFSDNPQGIIIFEEHTATVGTTSNNMFSKRKTLDEGSL

SEQ ID NO: 129181 - protein, 317 aa, Glycine max
  Coding DNA Sequence Number=SeqID_12403
  Gene Ontology: Mol. function=nucleoside-triphosphatase activity; Cellular component=membrane; Biological process=cobalt ion transport
  Homolog annotation: Hit_ID=Q1LD61; Match level="QueryCoverage=84%, HitCoverage=97%, E-value=1e-42, Identity=36%"; Hit description=ABC transporter related
MLGCCSGPTHGVDLQGVTPLPTPSCRAEPMLGCCSGPTHGVDLQGVTPLPTPGAHLQHVGRPQRLQQVPVVADHQQRARPCRQQFFQRLQGIKIQCIARLVQQQQLRCGIGIQHAGQRAFYPFAIAEAMGCTLDALRVQPEQGQPCAQFTGIGRRVGSLHGVENAAFAGEPQQLLVEQRQWCMTLHDATACRQLAGQHAQERGLATAVVTDHGDALAAADLQLQRCTATMRQHQRLRLQQTCAAAFTVTGEQRQLWRGVNCRSRCAQLVAAGLQTIGLDLLRAPVAGLCTLFLPAKQDRCLVGLLRIAIATCLALLL

SEQ ID NO: 129182 - protein, 109 aa, Glycine max
  Coding DNA Sequence Number=SeqID_12404
MTMLPPTFAYLWPWTWYGIYQLFSCPLTYRTTTMHMHAYDWAIQGTFPLNLMMTSMHFRVKKRLSFELQNVAVRLSSAARLSAYPPLSVASACLAQRRIWQSISIKAVC

SEQ ID NO: 129183 - protein, 62 aa, Glycine max
  Coding DNA Sequence Number=SeqID_12405
MTGDASKFTHISPKKSGHVTYGDNNKSRILGVGKIEASFMMMNQVDSNSFDDDKDDDKKSKE

SEQ ID NO: 129184 - protein, 140 aa, Glycine max
  Coding DNA Sequence Number=SeqID_12406
  Pfam annotation: Domain name=zf-CCHC; Domain location=108-125; Score =6.3; E_value=0.089; Accession=PF00098.13; Description=Zinc knuckle
MERTSTWLFKENKGGYIPCGSLLVKDFTRLLEISRTGGCLETGYIEKKRKRIALKVSSSKEDHKESFSDDEDANNLNLFVKKFGKFLKRSKDRKFSKPSKKVENNNTFTCLECMKQGHIKSDSPMYLKKQLVKKEGKKYG

SEQ ID NO: 129185 - protein, 84 aa, Glycine max
  Coding DNA Sequence Number=SeqID_12407
  Gene Ontology: Mol. function=transferase activity; Cellular component= cytosol; Biological process=glutamine metabolic process
  Homolog annotation: Hit_ID=Q1SPM3; Match level="QueryCoverage=87%, HitCoverage=28%, E-value=2e-25, Identity=79%"; Hit description=SNO glutamine amidotransferase; CobB/CobQ-like glutamine amidotransferase
MDLEMHLNFTENAEEESKVIVAVRQGNILATAFHPELTADTRWHSYFVKMSNEIGEEASSSSLVPAQVSTSQYQQPRNDLPIFQ

SEQ ID NO: 129186 - protein, 184 aa, Glycine max
  Coding DNA Sequence Number=SeqID_12408
  Homolog annotation: Hit_ID=Q2PMM5; Match level="QueryCoverage=99%, HitCoverage=8%, E-value=1e-105, Identity=100%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVE

SEQ ID NO: 129187 - protein, 240 aa, Glycine max
  Coding DNA Sequence Number=SeqID_12409
  Gene Ontology: Mol. function=transcription factor activity; Biological process=regulation of transcription, DNA-dependent
  Homolog annotation: Hit_ID=Q0KCD4; Match level="QueryCoverage=56%, HitCoverage=45%, E-value=3e-42, Identity=65%"; Hit description =Transcriptional regulator, LysR-family
  Pfam annotation: Domain name=HTH_1; Domain location=105-164; Score =56.4; E_value=9.6e-14; Accession=PF00126.17; Description=Bacterial regulatory helix-turn-helix protein, lysR family
MAQHAVLAHQHHRTDQAQRVDLLQQPLHRRQRRCRFKGKSGIHRGDPWGEARHSAIGIMPGAVTPQGLREAPHHSVAMAAPRAAITRPYPAVFIAGTPMSVLDNLANLQTFVHAADTRSFVETGRLQGISASAAGKCVARLEHALGVRLFHRSTRSITLTAEGQLFLARCRRILDERDAARTELAQPHAAPSGTLRIGLPLVGDLTLPLMAEFMAAYPDIRLDLDFSDRLVDVVEERLRC

SEQ ID NO: 129188 - protein, 125 aa, Glycine max
  Coding DNA Sequence Number=SeqID_12410
  Gene Ontology: Mol. function=helicase activity
  Homolog annotation: Hit_ID=Q2R0W4; Match level="QueryCoverage=96%, HitCoverage=10%, E-value=7e-12, Identity=24%"; Hit description=AT hook motif-containing protein, putative
MMLSTTKGAQSYSDIRTINGLVYPTFREACFAKGFLGSDQEFISDLQEANNWGIRLTEKETIHLCLTEIENMLQANRRSLRDFPSMSYPIGYARNQHHTNLIHNEMAYDKEMLAEQYNTTYQLLT

SEQ ID NO: 129189 - protein, 93 aa, Glycine max
  Coding DNA Sequence Number=SeqID_12411
MDLKSTLRLIRTLGSSLASLAQSTWSLLSNALARTCHSVWNSLVTQVDHHGGVVYARQGDLDTCCLVFISESVAWTRLDYFLTNGTTLDLRVE

SEQ ID NO: 129190 - protein, 78 aa, Glycine max
  Coding DNA Sequence Number=SeqID_12412
MPKKWGNEWLQWRLPEDPRRLLSELPKEGVLEIFWKKGSSESNQRSTGRTLLPEIFRNTFFQKLPRRSSSSGKFPEES

SEQ ID NO: 129191 - protein, 105 aa, Glycine max
  Coding DNA Sequence Number=SeqID_12413
  Gene Ontology: Mol. function=structural constituent of ribosome; Cellular component=ribonucleoprotein complex; Biological process =translation
  Homolog annotation: Hit_ID=Q6ZLP8; Match level="QueryCoverage=72%, HitCoverage=56%, E-value=4e-22, Identity=69%"; Hit description =Putative ribosomal protein S12
  Pfam annotation: Domain name=Ribosomal_L7Ae; Domain location=6-83; Score=4.2; E_value=0.011; Accession=PF01248.16; Description =Ribosomal protein L7AeL30eS12eGadd45 family
MVILHVAFMKVQKGSRSMLCNYVLAEACDQPDYVKLAKALCVEHNVSVLTILGAKTLGKWDGLGKIDSEGKARKVTGCFCSCAALGGGGGGGGRQEPKSPSLPSF

SEQ ID NO: 129192 - protein, 55 aa, Glycine max
  Coding DNA Sequence Number=SeqID_12414
CRNTLVFQQRVIPVQLALAQANNRLCLQNNIAIAEANTREQCWKQLKMTLARAWE

SEQ ID NO: 129193 - protein, 115 aa, Glycine max
  Coding DNA Sequence Number=SeqID_12415
EEVVLEPDDDLGHLRANVFQEGGNDENPETGQIYAKGPSSLLNQYQTYQSNPCGVYPDLSSFTGSDVYPNLSSFIGSGVIQKNSTASIKRSAPSQDHITIDGLRVLKKTLIGETL

SEQ ID NO: 129194 - protein, 85 aa, Glycine max
  Coding DNA Sequence Number=SeqID_12416
MTCGDTLWSSAPFVDREERIRQYQDDVGHSVLTIFKIFAGTICLLGCVLHLTTSRPLTPIVRQSVKFCDMWGVERKRQCAIRKVP

SEQ ID NO: 129195 - protein, 105 aa, Glycine max
  Coding DNA Sequence Number=SeqID_12417
MDETITNFIERFRKLISKCMTQHPRVEYVNMVMSNMHPLLREILLTQDCLDLNLLTTKVFRIDQIITTKQQGGYNWEMEPYMEVKVMISLEKQPIVTTVRQLKSW

SEQ ID NO: 129196 - protein, 94 aa, Glycine max
  Coding DNA Sequence Number=SeqID_12418
MDDTVTQAMPCLAIITLISLGLSASWCRPPTRHPLDPDKSNRAHGFPALITGLCQSFEAADAPPPPRQADPTGSLGMERYLQHLVRQQAANHRG

SEQ ID NO: 129197 - protein, 103 aa, Glycine max
  Coding DNA Sequence Number=SeqID_12419
  Pfam annotation: Domain name=Transposase_23; Domain location=37-101; Score=-17.7; E_value=0.098; Accession=PF03017.5; Description =TNP1ENSPM transposase
MKSWACTSQRCNESIWQFKHSTQFMVSSTSNLQFASLVVHEAKICEENPPRLVALGRIYEGSTTIHNIPLLLDQVKVGVEEVKDADAPVPVPTDKVNLVGADT

SEQ ID NO: 129198 - protein, 174 aa, Glycine max
  Coding DNA Sequence Number=SeqID_12420
MARVAKVVKILVQELDHVKQNRNGLVKIPRKRLEEKAKTLADQGEWASFIDILALLIFGVILFPNVEGLVDLAAINAFLAYHHSKESSVIAILADFYDTFDRRCEKSSARIHLFRQESRPAYPLQGHCLYAKKGKANLEQLLASVVGASINWFPVGRKEEPGFCPHVKDFQMFP

SEQ ID NO: 129199 - protein, 189 aa, Glycine max
  Coding DNA Sequence Number=SeqID_12421
MDLRTQMFHLRAKRNDVLSAYFVFQFLKQSVFVPVLLQTSSPAFILLPSAFHIIQAKRAYVLSLKFIYVKAELSALCCTKPKPLTMASKKRKSMTSSSSQAKFDRSKFHSLEAWDRYNDFMVTRKILPKRNVVVYHTKFDEFKEELMRRKWDEKLTTFTEGSIDVAIVREFYANLFDPEDKSPKQVRVR

SEQ ID NO: 129200 - protein, 76 aa, Glycine max
  Coding DNA Sequence Number=SeqID_12422
MRDAQALGVFNRELRVLMPFSFASYSFYRPKRGEHALSAVVPGLGEVITRLAQDFMLSAPLGFLAGLRRVKLELDR

SEQ ID NO: 129201 - protein, 197 aa, Glycine max
  Coding DNA Sequence Number=SeqID_12423
  Gene Ontology: Mol. function=protein binding; Cellular component =nucleus; Biological process=jasmonic acid mediated signaling pathway
  Homolog annotation: Hit_ID=Q45FY8; Match level="QueryCoverage=71%, HitCoverage=26%, E-value=1e-40, Identity=63%"; Hit description =Coronatine-insensitive 1
MSFCSYGGSGHKADGDEVIICGAGLRDAIHTRLQGPRCRVVGVPLVVQAQLAHMLRRRFLHLKSLKLKGKPREAMFKDWGGFVTTLVIDISQYFNCLKSLHFRHMIVRDSDLEVVARSRGHILQALKLDKCSGFSTDGLYYIDRYCRFKWRVNNTCPHSLTVGSFKITNLDLSLSARSALNTIPAREGIVLSENCRA

SEQ ID NO: 129202 - protein, 68 aa, Glycine max
  Coding DNA Sequence Number=SeqID_12424
MAVMDNDKATMVAATCGAMTTRTMEAMKVVSIKDGVMVGWRVCGSGGRRWQRDRELGKKGDGGSVKVQ

SEQ ID NO: 129203 - protein, 79 aa, Glycine max
  Coding DNA Sequence Number=SeqID_12425
MYWENCMITFAGGKSNVAGYKDGPNVGGSSGLENRGQTIAKMQMRSNINLHAQVPHHLQLRTVNSRLDWKVGNLGLVMN

SEQ ID NO: 129204 - protein, 222 aa, Glycine max
  Coding DNA Sequence Number=SeqID_12426
  Homolog annotation: Hit_ID=Q1SKD7; Match level="QueryCoverage=97%, HitCoverage=56%, E-value=3e-10, Identity=22%"; Hit description =Ankyrin
MASRKRKAPSTPTQARFDRSRFTSQEAWERYTDIVVPRKLLPERNVVVYYTEFDEFKKELERRYWDEELTDFLDGNIDVAIIKEFYANLYDPEEKSPKQVRVRGHLIKFDEDTLNTFLKTPVVVEERETLCAYSRFALLRPDPQELAAKLCIPGRGFELNADGKPLNILRKNMTTLTQTWSVLSFSNLIPTSHTFDVTLDRAKLIYGIIMKMDMNMRYLISH

SEQ ID NO: 129205 - protein, 74 aa, Glycine max
  Coding DNA Sequence Number=SeqID_12427
DCARKTPSGPEEGQQGLGVASSKYGSLSVLGSACRPSKVIRPPLPIKLSSRSTAPPGRHKAKHHNSIGMAGSGQ

SEQ ID NO: 129206 - protein, 67 aa, Glycine max
  Coding DNA Sequence Number=SeqID_12428
MTEEPPVAVEEQTTPNQTPKPSPSSAPAPEETQPSTPIAEPEQLIQDSSAAPTQDLNEDQPQEEQDV

SEQ ID NO: 129207 - protein, 94 aa, Glycine max
  Coding DNA Sequence Number=SeqID_12429
MGLISGNQFGLLGDNGNPNRLKPKEWLWSLRHQIKKQFLLSPSKEKMKARKEEGDLVEEVQDAEVFCNQLPRSLSAKYLFFFIRAKYLFHLGYC

SEQ ID NO: 129208 - protein, 97 aa, Glycine max
  Coding DNA Sequence Number=SeqID_12430
MQNTRWYIKLTSSHYDSYSRCHAILQREVENATPRRLCGLLVHNKNPKRFDIPSGCSIDRLKDVIKQVAPQGIPPYGIHESQIVRQLFFRQSEHSEY

SEQ ID NO: 129209 - protein, 181 aa, Glycine max
  Coding DNA Sequence Number=SeqID_12431
MSITSSTTSCEHACVIADEESNYEVILQDYIKIPAFYHEHWAPDYPNFAHFHYDRASYQIRLRQHRGKLFFADGLKHLRKYLDIYESVTINFMACKHRWIFNLHFTPPLEQQACGRPLLATRMHVWTLELTQALLGDPQPLMLPPLAAIHLPSCGFHMTVLRKFGPPFQWPILPVAPGFHG

SEQ ID NO: 129210 - protein, 204 aa, Glycine max
  Coding DNA Sequence Number=SeqID_12432
MDARWMQFGDYIAPVGKICVALGQCSSYYMEWLYMISHPFMTPAQPGDPPRVPPVYQYDTFVEPYVSQQSVAVVTPDEVDFEVHLPGHLVDGYVAIADKLDRLLNLRILIEGTKVYTVAEECLSIIRSYIGQLTRGHRSRRRRTPDGILNLLQATMTPTQDVMLYYNERWKMPRQDDFVGYSFTIKIQKDLTFLRDVASTDSRM

SEQ ID NO: 129211 - protein, 159 aa, Glycine max
  Coding DNA Sequence Number=SeqID_12433
  Subcellular localization annotation: CTP_CleavageSite=70; ConfidenceScore=5.83e-01
HFFAALGASSSSLFFFLSSCAFLVASSLWFFFFLRSCFFFLASSLFVFFIASICTPFIDAFAFSFEDPLMATEELNEEQQQPPVEEGFTNVEGFSCGPHDTSVLRDFENHIALRERPQLKLSSHGRQMAKFGRPALEIEGLVAANGLSPLIACSLDTGD

SEQ ID NO: 129212 - protein, 110 aa, Glycine max
  Coding DNA Sequence Number=SeqID_12434
MVAWMAETTATRERAKRAHVQRSETAVSRDSYQACRASRRMTVMGATASMWRMQDWTGKVEIVRMKKNQELVSEPFFLPLSYETCRMECESSFSQVTLPIFVGEVMTYRQ

SEQ ID NO: 129213 - protein, 282 aa, Glycine max
  Coding DNA Sequence Number=SeqID_12435
  Gene Ontology: Mol. function=nucleic acid binding; Biological process= DNA integration
  Homolog annotation: Hit_ID=Q1S4N1; Match level="QueryCoverage=75%, HitCoverage=17%, E-value=3e-56, Identity=55%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MDQDQVQNQPMQKEIERNFIRLANTAERKVILHLDVEEDLMLSAVSVIKWGMKQLFAETRINQMVKLQGLLIKRRRSTCFLLHVSLALNQVKIGLLTNKDLLKELRNSCTLKIHVGDGKYITVNEKGTVAISTNRDTKLIFDVLYVLEIDHNLLSVGQLVEKGYKVLFENKIFLIKDVGDKDILKVKMKGKSFILNPLEIAFPVKENNTELWHKKQKVVEDQASSEIAALTSWNGAAEARLAAATGQEKSTLEKVGIVQEHTNKKIQLREKAAKIEHNVTRR

SEQ ID NO: 129214 - protein, 48 aa, Glycine max
  Coding DNA Sequence Number=SeqID_12436
MSDPGRLLKYFCSAILHKHCAARERQKDGSIHLKVIVLRLGMKWWKNS

SEQ ID NO: 129215 - protein, 142 aa, Glycine max
  Coding DNA Sequence Number=SeqID_12437
  Gene Ontology: Mol. function=serine-type peptidase activity; Cellular component=lysosome; Biological process=proteolysis
  Homolog annotation: Hit_ID=Q8LFB7; Match level="QueryCoverage=90%, HitCoverage=26%, E-value=2e-42, Identity=58%"; Hit description =Prolylcarboxypeptidase-like protein
MVIPIGIGNDTMFEPIPFNLTRYAEGCKEQYGVSPRPHWVTTYYGGHNIKLVLRRLGSNIIFSNGLRDPYSIGGVLDNISDSIVAVHTVNGSHCLDLLRANQSDPGWLVEQRKKEVKIIKRWITQYYADLDALKDKPKFQSK

SEQ ID NO: 129216 - protein, 127 aa, Glycine max
  Coding DNA Sequence Number=SeqID_12438
  Pfam annotation: Domain name=DUF1723; Domain location=74-123; Score =5.9; E_value=0.1; Accession=PF08330.1; Description=Protein of unknown function (DUF1723)
MLVASKQPTSSASVRSPELDPYSATNTLIAFDKHHQKFILGPCFLNDGENTDKTANKPFNHEKNPFPITSIDMHWPQDVWVKILGFWSIAIKGFMLPKAMAGLTLLNVVAILNLSIHGEELRLLYGT

SEQ ID NO: 129217 - protein, 225 aa, Glycine max
  Coding DNA Sequence Number=SeqID_12439
  Gene Ontology: Cellular component=outer membrane; Biological process =pathogenesis
  Homolog annotation: Hit_ID=Q8PGS0; Match level="QueryCoverage=99%, HitCoverage=89%, E-value=5e-24, Identity=44%"; Hit description=Outer membrane protein
  Pfam annotation: Domain name=HIM; Domain location=50-70; Score=33.4; E_value=8.1e-07; Accession=PF05662.4; Description=Haemagluttinin motif
  Pfam annotation: Domain name=Hep_Hag; Domain location=140-167; Score =21.7; E_value=0.0027; Accession=PF05658.4; Description=Hep_Hag
  Pfam annotation: Domain name=Hep_Hag; Domain location=168-195; Score =17.1; E_value=0.063; Accession=PF05658.4; Description=Hep_Hag
  Pfam annotation: Domain name=Hep_Hag; Domain location=196-223; Score =28.2; E_value=2.8e-05; Accession=PF05658.4; Description=Hep_Hag
  Pfam annotation: Domain name=Hep_Hag; Domain location=21-48; Score =14.8; E_value=0.32; Accession=PF05658.4; Description=Hep_Hag
  Pfam annotation: Domain name=Hep_Hag; Domain location=98-125; Score =20.3; E_value=0.0069; Accession=PF05658.4; Description=Hep_Hag
  Pfam module annotation: Pfam domain module=HIM::Hep_Hag::Hep_Hag::Hep_ Hag::Hep_Hag::Hep_Hag; Domain location=50-70::140-167::168-195::196 -223::21-48::98-125
  Subcellular localization annotation: CTP_CleavageSite=73; ConfidenceScore=5.61e-01
MGNNSVVGGENAIVLSTGSNASASNAVALGAGSVASRARTVSVGSSGNERQVTNVAAGTQATDAVNKAQLDAVATTATTTSRFFQASGNGDDVAGALVEGDNALAAGDAANAIGNGATALGSGANALASNAQALGFNALATAANASAVGANAQATGEYATAQGAESEASGEQSAAFGAASIASGAGSTANGVLSEASGEEAVAVGYFSNASGDAATAVGSESVAS

SEQ ID NO: 129218 - protein, 330 aa, Glycine max
  Coding DNA Sequence Number=SeqID_12440
  Gene Ontology: Mol. function=phosphoribosylformylglycinamidine synthase activity; Cellular component=cytoplasm; Biological process =purine nucleotide biosynthetic process
  Homolog annotation: Hit_ID=Q8PGR7; Match level="QueryCoverage=93%, HitCoverage=25%, E-value=1e-136, Identity=72%"; Hit description =Phosphoribosylformylglycinamidine synthase
  Pfam annotation: Domain name=AIRS_C; Domain location=1-115; Score =41.1; E_value=3.8e-09; Accession=PF02769.12; Description=AIR synthase related protein, C-terminal domain
MERRCQEVIDRCVAMGANNPIKFFHDVGAGGLSNAIPELLHDSNVGGVIDLGKVPTDDPSLSPMQLWCNESQERYVLGVAQERLAEFAALCARERCPFAAVGVATAEEHLVVAYGAVPGHTPADAPIDLPMDVLFGKPPKMHRDTAHPPAPRWPALKTGGLDLQEAGLRVLAHPTVASKNFLVTIGDRSVGGLTAREQMVGPWQLPVADVAITLADFDGVAGEAMSIGERTPLALLDAAASARMAVGEALTNLCAAPVDALDEIKLSANWMAAAGHPGEDALLYDAVKAVGMELCPQLDISIPVGKDSLSMLRSGTTRANRTRACRRCLW

SEQ ID NO: 129219 - protein, 210 aa, Glycine max
  Coding DNA Sequence Number=SeqID_12441
  Gene Ontology: Mol. function=RNA-directed DNA polymerase activity; Cellular component=intracellular; Biological process=RNA-dependent DNA replication
  Homolog annotation: Hit_ID=Q1SNY7; Match level="QueryCoverage=84%, HitCoverage=39%, E-value=2e-22, Identity=38%"; Hit description =Peptidase aspartic, active site
MQSADEEGPKKPKPLTSTPISSVGGRSILFPYKNNRAVPWRYAPPGVRKGEATDISSLSAKVTNITGLSGITRSGRVFAAPSLLIQPAITKGKARMTEGQNVKVIPAPDEDVSTKDLYKGREGCGKKEVLNEAHVAQDIFVEGFGGIVNNITANNYLTFAEEEIPAEGRGHNRALHVSVKCMEHVMAKVLIDNGSSLNVMPKSPLEKITI

SEQ ID NO: 129220 - protein, 430 aa, Glycine max
  Coding DNA Sequence Number=SeqID_12442
  Gene Ontology: Mol. function=RNA-directed DNA polymerase activity; Biological process=RNA-dependent DNA replication
KASEVNLVPLNLKIEATCRKNNALRRRREQLEKQANQGDRGISSSTTSSPSPLDLEESTISTPFSIFADNSMAGDEPQRVTLEDYSSSSTPQYFTSIVRLEVQVANISYQHSLIELIQGNLFQGLPNKDPYAHLATYIEICNTVKIAGVSEGYGEILEEIPSKIKTTQGKAGISSFHQFLDRSLNEVLDRFYASVGCKIKLKMPDEAMELIENMAASDIAILRDQTHTPTKKSLLELTSQDALLTQNKLLENQLEILTKTLSKLPQQLHSGNPANVFVMQVGGCALYGGVHELGTYMTQEEASKVEAMQGFIHEEIFLRSKVKLGGSIKDDGEVLNSKTKGQLAREGKREAPTIPAKDIPYPLIPSWKDKDKYFARFLDFFRKLEITIPFDEVLQQMLMYTKFMKDLLTKKGKYTDNESIVVAENYNALI

SEQ ID NO: 129221 - protein, 169 aa, Glycine max
  Coding DNA Sequence Number=SeqID_12443
MEEKQKKQLEQVAQSGSFETIIGPSSPIRRHMKLKMVRTKISGQMKYEVKHQIADRIDSLEEQSAQGSFVAYGRQDVLTAVIGRLEHPSCGNVLPVEPKVAHSDARVSIKGSYVDPSGQDPDMDASNRYGLYDKQLPKGSVKPIDRSELDDDPIYQMTLMTLQLFLKPM

SEQ ID NO: 129222 - protein, 72 aa, Glycine max
  Coding DNA Sequence Number=SeqID_12444
MKNKKVVVAGVSLSEACALGENHSLSETLSPLRELGESTKHLRAQRIISSLRESFVFSRAKCAQLAQQIFTN

SEQ ID NO: 129223 - protein, 141 aa, Glycine max
  Coding DNA Sequence Number=SeqID_12445
MGPRCSMLHSYQLHNLHQQCHPPPQRPPKQALQHRHCSEHQHCAGTDDGGAEGPGAREGVGGVEARAEEDEPSDPRARALWVPRNMIMGSSRFQQFFFMYAKLIAGLRDSKVRESEITPRAKHKVVIRAKKPSLEELDWAI

SEQ ID NO: 129224 - protein, 167 aa, Glycine max
  Coding DNA Sequence Number=SeqID_12446
QQGQWRSHPGNQFNKDQGGPSNRPQQQGPSLYDKTTKLEETLAQFMHVTMSNHKSTKSAIKNLEIQVGQLARQIAEKSSSTFGVNIEQNPKEEYKAVMTRGRKAIMIEDEERIVDDNQELVVEEEEEEREDEEDYTVIQRILPPKHKDPGSVTIPCSIGSVSVGKAH

SEQ ID NO: 129225 - protein, 117 aa, Glycine max
  Coding DNA Sequence Number=SeqID_12447
MALSKPSSKSSTGDLVPLDLEIEATCRRNNAKRKRKILQDRTTPPILEEPQSSESSSIFPQKRESTTGAPEANIMAEDQPRRVTLEDYSSSAVPQFFTSIERPKVQAHNITYPHSLI

SEQ ID NO: 129226 - protein, 160 aa, Glycine max
  Coding DNA Sequence Number=SeqID_12448
MRIQLRLKRSSWCGGLTVSNSGSWWPSVVVGGGEEGVRVLGGRLKRKRESTFGAKRDNSRSAQFPLGLEFALSVTILAERNSSCAKHNNSHSVQFPLRIQNKCFFNFGAPQGEYSSPLQGLQGPTRIGTRGKNPAVGEGEYSPPPLCPIDIPTYVPPLVL

SEQ ID NO: 129227 - protein, 125 aa, Glycine max
  Coding DNA Sequence Number=SeqID_12449
  Subcellular localization annotation: CTP_CleavageSite=41; ConfidenceScore=5.38e-01
MAESSKKRKGSSSTTAAAGHRRHGPSEAPTTPIHPSLSSPRSSTLFSSDDQRIRYNSQFSSRIILDPKYLDIDFFNDETFDCYQVFQNSGLVDFMSLKLPYYPELLKVFYNNLKIQDSIISSEVH

SEQ ID NO: 129228 - protein, 48 aa, Glycine max
  Coding DNA Sequence Number=SeqID_12450
MKEECGCASPLDFVSIYRGGRDVIDYKICCTGIVTPNWYMIKKDSIIR

SEQ ID NO: 129229 - protein, 106 aa, Glycine max
  Coding DNA Sequence Number=SeqID_12451
MEDEEKRALMGEIKEECVSPDKSEQEKQRQSKVPEAEIHLYRQGKGPMAVFKSALGDWEQDQLEFREDILEKHDMKLVFAFNPTFSRSVLTYRDVVVVYLDGEPKD

SEQ ID NO: 129230 - protein, 122 aa, Glycine max
  Coding DNA Sequence Number=SeqID_12452
  Gene Ontology: Mol. function=DNA binding
MVLNEIQKALEEEYHHNQSEATTNSIPRIQPLVTRPVTGIEAFGPPPMQNQNDKYRLQLFPLSLTSMTFTWYSSLPPNLINSWAVMECCFHDTFYSPQQDILVANLMNTKQLADESITKFLE

SEQ ID NO: 129231 - protein, 145 aa, Glycine max
  Coding DNA Sequence Number=SeqID_12453
  Gene Ontology: Mol. function=RNA-directed DNA polymerase activity; Biological process=RNA-dependent DNA replication
MEVLEDIMQMIEAHLFEKLSKDLVEHRLPLKEGFKLYKQLAQGFNPEVLQMVKKKVECLLSSEFIRRTEYADWLSNIVPLIKKKNKWVVMPFILKNVGATYQRAINLIFHDLISMTMEVYIDDGIVKLAEFDQCLIDLEQAFKRN

SEQ ID NO: 129232 - protein, 98 aa, Glycine max
  Coding DNA Sequence Number=SeqID_12454
MDELTLALIKKSWYMCYSRVRIKTSISQSAKKFFDEDMTKSKGKDPLEGLGGPMTRARARKAKEALQQVLSILFEYKPKFQGEKSKVVSCIMAQMEED

SEQ ID NO: 129233 - protein, 94 aa, Glycine max
  Coding DNA Sequence Number=SeqID_12455
MRRHSVVFRYCRTFYEGEDGGVGGGVRCRGADRDDVRLGVTSEVDRAKVVCGAASDLKEHGDSLLEVGGGRCGEVVADNEVDDGDDENGKGGVV

SEQ ID NO: 129234 - protein, 144 aa, Glycine max
  Coding DNA Sequence Number=SeqID_12456
  Homolog annotation: Hit_ID=UPI000034EE59; Match level="QueryCoverage =95%, HitCoverage=16%, E-value=3e-40, Identity=57%"; Hit description =transcription factor
  Pfam annotation: Domain name=C2; Domain location=6-90; Score=16.8; E _value=0.0077; Accession=PF00168.20; Description=C2 domain
MAKIWIEVCLISARGVRGSPSLWKRQWYAVGWVDPKSKYCTKVDTSGNTNPIWRTKFAVHVDDSEPDLALHVEVYSIDPVFLTEKLHGSATVVLREFLAKEVHNNSEEVGSYQLRKKKSNKPSGFVDVSIRVSEDKEEPNFHPQ

SEQ ID NO: 129235 - protein, 119 aa, Glycine max
  Coding DNA Sequence Number=SeqID_12457
  Homolog annotation: Hit_ID=Q67YP2; Match level="QueryCoverage=81%, HitCoverage=29%, E-value=5e-15, Identity=47%"; Hit description=MRNA, complete cds, clone: RAFL24-17-M19
MGAPRGAMRCRYGGLSYEKQYMQEVQLRAAAEQNVDPKEEQPAVTGGTGKAEAIGGNVKSRPSNSSSTEQDLDTFLLGDLEDSDEAPDDGEGSFDDDFDKIGNSDVEDEKHVKKTAATV

SEQ ID NO: 129236 - protein, 77 aa, Glycine max
  Coding DNA Sequence Number=SeqID_12458
MALPPFVPVFKAKELEIEGRKFPLIIMLKEKSLKILHSQVLLPFNMNNFSHAFLGSYWLELKLEEALDPYLPSTDEE

SEQ ID NO: 129237 - protein, 113 aa, Glycine max
  Coding DNA Sequence Number=SeqID_12459
MRVFAGHVEVLRANCHAIRGVLQPWAHLGPSGSFYMKQPACLGKLSSPGQACYFGLKLPAPLGKLGDKLLPYFCYKRAWEVEGKGSAPLVSIFNLKLVKRRRKKKKIKAETLP

SEQ ID NO: 129238 - protein, 322 aa, Glycine max
  Coding DNA Sequence Number=SeqID_12460
MDQVQRQSFNKEWSGGYTEEVFGGEDKLVDLATIDAILAYHHSKESQVVAMLANMYDTFDLRCEKSSERIVCGTLALYVWLVSHVLDHGSRSIYPLQALRMCLGKDKVRKAWNQVERKDKELRGRSNSVIGGYHKWLEYRVQGIALLKKLEGLNEVETEVSEEREEVRVFKDELERTKMAKEKMTMVVTRVRKECERLKDINMSTAEALEQEMRKARGEASSKKRFQGALLGNSNEVKLRKAKTNKAITENKNMLIIIDQYEGKMDFSIIQGQALKDEQAKVLALRPEKKGTSLMEGTFTRFKENKGGYIPCGSLLVKGFLQ

SEQ ID NO: 129239 - protein, 426 aa, Glycine max
  Coding DNA Sequence Number=SeqID_12461
  Gene Ontology: Mol. function=DNA binding; Cellular component=nucleus; Biological process=regulation of transcription, DNA-dependent
  Homolog annotation: Hit_ID=Q9ATD4; Match level="QueryCoverage=65%, HitCoverage=80%, E-value=6e-94, Identity=65%"; Hit description =GHMYB25
  Pfam annotation: Domain name=Myb_DNA-binding; Domain location=14-61; Score=48.1; E_value=2.9e-11; Accession=PF00249.21; Description=Myb -like DNA-binding domain
  Pfam annotation: Domain name=Myb_DNA-binding; Domain location=67-112; Score=48.7; E_value=2e-11; Accession=PF00249.21; Description=Myb-like DNA-binding domain
  Pfam module annotation: Pfam domain module=Myb_DNA-binding::Myb_DNA -binding; Domain location=14-61::67-112
MGRSPCCEKVGLKKGPWTPEEDQKLMAYIEEFGHGSWRALPAKAGLQRCGKSCRLRWTNYLRPDIKRGKFSLQEEQTIIQLHALLGNRWSAIAAQLPKRTDNEIKNYWNTHLKKRLTRMGIDPTTHKPKTDALGGAGGGQTRDAANLSHMAQWESARLEAEARLVRESKLQVQNNLGSNNTQPARLVLNKITTQQQPSLPPCLDILKAWQSSWNKPPQPSTTKENNTKIMHSMYAMMLSTDDTLESPTSTLCFPGTTTTTMLPVSNNHNNNNIGVLFNENNSNMYSLATNIDDGVFMKDNTATMLHLQMQDDDIMAAVEAFRTYDDNSSNKYNNNNNNNIVVVPPLLSNSVVLEGFNNESNDNNNVASLVVYDSNDNLSTEEAENLAIINGDGSLCNVKNLDENNKHYWNNIFNLVNDPLSGSSVF

SEQ ID NO: 129240 - protein, 77 aa, Glycine max
  Coding DNA Sequence Number=SeqID_12462
LRRGVGIEVVLGRAIVGAMTIDGLTIIGDGWRFRLRWLISLMVDGGFDHGELWWVTKFRYGEGVGQISMGSDMVNNY

SEQ ID NO: 129241 - protein, 53 aa, Glycine max
  Coding DNA Sequence Number=SeqID_12463
MDTHSYYCKFILRAEKVVEEVAIIELEVEKQNLPPNESQPPSPSSQDQNSISA

SEQ ID NO: 129242 - protein, 190 aa, Glycine max
  Coding DNA Sequence Number=SeqID_12464
  Gene Ontology: Mol. function=hydrolase activity; Biological process =proteolysis
  Homolog annotation: Hit_ID=Q1SA76; Match level="QueryCoverage=73%, HitCoverage=28%, E-value=7e-29, Identity=41%"; Hit description =Transposase
MDKDHWMHDNIMSEKVDMNVENEDEPGVKLEHIDCSYAFNTSKDEDVVRDIFWSHLDAVKLFNAYNLVFLIDSNYKTNRYTLLLLDIAGVTSTGMTFSVAFAYLEGECLNNVVWALERFRVLFLIRDALPGVIVTDKDITLMNAVKTVFPECTNLLCWFHIDKNLKAKCKSLEEFDECLKNFEIACLPGP

SEQ ID NO: 129243 - protein, 101 aa, Glycine max
  Coding DNA Sequence Number=SeqID_12465
MELIIIITLLSFSFSYLIPTSSSQIQLEPSLQLEDGNTGAVVNTNLQLSDLPTIPRKLRFTEKVKEVDEARDLASNKQQEGSFASVIQSKVFLLILACMPV

SEQ ID NO: 129244 - protein, 203 aa, Glycine max
  Coding DNA Sequence Number=SeqID_12466
MAFLGETSSQTIVNSRLTFIFPNGTVIHNECGVYFQSSSPVPMRVPNLCDFSTLKSRIHNTLQLNNNQVVDEIHYRRPVEDTADAILNLLEHPSIPTHDAVLYYNGRWNMPRQNNFVGYAFTGINPKKFDIPKGCSIDQLKDLIKQVAPKGNPPHGIHESQVVRRLFYRQPSHLEYSEKVLEFEIIELKCDDDVLKVLVESNY

SEQ ID NO: 129245 - protein, 158 aa, Glycine max
  Coding DNA Sequence Number=SeqID_12467
MEKIFFPLLAPYSSLSVHSSFPLYSLYCLCMYVSRRMVVDGCSRGVWFDSGIGWRWDLLGRGRGLSLPSSSAIEVEDEVLPREEPSSARVKVDENVAYRRRCSSAGSSGRRLFRLIQIFNLFHPRRMGSVSQNYFFFSSSTKQQQCRLSYSFFGDSNR

SEQ ID NO: 129246 - protein, 107 aa, Glycine max
  Coding DNA Sequence Number=SeqID_12468
MTSSLFTLLCSRPEDCVPYQSFANQIMTSSLFTLTHSKLKDYVPYQSFFNRTMTLSLFVLTRERMEDYVLIGHLSSDHDFKPHCVLCLSLEECVPHQSFLDCSGLQV

SEQ ID NO: 129247 - protein, 517 aa, Glycine max
  Coding DNA Sequence Number=SeqID_12469
MKLEGNKVTFRHSNIGLEPESQAFVFIDDDQVSDGYKLQNQKVKEYENVVPAFLENNEQGLDSSQYNMESADCMKNEYEAKVKDIVEPVSHSSKDMESFMKFPNDVESVKRSLTSPISNPAEGRDLPRNSVDGYMDKTVTECEPHLEVCYKESNYHVVKDICVDEGVLNKDKVMFVNTVDEKAHNFFHSESYENKEKQKDNTSIKALSLTPTEEKAHNFFLSESYENKEKQKDNISINVLSLTPTEEKAHNFFPSESKEKQKDNTSINVLSLTPTEESDEVHANHDQPKGLMHKDGDATEKISGNVNKEMKPLPEDKVLLQDLLTEDSVSSDDKGEQISNEPELHSQSEGSKNTVEEAILESPSLALADDESNNDNMLSEKESSTHQLDPSRPSDCGKEECHQAGVCKCDEIQQTMKPVEGKSDDQAVTGHIHHSLGEASFSSIGPMSGRISYSGPVPYSGSISLRSDSSTTSTRSFAFPIIQSEWNSSPVRMAKADRKHFRKQRWCWRDGFLCCKF

SEQ ID NO: 129248 - protein, 58 aa, Glycine max
  Coding DNA Sequence Number=SeqID_12470
MIGRDDEGDRKHGRKFSRKAQHGKFSGTRENFRVQKNEEDSRKGDLRSWKSELKRKIC

SEQ ID NO: 129249 - protein, 415 aa, Glycine max
  Coding DNA Sequence Number=SeqID_12471
  Gene Ontology: Mol. function=pyridoxal phosphate binding
  Homolog annotation: Hit_ID=Q9FGL6; Match level="QueryCoverage=95%, HitCoverage=96%, E-value=2e-46, Identity=48%"; Hit description =Arabidopsis thaliana genomic DNA, chromosome 5, P1 clone:MJM18
  Subcellular localization annotation: CTP_CleavageSite=41; ConfidenceScore=5.57e-01
MQSLGQNEAPLACPQGCCPTSLLFNPPPPPPQSQNTTAKPRNSSAECRHNFAATTTSSIFPNTKFTNHESLPSLHESFSGFKKVYPQYSETDQVDHVRAKEYYHLSFSNQSCLDYIGIGLFSYYQRQHHHDTSNTQLASSSTPQYSDNIPFFSISYKTGNLKTLLLHGGQESEFESAMRRRIMKFLNISDNDYFMVFTANRTSAYDYENEAVEAMISCSEKRGAKAHSGTCKTKRRCLDQVDSLGLIMITNRTRYLINWLVNSMMKLKHPNAEGVPLVKIYGPKVKFDRGPALAFNVFDWKGEKVEPVLVQKLADRNNISLSYGFLHHVWFADKYAEDKGKVLQTKEGRVQGVTTNKKKDRDELGVIVVTVALSFLANFEDVYKLWTFVARFLDADFVEKERWRYTTLNQKTIEV

SEQ ID NO: 129250 - protein, 209 aa, Glycine max
  Coding DNA Sequence Number=SeqID_12472
MNVHFTGHLPPDQNSKPLRAYMLKVEGLCTLSKVCQSDHDFKLLRMFTLKARGLTAYLSGRLPINHDFKPLRAYVLEAGGQCTLLPFHPYALKARGPCTLSVIFQPDHDFPHIGLNDRLSKYTHINNGNYLCNSSGVVTVTQEKLLQVLIITIHGELKDYVSYSSFVDRTMTSSLFALTCSRLDDYVPYQSFADRTFTSNLFALTCLRP

SEQ ID NO: 129251 - protein, 81 aa, Glycine max
  Coding DNA Sequence Number=SeqID_12473
  Homolog annotation: Hit_ID=Q00M75; Match level="QueryCoverage=50%, HitCoverage=6%, E-value=4e-10, Identity=80%"; Hit description=PPR -repeat containing protein
MAYTMAGVRFKLGSCSHLKTLSPMAVANSLDKLYSLDQEDEFVIMESKSRRASPGAAVKLCLGDLLVMGSNPETASLHMQG

SEQ ID NO: 129252 - protein, 86 aa, Glycine max
  Coding DNA Sequence Number=SeqID_12474
MEIADLCDFVRLSIYLLEMKMSMEIIVVTDLLYCHLSWPYTDIHHFLLPWSCRGGRGGNWRKVESGWLSEKWKVKGWGNGVFKCFL

SEQ ID NO: 129253 - protein, 71 aa, Glycine max
  Coding DNA Sequence Number=SeqID_12475
  Gene Ontology: Mol. function=protein dimerization activity; Cellular component=nucleus; Biological process=regulation of transcription, DNA-dependent
  Homolog annotation: Hit_ID=Q0GPG5; Match level="QueryCoverage=75%, HitCoverage=12%, E-value=4e-11, Identity=67%"; Hit description=BZIP transcription factor bZIP105
MQNKPIVAIRPTTSGSSGEQPDDEEVEGEINKTKNMTPVDAKRSTINATIVNKECLSDYIEVRDELLMLGD

SEQ ID NO: 129254 - protein, 94 aa, Glycine max
  Coding DNA Sequence Number=SeqID_12476
  Subcellular localization annotation: CTP_CleavageSite=47; ConfidenceScore=5.07e-01
MVTILKCLGFTFLLLLVLPCFSSIFFSFRTLNPSPYMAIYRKSHLVQGMLAQASWLLKAGGISLPRRVAYLGLKKFHGPSEQDASLGEFRVRKL

SEQ ID NO: 129255 - protein, 118 aa, Glycine max
  Coding DNA Sequence Number=SeqID_12477
  Gene Ontology: Mol. function=cysteine-type peptidase activity; Biological process=proteolysis
MCRKDIDPLKLDDLKNEAVIILCLLEMYFLPSIFNIMVHLIVHLLREIKCYGLIYLWWMYPVERYMKILKGYTKNLHHLEASIIERYIAEEVIEFCSKYIEKAKPVVLLESQHDERME

SEQ ID NO: 129256 - protein, 65 aa, Glycine max
  Coding DNA Sequence Number=SeqID_12478
MVKGGEGGVRVSGELVLLSGNPHLALSVTFYTERNSNPSGIALSALVLLNEMSKSVFLQIPMVKA

SEQ ID NO: 129257 - protein, 68 aa, Glycine max
  Coding DNA Sequence Number=SeqID_12479
MRTRSPLKARACSPLQARMCSPLMARTYGPLKIDCPFEKGDNSCNLILSFANLSGNSLRVYVLFDLVT

SEQ ID NO: 129258 - protein, 134 aa, Glycine max
  Coding DNA Sequence Number=SeqID_12480
  Subcellular localization annotation: CTP_CleavageSite=55; ConfidenceScore=5.01e-01
MTTLTWMTLLFTNILPSDHNVNLPLQMYQLGSRPQDTQWTRRSPTGPWGFQLWLRASVSPTGCPFPQQEWHPQRHPVDPEKSNRALGFPALVTGLCSPTGCPFPPARSRHHRDRAYKTPSGPEEVQQGLGVVKL

SEQ ID NO: 129259 - protein, 38 aa, Glycine max
  Coding DNA Sequence Number=SeqID_12481
MIRLDKEEHDEELIHDEDDPFKGMTKTKQEYLDSSKHN

SEQ ID NO: 129260 - protein, 80 aa, Glycine max
  Coding DNA Sequence Number=SeqID_12482
  Subcellular localization annotation: CTP_CleavageSite=22; ConfidenceScore=5.18e-01
MNALSAPVALSLFIATVNFFFRFMMIALSGPCRAKHVHLGCCTQNDADAKRTCALSVNARLCAKPQCLSVEAELSASMRR

SEQ ID NO: 129261 - protein, 538 aa, Glycine max
  Coding DNA Sequence Number=SeqID_12483
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=6e-60, Identity=31%"; Hit description= UPI00006A17C9 related cluster
  Subcellular localization annotation: CTP_CleavageSite=52; ConfidenceScore=5.74e-01
MARACSPLKGSAYSPLKGRTCSPLAARTCSPQVPRTYSLQVLRTCSPLARACSSLKGRMCNPLKANACSPMKPKACSPSNARACSPLKVRTCSPLKAKPSEGKARVSSLLKTKACRPLKARMCSPLKVRTCSPLKARTCSPFKARTCSPLKAKAYSPLEARTCSLQKARTCSPLKARTCSPLKARTCSPLKARMSSPLKVRTCSPWKVRTCSPLKARMCSSLKARMCAPMKVRACSPMKARTSSPMKVRACRPRITRSCSPLKARTRTCNPMKARTCSPLKARTCAPLKARTCSPLKARTCSPLKVRMYSPRKARASIPLKARACIPLMVKMCSPLKAKVCSTLKARACSPVKARTHSPLKARACSPLNARVCSPLKVRTSSPLKVRVCNPLNARACSPRKKKTCSSLKARACSHLKARACSHLKARACSPLRLETFSPLKTRSCSPLKARTCSPLKARAACCLLKARTCSPLKARACSLLKATTCSPLKARTCRPLKVRTCNPLKARASSPLKARMCSPLKVRVGSLLKERRGRVAL

SEQ ID NO: 129262 - protein, 234 aa, Glycine max
  Coding DNA Sequence Number=SeqID_12484
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=100%, E-value=4e-25, Identity=32%"; Hit description= UPI00006A17C9 related cluster
  Subcellular localization annotation: CTP_CleavageSite=52; ConfidenceScore=5.74e-01
MARACSPLKGSAYSPLKGRTCSPLAARTCSPQVPRTYSLQVLRTCSPLARACSSLKGRMCNPLKANACSPMKPKACSPSNARACSPLKVRTCSPLKAKPSEGKARVSSLLKTKACRPLKARMCSPLKVRTCSPLKARTCSPFKARTCSPLKAKAYSPLEARTCSLQKARTCSPLKARTCNHLKARTCSPLKARMSSPLKARACSPLSYPNFVRGPLLDDVRPFFGPREVLGTHH

SEQ ID NO: 129263 - protein, 259 aa, Glycine max
  Coding DNA Sequence Number=SeqID_12485
  Gene Ontology: Mol. function=chitin binding; Cellular component =extracellular region; Biological process=chitin metabolic process
  Homolog annotation: Hit_ID=UPI000044A8F0; Match level="QueryCoverage =84%, HitCoverage=99%, E-value=2e-36, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHALAFRGLHVLAFRGLHVLAFRGLHALAFRGLYILSFRGLHALALRGVHVLTFRGLDFLAFRGLHLLAFRGLHILAFRGLHVLTFRGLHVLAFRGLQALAFRGLHVHIFRGLHALAFRGLHRAISLCLAFRGLHVLTFRGLHVLAFRGLQVLAFKGLHILVFRGLHALDFRGLHILAFIGLHTLTFRGLHDLTFKGLHAIAFKGICVLAFIGLHAHALMQSYPARALDRKLQVDWAKDAREGPRVLMSLRVDFGPMG

SEQ ID NO: 129264 - protein, 353 aa, Glycine max
  Coding DNA Sequence Number=SeqID_12486
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=100%, E-value=6e-31, Identity=32%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPSEDCMSSPSEGYTPSPSEDYMPSPSEGNRPSSLEDYTSLPSEGYTPSPYEHYTSSPSEDYTSIAFRGLHILTFRGRRLHILTFRGRRLHVLTFRRVDILTFRELHVLASGGLRVIAFRGLHVLTFRGLHVLAFRGLQALAFRGLHVLVFKGLHALDFRGLHILAFIGLHTLIFRGLHALAFRGLHTLAFRGIDRTTPTYLQMTTRPRLQRATCPHHLRTTRPHLHRATRPRHQRIARPGLQRARRLRLAFRGQHTLAISGLHILTVRGLHALAFKGLHGHAFRGLRVLAFRGLLALALRGLNVLAFRGLHAFAFRRLHTLAFIGLHVLAIKGLHVLAFRGLHVVTIRGL

SEQ ID NO: 129265 - protein, 275 aa, Glycine max
  Coding DNA Sequence Number=SeqID_12487
  Gene Ontology: Mol. function=DNA binding
  Homolog annotation: Hit_ID=Q1SDS1; Match level="QueryCoverage=60%, HitCoverage=30%, E-value=2e-19, Identity=38%"; Hit description=IMP dehydrogenase/GMP reductase
VKSLGITSLKELGQLMGQLQRQAFRKAYGKIWDLAMAEVSIEAIASLAQYYDQPLRKQVENGVVGVSRKCLEAKAKARILVGRGEWAPFIDILALLIFGGVLFLNVDGLVDLEAINAFLAYHDRKESLVVAILAYLYDTFNRRCEKSSTRIFCYTLALYVWLVSHFFCQEVRHACPLESHRSCTEKRGANWDRLLASKEGASVNWFPRWKEGRTGVLISCRGFPNVPLMGTRGCISYNPILAIRQLGYPMRGAPLEEELAPTIARGFNNTNVGAL

SEQ ID NO: 129266 - protein, 87 aa, Glycine max
  Coding DNA Sequence Number=SeqID_12488
  Gene Ontology: Mol. function=RNA polymerase II transcription factor activity; Cellular component=transcription factor TFIIF complex; Biological process=transcription initiation from RNA polymerase II promoter
  Homolog annotation: Hit_ID=Q5N8X8; Match level="QueryCoverage=93%, HitCoverage=29%, E-value=6e-24, Identity=63%"; Hit description =Putative transcription initiation factor IIF beta subunit
MTIREKKKSPAKATDTKRTRRDRGEMEEIVFKLFERQPNWSLRNLIQETDQPEQFLKDILKDLCVYNNKGTNQGTYELKPEYRKSGD

SEQ ID NO: 129267 - protein, 214 aa, Glycine max
  Coding DNA Sequence Number=SeqID_12489
GLGSKSSSENYVDDRPDEFVATNDLESRKRKVMKSSILNSKRVYNDSSIHHYLDKEVKEYLPNNASHASEFINVEQVESNAGEHVIRKGRGHTINAKFQKKKKNLIAKGKNIDIQFPPPFYKICGIHAKYFKSEAQVCIRQKAPLQVNGWSKISKDDVDEMWRHMKDAFSLSDEVKEYAMKQIQSQYKNKLYHLHQAYVKEKGRPKYVSPEDWN

SEQ ID NO: 129268 - protein, 78 aa, Glycine max
  Coding DNA Sequence Number=SeqID_12490
MMLHSLNQRLLLGGLSSRQKGSTECGYYVMHWMSTIIFGTFRNNWEAYFNNPRPLEPERLKALRIQWVQFYLRVRDQA

SEQ ID NO: 129269 - protein, 273 aa, Glycine max
  Coding DNA Sequence Number=SeqID_12491
  Gene Ontology: Mol. function=hydrolase activity
  Homolog annotation: Hit_ID=Q38ZY7; Match level="QueryCoverage=97%, HitCoverage=94%, E-value=3e-42, Identity=34%"; Hit description=Beta -lactamase-like
  Pfam annotation: Domain name=Lactamase_B; Domain location=45-217; Score=44.5; E_value=3.6e-10; Accession=PF00753.17; Description =Metallo-beta-lactamase superfamily
MTLHIGECSIDKVIEQTSSLPFAALFPAHRETMGDTLAQQPAELSIHSWVVPTARDTIVIDTATGNGRNRDNKPLFHQLQTAWPQRLAEAGVDPDEVTLVLMTHIHTDHVGWNTCWRAGRWQPMFRHARYICSSRELAQCRSMPSMQALYHDSLAPLLASGQLETIDVQHSPLFAGVLRYMPTPGHSVDHASIVLQSAGAHAVFSGDVMHHPVQFAHPQWNSVFCEDLPRAVTSRQLLIDWCIRHQALWCSSHFAGSSCGRVSPERQWIPVEA

SEQ ID NO: 129270 - protein, 105 aa, Glycine max
  Coding DNA Sequence Number=SeqID_12492
MKGEEGSVEIVEGWGLVNVDERGEDWVRVARCRSTISTSPLQKSERATIRGTTVRAHDGATLVVLRPPILGDLGVSVWDSEVEGFGETGSMTMREVPRQQLRCAG

SEQ ID NO: 129271 - protein, 52 aa, Glycine max
  Coding DNA Sequence Number=SeqID_12493
MVHDISVKVKLEVTGTSTALNVFGSRRRSNKWVYDPNMVGSWYLTHATKNAS

SEQ ID NO: 129272 - protein, 140 aa, Glycine max
  Coding DNA Sequence Number=SeqID_12494
LCCLNVGLLGCCGSLGGLMGTRGWWVYARIVDVENLLCTIARPPPSTTCDGVKLPAFIVDHRVVPGDMSRGSGDLGDVRRAPGSQQIKGTKTTKQGGLWWLASCEFCVICGLWPLVIDYQGLENEVRKLRKPLVIDYQVV

SEQ ID NO: 129273 - protein, 75 aa, Glycine max
  Coding DNA Sequence Number=SeqID_12495
MEEEKAAAYYDELTRKGERAARFKQGLGFSSLAPNDDIPKPSSSPNSSKPPPSRRSKRNSSPSTTSSRKSPLSSL

SEQ ID NO: 129274 - protein, 201 aa, Glycine max
  Coding DNA Sequence Number=SeqID_12496
  Gene Ontology: Mol. function=aspartic-type endopeptidase activity; Biological process=DNA integration
NKEKKDQGNQRSNDDENTITLVINGEVVFLFVEEEECHVANSCVEWVIDSATSYHATSNKELFTMYKVGDFGKVNMGNSIIAKIFGIGGNNFSDGKWKLTKGSLMVVKDIVYSTLYKTQVKLIRDRLNVVGDDVLPNLWHKRLAHLSEKGLQILSRKYLILSKKENVLDMVYSNVYGPMEVETLGGSRYFVMFTDDALRKV

SEQ ID NO: 129275 - protein, 127 aa, Glycine max
  Coding DNA Sequence Number=SeqID_12497
SLQVVAPPGSIPFVEQFLERVAWPGAQPSLHMEDEGPTAQVAQHLEDDSSKATIPEPFLVEEEAEPPALVVDLSSPQYAADPSTPILEIPEDPTTPVLTLSTSLPATLVLHLTDEEDVQTQDTQDQS

SEQ ID NO: 129276 - protein, 234 aa, Glycine max
  Coding DNA Sequence Number=SeqID_12498
  Homolog annotation: Hit_ID=Q1SMF0; Match level="QueryCoverage=94%, HitCoverage=43%, E-value=8e-32, Identity=35%"; Hit description =Tetratricopeptide-like helical
  Pfam annotation: Domain name=FAR1; Domain location=59-215; Score= -61.6; E_value=0.037; Accession=PF03101.5; Description=FAR1 family
MDKDQWMYDSILSEEVDINDENEGEAGVNEEHIDHSDVFNTSHVFATQDDILQWAPSVAYEIGFVTMILRSDINIGMRGRTSFMLIGCKRSGQYGSRKKDFVRRITGSRKCGCPFKLHGKPVVGGQGWMMKLMCGSHNHELAKSLVGHPYAGRLTKDEKTIIAYMTKSMVKLRNILLTLKEHNANSCTTIKQMYNARSAYRSSIRGSDTEMQHLIKLLERNQYIHWHRLKDQDV

SEQ ID NO: 129277 - protein, 236 aa, Glycine max
  Coding DNA Sequence Number=SeqID_12499
  Gene Ontology: Mol. function=hydrolase activity
  Homolog annotation: Hit_ID=Q5H1P1; Match level="QueryCoverage=87%, HitCoverage=59%, E-value=7e-86, Identity=72%"; Hit description=MRNA 3'-end processing factor
MQPGRAIVQWPQFGQHPLRLAQGIAQQDRRFATLFAFAAPRHDFRRHRRRVRPAVDGQGERGFGDEGIAGHHFERRAGRVGLALVVARGHPDLPAVVDAYLRRAEDMAGRVQRYLHLPQAERHALDVRLHRHVTQAPAQDRQAAFAAVVLAHARTGMVAVAMGDDRARYRSPRVDMKIAGGAVQPLRAQHHQIVVACHAVTVACVSCRGAAVVDRRRGADGSSCGREGARQLRAAA

SEQ ID NO: 129278 - protein, 260 aa, Glycine max
  Coding DNA Sequence Number=SeqID_12500
  Gene Ontology: Mol. function=hydrolase activity
  Homolog annotation: Hit_ID=Q5H1P1; Match level="QueryCoverage=94%, HitCoverage=67%, E-value=1e-106, Identity=73%"; Hit description=MRNA 3'-end processing factor
MAGNDDLVVLRPEGLYCAAGDFHIDPWRPVARAVITHGHGDHARPGMGEYHCSEGSLPILRWRLGDVPVQAHVEGVPFRLGKVQVSLHPAGHVLGSSQVRIDDGRQVWVASGDYKRQPDPTCAPFEVVPCDTFITEATFALPIYRWPDTPAVAAEIVAWRRECEQRGEAAILLCYALGKAQRVLAELRPLDDRPAWLHGAIANGVAVYRQAGVPMLETLTMAEQGRQPDAAGQLILAPPSAAGTPWMRRFGRHQLASHPA

SEQ ID NO: 129279 - protein, 410 aa, Glycine max
  Coding DNA Sequence Number=SeqID_12501
  Gene Ontology: Mol. function=beta-N-acetylhexosaminidase activity; Biological process=carbohydrate metabolic process
  Homolog annotation: Hit_ID=Q1ZR57; Match level="QueryCoverage=98%, HitCoverage=51%, E-value=3e-75, Identity=36%"; Hit description=N -acetyl-beta-hexosaminidase
  Pfam annotation: Domain name=Glyco_hydro_20; Domain location=20-203; Score=-170.5; E_value=0.017; Accession=PF00728.12; Description =Glycosyl hydrolase family 20, catalytic domain
  Pfam annotation: Domain name=VWA_CoxE; Domain location=196-398; Score= -86.7; E_value=0.036; Accession=PF05762.4; Description=VWA domain containing CoxE-like protei
  Pfam module annotation: Pfam domain module=Glyco_hydro_20::VWA_CoxE; Domain location=20-203::196-398
GQDSLGASAQDGYQGILSTGFYLDQPQSTAYHYRNEILPQPLGVETAVQPGEQAQSWGFSMPRLKGSAVEGSFTLIEGKQGWRGFIDFNGKSRRAVHDIVWRTPQQVTFRVDTWMGDTRPVFTLQQDKLSGYTLVGNVRYPTRGDKLAAVPAGKMPVVPDEKGQANILGGEAALWAENVRAPLLDLKLWPRAFAVAERLWSAQDVTDSENMYQRLSAIDRWGTVSVGLQQHQQAEVQMMRLANSSDITPLRVLAEVLEPAQYYTRQHLKFQAGHYDYFEPLNRLADVLPAESEPVRLLDKQVDALIANRGDHAAASALRHQLQRWQRNSDAVMPLVLGNYQLKALQPQVRQVAELSRMGLDLVNALERNQAYGAGEVAQMHARLDAAAQVQDETVLALVRPLEKLLRSSR

SEQ ID NO: 129280 - protein, 227 aa, Glycine max
  Coding DNA Sequence Number=SeqID_12502
  Homolog annotation: Hit_ID=Q3AA79; Match level="QueryCoverage=97%, HitCoverage=68%, E-value=9e-14, Identity=30%"; Hit description =CRISPR-associated RAMP protein, Csm4 family
TILSGLINSYNLLFGSEKTKELLGKIDNSHSELLLSSTFFYVGDKYFLPKPKGETFGLENKIEQVKKIKKIKFVEDKVLLENSSLSEENIDIPFILSGKADAAIAKFYEVLERPRVMVARDYSQSNLFYFSEVHFKEGSGLWFYLKVSDDIEKEVLAALKLLSDEGIGGDRTYGFGQFEYDLTQVNLPEQGENYLLLSPYIPDSEDYEENSKEITKLAKAYELRYRT

SEQ ID NO: 129281 - protein, 49 aa, Glycine max
  Coding DNA Sequence Number=SeqID_12503
MENWRTALRNNFAGLQTRSGEWRIGEQRYAITSRGSRLEGGGCMNSARQ

SEQ ID NO: 129282 - protein, 169 aa, Glycine max
  Coding DNA Sequence Number=SeqID_12504
  Subcellular localization annotation: CTP_CleavageSite=50; ConfidenceScore=5.71e-01
MATPPSSSPPPPTGAASHSPSTLKRTRKVTRLRSLVTKPVGAKRPLVHVNPATEKADSPHRKKLRTYLGIIARDKAEFDIPEASDLRTKKKILQTVEECVKDTVCKKYDISKEKWTHFCQSRRDPSWEDVQKKAQVIQKQNTAPQVLSRGGYEYLENKLMEEKKKKQLE

SEQ ID NO: 129283 - protein, 124 aa, Glycine max
  Coding DNA Sequence Number=SeqID_12505
GTGGNTQVVIRINILLLSGYLMDTHAFHQPGANELVDAQRLTSSPAPFVVLTCEGYLIVTRVFRQPGANEPIDAPSLTLSPAPFVVLTRETDVVFCTFCHPGTASKVVGGDALWSSAPFVNRGE

SEQ ID NO: 129284 - protein, 234 aa, Glycine max
  Coding DNA Sequence Number=SeqID_12506
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=UPI00005F8E54; Match level="QueryCoverage =91%, HitCoverage=49%, E-value=1e-100, Identity=79%"; Hit description= COG1455: Phosphotransferase system cellobiose-specific component IIC
  Pfam annotation: Domain name=PTS_EIIC; Domain location=1-145; Score= -78.4; E_value=0.093; Accession=PF02378.9; Description=Phosphotransfer ase system, EIIC
MILPQAIMHLLEPLVSASDSLPAILLSVLMCQIFWFAGIHGSLIVTGIMNPFWMANLSANQAALAAGAALPHVYLQGFWDHYLLIGGVGSTLPLAFLLLRSRVTHLRTIGKMGIVPSFFNINEPILFGAPIIMNPMMFIPFVCVPMVNAVLAYGATRLGWLSQVVSLTPWTTPAPIGASWAANWTLSPVVMCVICMVMSAVIYLPFLRAYERSLIKNEVEKAKSVASVAGAVSQ

SEQ ID NO: 129285 - protein, 159 aa, Glycine max
  Coding DNA Sequence Number=SeqID_12507
LSSARHSARLALSSNPLTCAKRQGGAKRNIDSRAHHNAYFGKRALEAAKGAAFAEITRCRNVPFAGERGRGSRVRFPKEERCAESPPTFICGKRRENRTKPVKMKILSSGVVFTLEEGISTSHVDKSGALAPTYPPSKRKSDLRSSSLCVNQVIDFLLE

SEQ ID NO: 129286 - protein, 101 aa, Glycine max
  Coding DNA Sequence Number=SeqID_12508
  Subcellular localization annotation: CTP_CleavageSite=59; ConfidenceScore=5.27e-01
MGVFPSVTGEIPYSKKSQISHQGSAEFAKRFRLQYPMKRFSTFCRVGLPRSLSRIGHVRSLKEVDAGLASVCPQVLEYSNGSLGNHPPTIGCPRGDPRLPD

SEQ ID NO: 129287 - protein, 134 aa, Glycine max
  Coding DNA Sequence Number=SeqID_12509
MLKNSRESSRNYSLKRYGSASAWIFFTEIIFLGNFERGRSAKKGRSLPPSSLRRARLLPPEGWKDLEGPTFEGVTETHGLRKNTSFRFPPHHGISRIAQACFLLISDTSRDFIYCATKDAKYLKAANQRLHVIK

SEQ ID NO: 129288 - protein, 43 aa, Glycine max
  Coding DNA Sequence Number=SeqID_12510
  Subcellular localization annotation: CTP_CleavageSite=36; ConfidenceScore=5.46e-01
MFNPPENPSRGTSVTFPWVISQRFSTVLRRSSFVLRRSSVFNR

SEQ ID NO: 129289 - protein, 116 aa, Glycine max
  Coding DNA Sequence Number=SeqID_12511
MVMGDFISRLSFPACLHFSEENTETFSSLTSYPELRRSEFLIGGYVGARASLLSTIPPFVAMTQELVVRGDTLRLFAPFCHPEAAGPMTSRDQVWSFCTLVSSRGGGPDDTRRYLT

SEQ ID NO: 129290 - protein, 265 aa, Glycine max
  Coding DNA Sequence Number=SeqID_12512
  Gene Ontology: Mol. function=N-acetyltransferase activity; Biological process=metabolic process
  Homolog annotation: Hit_ID=Q8UBR7; Match level="QueryCoverage=68%, HitCoverage=86%, E-value=1e-91, Identity=91%"; Hit description =Acetyltransferase
  Subcellular localization annotation: CTP_CleavageSite=19; ConfidenceScore=5.13e-01
MAKSQSGRVPEVRNTSHSSASACGKARERGPAFSLPQNRQAIPQCCRHRKGAVGAAPDAMSRSRGRGLAALSQGPPGGGSVRACSSHVPPALQRNPGLAVQPVPFDRHHATERQRTDHAGALELETALLDDTARRDVGDPATGIDLVDLTRTKGHVDQRMRRFGHVSPVPVGFPQPVTDLQRLFVFLGFERAAAQKLAIVHAGNRIDALANLASFGASHKIRGVFGRVGVRHTRYHGRDIGIVGKMGKGVDVFFVRLAQNQPLRQ

SEQ ID NO: 129291 - protein, 331 aa, Glycine max
  Coding DNA Sequence Number=SeqID_12513
  Homolog annotation: Hit_ID=Q9MD97; Match level="QueryCoverage=8%, HitCoverage=51%, E-value=4e-09, Identity=92%"; Hit description =Hypothetical protein rps12
GEESKSDSRSSGERNGSSLNRENGVVGELYKCRAARRSSRECCTLDGESPVAESITSLRSDPSSMGHVESRVNQQGPPCKAKYSWVTDSEVVPETTGAVAKASLHRAIVTAYGPEPGGEMPLEPRASWFSPKCVEAQQLTRHLGVKHCFGAGRESDDGDKLHRREGNSRITAKALNDRSVIRSALAPKMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSRKT

SEQ ID NO: 129292 - protein, 66 aa, Glycine max
  Coding DNA Sequence Number=SeqID_12514
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=P56760; Match level="QueryCoverage=90%, HitCoverage=100%, E-value=3e-10, Identity=53%"; Hit description=ATP synthase C chain
  Pfam annotation: Domain name=ATP-synt_C; Domain location=13-62; Score= 38.8; E_value=1.8e-08; Accession=PF00137.12; Description=ATP synthase subunit C
YEEIIMNPIISAASVIAAGLAVGLASIGPGVGQGTAAGQAVEGIARQPEAEGKIRALALLFANPFV

SEQ ID NO: 129293 - protein, 50 aa, Glycine max
  Coding DNA Sequence Number=SeqID_12515
MARDRHWWSWVVEKKEISLSKLVSLSRNPLLALSTASRTERITSSSLNCT

SEQ ID NO: 129294 - protein, 59 aa, Glycine max
  Coding DNA Sequence Number=SeqID_12516
MKDDEKRKVQDDKKAKNILTSSLSSDEFFSTARCKSAMEIWKMLIMLQSLFGIERNILN

SEQ ID NO: 129295 - protein, 210 aa, Glycine max
  Coding DNA Sequence Number=SeqID_12517
  Gene Ontology: Mol. function=helicase activity; Biological process =viral genome replication
  Homolog annotation: Hit_ID=Q6YTQ6; Match level="QueryCoverage=99%, HitCoverage=19%, E-value=2e-40, Identity=37%"; Hit description =Helicase-like protein
  Pfam annotation: Domain name=DUF889; Domain location=86-208; Score= -17.9; E_value=2.7e-10; Accession=PF05970.5; Description=Eukaryotic protein of unknown function (DUF889)
ALSGIASLLLPGGRTTHSKFAIPVPATQNSTCNIHQDSELAELLKVTKLIVWVEAPMCHKFAFEALDKSLKDIMQNNLPFGGKIIVFGGDFRQILPIVPKGDGKIGQHNDGFLEITIPDEFRIKNYDDPIHAIVEATYPSLIDNYSDTNYLQKRAVLASKKEIVDKINDYVLSLVPNNEKEYCSADSIDKSDELLNPAFALLPPEFLYSL

SEQ ID NO: 129296 - protein, 282 aa, Glycine max
  Coding DNA Sequence Number=SeqID_12518
  Homolog annotation: Hit_ID=Q1RUD8; Match level="QueryCoverage=47%, HitCoverage=30%, E-value=1e-20, Identity=40%"; Hit description=IMP dehydrogenase/GMP reductase
SSKSGQDLGISARPSETKQKWGELLVFGIVLFPNVDGLVDLAAINTFLAYHHNKESPVVVVLADAYDKFDWRCKKSNTRIICCTPALYVWMVSHIFHHESRLVCPLQGRHMCAEKGKTNWEELLEGFPNVPLMGTRGCINYNPMLAIRQLGYPVRRAPSEEIIVLLIARDKELRGSNNGVIRDYHTWLKARTEEAEVPEESEEVQSLKAKLERARGVKEKFKMTATRVRKECDELRDVNMAMAEGTQALKGRKGRVKDGKYDIRGQVEGLSKVEEEFNRTTE

SEQ ID NO: 129297 - protein, 194 aa, Glycine max
  Coding DNA Sequence Number=SeqID_12519
  Homolog annotation: Hit_ID=O49929; Match level="QueryCoverage=76%, HitCoverage=74%, E-value=1e-46, Identity=60%"; Hit description=Pore protein of 24 kD
  Subcellular localization annotation: CTP_CleavageSite=38; ConfidenceScore=5.25e-01
MWIVKVLYDGVVEILIHPLFSSPTSSSFLVSLSPPPPQSLRVWSLRHFVSEVTFINGPSLTGLALVDYNVPKMDFWFQFMNTVRVRERSLNLTYVHSRGDYRIIMDGTFVYDSANKVSTNYTLNSGNYKLKYTYVHKGLTTFAYDMAKNMWDFFILWKVYSGNDTLRASYQTYNRVLGVEWLRNPKHTAGFKVE

SEQ ID NO: 129298 - protein, 372 aa, Glycine max
  Coding DNA Sequence Number=SeqID_12520
  Homolog annotation: Hit_ID=Q1S568; Match level="QueryCoverage=25%, HitCoverage=38%, E-value=6e-15, Identity=47%"; Hit description =Glycosyl transferase, family 8
MELSFVEDDGWVLFEGDGGEFGNVVDKYEVGVGVSEVVVSVVEKEIEGKVDGGGDEAKDGNIFKGVAEGGVEDAIEKGKGGLGGNNDEVEDDIFGAGGVLKDEEDDDHEGGLLRKDSWNMLRNLSSLSTLPWCVIGNLNNILPGTLIVVEEWLDYALTTKDWLDLHPDVELKNTLASMSDHSPIILYVDAQRHDVKETAQGSWDDSCDVEFTSKIKEEEVMEYNKEKEVLTNKALAKGWRYEHQIFHSSASRNYGVVPNKVNTKNSDEDNLILMRPFSIEEFKEGRVVCNTLCKLHQIERDPEDVHVWDCTVEDDLKELIGTTYTNKMHILFGSTSLKNSIVKRSLILKAVKVDCGVLRKVYLRKVLTGEGF

SEQ ID NO: 129299 - protein, 204 aa, Glycine max
  Coding DNA Sequence Number=SeqID_12521
  Subcellular localization annotation: CTP_CleavageSite=44; ConfidenceScore=5.14e-01
MAKKQNQPQAAQAAPDLKNNPPSTSSENSSPIWITRPAPMTILVAEVIMKDKEPRVHVEHFFDIESLENAGVIKSHLMLCGIHHFFEDPKANVPELIHEFWRISKVYMNKIIGRYFTRKVLGIIVKLIAETIAQAIGCSKDFLSNAHKFILYHLIKGTSFDLPQILFNCFATKVIKDKSIGKDIYHNIVLTKVFEVHGVIKKFL

SEQ ID NO: 129300 - protein, 370 aa, Glycine max
  Coding DNA Sequence Number=SeqID_12522
  Homolog annotation: Hit_ID=Q9FKB4; Match level="QueryCoverage=86%, HitCoverage=56%, E-value=2e-35, Identity=29%"; Hit description =Genomic DNA, chromosome 5, TAC clone:K24G6
MAECVASAFCVKLNAQRRPVRERGFSGQITSLKSVQRKYSRNGCKFVHFSMWKTFELSVFGATHLKFTPHLQEFPLKCIGLGALVDFNGATASDLVPVVDQMLLLGSIFLTYMAGVIPVEKSYASYQKTNSDKNVFPESSDISGSSAKKNSGFESKYVLNVVREKLLNSLNALENKDYSGDIIVQSAKRPLSLSAVARGPKLRLLWAVFQQVEEEAGILFIFFNIRPLSLSAVARSPKLRLLWVAFQHVEEEAGIIFIFFNTVICIIYVNSFSCISRAVGMDDLFGMFSDIIQRSCHSTCTAWLEKEFFLLKGNADKELASMILVKVKGDITIVQSITRSGKKDLYAELLWYLTFGSLSLCNEAGMLQII

SEQ ID NO: 129301 - protein, 266 aa, Glycine max
  Coding DNA Sequence Number=SeqID_12523
MASGLIEHVPCSRRCLAKTEDVKDPMVVVADHLGFEENCKRVADQDLELKYIHLFQGVPKQDVGRASLICKGHLDDTVGYINTTQHWVVLYQVNCLDVARVSNESMELGSLTWVMYTSRHSFGSVVPSYFLVVKLFELEGIVASIMLRTKWFLNCDNYLPKVLKDKGIASERTLRFVARGKSIVVDLASPPSCGIASVDCSIGVVFVLVLVIFMSSWAPWELVGLGSSSSMDFFASWKMNDSGMEKEEREETPLQGEDESRRSSPS

SEQ ID NO: 129302 - protein, 202 aa, Glycine max
  Coding DNA Sequence Number=SeqID_12524
VAEDDVSLCVLSGFSSYRMQKVYTDNHSGISGRQRDSKVSMTDLVSTEDNLNLHVSTGLSAAIAKGAEDDVSLCVLYGFSSYRKQKVYTDYHSGICARQRDSKVSMTDHVSAEDNVNLHVQQKVYTNNHSGISARQRDSKVSMTDLVSAEDNGAEDDVSLCVLSGFSSYRMQKVYTDNHSGISARQRDSKVSMTNLVSAKEN

SEQ ID NO: 129303 - protein, 200 aa, Glycine max
  Coding DNA Sequence Number=SeqID_12525
  Gene Ontology: Mol. function=protein kinase activity; Biological process=protein amino acid phosphorylation
  Homolog annotation: Hit_ID=Q2QZ78; Match level="QueryCoverage=91%, HitCoverage=33%, E-value=1e-57, Identity=59%"; Hit description=AT hook motif-containing protein, putative
  Pfam annotation: Domain name=DUF889; Domain location=123-200; Score= -91.3; E_value=2.7e-05; Accession=PF05970.5; Description=Eukaryotic protein of unknown function (DUF889)
MFFLYEFGGIGKTFIWRTLASSLRAENQIVIIVASSGITSLLVPGGRTAHSRFKIPIPIFEDSTCNIHQGTELAELLNQTSLIIWDEVAMAHKFCFEALDQSLRDIITNKSNSNQIFGGKVIVFGGDFCQILPVIPRGTRSDIVNAAINSSYLWDSYEILTLTKNMRLHSNLESVDEQETATFAKWILDIGDGIIDDEHD

SEQ ID NO: 129304 - protein, 85 aa, Glycine max
  Coding DNA Sequence Number=SeqID_12526
  Subcellular localization annotation: CTP_CleavageSite=45; ConfidenceScore=5.00e-01
MGAKYLEVVKRGSHPNNGWSPDEIRPASTAKRSFSALCVTRESGRAQELRSCAKRKISLLSETFVSCQAQCTTGAKRDIAISEPI

SEQ ID NO: 129305 - protein, 73 aa, Glycine max
  Coding DNA Sequence Number=SeqID_12527
MGPITSRQFDLEGLVEGLPKVQKKPISAFMRDEDQHVSHHQQARGRVIDSLHQEATMWMDRFALTLNGSQELP

SEQ ID NO: 129306 - protein, 39 aa, Glycine max
  Coding DNA Sequence Number=SeqID_12528
MAQVEAINTRRNEVDKKVLLGRWSCFYMIGVLLMLDKAI

SEQ ID NO: 129307 - protein, 459 aa, Glycine max
  Coding DNA Sequence Number=SeqID_12529
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=2e-50, Identity=37%"; Hit description= UPI00006A17C9 related cluster
FRGLHILPFRGLHVLPFSGLHVLILRGLHALAFRELHVLPFGELHAIAFKGLHVISFIGLHVLPFKELHVLAFRGLLVLTFRGYTSSTSETYTPLPSKDCTSSPLEDYKCSPSNGCTHSPLEDYTSSPSESYTASHSEEYTSSLSEDYTGLNVLAFRALHLLPFRELQAVAFRGLHVFAFRGLHVLTFRGLHVLPFRGLHALPFRGLHVLIFRGLDALAFRGLHDLPFRGLHVLTFRGLHVLPFGGIHVLTFRGLDALAFRGLHDLPFRGLHVLTFRGLHILAFRGLHVLQLKGLQVVAFRGLHVLTFRGLHVLALRGQHILPFRGLHVLTIRGLHSLAFRRLHALQLKGLQVVAFRRLHVLPFRGLHVPALRGLHILPFRGLDVLTIRGIHSLAFRQLHALPFSRQHVLPLRELLALAINGLHVLAFIGLHVLSFRELHALSFRGYSSSPSEDNTSSP

SEQ ID NO: 129308 - protein, 150 aa, Glycine max
  Coding DNA Sequence Number=SeqID_12530
  Gene Ontology: Mol. function=serine carboxypeptidase activity; Cellular component=cellulose and pectin-containing cell wall; Biological process=proteolysis
  Homolog annotation: Hit_ID=Q45NN7; Match level="QueryCoverage=94%, HitCoverage=76%, E-value=3e-58, Identity=75%"; Hit description =Serine carboxypeptidase S10 family protein
MISLSQGRAMQIGNPLVEFNTDFNSRAEFFWSHGLISDSTYEIFTKVCNYSQIRRQHQGGTLTPICSGVNRLVSTEVSRYIDTYDVTLDVCLSSADQQAYVLNQLTQLQEGAKIDVCVEDETIAYLNRKDVQEALHAKLVGITSWSTCSE

SEQ ID NO: 129309 - protein, 62 aa, Glycine max
  Coding DNA Sequence Number=SeqID_12531
MKSCMMRSRNKLEIQKSTSSNNSQVWFHATSLASRDIILLGNNIVAVGTTNDNASPNEENSR

SEQ ID NO: 129310 - protein, 43 aa, Glycine max
  Coding DNA Sequence Number=SeqID_12532
RDGFGDEFKSGINHPISNPERLDGSGTGPQVHRNKMYIYALTA

SEQ ID NO: 129311 - protein, 79 aa, Glycine max
  Coding DNA Sequence Number=SeqID_12533
MAPPLPKGTFFNVGSARGINYFRLEELDMRCVTDINPGGTCYGTYASSPIARLDAARKALFDLRVLFSPLSWLHPADRK

SEQ ID NO: 129312 - protein, 111 aa, Glycine max
  Coding DNA Sequence Number=SeqID_12534
PEPMSAMQTALIHQKDRDGYQQDKTYHVATSSFLTQTDPKRARLAKHKELGEMQDFFLKELEQKLFTHAQLKPTSISSGGRSGGVVQLGLPFGNPGPPPVYSYAISITAKV

SEQ ID NO: 129313 - protein, 49 aa, Glycine max
  Coding DNA Sequence Number=SeqID_12535
MARVRGPKLLMLRQPLRKVLIETPQDRLGIEQSSAFRLSRARLRTTTYW

SEQ ID NO: 129314 - protein, 113 aa, Glycine max
  Coding DNA Sequence Number=SeqID_12536
MRRSSVGELVPLDLEIEATFRRNNAERKRKLLHNITVASILEEAHFYESSSSNSPTSKESQTTEFEAEVMAEEQPRRVTLEDYSSTSVPQYFSSATWPKVQEQNLTYPPSLIS

SEQ ID NO: 129315 - protein, 43 aa, Glycine max
  Coding DNA Sequence Number=SeqID_12537
  Subcellular localization annotation: CTP_CleavageSite=33; ConfidenceScore=5.29e-01
MVPGASLASVKFLKTLGGSNCAVSSSTFLKMVSGASVASVMLP

SEQ ID NO: 129316 - protein, 33 aa, Glycine max
  Coding DNA Sequence Number=SeqID_12538
MVRALTNGERGGLCDLVDSLNYAASVATLPTVS

SEQ ID NO: 129317 - protein, 224 aa, Glycine max
  Coding DNA Sequence Number=SeqID_12539
  Homolog annotation: Hit_ID=Q00M75; Match level="QueryCoverage=13%, HitCoverage=5%, E-value=2e-08, Identity=96%"; Hit description=PPR -repeat containing protein
MEEIKQHSRMFIGTCKRLKIMKGSDPIGLENCFVPAGFQVRNVFPAIKEALTVNGIEGDNIYAFDHSTSFSKRNFKELLRLTSIRYTKTKVATQKHASEAFHKVASITWRWGWLKGEDLSLIHVNHFAPAHFQKKITLVLNIVFVSIINSFLKDKKKTSYPIAQRLFAMRRYGGGMLYAALPLHMQRGRFQIRTHDQQVTKAQLYRCTRARPPGSIAWKAIILT

SEQ ID NO: 129318 - protein, 96 aa, Glycine max
  Coding DNA Sequence Number=SeqID_12540
  Gene Ontology: Cellular component=integral to membrane
  Homolog annotation: Hit_ID=Q6Z1N7; Match level="QueryCoverage=89%, HitCoverage=49%, E-value=1e-18, Identity=54%"; Hit description =Putative peroxisomal membrane protein
MSDEVNNVFKKYLNQLQLHPLRTKFWLVLVMQWHRSYLGQETSVRRVLLFMLYGFAYSGPFGHFLHKLMDKIFKGEKGNDTVAKKVLSTMGILGII

SEQ ID NO: 129319 - protein, 323 aa, Glycine max
  Coding DNA Sequence Number=SeqID_12541
  Homolog annotation: Hit_ID=Q1SKD7; Match level="QueryCoverage=59%, HitCoverage=57%, E-value=3e-12, Identity=24%"; Hit description =Ankyrin
MASKKLSTKRSRKDAIGESSSAASGFDRHRFRSAKHQQCFEVIKGWSFHRERQVQHREDEYPNFQEEVTRRRLAPLVTPMAKFDSEIVIEFYANAWPIEEGVQDMSSWVRGQWIPFDANALNQFLDHPLILEEGQQCEYGQRRNQASSFDEEAIAQLLCIPGNILPSDHNSDLPLPKCQLVYAILTRMSIHVAQLIANAIYLFAGTTPARHPLDPKKSNRALGFPALITNLCYKVIQLPITRALIEKYCTPRQAGWSTIYDMWPASRRPTTGDWCGCMSIFTDTPSASKAKVGPARTPEDADGAQEDEDMAYLLDFLGGSGAT

SEQ ID NO: 129320 - protein, 591 aa, Glycine max
  Coding DNA Sequence Number=SeqID_12542
  Gene Ontology: Mol. function=RNA-directed DNA polymerase activity; Cellular component=intracellular; Biological process=RNA-dependent DNA replication
  Pfam annotation: Domain name=G-patch; Domain location=346-390; Score =6.5; E_value=0.029; Accession=PF01585.13; Description=G-patch domain
MSGNKHVPFPYKNSNAVPWRYAPPKPSKRKEETTDIDSLSAKVTNITCLSGVTHSGHIFAPPDLPARPVNAKGKAKVIKEQTNKASPVSDEDVSIGRFTKRKEGFSGREVSLEESNEFLRIIQQSEFKIIEQLNKTPARVLNKAHVAQDISVEGFEGIVNNITANNYLTFAKEEIPAEGRGHNRALHVSVKCMEHIMAKVHIDNGLSLNVMPKSTLEKLSFDASHLRPSSMVVWAFDGGRWEIGPHTYQVTFQVTDINPAYSCLLGRPWIHSVGVVPSIFHQKLKFVVEGHLIIVSGEEDVLVSCPSSMPYVEATEESLETIFQSFEVVSNASIKSLPMQLRMFGTTMMVVWVMLVHDYEPGMGLGKNNDGMAGVVDIKGNHERFRLGYKPTQADVRKNILERRNKGQGSQPRPQAREVPPCHISRSFVSMGLRHEEQVTAIFDEAPQRRLGLVQPCLPDFQLGNWQVVERLEVYMTNIISDNESCEGTNTEDPAINFEREASRAEDEEEEDIGFFSKLERIIAQEDQEMKSHQEETEILNLGVGDGKKEIKVGTGMTTPICEELVALLWDYQDVFAWSYEDMPGLSRDIV

SEQ ID NO: 129321 - protein, 141 aa, Glycine max
  Coding DNA Sequence Number=SeqID_12543
  Subcellular localization annotation: CTP_CleavageSite=64; ConfidenceScore=5.58e-01
MRGYRMVTSTFRQPGANEPVDVQRLASSSAPFVVLTRKVLLSSFGNIQARRCARFFSAGQGRSSAMAKGSVVVVQLCRFQDTEGKLSYPNFVRGPLFGGMQPSLDRFEGCANSNQAHLGLLGGSNRRRCLLVEATQLAWAS

SEQ ID NO: 129322 - protein, 43 aa, Glycine max
  Coding DNA Sequence Number=SeqID_12544
  Subcellular localization annotation: CTP_CleavageSite=19; ConfidenceScore=5.14e-01
MPRRFCNVSITFSWVISCRFSTVFQRSSFVLHRSSVFNRFLKA

SEQ ID NO: 129323 - protein, 74 aa, Glycine max
  Coding DNA Sequence Number=SeqID_12545
  Homolog annotation: Hit_ID=Q9ZR08; Match level="QueryCoverage=99%, HitCoverage=8%, E-value=3e-20, Identity=58%"; Hit description =Putative receptor kinase
MDNGNLIVSDEVNHQVKILWQSFANQIDTFLPGMKMDDNLALTSWRSYEDPAPGNFSFEHDQEENKYIIWKRSI

SEQ ID NO: 129324 - protein, 506 aa, Glycine max
  Coding DNA Sequence Number=SeqID_12546
  Gene Ontology: Mol. function=indole-3-acetic acid amido synthetase; Cellular component=cytoplasm; Biological process=response to auxin stimulus
  Homolog annotation: Hit_ID=O81829; Match level="QueryCoverage=99%, HitCoverage=80%, E-value=0.0, Identity=69%"; Hit description=Indole -3-acetic acid-amido synthetase GH3.5
  Pfam annotation: Domain name=GH3; Domain location=1-478; Score=826.1; E_value=1.8e-245; Accession=PF03321.4; Description=GH3 auxin -responsive promoter
MPTIEDELERRSLLYSLLMPVMDQFVPGLDKGKGMYFLFIKSESKTPGGLLARPVLTSYYKSSHFKNKTHGLNFDPYTNYTSPIETILCQDSYQSMYSQMLCGLSQNEHVLRVGSVFASGFIRALKFLEKHWESLCHDIRNGTIDHEITDSTVREAIMKILKPNPKLADFIEGECKKGLWKGIITRLWPNTKYVDVIVTGTMAQYIPMLDYYSNGLPLVCTMYASSECYFGLNLNPLCDPSEVSYTLVPTMAYFEFLPLNKMKGHANSISHTEQELLVDLVDVELDQEYELVVTTYAASNNYVIMHNPHTGLYRYRVGDILRVAGFKNNAPQFNFVCRKNVVLSIDSDKTDEVELQNAVKNGAKHLATLGASLTEYTSCADTSTIPGHYVLYWEINMNNNDQTPIPSSVFEECCFAVEGSLNSVYRQGRVSESIGPLEIKIVENGTFDKLMDFALSQGASINQYKTPRCVKYAPIVELLDSKTVSNYFSPKCPQWVPGHKKWCMYP

SEQ ID NO: 129325 - protein, 196 aa, Glycine max
  Coding DNA Sequence Number=SeqID_12547
MDFITQVLSIRDKYSDIRVLCFRARLSFSRLNSLIRRAIRHNVRELDIEASTVCTDDYFNFPRCVIWSETLRVLKLKSGFRLPPSSILSNNHLLIQPFYNLKHLELHTGFNRSNVPGLILLFKSSRTLNTLILKIIHEYRIERKEWNRDLWGMTITEGEKSERVFSTTLGSAAKFMVFLVMRMLHLQSFSQSMGRP

SEQ ID NO: 129326 - protein, 108 aa, Glycine max
  Coding DNA Sequence Number=SeqID_12548
  Gene Ontology: Cellular component=integral to membrane
  Homolog annotation: Hit_ID=Q1SRT2; Match level="QueryCoverage=99%, HitCoverage=25%, E-value=2e-34, Identity=73%"; Hit description=Amino acid/polyamine transporter II
MKLYEFVIIFGCFMLILAQIPSFHSLRHINLVSLVLCLAYSAGATIGSIYIGKLNSQSPFQFFWRVIKRTRKGYSLKGDSMNRLFGIFNVIAIIATTYGNGIIPAIQV

SEQ ID NO: 129327 - protein, 131 aa, Glycine max
  Coding DNA Sequence Number=SeqID_12549
  Gene Ontology: Mol. function=pyridoxal phosphate binding
  Homolog annotation: Hit_ID=Q9FGL6; Match level="QueryCoverage=90%, HitCoverage=18%, E-value=6e-24, Identity=50%"; Hit description =Arabidopsis thaliana genomic DNA, chromosome 5, P1 clone:MJM18
SIRGPAVAFNVFDWKGEKCDPALVQKLADRNNISLGSSYLRNIRFSDKNEEERHWASETTRGCSEVEGLGLSKKKTRSHEPGIFVVTAALGLLTNFEDIYRLWAFLSRFLDADFVEKERWRYMALNQKTIE

SEQ ID NO: 129328 - protein, 125 aa, Glycine max
  Coding DNA Sequence Number=SeqID_12550
  Gene Ontology: Mol. function=nucleic acid binding; Cellular component= nucleus; Biological process=DNA integration
TTLNIELEQLIVKTSFLHGRLEEDILVKQPKGVEVEGKENYVCRWKWYLYRLKQSPSLYDLCVYHNKVEDDSHIYLLLYVDHVLIASQILLAIQKLKSLLSSEFEMKDIGVAEKILGMEIKSDRV

SEQ ID NO: 129329 - protein, 201 aa, Glycine max
  Coding DNA Sequence Number=SeqID_12551
DRELRGSSNGIIGGYHKWLRVRTQGLDWLPNLKTVRDDEVKASEESDEVQALKAELERARVVEEKFKAAIVSSSSEEVKGIIMGQRHDLEGRAKGNMWAIIDKCKEKLNLAATHEQRLKDEYAKISAEREARERVIDSLHQEATMWTNRFALTLNRSQELPPLLAKAKAVADTYSAPEEIHGLLSYFQHMIDLMDHMIRNR

SEQ ID NO: 129330 - protein, 386 aa, Glycine max
  Coding DNA Sequence Number=SeqID_12552
  Gene Ontology: Mol. function=DNA-directed DNA polymerase activity; Cellular component=intracellular; Biological process=DNA repair
  Homolog annotation: Hit_ID=Q1GXK3; Match level="QueryCoverage=95%, HitCoverage=95%, E-value=1e-128, Identity=61%"; Hit description=DNA -directed DNA polymerase
  Pfam annotation: Domain name=IMS; Domain location=12-367; Score =308.2; E_value=1.5e-89; Accession=PF00817.11; Description =impBmucBsamB family
MPDQETRRIAHIDMDAFFASCELSRYPELKGLPMVVAGRASHAPRLKEDGTREFSRLRDYAGRGVLTTATYEARALGLNSAMPTMHAARLAPDAILLPVNFELYRHYSRLFKEAIRSISPLVENIGIDEVYADVSALTGDATEIAQRLKSAVFEATSLTCSVGIAPNKLLAKLCSEMQKPDGITVITMADLAKRIWPMPANKINGIGPKASAKLESLNIHTIGEIAAMNEAWLVQHFGNSYGRWLYRVSHGQDERPVITESAPVSMSRETTFERNLHPLRDKPELSQAFTQLCERVASDLQHKGYICRKIGIKLRFDDFKTVTRDLTLPAPISDAKSLRQAAGKCLKRIDLSKHIRLLGVKASGLTRADSPANTGTGQFELDFNFD

SEQ ID NO: 129331 - protein, 200 aa, Glycine max
  Coding DNA Sequence Number=SeqID_12553
  Gene Ontology: Mol. function=5'-nucleotidase activity; Cellular component=cytoplasm; Biological process=nucleotide metabolic process
  Homolog annotation: Hit_ID=Q2XM95; Match level="QueryCoverage=94%, HitCoverage=57%, E-value=9e-75, Identity=68%"; Hit description=5 -nucleotidase, putative
  Pfam annotation: Domain name=5-nucleotidase; Domain location=1-197; Score=263.9; E_value=3.2e-76; Accession=PF06189.3; Description=5' -nucleotidase
VDSRGSHNTSLWGSANEEDVQSAIDLDYPAGVVLPSKVYDDEADTELRIAFDFDGVIADDEAEAVFKMNNDLGEFEAHEVEKQSIPHQAGPLADLFKKLSFMQQLEEKLLKENPSYKKILRIAIITARNAPSHERVVTTLKEWGVSADESFFLGGMEKARILAVLKPHMFFDDQRSHLQSSAGDIPMVHIPFGIANKKIK

SEQ ID NO: 129332 - protein, 196 aa, Glycine max
  Coding DNA Sequence Number=SeqID_12554
MLEIGLTFGRPLVLGILEVVSNPWRFILVNWFYDADLVNPTRIDRVLTNKDLLADSYPDLEAFNLDEKEFLLLKVISTLPELSCLICSMVGAGLGTDNVALSMTHFPKRVASSHFMVLGRETLAFVISVINKVVSPLCDHVSYPNFVWGSLFVSMQPSFDHLKMFNHHRCGIHKVPRCFGKKPVKNTKMEVYLAKW

SEQ ID NO: 129333 - protein, 182 aa, Glycine max
  Coding DNA Sequence Number=SeqID_12555
MLRALASSGIVLASFSHDLSKLNDMLAVRTDRLKKLLVSKIQEDDYNDIEDRNNPFKLIERIKIQDVKIQNWLNFSLDITEPEKVFEPLFTTRRNQYTGEEEGTGLGMWLIKSIVNENDGTLGYNVPYNGVELVEEFLTIRYKFPSFVLTAKDQDAVSDSEDVNLVYTKSLMTTEIADTKAK

SEQ ID NO: 129334 - protein, 57 aa, Glycine max
  Coding DNA Sequence Number=SeqID_12556
MAGKAEINELVHSCRDAHGRVVVGLRMDKSISDKDSGALEEGFDFCLPEVLIHGRFF

SEQ ID NO: 129335 - protein, 92 aa, Glycine max
  Coding DNA Sequence Number=SeqID_12557
MTRGLEAIEVNWFSIGEQRFNTNSTYGVGRRLQCKARNHSASLWLAWAPKLLQGEGTSSLWRALARPGELPLPPSAHFPINRGVREAKERFQ

SEQ ID NO: 129336 - protein, 83 aa, Glycine max
  Coding DNA Sequence Number=SeqID_12558
MELFQTNYGISLNDSNGNSNKQACDISNNNNDMVIIIMKIIFVLTNENFISIVGGGRPNGDISNDDGINGYNVVHGINDMKLI

SEQ ID NO: 129337 - protein, 719 aa, Glycine max
  Coding DNA Sequence Number=SeqID_12559
  Gene Ontology: Mol. function=nucleoside-triphosphatase activity; Cellular component=integral to membrane; Biological process=transport
  Homolog annotation: Hit_ID=Q2PCF1; Match level="QueryCoverage=95%, HitCoverage=86%, E-value=0.0, Identity=44%"; Hit description =Pleiotropic drug resistance protein 2
  Pfam annotation: Domain name=ABC2_membrane; Domain location=329-542; Score=205.8; E_value=1e-58; Accession=PF01061.14; Description=ABC-2 type transporter
  Pfam annotation: Domain name=ABC_tran; Domain location=5-227; Score =49.7; E_value=6.8e-12; Accession=PF00005.17; Description=ABC transporter
  Pfam annotation: Domain name=NACHT; Domain location=5-135; Score= -40.0; E_value=0.076; Accession=PF05729.3; Description=NACHT domain
  Pfam annotation: Domain name=PDR_assoc; Domain location=547-614; Score=130.8; E_value=3.8e-36; Accession=PF08370.2; Description=Plant PDR ABC transporter associated
  Pfam module annotation: Pfam domain module=ABC2_membrane::ABC _tran::NACHT::PDR_assoc; Domain location=329-542::5-227::5-135::547 -614
MYYLRLTLLLGPPRSGKTTLLQALAGKLDRDLRVSGRVTYCGHELSEFVPQRTCAYISQHNLHHGEMTVRETLDFSGRCLGVGTRHELLLELIKREKQSGLKPDPEIDAFMKATAVEGQETSLITDYVLKVLGLEICADTLVGDEMRRGISGGEKKRLTTGEMLVGPAKVFLMDEISTGLDSSTTFQIVKFLRQLVHVMDVTMIISLLQPAPETYDLFDDIILLSEGHIIYQGPRENVLNFFESVGFKCPERKGVADFLQEVTSRKEQEQYWFARDKPYRYVSVPEFVAHFNNFGIGQQLSQDLQVPYDRAETHPAALVKDKYGISKLELFKACFAREWLLMKRSAFVYIFKTTQIMIMSLITMTVFFRTEMRSGHLEDGRKYYGALFFSLTNIMFNGMAELSLTIFRLPVFFKQRDSLFFPAWAFAIPIWIFRIPLSFVESGLWVVLTYYTVGYAPAPSRFFRQLLAFFCSHQMGMSLFRFIAALGRTLVVANTFGFFVLLLVYVLGGFIIAKDNLEPWMKWGYYISPMMYGQNAIAINEFLDERWSAPNTDHRIPEPTVGKALLRIRSMFTEDYWYWISIGALLGFSLLFNICFIIALTFLNPYGDSKSIILEEENEKKGTTEDSSASTDKSFENIDMAEKNTRESSIPKAGTATTKRGMVLPFKPLSLAFDHVNYYVNMPTVNSTHSSPNLTTFKCYFSIVFRCFLFLPVISISVD

SEQ ID NO: 129338 - protein, 197 aa, Glycine max
  Coding DNA Sequence Number=SeqID_12560
  Gene Ontology: Mol. function=nucleoside-triphosphatase activity; Cellular component=integral to membrane; Biological process=transport
  Homolog annotation: Hit_ID=Q2PCF1; Match level="QueryCoverage=89%, HitCoverage=11%, E-value=1e-37, Identity=51%"; Hit description =Pleiotropic drug resistance protein 2
MEEGVDADEVVRSVSSLRMSIGSMSRRSWVSASVSEMWGAGHGGDVFERSTRVDDGDNDEEELMWAAIERLPTFERLRKSIVKRALEESGRFNYEEVDISNLGFQDKKKLLHAILRKVEVDNETFLRRIRERIDRVAIEIPKVEVRFEHLFVEGDAFNGTRALPTLVNSTMNAIEVLQWDPLQPNNCVVVAAAYNDT

SEQ ID NO: 129339 - protein, 256 aa, Glycine max
  Coding DNA Sequence Number=SeqID_12561
  Gene Ontology: Mol. function=RNA-directed RNA polymerase activity
  Homolog annotation: Hit_ID=Q1RZP1; Match level="QueryCoverage=92%, HitCoverage=19%, E-value=1e-112, Identity=84%"; Hit description=RNA -binding region RNP-1 (RNA recognition motif); RNA dependent RNA polymerase
MPPHLKPKLYPDFMGKERHQSYRSKKILGRLYRRIKDAYDEDIDAPYLNFVTGDIPYDKDLEVPGSADFIADAWEQKCSYDGQLSGLLGQYKVKREEEVVTGQIWSMPKYNSRKQGELKERLKHSYSALKKEFRHTFEKLNSDVGELSEEEKNLFYEQKASAWYQVTYHPEWVKKSLDLQDKSSENQEADSLGSTVMLSFPWIAVDYLARTKIRQRHQRCGNFDSTKPVDSLAKYLSERFVPKPGNASGFEAYDCI

SEQ ID NO: 129340 - protein, 447 aa, Glycine max
  Coding DNA Sequence Number=SeqID_12562
  Gene Ontology: Mol. function=nucleoside-triphosphatase activity; Cellular component=integral to membrane; Biological process=transport
  Homolog annotation: Hit_ID=Q7PC84; Match level="QueryCoverage=99%, HitCoverage=32%, E-value=1e-148, Identity=55%"; Hit description =Probable pleiotropic drug resistance protein 11
  Pfam annotation: Domain name=ABC2_membrane; Domain location=171-385; Score=223.3; E_value=5.5e-64; Accession=PF01061.14; Description=ABC -2 type transporter
  Pfam annotation: Domain name=ABC_tran; Domain location=1-95; Score= -51.3; E_value=0.006; Accession=PF00005.17; Description=ABC transporter
  Pfam module annotation: Pfam domain module=ABC2_membrane::ABC_tran; Domain location=171-385::1-95
MFVEEVMNLVELHPVRDFQVGLPGIDGLSTEQRKRLTIAVELVANPSIIFMDEPTSGLDARAAAIVMRAVRNTADTGRTIVCTIHQPSIDIFESFDEAFPEVPRIKDGYNPATWVLEISTPAVESQLRVDFAEFYTKSELRNQELIKELSTPLEGTKDLDFPTKYSLSFITQCIACFWKQHLSYWRNPQYNGIRLFMAISIGVIFGLIFWKKGNQTDTEQDLMNLMGAIFAAVFFLGGSNTSTVQPIVAIERTVFYRERAAGMYSALPYAIAQVAIECIYVAIQTFTFSLILFSMMGFLWRVDKFLWFYFFMFISFVYFTLYGMMTAALTPNPQIAAIVMAFFLVFWNVFSGFIIPKSQIPIWWRWFYWVCPTAWSVYGLVTSQVGDKDTPILVPGSEPMTVKAFLEEEFGYEYGFLGVVAVAHIAFVALFLFVFAYGIKVFNFQKR

SEQ ID NO: 129341 - protein, 1012 aa, Glycine max
  Coding DNA Sequence Number=SeqID_12563
  Homolog annotation: Hit_ID=Q2R243; Match level="QueryCoverage=28%, HitCoverage=51%, E-value=2e-34, Identity=35%"; Hit description =Expressed protein
  Pfam annotation: Domain name=XS; Domain location=852-952; Score= -19.2; E_value=0.00032; Accession=PF03468.5; Description=XS domain
MQYNRRREEEHGVPHRFESEPDPFRRNRRDGSDSARQRKVSPLKVDGVRRVGGGGNKGGSDGFEGRDYDWQHVGGGRRSARVRSRSPPAEPVRKRSHFDDGVGHNRSCSPPQPPPPGLRARYELSKTTDYSVDDGNLDGKRVYLDREQDLVEGRLGGMVDQKFVVRENELGGSYGYRSIPPDMDVSVTTRYKEAGEHLPLLPRGVPAGRFEHGRLHHRDGPPMDKMPITESHSRAEKTIVHARDVSYSAVSPSYAKDFAGPSHMRDYGDSSIEMSRGDFLCSHGDGICLPASYDLSRNSRKLAEPVGFSGHGQRAIIDTARGPEIGLRNMACHQRCEFSPTRTEHEDYLNHKLQVRAAQDELLYQYDDLPRRIAPHGRLDYEQSVTEYDNREFSRPCIPHPDLDRTGKSEDSYGNQRRVIVHDHPALQKPKYFDYHDVRRTSIASMQGEAYLRSGYKHLENGKSIPQDYEVSHMGAPEADRLPILRTEYESRRDRGPGLQQERFQSPPLSKHNSETYRQGVKVQEMRQDLGIHDHSDRLMKRKYNPNDEIDVHDLRTIKSSKWGATEEFQDAYECEEWVDDRDMDMLYSSGNVEFNPKIYRKYKKEYDELENEEDFPSDEWVIPQGSMGHVQRHSFQFRKYSNQNIKHHSKSSSSNWYKSQHFSKRNAIQKQPKVWKKYHGYDENKHAANDESSEDWISAAESEPTEGSEEFNQMVHENFLMYSKKLNLNLYVQRRYEDQGKAGSLYCIVCGRRFPRNCRLVMLRKKGKTAMIPETGKFMWLLIFKGSSKEFMDTQRLVTHAFMSHKAGLRAKHLGLHKAVCVLMGWDTVVPQDTVTWVPQVLPQAEALAQKEDLILWPPIVIIHNISMSDDNPQNWKVVSMETIEGFLRGKGFVRGRIKLCLGKPADQSVVLVKFLGTFGGLGDAERLHKYLSDNNHGRAEYERVKSEGIKSCNISETDEGDKVENILYGYVGIAEDLDKLDFNSKKWSMVKSRKEIDDLDKAPVKTDEKR

SEQ ID NO: 129342 - protein, 369 aa, Glycine max
  Coding DNA Sequence Number=SeqID_12564
  Gene Ontology: Mol. function=protein binding; Cellular component =microtubule cytoskeleton; Biological process=phosphorylation
  Homolog annotation: Hit_ID=Q10AZ7; Match level="QueryCoverage=99%, HitCoverage=89%, E-value=1e-116, Identity=46%"; Hit description =Kelch motif family protein, expressed
  Pfam annotation: Domain name=Kelch_1; Domain location=106-151; Score =21.0; E_value=0.0043; Accession=PF01344.15; Description=Kelch motif
  Pfam annotation: Domain name=Kelch_1; Domain location=156-204; Score =13.8; E_value=0.11; Accession=PF01344.15; Description=Kelch motif
  Pfam annotation: Domain name=Kelch_1; Domain location=3-44; Score =3.3; E_value=1.6; Accession=PF01344.15; Description=Kelch motif
  Pfam annotation: Domain name=Kelch_1; Domain location=55-100; Score =32.6; E_value=1.4e-06; Accession=PF01344.15; Description=Kelch motif
  Pfam annotation: Domain name=Kelch_2; Domain location=1-44; Score =7.5; E_value=3.9; Accession=PF07646.5; Description=Kelch motif
  Pfam annotation: Domain name=Kelch_2; Domain location=106-151; Score =27.5; E_value=4.7e-05; Accession=PF07646.5; Description=Kelch motif
  Pfam annotation: Domain name=Kelch_2; Domain location=156-204; Score =17.0; E_value=0.071; Accession=PF07646.5; Description=Kelch motif
  Pfam annotation: Domain name=Kelch_2; Domain location=209-252; Score =10.0; E_value=1.8; Accession=PF07646.5; Description=Kelch motif
  Pfam annotation: Domain name=Kelch_2; Domain location=55-100; Score =28.2; E_value=2.9e-05; Accession=PF07646.5; Description=Kelch motif
  Pfam module annotation: Pfam domain module=Kelch_1::Kelch_1::Kelch _1::Kelch_1::Kelch_2::Kelch_2::Kelch_2::Kelch_2::Kelch_2; Domain location=106-151::156-204::3-44::55-100::1-44::106-151::156-204::209- 252::55-100
VIPLLTSGNPKVVVFGGLVDKKFLSDMAVYDIEAKQWFQPECTGSGSDGHVGPSSRAFHVAVAIDCHMFIFGGRLGSQRLGDFWVLDTDIWQWSELTGFGDLPSPRDFAAASAVGNRKIVMYGGWDGKKWLSDVYVLDTISLEWMELSVSGTLPHPRCGHTATMVEKRLLVYGGRGGGGPIMGDLWALKGLIEEAQWKRLSIGNEPPPARAYHSMSIIGSRYLLIGGFDGKSTYGDPWWLVPQEDPIASRLTASPPRNIPESKDVTSLNDDFQPQFKESQTEKFPFSELQRRLQISVSESNSRLHIVNELEDKELLELASRLAGENVSTNSLAIEALREHWRKSESNMVKLKELGPLLRDYQRLIYRQY

SEQ ID NO: 129343 - protein, 88 aa, Glycine max
  Coding DNA Sequence Number=SeqID_12565
MVLNCGCGRGCGVTNQEKKVISNYGFMILEKGRPYNCGGFAFIPETKPFKVTCFPAYISYEFPIAIIKLQLPKHNVLSSKLQEHNYQM

SEQ ID NO: 129344 - protein, 197 aa, Glycine max
  Coding DNA Sequence Number=SeqID_12566
  Gene Ontology: Mol. function=chitin binding; Cellular component =extracellular region; Biological process=chitin metabolic process
  Homolog annotation: Hit_ID=UPI00006A17C9; Match level="QueryCoverage =77%, HitCoverage=100%, E-value=3e-22, Identity=33%"; Hit description= UPI00006A17C9 related cluster
MTKDNDWYLKALHWGNEGAPCMSLNTLTFRGLYVLTFRGLHVLPFGGLHALVFRGLHVLTIRGLHALTFRGLHVLAIRGMHILIFRGPNILIFRGLHVLTFIGLHALTFIGLHVLTFIGLHALTFIGLHVLTFIGLHALTFRGLHVLSFRGLHVLHFRGLHILHFRGLHVLAFRGLHALAFSGLHIRTLSEFKVLFP

SEQ ID NO: 129345 - protein, 152 aa, Glycine max
  Coding DNA Sequence Number=SeqID_12567
  Gene Ontology: Mol. function=sugar porter activity; Cellular component=integral to membrane; Biological process=carbohydrate transport
  Homolog annotation: Hit_ID=Q1S244; Match level="QueryCoverage=84%, HitCoverage=26%, E-value=7e-32, Identity=51%"; Hit description=Sugar transporter
MMGRKRTPSLLVETLRARLTQMPLLSLHGTACNACRQIMPSVPIVNQFLPRACLAIEKSVRGVCNAAYAPGMGTVPWVLNSEIYLLRYRGLGGGIVAVSNWCANLIMSESFLSMTESLGIANIFLLVVGFSLVVTQQTHFSLLLASRWLQRS

SEQ ID NO: 129346 - protein, 79 aa, Glycine max
  Coding DNA Sequence Number=SeqID_12568
MKMLQCEGFSSKMRYYFEIPNGENVRNWVANVLLKFHDDPTVNKSEIVIFLRQVWWAAGKRKGFERRRGKTKMRPKRGT

SEQ ID NO: 129347 - protein, 64 aa, Glycine max
  Coding DNA Sequence Number=SeqID_12569
MEPNIPEVLVAPEAGPSHAPSDVEHVNIVSTNKALIQDFFKIKPCLTMKGFKSFKVHVIDYQYM

SEQ ID NO: 129348 - protein, 210 aa, Glycine max
  Coding DNA Sequence Number=SeqID_12570
  Homolog annotation: Hit_ID=Q1T493; Match level="QueryCoverage=96%, HitCoverage=39%, E-value=3e-11, Identity=25%"; Hit description =Nucleic acid-binding, OB-fold, subgroup
  Pfam annotation: Domain name=Rep_fac-A_C; Domain location=1-122; Score=-55.9; E_value=0.0083; Accession=PF08646.1; Description =Replication factor-A C terminal domain
MDNHSWCYPACAQCHRKTDIPIGPFTCGCGKDNDQPVLRYRVEVMVTQNNKSGKFLLWDREYAELIGQTADDVNRVKIEDGDLDLNASPQALDKLLVHVLAFKVRIQSRLKNAVVLKYSKDLDLINAVLEMLADSEACSKIDPSNVDCNDATHAECQFVSVTADHDPVAGLPLTPRKRMSSNEADDGLGSSQISPAQLSSNKLTRHSHRS

SEQ ID NO: 129349 - protein, 82 aa, Glycine max
  Coding DNA Sequence Number=SeqID_12571
MTPPTTPSVGFRGESEVGLRQWHQRCMLFLVGMRVEGESENGGVKGDTENGNPRRHGGWIGGSDSDQNGERSKGNDGDEQDF

SEQ ID NO: 129350 - protein, 588 aa, Glycine max
  Coding DNA Sequence Number=SeqID_12572
MDLEEQLKTVILQRKMAEKATADVLAILESEGISDVSEEFDSGSDLENPCDSSVSNECAKEGEEPMSSKGRQHGSDKMPGSNVDSSPVSSKSLSWKGRHDSSHSLEKYKTSNLRRQSSFSSISSSPKHRQGKSCRKIRHRQIRLVVEESRNKFANHEKELASLSKGFPNFSGGGSNIPKIESEIQEEGGSGANPLNKNHHVDGYGREKDMEKALEHQAQLIDQYEAMEKVQREWEEKFRENNSTTPDSCDPGNYSDMTEDKDESKVHIPFAAKVVTSDAQESKGEPRGVCLSEEKFKAEARDIMPKTHDDTGGYSDQKNTTFSTSDLLGQQNSCPPLKGNQNESSVNGHFQPSVMNHQDPGRHGYHDSKPTYSFPTDIHGVQHQNDASRNKTDLFALVTHEQPHKFNGVLESLKQARISLQQELKRLPLVESGYTAKPSASFSKSEDRFEVPVGCSGLFRIPTDFSDGATARFNVKDPTAGFGSNFHLNRAMSRTSDGQFFPSLPYPDTQLSLPANDQSLAIRYVENGPNGGSLSSSKYTYPTFPINPSYQNATPQMPFGNEVSRPYSSSTVGVPLANRFSFNSDHLR

SEQ ID NO: 129351 - protein, 167 aa, Glycine max
  Coding DNA Sequence Number=SeqID_12573
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=100%, HitCoverage=10%, E-value=3e-42, Identity=49%"; Hit description=Chromo
MNSLFQPYLRRFVIIFFDDILIYSASIEEHLTDLEVAFQLLLNHQFVLKLSKCFFAQSQVEYLGHLVSHAGVQPVASNIDAIRQWPVPQTIRAVRSFLGLPGFYRRFIKGYASIAAPLVQLTTMPKFQWTVTAQIAFDHLKQALSEASVVAVPDFTLPFTHETDGSG

SEQ ID NO: 129352 - protein, 283 aa, Glycine max
  Coding DNA Sequence Number=SeqID_12574
  Homolog annotation: Hit_ID=Q9M3G7; Match level="QueryCoverage=76%, HitCoverage=4%, E-value=8e-14, Identity=30%"; Hit description =Serine/threonine-protein kinase ATM
MGKTAEVPLNTKHVIEKTRLKNSIEKVIKKPLNSKLAIEKTERKNIIEKAIKIPLNTKLAMHSPGNGESLGTCLLLHFSPGAYLPSKEDLLTTFYRFGPLKVCETQLLKDTCSAQVVFVKSADAETAFHSLEYNNFPFGSTLVDYKLYHLSATCPLVEQCVTHAQPTGSIAMPGVTEPSGSMPMPMPGVIPIQPIESITMPRVIPTLPIRSIATPDVTPTQQTWSTAMPPSETPPSVEFMKQKLEMMASTMESSGHRLSPQIRAELDAGIKNLLKRVNSRLNA

SEQ ID NO: 129353 - protein, 53 aa, Glycine max
  Coding DNA Sequence Number=SeqID_12575
ECTRDLRDFESLFGSQLPKGPVPPSGPSSCHNKLSPYKYSKASFPDDYYNFCP

SEQ ID NO: 129354 - protein, 70 aa, Glycine max
  Coding DNA Sequence Number=SeqID_12576
MARQDSRVLLPKRKMPGVATNVYSGKTLEKPKGRIFRRMIDLIQRKLLQPRYVHCYINMKAARVFYQVRD

SEQ ID NO: 129355 - protein, 169 aa, Glycine max
  Coding DNA Sequence Number=SeqID_12577
MALSGYTHDSLQVSHSSAHGADRQTICVAPRLNHTRIRGIHWLCRADFQGSRKGYRWRVMTNEKLSEGEPGGSWWACNTLIKSHQNERDPLAVQPLRSKKFGMLQDVTPITMDHSRYYYILGDLRLTDNWSGNVLSWRFELVCPVQVIMDRGDHTNMTPKEEEEYHELL

SEQ ID NO: 129356 - protein, 55 aa, Glycine max
  Coding DNA Sequence Number=SeqID_12578
MYLCSMLSFLHGSQWNSDVRMVMNVRVAAWKHMHTTRVAWYISSSIGFGIAEHAM

SEQ ID NO: 129357 - protein, 138 aa, Glycine max
  Coding DNA Sequence Number=SeqID_12579
  Subcellular localization annotation: CTP_CleavageSite=71; ConfidenceScore=5.12e-01
MAQSLTLQHRSIGNILQKQKRVRTMSSRNESYPKLGLDLNLPPPTIVNHRLESPARSTTVLPTSPSNSCVSTELNQDDNNNNNSNNNLEYSNNSEAIFVVLVGCSYCLMYLMVNEGDLKCPKCKSTNLIHFLNFNNIP

SEQ ID NO: 129358 - protein, 762 aa, Glycine max
  Coding DNA Sequence Number=SeqID_12580
  Gene Ontology: Mol. function=nucleic acid binding
  Homolog annotation: Hit_ID=Q06AW3; Match level="QueryCoverage=16%, HitCoverage=90%, E-value=8e-09, Identity=31%"; Hit description=RNA -binding protein
  Pfam annotation: Domain name=RRM_1; Domain location=91-154; Score =53.8; E_value=5.6e-13; Accession=PF00076.12; Description=RNA recognition motif. (a.k.a. RRM, R
  Pfam annotation: Domain name=zf-CCHC; Domain location=329-346; Score =31.0; E_value=4.1e-06; Accession=PF00098.13; Description=Zinc knuckle
  Pfam module annotation: Pfam domain module=RRM_1::zf-CCHC; Domain location=91-154::329-346
MGHRKVCFGSSINIDTLEAANACVPLDQMQCYSTPPSTHGSKHNPVTDAIVPSHFSDSHDSKSPLATHRFDPVDSSSGASERNGAEFEMSLYIGNLSEHSRRDDLERVFRRFGHCNVQLKRNGYGFVVFDFPLDAEKALRALKGRNICGESLTLTWSSKQPSSHFSRIPSGVRRNAYELGHARNAERVGYARRRMGTNGRSNQKMGRGKSVEMAGEERGYCRDDFKDYVGEKKNYEGDFPNEGGGVVPNKEENGGWGEPVHDPLVDNGNGSGIEFDRYEPYQCPDRKHDNEDYHVGYSGGSPAAHSQENVSRALGEDTSNCSNGSKFQQNCFRCGDPGHKMRNCPKEHTSQRKYNSKIVQQNNKIDKKHKSEDENKFESDSLARLQSSVEALSMRHQIDGRRLSGSRHHHAPRRNESSPVTRETDKHNKKEYGGKKRSRNEIELPKQSKAKISKQSVSSSLLSDYSASRFHSNSQSSKSLHRSSSHSRSRSVSSRSYSSSSKSQYCKGKRLNSRRLSSSMPLCVSLNQTLSSSPNKIQLNSKGSSINGTALESVEHLVAQGQQIGSKMELENLQSKDTVIAVNGKAAVYTTVVDDVEKGQFVQEDNHENHFFLKSSGRVTDLNEPLVGNLSPPVEKETKGLEHSGAMMLDNISTEIEKPASETNVNLHSNLSTIVSTEEIRMVLNTYGLELPKDDENNLTIDAVFGCARLWPWHVVYYRRLKKGPISTENYARRVAQNQEFGIVDKYIRSSSGWGEFSLENA

SEQ ID NO: 129359 - protein, 107 aa, Glycine max
  Coding DNA Sequence Number=SeqID_12581
IPEHKGRVVPVWFRLCKKSFTKRMENLNQSNFSQHQLDLAPYASEPYNAQWNAPRLLRDKHTLRSSRILGEMEVDEPLLGLWLPLNYQIDMGARMAFVDNWAVGKEK

SEQ ID NO: 129360 - protein, 83 aa, Glycine max
  Coding DNA Sequence Number=SeqID_12582
  Subcellular localization annotation: CTP_CleavageSite=55; ConfidenceScore=5.03e-01
MKCVLKSVFLTFLIIVILFYWTRGAPVLSGLVFGCTTSSRLQNTSPLRLKDEPFVDSMDKDNVEGEGVGGAGVFVSIQVFWGA

SEQ ID NO: 129361 - protein, 256 aa, Glycine max
  Coding DNA Sequence Number=SeqID_12583
MYVPTSTATLGELFYYLHIKAYKTKRCGTKELRPQTLTLHHAAQTHADRGRGGGDGSGGGGNGDEYDGRGREARDDPGGTSGATSFRVVSPLLVSGTSKGAVCCCGMSAGHGGRVGMVAGAVSLGDGVGLSGRGSGRVSGVVGHWSSSSKDEAFVDSMDKDNVEGEGVGGAGSSPWKTAQLNHICIYTLQVSQTTENAQRTLPSGRSRKYFRQIVSAVRHYHWHDMYHCDLKLDNILLDKDMNLKVSDFGLGALRS

SEQ ID NO: 129362 - protein, 336 aa, Glycine max
  Coding DNA Sequence Number=SeqID_12584
  Gene Ontology: Mol. function=ubiquitin-protein ligase activity; Cellular component=ubiquitin ligase complex; Biological process =protein ubiquitination
  Homolog annotation: Hit_ID=Q84VE7; Match level="QueryCoverage=95%, HitCoverage=47%, E-value=2e-60, Identity=39%"; Hit description=Arm repeat protein
  Pfam annotation: Domain name=U-box; Domain location=270-336; Score =57.2; E_value=5.2e-14; Accession=PF04564.6; Description=U-box domain
  Subcellular localization annotation: CTP_CleavageSite=55; ConfidenceScore=5.45e-01
MALSPETFTTRKRRPRGSSFTSPKVNDLNVLSSLLQLTDQICSLNLTATLLNRVSSSTIRKTQLLGVVFEELFRVSNLNSDSVLFLCLEEMYIVLHKLKTLIQDFSNGSKFNLLMQIDTVAESFHRLTGELSTLLDVFPLQDLDLNDDVRELVLLVRKQCSEAKAFIGAEHVSLRNDVVLVLDRIKNEIVPDQAHLASIFEKLEIRDASSCRAEIESLEEEIHNRCEEQPKTDLVALIGLVRFAKCVLYGASTPSQKTVTLRRNQSSELAIPADYRCPISLELMRDPVVVATGQTYDRVSIKLWMDSGHNTCPKTGQTLSHSDLIPNRVLRNMITA

SEQ ID NO: 129363 - protein, 142 aa, Glycine max
  Coding DNA Sequence Number=SeqID_12585
  Gene Ontology: Mol. function=ubiquitin-protein ligase activity; Cellular component=ubiquitin ligase complex; Biological process =protein ubiquitination
  Homolog annotation: Hit_ID=Q8LRC7; Match level="QueryCoverage=77%, HitCoverage=16%, E-value=6e-16, Identity=42%"; Hit description =Putative arm repeat protein
MAAIPEDGVTILEAVVKRGGLVAVAAAYAGIKRLGAVLREGSERARESAAATLVTMCRKGGSEVVAEMAAVPGVERIIWELMAVGSVRGRRKAATLLRILRRWAAGLDGGENEGFPTTTTMVASSTTTVVVPTTTTTTSLAQ

SEQ ID NO: 129364 - protein, 164 aa, Glycine max
  Coding DNA Sequence Number=SeqID_12586
KDHALQLPYRTRARARVMGEVEEVQEQMKADTEALKEQMATMMEVMMSIKEIMEVNAAVIAVTSTITEPSFSAKNKHAFPPYGLPPNYTPPNVAYTPSKDVNNFAPILIESRQPQTDHAHVSQTMGERHEIPYHNLADFEPCLGYATEGQAVGGIPLQNTLEGP

SEQ ID NO: 129365 - protein, 159 aa, Glycine max
  Coding DNA Sequence Number=SeqID_12587
MDNTYWRLDSMLLHICHAPWVKYTGVMAGAYVHMSLAKGGMYWSHPGDTLLHVCHSLWVRRSTEVELQVGCDPEGTFSVEAKLSRSEIFSGFTSISPYEVPPSYFLHFIVVVRPPCQWFPNFYGDHGVYAICESSVDTLQQMVSGILNKAQVEKDEGPK

SEQ ID NO: 129366 - protein, 203 aa, Glycine max
  Coding DNA Sequence Number=SeqID_12588
  Gene Ontology: Mol. function=RNA-directed DNA polymerase activity; Cellular component=cell wall; Biological process=RNA-dependent DNA replication
MTIKIDPEKAYDRLKWDFIVETLTDIGFPNNFIDKTTLLFFAEASIDQENIIKGILMLFVRVLVPDSIATQLGYQRTVDLGNYLGIPMHLQRVSSKSFSFITKKVDQPLGNWKAKNLSLAGRVTLTKFVIQALPTYAMQSNYISASVCDEIDKRCCIFIWEDSNNSRKVHWMSWKALCSPKKSGGLGLRMLSHMNKSLLMKST

SEQ ID NO: 129367 - protein, 328 aa, Glycine max
  Coding DNA Sequence Number=SeqID_12589
  Homolog annotation: Hit_ID=Q9T041; Match level="QueryCoverage=23%, HitCoverage=8%, E-value=2e-14, Identity=58%"; Hit description =Microtubule-associated protein TORTIFOLIA1
MVSSARVCKISDEGSTIEEDDLLHRSTTKIREGSKIVEEVPKEKEGDVNETKDGLGDDRGGGGGGVGTMVGLFVKPLFEAMGEQNKGVQAGAAVCMAKMVECGGGGEGGEVVPVAAFQKLCPRICKLLNSPVFEPYWSCIEAVSSLRKPYLSRVPEEKSHEVRADVSPKETTNPYIINDNNDINDKDNQFGAVDYANKILESEEALKASLDVMNFPTDDMGLKYESSRMFLVETHASNAVATRIIPKTSFNVSFVKETRVQSRGIWCLWKSENWKVEILRSDDQYAWMVIGDFNTVLYAHDRIGGSENPCWRGTNIYMDERKFGSAPR

SEQ ID NO: 129368 - protein, 54 aa, Glycine max
  Coding DNA Sequence Number=SeqID_12590
MEESRRFSTTPKRIPNLSHSITIAKATSESFNLLLTNRAETFLSHMTVISKSIG

SEQ ID NO: 129369 - protein, 124 aa, Glycine max
  Coding DNA Sequence Number=SeqID_12591
  Homolog annotation: Hit_ID=Q1RYI2; Match level="QueryCoverage=72%, HitCoverage=14%, E-value=2e-07, Identity=29%"; Hit description =Ribonuclease H
MMHDLRRLNEELDVLQSSMMVNDSTSKSYWSPPCPGVFKQLQRVCGGIIRDEKTNFIQAYSRRMASCSILEAKLWSIFYGMRLAEDCGVQHIIMESDSAEAVNHLMEHSYDNHLLFHLVQEIKR

SEQ ID NO: 129370 - protein, 70 aa, Glycine max
  Coding DNA Sequence Number=SeqID_12592
  Gene Ontology: Mol. function=protein serine/threonine kinase activity; Biological process=protein amino acid phosphorylation
  Homolog annotation: Hit_ID=Q6ULS3; Match level="QueryCoverage=57%, HitCoverage=15%, E-value=2e-13, Identity=85%"; Hit description =Phosphoenolpyruvate carboxylase kinase 4
AALKHTAWRRLLRRIIPVSLVVFFDCRQPVKANLRFPTRVFCSISPAAKDLLRRMLCKELSRKFSVEQVL

SEQ ID NO: 129371 - protein, 180 aa, Glycine max
  Coding DNA Sequence Number=SeqID_12593
HDSNVSMTDLVSAEDDIAKKNVYTDNNSGNSARQRDSNVSMTDLVSAEDDANLHVSTGFSAAIDTAKKNVYTDNHSDISARQRDSNVSMTDLVSAVVDTSKKNVYTDNNSGNSTRQRNSNVSMTDLVSAEDDANLHVSTGYSAAIDTAKKNVYTDNHSGISARQRDSNVSMTDLVSAEDD

SEQ ID NO: 129372 - protein, 784 aa, Glycine max
  Coding DNA Sequence Number=SeqID_12594
  Gene Ontology: Mol. function=GTP binding; Cellular component=exocyst; Biological process=vesicle docking during exocytosis
  Homolog annotation: Hit_ID=Q9LXX6; Match level="QueryCoverage=99%, HitCoverage=99%, E-value=0.0, Identity=67%"; Hit description =Probable exocyst complex component 6
  Pfam annotation: Domain name=Sec15; Domain location=436-781; Score =36.3; E_value=2.3e-11; Accession=PF04091.3; Description=Exocyst complex subunit Sec15-like
MRRGVMENSDGGEDMVLANLIANGDDVGPLVRLAFERGRPEGLLHQLIYVVKQKEAEIEEMCKTHYEEFILAVDELRGVLLDAEELKSELQSDNFKLQQVGSALLAKLEELLESYSVRKNMTEAIEMSKNCIQVLELCVKCNSHISEGQFYSALKTLDLVEKSCTQNIPAKAIKMLIESRIPVIKLHIEKKVCSEVNEWMVEIRSSAKNIGETAIGHAVTVRQRDKEMLEQQRKAEEQSISGLGDLAYTLEAEELEEDSVLQFDLTPLYRACHIHDCLGIQEKFREYYYTNRLLQLNSDLEITSAQPFVESYQTFFAQIAGFFIVEDRVLRTTGGLLVADQVETMWETAVAKMSSLLEEQFSCMESAPHLLLVKDYVTLFGSTLRQYGHEIGTLLDVLNSSCDKYRLLFLEECQQQILDVFGNDPYDQMEIKKQSDYENIVLSFNLQTSDIMPAFPYTAPFSSMVPNACRIVRSFIKGSVDYLSYGIHVNFFDVVRKYLDKFLIDVLNVMLLEKINSGNVTVPQLMQIAANIAVLERACDFYLRHAAQLCGIPVRSVGRPLGTLTAKVILKTSREAAFIALQSLVNTKIDEFMTLTESVNWTPEETNENGNDYIHEVIIYLDSILSPAQQILPLDAVYRVGSGAFEHISNSIVAAFSSDNVKRFNANAVINVDYDLQIIENFAEERFYSAGLGEIDDEVSFKICLVEARQLVNLLLSSHPENFLNPDIWEKNYYTLEIKKVAAILDKFKDSPDGIFGSLANKNAKQSARKKSMDVLKKRLKDFN

SEQ ID NO: 129373 - protein, 82 aa, Glycine max
  Coding DNA Sequence Number=SeqID_12595
MALSPCQRRMKKEVSEPKCQFDVVIRVSDEVEDCTEELEEDLLGGFWRRGEGPPTTTTVSSGNIFPTTMDDKEDTTIKNPFL

SEQ ID NO: 129374 - protein, 57 aa, Glycine max
  Coding DNA Sequence Number=SeqID_12596
MASYGDLKKQRNPLTKKIQGLQAPHGATSFDSLEGYTTPIWVTPTTFVSYQPELQHS

SEQ ID NO: 129375 - protein, 174 aa, Glycine max
  Coding DNA Sequence Number=SeqID_12597
MPLSEISHFLKSIGFEGSKKNCIEAGTAERQLIDLENDEVDSDNEYNPSFVCDKDMATNLELYETPCLKDVKWIDKQVHGKAMGKSMEKPFSIAAFLATSGGNNKKMLSRNKPKPSDKGRSSIVETHSKSTHDLPLPPLKRERVVNIEDGVEPASCSLIVVSKIGGPPMWMSSG

SEQ ID NO: 129376 - protein, 115 aa, Glycine max
  Coding DNA Sequence Number=SeqID_12598
MIGGMMNVLSGATLFCKITHAPNIFMICVHRDSLGRNNQHENKEKVMFYSITFLNFLNNDQGLPMDPKRIKVIPEWPTPPSVEERIHEFHEPLDLRSNPFQVRGDDAILPPKGIG

SEQ ID NO: 129377 - protein, 122 aa, Glycine max
  Coding DNA Sequence Number=SeqID_12599
  Subcellular localization annotation: CTP_CleavageSite=75; ConfidenceScore=5.25e-01
MNCVFVHVSSTFEFGAMRSDCLVQFSIVNLFQSSMNCVFVHVSSTFEFGAMRCDCLVQFSILNPFSEPMNFVFVHASSTFEFGAMRSDCLVQFSILNLFRSPMNCVFVHVSSTFEFRAMRSD

SEQ ID NO: 129378 - protein, 54 aa, Glycine max
  Coding DNA Sequence Number=SeqID_12600
MKDAIHANRCQTNSPRRAVLAQVSWLLKAEDTHSPRRVVCLSLKKLHKPRQVGC

SEQ ID NO: 129379 - protein, 117 aa, Glycine max
  Coding DNA Sequence Number=SeqID_12601
MEHLLVPQWDEFEATSSVSESETSLLTLLWRRVLGLGVGPKLLAERPRNNSTGLETLLVIINDDIVASPEKGKHQHIPSPFHFHSSCKKQRNPLMKKILGLQAPIELTSCGIKSIFI

SEQ ID NO: 129380 - protein, 99 aa, Glycine max
  Coding DNA Sequence Number=SeqID_12602
  Homolog annotation: Hit_ID=Q00M75; Match level="QueryCoverage=33%, HitCoverage=5%, E-value=4e-10, Identity=93%"; Hit description=PPR -repeat containing protein
MVYTQIVGIPHRQATVPDSKTKSHSKICIEPYPCICKEAVSGFEPMTNKSPRHNFTAAPGLALFSKFRTPLPRGSSLCEGMGEGCCTQPYPCICKEAVS

SEQ ID NO: 129381 - protein, 66 aa, Glycine max
  Coding DNA Sequence Number=SeqID_12603
MNITVKHREQKNLMQVWIAVVKIQISVSKSKSINTSVLAVEVAWNFVLQQDGRISKHALNNMWLSF

SEQ ID NO: 129382 - protein, 85 aa, Glycine max
  Coding DNA Sequence Number=SeqID_12604
MVGGVGLELEGPSKDASMWWRDLKLICRGNNQSLWFDYIVKWRIDDRDGLEVSRTSVAECSCLWVEKRLDGSKLASLHILTLPYI

SEQ ID NO: 129383 - protein, 122 aa, Glycine max
  Coding DNA Sequence Number=SeqID_12605
MECNSSFSKFDRELSLLEKREVVKVRSDRGRGTVVVYHKGKSGGKKDVSYHIGSKKKSMEVLKMEMKVGPMIMGDGGVEGHMYVNGEILAYLGHNVKLKRAQIGERSVRPNFCTHKIKMLGR

SEQ ID NO: 129384 - protein, 178 aa, Glycine max
  Coding DNA Sequence Number=SeqID_12606
  Gene Ontology: Mol. function=RNA-directed DNA polymerase activity; Biological process=RNA-dependent DNA replication
  Homolog annotation: Hit_ID=Q1T5K4; Match level="QueryCoverage=98%, HitCoverage=19%, E-value=6e-18, Identity=32%"; Hit description=RNA -directed DNA polymerase
MGGGPYVLKEKFKDKLKIWNKEHFGDLQRRRRIIEYEMIILDKKGEKWGLPLKKCVLREKETLQDQLWSVAMSNESLLRQKSRDRWIVKGDCNTKYFYSMVNKRRRKSLTRGIFIGGEWVEEPNMVKEEVKHFSQKRFHHQHGCRPLLDGIMFEEEEVKEAVWKCRNKKSIGLDDFNF

SEQ ID NO: 129385 - protein, 63 aa, Glycine max
  Coding DNA Sequence Number=SeqID_12607
MVSDSEGNDSDNDGGGDGDINQNNGGGDNGYSGCGESDNSNDSDDNYNDESMIIVMVVVTKIV

SEQ ID NO: 129386 - protein, 610 aa, Glycine max
  Coding DNA Sequence Number=SeqID_12608
  Gene Ontology: Mol. function=protein serine/threonine kinase activity; Cellular component=cytoplasm; Biological process=protein amino acid phosphorylation
  Homolog annotation: Hit_ID=Q6EIX6; Match level="QueryCoverage=99%, HitCoverage=95%, E-value=1e-156, Identity=48%"; Hit description =Mitogen-activated protein kinase
  Pfam annotation: Domain name=Pkinase; Domain location=33-272; Score =120.7; E_value=4e-33; Accession=PF00069.15; Description=Protein kinase domain
  Pfam annotation: Domain name=Pkinase_Tyr; Domain location=35-272; Score=-36.8; E_value=3.3e-10; Accession=PF07714.7; Description =Protein tyrosine kinase
  Pfam module annotation: Pfam domain module=Pkinase::Pkinase_Tyr; Domain location=33-272::35-272
MYKGRFGGKAELGYVETDPSGRYGRNMVIELEGYFRDILGKGAVKVVYRAFDEVLGREVAWNQVKLGDVFHSPDLLPRLYSEVHLLKNLEHDSIMTFHDSWIDVHCRTFNFITELFTSGTLREYRKKYQRVDIRAVKNWARQILSGLEYLHSHDPPVIHRDLKCDNIFINGHLGQVKIGTPEFMAPELYEEEYNELVDIYSFGMCMIEIFTSEFPYSECSNPAQIYKKVTSGKLPEAYYRIHDLEAQKFVGKCLANVSERLSAKELLLDPFLATEQLDSPLPSPTLPKKQTPTLNFTALLAKELPPPKSNQTKDTHMTITGSMNEENDTVFLKVQISNKNGQKRNIFFPFDTINDTAIDVAMEMVKELEISDLEPLEIAEMIEEEISALVPTWRDWGSAKYQKQHSFSYEEEYDMSNHHPFFSPTSRSSSHASLPVFGSSSYKNSSHHRENHYPFAQDWPQGTPPLSTRNTNELFMNDDASSQSSMNSFKCFNLNCCDPGNEDEHDPTLALGAEHLFYTPKGNEKYTRFCPREEVMESDFTKQFCNMRMDSHRCHGMHRLTRIRSFVDLRRQQQQRSLVEEIHKRRMFKTVGAIENIGFQDPEGDGCFSY

SEQ ID NO: 129387 - protein, 68 aa, Glycine max
  Coding DNA Sequence Number=SeqID_12609
MKMELHQLIGDLFWIGHKIYNVQAIMLLYAEDILNFNSILVQYFSSIIINLHVGLDGHLSGSRLEILG

SEQ ID NO: 129388 - protein, 89 aa, Glycine max
  Coding DNA Sequence Number=SeqID_12610
MSIKGGAGGAGGGGRISTFGEAGGSTTGGCDSTGTIISCPRNRLCNIGTIGCACRPSGSMVVVGGGGLDDEGMSSALALFLEVIYKKRM

SEQ ID NO: 129389 - protein, 150 aa, Glycine max
  Coding DNA Sequence Number=SeqID_12611
MDDFSEDGDQKFFDHINEDSDDQSNNEGVGRPTTPPSPPLQYHQPRCPVDLNFDHLPHYIDRHHFVQQQHNVQPPICTQGCMAFNEKAQYRHPSIISAYNNPTNLWVQDTSHFFCLRHIAQNFLLGNSNGKHLRKPLMLAGYTYTEKMHL

SEQ ID NO: 129390 - protein, 99 aa, Glycine max
  Coding DNA Sequence Number=SeqID_12612
MEGFFCEKLLGIVVLEVEELFWDKLLIKRGEFEEEEEEEPLVEQLLENNDDLLDDVLEPASFFDTFHFSSMKNKGTVISTTSYGTECVCERERESENGK

SEQ ID NO: 129391 - protein, 500 aa, Glycine max
  Coding DNA Sequence Number=SeqID_12613
  Gene Ontology: Mol. function=oxidoreductase activity; Cellular component=intracellular; Biological process=translation
  Homolog annotation: Hit_ID=Q1SGI4; Match level="QueryCoverage=98%, HitCoverage=82%, E-value=0.0, Identity=84%"; Hit description=Copper -resistance protein CopA
  Pfam annotation: Domain name=Cu-oxidase; Domain location=81-240; Score=199.2; E_value=9.8e-57; Accession=PF00394.12; Description =Multicopper oxidase
  Pfam annotation: Domain name=Cu-oxidase_2; Domain location=350-484; Score=181.9; E_value=1.6e-51; Accession=PF07731.4; Description =Multicopper oxidase
  Pfam annotation: Domain name=Cu-oxidase_3; Domain location=2-71; Score=64.1; E_value=4.6e-16; Accession=PF07732.5; Description =Multicopper oxidase
  Pfam module annotation: Pfam domain module=Cu-oxidase::Cu-oxidase _2::Cu-oxidase_3; Domain location=81-240::350-484::2-71
MTTKNRHGVRQLQSGWADGPSYITQCPIQTGQSYVYNFTIVGQRGTLFWHAHISWLRATLYGPLILLPRRNESYPFEKPYKEVPILFGEWWNADPEAVIAQALQTGAGPNVSDAYTFNGLPGPLYNCSNNETDTETDTFRLKVKPGKTYLLRLINAALNDELFFSIANHTLVTVEADATYVKPFESEIIVIGPGQTSNFLLKTKPEYPNVNFLMLARPYFTGMGTFDNSTVAGILEYKKPLVAPKNTIPTLKPSLPAINDTSFVANFSSKFLSLNTDKYPAKVPQTVDKSFFFTIGLGTSPCPKNQTCQGPNNSSKFAASMNNISFTLPSIALLQQHFFGQANNGIYTTDFPAMPLMPFNYTGTPPNNTRVSNGTKTVVIPFNTRVQVVLQDTSILGAESHPLHLHGFNFYVVGQGFGNFNPNTDPPKFNLVDPVERNTVGVPSGGWVAIRFLADNPGVWLMHCHFDVHLSWGLRMAWIVEDGKLPNQKLPPPPADLPKC

SEQ ID NO: 129392 - protein, 92 aa, Glycine max
  Coding DNA Sequence Number=SeqID_12614
MENLIPHGLGFLNISNLMYYVMQSYPTRALDRRLQEDRARDARESPRVLMTLVMQSYPPRTLDRRLQEDWARDAREGSRVLMSLWVDFASMG

SEQ ID NO: 129393 - protein, 135 aa, Glycine max
  Coding DNA Sequence Number=SeqID_12615
  Gene Ontology: Mol. function=serine-type peptidase activity; Cellular component=integral to membrane
  Homolog annotation: Hit_ID=Q00YZ7; Match level="QueryCoverage=66%, HitCoverage=38%, E-value=6e-08, Identity=36%"; Hit description=[OU] KOG1568 Mitochondrial inner membrane protease
MAPTIDGKAVTLVRKLPVVDPTRVFVGDVVVVKDPEKPDNYLLRRLTAVEGYEMVSTDEKDEAFVLEKDQCWVVAENEKLKAKEAKDSRTFGPVQMTDIVGRVIYCLRSAVDHGRDTPVLEVELDVDEMAKSHKA

SEQ ID NO: 129394 - protein, 1153 aa, Glycine max
  Coding DNA Sequence Number=SeqID_12616
  Gene Ontology: Mol. function=RNA binding; Biological process =regulation of translation
  Homolog annotation: Hit_ID=Q2HS37; Match level="QueryCoverage=91%, HitCoverage=98%, E-value=0.0, Identity=71%"; Hit description=Nucleic acid binding NABP
  Pfam annotation: Domain name=NABP; Domain location=328-736; Score =183.2; E_value=6.3e-52; Accession=PF07990.3; Description=Nucleic acid binding protein NABP
  Pfam annotation: Domain name=PUF; Domain location=737-771; Score =34.4; E_value=4e-07; Accession=PF00806.9; Description=Pumilio-family RNA binding repeat
  Pfam annotation: Domain name=PUF; Domain location=773-807; Score =31.8; E_value=2.4e-06; Accession=PF00806.9; Description=Pumilio -family RNA binding repeat
  Pfam annotation: Domain name=PUF; Domain location=809-843; Score =38.1; E_value=3e-08; Accession=PF00806.9; Description=Pumilio-family RNA binding repeat
  Pfam annotation: Domain name=PUF; Domain location=845-879; Score =34.5; E_value=3.6e-07; Accession=PF00806.9; Description=Pumilio -family RNA binding repeat
  Pfam annotation: Domain name=PUF; Domain location=881-916; Score =45.6; E_value=1.7e-10; Accession=PF00806.9; Description=Pumilio -family RNA binding repeat
  Pfam annotation: Domain name=PUF; Domain location=918-952; Score =38.9; E_value=1.8e-08; Accession=PF00806.9; Description=Pumilio -family RNA binding repeat
  Pfam annotation: Domain name=PUF; Domain location=954-988; Score =34.3; E_value=4.2e-07; Accession=PF00806.9; Description=Pumilio -family RNA binding repeat
  Pfam annotation: Domain name=PUF; Domain location=996-1030; Score =33.0; E_value=1.1e-06; Accession=PF00806.9; Description=Pumilio -family RNA binding repeat
  Pfam module annotation: Pfam domain module=NABP::PUF::PUF::PUF::PUF::P UF::PUF::PUF::PUF; Domain location=328-736::737-771::773-807::809 -843::845-879::881-916::918-952::954-988::996-1030
MLSELGRRPMLGSNEGSFGDELEKEIGMLLREQRRQEADDRERELNIFRSGSAPPTVEGSLSAVGGLFAAGGGGGPATGAPAAFLEFRGAKDVNGIASEEELRSDPAYLSYYYSNVNLNPRLPPPLLSKEDWRFQQRLKGGASALGGIGDRRKVNRTDDNAGRLLFATPPGFNMRKLESEVDNEKTRGSAEWGGDGLIGLPGLGLSKQKSFAEFFQVPLFSYPFLSAHHLQPVIVQDDLGHNTSITRLPSRPASRNAFDENDIISSAEPELAHVRRESTPTDALRSGSNVQGSSAAQNVGLPASYSYAAAVGSSLSRSTTPDPQLIARAPSPCITPIGGGRAIASDKRAIANPDAFNGVSSGINESADLVAALSVMNLSADDVLDGENHFPSQVESDVDSHQRYLFGRQGGQDHGKQQAYLKKSESAHLQNSSKSSRSGSGLNNPSLDRQVELQKSTVPSNNSYFKGSPTSHFSGGGSMPPQYQPLDGTNSSFTNYGMSGYAGNPALASLMTNQLGTGNLPPLFQNVAAASAMAAPGMDSRILGCGLASGTAAPSDVHNLGRMGNQIQGSALQAPFVDPMYLQYLRTSEFAAAQLAALNDPSVDRNYLGNSYMNLLELQKAYLGSVLSPQKSQYNVPPGGKSGSFTPHGYYGNPAYGAGLSYPGSPMANSVVSTSPVGSGSPVRHNELNMHFASGMRNLAGVMGPWHVDNENIDESFASSLLEEFKSNKTKCFELSEIAGHVVEFSADQYGSRFIQQKLETATTEEKNMVYQEIMPHALALMTDVFGNYVVQKFFEHGLASQRRELANKLLGHVLTLSLQMYGCRVIQKAIEVVDLDQKIEMVQELDGNVMRCVRDQNGNHVIQKCIECVPEDAIHFIVSTFFDQVVTLSTHPYGCRVIQRVLEHCKDPTTQQKVMDEILGAVSMLAQDQYGNYVVQHVLEHGKPHERSSIIKELADKIVQMSQQKFASNVVEKCLTFGGPSERQLLVSQMLGTTDENEPLQAMMKDQFANYVVQKVLETCDDQQRELILSRIKVHLNALKKYTYGKHIVSRVEKLVAAGGAISLIACSYMINALHEIHAWKPSHSAASNCVMICTFNFKLMKGELLLRLLLNPLRCLENNLVQLTEASVPLLLPLSLPDQEVPLSLPDQEVM

SEQ ID NO: 129395 - protein, 90 aa, Glycine max
  Coding DNA Sequence Number=SeqID_12617
YIYLGLTENKRGYISCGSVLVEGTSTRFKENKGGYIPCGSLLIIPLDSEEEANLCLMVDASTNKVEPTLDTSSNNEDSHPNDTINSDGEE

SEQ ID NO: 129396 - protein, 47 aa, Glycine max
  Coding DNA Sequence Number=SeqID_12618
MTHLEMLNIVEFPLLLCLPSGMYHLIAPEDLSIDGCPELCRKCEPQS

SEQ ID NO: 129397 - protein, 111 aa, Glycine max
  Coding DNA Sequence Number=SeqID_12619
MLLGEISNSKEQDLAHKKAYSNVQKLKAFDVSNEGSVLTRLWLTFSTQFRTTIYAQIFRGNERLQESTEAMSVALDNAQDAGLSSSIFGLHFHNSMADLASCSVFHTEPPV

SEQ ID NO: 129398 - protein, 88 aa, Glycine max
  Coding DNA Sequence Number=SeqID_12620
MALVVKKDVQYKPLKTALHHHILKEMTLHLFCTSFLKGLMNFKPMLVREGSNRLPEGSNRLPVAIIVFKTDLQSCNRLPWACNRLPMF

SEQ ID NO: 129399 - protein, 192 aa, Glycine max
  Coding DNA Sequence Number=SeqID_12621
  Gene Ontology: Mol. function=DNA binding; Biological process =regulation of transcription
  Homolog annotation: Hit_ID=Q4H2B3; Match level="QueryCoverage=99%, HitCoverage=59%, E-value=8e-46, Identity=52%"; Hit description =NbPCL1 protein
  Pfam annotation: Domain name=Myb_DNA-binding; Domain location=145 -192; Score=21.1; E_value=0.004; Accession=PF00249.21; Description =Myb-like DNA-binding domain
MGEEVKTSEYDEERVMEWEMGLPTANDLTPLSQPLIPPELASAFSISPEPHRTLLEVNRASRNTLSTIRGGGSVHQAFSSNNNNNHHYDGDGDGGDEEEYDDADRDGSGSDSRKQRKIDCGVAEEADSAVRTETSAERTAVKRPRLVWTPQLHKRFVDVVAHLGIKNAVPKTIMPLMNVEGLTRENVASHLQ

SEQ ID NO: 129400 - protein, 871 aa, Glycine max
  Coding DNA Sequence Number=SeqID_12622
  Gene Ontology: Mol. function=RNA binding
  Homolog annotation: Hit_ID=Q2HS37; Match level="QueryCoverage=93%, HitCoverage=79%, E-value=0.0, Identity=75%"; Hit description=Nucleic acid binding NABP
  Pfam annotation: Domain name=NABP; Domain location=126-534; Score =175.6; E_value=1.2e-49; Accession=PF07990.3; Description=Nucleic acid binding protein NABP
  Pfam annotation: Domain name=PUF; Domain location=535-569; Score =34.4; E_value=4e-07; Accession=PF00806.9; Description=Pumilio-family RNA binding repeat
  Pfam annotation: Domain name=PUF; Domain location=571-605; Score =32.0; E_value=2.1e-06; Accession=PF00806.9; Description=Pumilio -family RNA binding repeat
  Pfam annotation: Domain name=PUF; Domain location=607-641; Score =34.1; E_value=4.9e-07; Accession=PF00806.9; Description=Pumilio -family RNA binding repeat
  Pfam annotation: Domain name=PUF; Domain location=643-677; Score =34.5; E_value=3.6e-07; Accession=PF00806.9; Description=Pumilio -family RNA binding repeat
  Pfam annotation: Domain name=PUF; Domain location=679-714; Score =45.6; E_value=1.7e-10; Accession=PF00806.9; Description=Pumilio -family RNA binding repeat
  Pfam annotation: Domain name=PUF; Domain location=716-750; Score =38.9; E_value=1.8e-08; Accession=PF00806.9; Description=Pumilio -family RNA binding repeat
  Pfam annotation: Domain name=PUF; Domain location=752-786; Score =34.9; E_value=2.8e-07; Accession=PF00806.9; Description=Pumilio -family RNA binding repeat
  Pfam annotation: Domain name=PUF; Domain location=794-828; Score =33.0; E_value=1.1e-06; Accession=PF00806.9; Description=Pumilio -family RNA binding repeat
  Pfam module annotation: Pfam domain module=NABP::PUF::PUF::PUF::PUF::P UF::PUF::PUF::PUF; Domain location=126-534::535-569::571-605::607 -641::643-677::679-714::716-750::752-786::794-828
MVSPRNSFQDSGHDSAPATFSQSILIKLEQVLLFSYPFSSAHYLQPVIVQDDLGHNTSIGCLPSRPASRNTFDDTDIISSAEAELAHVQGSSAAQNVGLPASYSYAVAVGSSLSRSTTPDPQLVARAPSPCITPIGGGRAIASDKRAIANPDAFNGVSSGINESADLVAALSVMNLSADYVLDGANHLPSQVESDVDSHKRYLFGRLGGQDHGKQQAYLKKSESAHLQNSSKSSRSGSGLNNPSLDRQVELQKSTVPSNNSYFKGSPTSHFSRGGSMPLQYQPLDGTNSSFTNYGMSGYAGNPALASLMTNQLGTGNLPPLFENVAAASAMAAPRMDSRILGGGLASGAAAPSDVHNLGRMGNQIQGSALQAPFVDPMYLQYLRTPEFAAAQLAALNDPSVDRNYLGNSYMNLLELQKAYLGSVLSPQKSQYNVPPGGKSGSFTPHGYYGNPAYGAGLSYPGSPMANSVVSTSPVGSGSPVRHNELNMHFASGMRNLAGVMGPWHVDNENIDESFASSLLEEFKSNKTKCFELSEIAGHVVEFSADQYGSRFIQQKLETATTEEKNMVYQEIMPHALALMTDVFGNYVVQKFFEHGLASQKRELANKLLGHVLALSLQMYGCRVIQKAIEVVDLDQKIEMVQELDGNVMRCVRDQNGNHVIQKCIECVPEDAIHFIVSTFFDQVVTLSTHPYGCRVIQRVLEHCKDPTTQQKVMDEILGAVSMLAQDQYGNYVVQHVLEHGKPHERSSIIKELAGKIVQMSQQKFASNVVEKCLTFGGPSERQLLVCEMLGTTDENEPLQAMMKDQFANYVVQKVLETCDDQQRELILYRIKVHLNALKKYTYGKHIVARVEKLVAAGERRIAAQAPPQPA

SEQ ID NO: 129401 - protein, 73 aa, Glycine max
  Coding DNA Sequence Number=SeqID_12623
MEEDEGKCLLQPLNPISLCFTHSKAWLDSGCGGARVSENPLSELGRAKREKRQRPRWASMLRVERADLWLILF

SEQ ID NO: 129402 - protein, 218 aa, Glycine max
  Coding DNA Sequence Number=SeqID_12624
  Gene Ontology: Mol. function=nucleic acid binding; Biological process= DNA integration
  Homolog annotation: Hit_ID=Q1S1X7; Match level="QueryCoverage=52%, HitCoverage=8%, E-value=4e-11, Identity=32%"; Hit description =Integrase, catalytic region; Zinc finger, CCHC-type; Peptidase aspartic, catalytic
MGMRFIIDTSIWDGKKILDTSIYDGQDSCYCNKGYYTNDMRANLSPSTVWFEDEPGKISWACNTLSESHHNKRDLEVVQVFNGVSKELIVVGFWLKFEKLFMMISIYNKLLLKRRYLGLRMRKGMPLKKHIDELNSILMELCEIDVKKEDKDLTMILLAFLPPSYENFVSSLSLSNDFITLKEVKASLYSRELLVKASRNNDEASTFGLLVVDSAKGQ

SEQ ID NO: 129403 - protein, 97 aa, Glycine max
  Coding DNA Sequence Number=SeqID_12625
MTRSKRIQEDSEEKKNSFLKAADDVFTEKDQAPRKVEVSTNGNPVASKEGKKEVLRPPHVSVLFPQRLKDKSEDEQFARFVEMLKKKCIMIPLGIPK

SEQ ID NO: 129404 - protein, 175 aa, Glycine max
  Coding DNA Sequence Number=SeqID_12626
  Gene Ontology: Mol. function=RNA-directed DNA polymerase activity; Biological process=RNA-dependent DNA replication
MMDGIFFFLKEQNSLEGRHRTLATLMRVIIQKNLKNWEKYCLPHVEFTYNRSIHSTISYSPFEVMYGFNPLTPLDILPLPSNDYVSFDGKKKADSIKELHSKVRATIEKKNKQYAKQANKGHIKVIFELGDWVWVHDEILPPRASDRRLQKDWARDAREGPRVLMSLRVDFGPVD

SEQ ID NO: 129405 - protein, 166 aa, Glycine max
  Coding DNA Sequence Number=SeqID_12627
  Gene Ontology: Mol. function=microtubule motor activity; Cellular component=microtubule associated complex; Biological process =microtubule-based movement
  Homolog annotation: Hit_ID=Q0WN69; Match level="QueryCoverage=81%, HitCoverage=17%, E-value=9e-12, Identity=33%"; Hit description =Kinesin-related protein
GEKIKEKVKKVDENEVVRLIKEQEDKNLEISALKVELETTIRTYEVQFSQMEEEANSFKAALTRKAEKINEEVKTTDEEESIKFMKEQEDKKLKISSLKQCSQLEEDAKDAKAELTHKAQEYENQLEALGNKFAAQGLEASVNLKVKFGRYKHYPAYCSKVKFGTA

SEQ ID NO: 129406 - protein, 125 aa, Glycine max
  Coding DNA Sequence Number=SeqID_12628
KKLEEVVQSESTKAVIDPPSPIRRHVKWKIIRTKKTSQMTSEAAKEIAEKIASQGSFVPHRRQDVLTAAIGRPEHPGRVHAAGAGGLALPSEPEDGPLAGRVSTKGSCVDPSGNDPDTGDSDKYG

SEQ ID NO: 129407 - protein, 137 aa, Glycine max
  Coding DNA Sequence Number=SeqID_12629
MASMMDAMLGMKQLMESNVATAVAISSTAEADPTLSTVVHHPIPNMVGRERSTPGHISNPIRGTTEVLTPTVYHPITHHQPYMKTWVTFLPSSSKGSLLGILTGSTRILKSMLRETSTPTPRFPLRGRRPTPMIILS

SEQ ID NO: 129408 - protein, 122 aa, Glycine max
  Coding DNA Sequence Number=SeqID_12630
MARTKKTKQMTSEATKEIADKIASQGSFVAHRHKDVLTVAIGRPKHLGHVCAAGVGVMIKQYFGPAPKGLTMPPKPEVCPSTARVSTKESCVDPSGNNPDTVKVGVKKVTNAYAHIPVPTEE

SEQ ID NO: 129409 - protein, 61 aa, Glycine max
  Coding DNA Sequence Number=SeqID_12631
MKGRCALCDLHATLNAFGHQASDIKEELIGSVRSVCKCKLSVNGQLAKPACPAKPKNVSVL

SEQ ID NO: 129410 - protein, 407 aa, Glycine max
  Coding DNA Sequence Number=SeqID_12632
  Gene Ontology: Mol. function=protein serine/threonine kinase activity; Cellular component=cytoplasm; Biological process=protein amino acid phosphorylation
  Homolog annotation: Hit_ID=Q8H2C2; Match level="QueryCoverage=93%, HitCoverage=97%, E-value=1e-133, Identity=57%"; Hit description =Serine/threonine kinase
  Pfam annotation: Domain name=NAF; Domain location=249-308; Score =115.5; E_value=1.5e-31; Accession=PF03822.5; Description=NAF domain
  Pfam annotation: Domain name=Pkinase; Domain location=12-206; Score =164.9; E_value=2.1e-46; Accession=PF00069.15; Description=Protein kinase domain
  Pfam annotation: Domain name=Pkinase_Tyr; Domain location=12-206; Score=-63.6; E_value=1.4e-08; Accession=PF07714.7; Description =Protein tyrosine kinase
  Pfam module annotation: Pfam domain module=NAF::Pkinase::Pkinase_Tyr; Domain location=249-308::12-206::12-206
MEQKGGVLMQRYELGRLLGQGTFAKVYHARNIITGMSVAIKITDKDKILKVGMSDEANQASTCGGELFNKVSKGKLKQDDARRYFQQLISAVDYCHSRGVCHRDLKPENLLLDENGNLKVTDFGLSTLAETKHQDGLLHTTCGTPAYVAPEVINRRGYDGAKADIWGEFKFPNWIAPDLRRLLSKILDPNPKTRISMAKIMESSWFKRGLEKPTITRNEDQELAPLDADGVFGACENGDPIEPAKDSKRCNNLNAFDIISYSSGFDLSGLFEETNRKKEARFTSDKPASIIISKLEEICIRLGLKVKKKDGGLFKLEGSKEGRKGSLGIDAEIFEITPVFHLVELKKSSGDTLEYQKLLKQEVRPALKDIVWNWQGEQPQQLQHGVVQKEEQPSYPGISDVAPPQTA

SEQ ID NO: 129411 - protein, 220 aa, Glycine max
  Coding DNA Sequence Number=SeqID_12633
  Gene Ontology: Mol. function=RNA polymerase II transcription factor activity; Cellular component=transcription factor TFIID complex; Biological process=transcription initiation from RNA polymerase II promoter
  Homolog annotation: Hit_ID=P28147; Match level="QueryCoverage=99%, HitCoverage=100%, E-value=5e-93, Identity=81%"; Hit description=TATA- box-binding protein 1
  Pfam annotation: Domain name=TBP; Domain location=130-216; Score =151.5; E_value=2.2e-42; Accession=PF00352.12; Description =Transcription factor TFIID (or TATA-binding protein, TBP)
  Pfam annotation: Domain name=TBP; Domain location=20-125; Score =101.2; E_value=3e-27; Accession=PF00352.12; Description =Transcription factor TFIID (or TATA-binding protein, TBP)
  Pfam module annotation: Pfam domain module=TBP::TBP; Domain location =130-216::20-125
MADQVAVAIEPVDLQKHPSGIVPTLQNIVSTVNLDCKLDLKTIALQARNAEYNPKAIAYPAFWIVFCSFLDQRSVRFAAVIMRIRDPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 129412 - protein, 91 aa, Glycine max
  Coding DNA Sequence Number=SeqID_12634
  Subcellular localization annotation: CTP_CleavageSite=13; ConfidenceScore=5.05e-01
MNRAYSSWLAKVLAFASKHFLGTPTTLFSTCFPGSNSCAEILIILEILAKEGLNPEKRYGFLPPRGHPKISSNYSIVGVNWKSPKVKHLKG

SEQ ID NO: 129413 - protein, 59 aa, Glycine max
  Coding DNA Sequence Number=SeqID_12635
MYEYLEEERVPYPESILADFMTYQAISKGTSLLQAITRSHAGNQIIMIKQNELLIWMTC

SEQ ID NO: 129414 - protein, 52 aa, Glycine max
  Coding DNA Sequence Number=SeqID_12636
MVATRSLWGFRLIKEVATRVWVCGGDNKVVIGSLATWWRGGVVVAVMWLLML

SEQ ID NO: 129415 - protein, 262 aa, Glycine max
  Coding DNA Sequence Number=SeqID_12637
  Gene Ontology: Mol. function=receptor activity; Biological process =protein amino acid phosphorylation
  Homolog annotation: Hit_ID=Q84KS6; Match level="QueryCoverage=88%, HitCoverage=71%, E-value=3e-26, Identity=34%"; Hit description =Membrane located receptor-like protein
MWRERALLVILLLLLVQQICATKKQDHGCPLSSCGKITNITYPFRLKGHPKSCGDNRYELACENNVTVLHLYSGKYHVQAINYNNFTIRVVDPGVDQQTNCSSLPRYFLSRSNFTDTYNYRYNMDPYQAGRSNWDRLAFQHIVYMNCSNPVTQNGKYVDTASYVNWDSKDKYIYAIAGDLKAEDFQVGCHVKLVALTSWWGLDTNNYSYAAMHTGLVYGFEISWMRLICDQHCPSKHGCDDCFFDSVSQELNYWNGNSLWSE

SEQ ID NO: 129416 - protein, 118 aa, Glycine max
  Coding DNA Sequence Number=SeqID_12638
  Gene Ontology: Mol. function=protein serine/threonine kinase activity; Biological process=protein amino acid phosphorylation
  Homolog annotation: Hit_ID=Q1S8T0; Match level="QueryCoverage=55%, HitCoverage=10%, E-value=1e-09, Identity=43%"; Hit description =Protein kinase
MFDIVTPVLAYGMQRNSLDLRWFEANSSKCKAKGKKCKWKNNKGSILLGFIVIAIFKIIYHFRQKEEDQARGKKFLEEYRAEKPARFTYADVKRITGGFKDKLGEGAHGVVLRGKLFN

SEQ ID NO: 129417 - protein, 156 aa, Glycine max
  Coding DNA Sequence Number=SeqID_12639
MTPFRMPLSSLSFFNELLHALWTLCITLRLCALDSSQGKARDFLWCEINHKQRAGKQQTIRALFFSHLRSKVSNKSAKIATVATYPSAGGRRETRGMRVPRKEYARSRHQCLFEENVGKTDKDAIYELLNEKVRELYLRTGKVLAPHTSVPRDGSL

SEQ ID NO: 129418 - protein, 209 aa, Glycine max
  Coding DNA Sequence Number=SeqID_12640
  Gene Ontology: Mol. function=protein serine/threonine kinase activity; Cellular component=membrane; Biological process=protein amino acid phosphorylation
  Homolog annotation: Hit_ID=Q1S8T0; Match level="QueryCoverage=98%, HitCoverage=46%, E-value=1e-41, Identity=35%"; Hit description =Protein kinase
  Pfam annotation: Domain name=Pkinase_Tyr; Domain location=47-200; Score=-139.8; E_value=0.00068; Accession=PF07714.7; Description =Protein tyrosine kinase
IAIFKIIYHFRQKEEDQARVKKFLEEYRTKKPARFTNADVKRITGGFKEKLGEGAHGREEGKEFINELEIMGKIHHINVVRLLGYCAKGIHRALVYNLFPNDSLQSIIFPPDDKQDFLGWEKLQNIALGIAKGIEYLHQQLEEPWDTLHLKFSLETLGMSYKSNIYSYRILLDMSSPQDFHVLYPDWMHDLVHRDVHIHVEDDGDVKIA

SEQ ID NO: 129419 - protein, 68 aa, Glycine max
  Coding DNA Sequence Number=SeqID_12641
  Subcellular localization annotation: CTP_CleavageSite=55; ConfidenceScore=5.12e-01
MTLWLPLHSSHTMNLKPPQESQVLFWLERKRRLMSWWSSSRKSVMLLCGRERVAKARVKGSAREWREK

SEQ ID NO: 129420 - protein, 459 aa, Glycine max
  Coding DNA Sequence Number=SeqID_12642
  Gene Ontology: Mol. function=kinase activity
  Homolog annotation: Hit_ID=Q9STE9; Match level="QueryCoverage=63%, HitCoverage=70%, E-value=1e-26, Identity=30%"; Hit description =Serine/threonine kinase-like protein
  Subcellular localization annotation: CTP_CleavageSite=28; ConfidenceScore=5.49e-01
MIQLKRPQRHVETPTTPPTIQTMEQLLRAEESSKSKRSPTFSSSSSSSSNSFSPSSPFFQRLRHHDSEEDHGQNQKKSVLTKVKEKAKKLRHSLSKRRHEDGSPTSPSSGDGVEEDAEYLGAPMYKSEKSPQGYEANARQHSSPRGNPVFPEKHVLSSSDKHVVELDHQEKTLSRSISKKTATQPATTISSPNATTATTFNTHTNTNALFGPNKTMTETVAKKPTPVHVQKPDAAHITSKIQDRTVSKPTEHHDHPSPLTVKTARNTSLSYAAPCTPPAKLPSVVASSTLETTPASVTPAPSSAPAFSGKNTSPTAKIWDKGVSMKEYLLNKLEPGEDEKALSQVISEAMSPRRTPGDAGVMEKVKEVVTSLLRTEEPTKYADMTTTATATSTTTPTRISRQSPVSTNASRISSQMSASTSASRPSSEMPASTSGSRSSSQIPEFFNAQQGSNVPITVH

SEQ ID NO: 129421 - protein, 724 aa, Glycine max
  Coding DNA Sequence Number=SeqID_12643
  Pfam annotation: Domain name=Extensin_2; Domain location=168-532; Score=-130.2; E_value=0.032; Accession=PF04554.4; Description =Extensin-like region
  Pfam annotation: Domain name=PWI; Domain location=6-78; Score=130.0; E_value=6.4e-36; Accession=PF01480.8; Description=PWI domain
  Pfam module annotation: Pfam domain module=Extensin_2::PWI; Domain location=168-532::6-78
MTKVNMEVIKPWITRRVTELLGFEDEVLINFIHSLLDAKEVNGKEVQIQITGFMEKNTGKFMKELWMLLLSAQKNASGVPQQFLDAKEEELLKKKAESDLIASEIQRKKDKEGREIMEERLKKLDGGFDSKDNDTASDPTLKPRDSGYYERDGKETDKRNGVRARSRFSRSPHSPAVSTSPHRGSPSRSMSKSFSNSRSYSGHRSRSISRSPEARGRSRSFERIRHSPRRRSISPHRHSPRRSPYRRIPYSRRSRSPSPVRRRMHSPVHRRSPSFRRRRSPSLVRRRRPPSPVRRRRSPSPVRRRRSPSPGRRRRSPSPGPRHRSPSPGPRHKSPSPGRHHRSPSPLGRRRSLSPRRRRSVVTRHRSPSLVRRIPPTNVRRRSDSPMQSPSPIRRRYGSRTPPHSPSPLRRRSPIPGKQRSPSISPQRSPRDEWSSQSPIRRVSPSPIRKNSPRHKRSPLPSSMGRVRTQERLSSETRQPSSPLGSTRRDKSGKASHYKSQDSMSTQEKSPIRSVSPEERSETSSEGRSPHESPMKQRREKLSNERSMSPLKKQRTQKPSRDSPDTREEAEETYYSRESRDPKMNSSQKISKHSPISKRKGSPAKFRHEDFSPERVSGHTASEHHYDNDDWSKKGREIKRDKSSRQDNEFPAQKSSINKETFSREKPQESYAVDVKKSDDKDQSRSNYAKSSGRHHKSEATQDLVGKGDRVNHSASYDSVSEDS

SEQ ID NO: 129422 - protein, 57 aa, Glycine max
  Coding DNA Sequence Number=SeqID_12644
MADLGGSFIIRSKVAEELGMGMPMWPWAWGMPDIMGGGYGMDIMGGGYGMDIMGTGR

SEQ ID NO: 129423 - protein, 238 aa, Glycine max
  Coding DNA Sequence Number=SeqID_12645
  Gene Ontology: Mol. function=metal ion binding; Cellular component =intracellular; Biological process=protein kinase C activation
  Homolog annotation: Hit_ID=Q1PFA6; Match level="QueryCoverage=84%, HitCoverage=39%, E-value=4e-17, Identity=28%"; Hit description =Pentatricopeptide repeat-containing protein
  Pfam annotation: Domain name=PPR; Domain location=165-199; Score =30.1; E_value=7.9e-06; Accession=PF01535.11; Description=PPR repeat
  Pfam annotation: Domain name=PPR; Domain location=201-235; Score =10.0; E_value=0.48; Accession=PF01535.11; Description=PPR repeat
  Pfam annotation: Domain name=PPR; Domain location=35-69; Score=7.8; E_ value=0.89; Accession=PF01535.11; Description=PPR repeat
  Pfam module annotation: Pfam domain module=PPR::PPR::PPR; Domain location=165-199::201-235::35-69
  Subcellular localization annotation: CTP_CleavageSite=27; ConfidenceScore=5.44e-01
MFAAGSISLAPALAAASTITLSPCSLRCNPFKGLRPTTSLIVMYSKCEKVEDARKVFDGMTVKDTGAANEALGLVETMKLMGLKPNVKGDQGMVFEIFRLMIADGVEPDVKFRNKEAFDTFKQMLSHGCCPTSATISTLLPACATAARVRRGICLVGCQRRTPYVTWNSIIFGFVNHGYCEEAIELFNQMEKERAAKLDHLTFTAALTACSHVGDIELGQKLFKIMQEKYSIEPPLEH

SEQ ID NO: 129424 - protein, 439 aa, Glycine max
  Coding DNA Sequence Number=SeqID_12646
  Gene Ontology: Mol. function=sugar porter activity; Cellular component=integral to membrane; Biological process=carbohydrate transport
  Homolog annotation: Hit_ID=Q07A14; Match level="QueryCoverage=68%, HitCoverage=63%, E-value=9e-88, Identity=51%"; Hit description =Putative sugar transporter
  Pfam annotation: Domain name=MFS_1; Domain location=107-429; Score= -29.3; E_value=0.007; Accession=PF07690.6; Description=Major Facilitator Superfamily
  Pfam annotation: Domain name=Sugar_tr; Domain location=103-434; Score= -14.3; E_value=2e-06; Accession=PF00083.14; Description=Sugar (and other) transporter
  Pfam module annotation: Pfam domain module=MFS_1::Sugar_tr; Domain location=107-429::103-434
  Subcellular localization annotation: CTP_CleavageSite=58; ConfidenceScore=5.53e-01
MASTSLFNFRLPLFNFNPLHHRRIKRPKSLLSSPRNSPRLVSSINDHLALTRVTYPLLQSHSAPKRRFHVGVQKEYSDGESSESIVSDATYQEEFSWSSVVLPFLFPALGGLLFGYDIGATSGATISLQSPELSGISWFNLSAIQLGLVVSGSLYGALLGSLVAFAIADFLGRKKQLITAALLYLFGGVITAYAPELGVLLAGRLIYGLGIGLLGYFVGSFLIETVGGWRFMYGFSAPVAVLMGLGMWTLPNSPRWLLLRAVQGKGSFQDLKEQAIASLSKLRGRPPGDKESEKQIEETLVSLKSVYADQESEGNFLEVFQGPNLKAFIIGGGLVLFQQSAGFSAASDATKVSVVIGLFKLLMTWIAVLKVDDLGRRPLLIGGVSGIVGIPSQFKLTDSYYAATCHMQMVNVFWSGLVIGPASFIIIFNPGMDFFYSSV

SEQ ID NO: 129425 - protein, 164 aa, Glycine max
  Coding DNA Sequence Number=SeqID_12647
  Homolog annotation: Hit_ID=Q93XJ4; Match level="QueryCoverage=35%, HitCoverage=28%, E-value=2e-13, Identity=62%"; Hit description =Lateral shoot inducing factor
  Pfam annotation: Domain name=zf-C2H2; Domain location=31-53; Score =22.4; E_value=0.0016; Accession=PF00096.16; Description=Zinc finger, C2H2 type
MESDHHHEAASDNHPSDGEEQGASHVTSRSYECNFCRRGFSNAQALGGHMNIHRKDKAKLKQQQSSNQIQQDPAKSGGEESNKPNWNWNVSPQEHVIHKRHQLPLFAETPTSSETQKPQGQTQTTTEQTLLSTHQDSSSELDLELRLGPEPQDSSAETDTRNFF

SEQ ID NO: 129426 - protein, 83 aa, Glycine max
  Coding DNA Sequence Number=SeqID_12648
MTFLLDISKSIVSNIFTKSNLNRLCRVGDESHLIWPHGVGTMQIEVRSECFRNLFVQTIDFEILGRKATLGKMLEKCRGVQKF

SEQ ID NO: 129427 - protein, 233 aa, Glycine max
  Coding DNA Sequence Number=SeqID_12649
  Gene Ontology: Mol. function=oxidoreductase activity; Cellular component=mitochondrion; Biological process=metabolic process
  Homolog annotation: Hit_ID=Q10NH7; Match level="QueryCoverage=99%, HitCoverage=85%, E-value=3e-76, Identity=60%"; Hit description =Tropinone reductase, putative, expressed
  Pfam annotation: Domain name=adh_short; Domain location=1-152; Score =28.8; E_value=7e-08; Accession=PF00106.15; Description=short chain dehydrogenase
ELAQLGVTVHTCARNEAELNESLNEWNTKGYRVTGSVCDVASRAERQDLIARLSSEFNGKLNILVNNVGTNIWKDLLEYTEEDFLFLVNTNLQSAFHLCQLAHPLLKASEAASIVFISSIGGVVSINLGSVVYSATKGAMNQMTKNLACEWAKDNIRTNCVAPGMIRTPAADEYLKEGKIANAYIPRTPLGRFGEGDEVSSVVAFLCLPAASYVTGQIICVDGGFTVNGLYIS

SEQ ID NO: 129428 - protein, 87 aa, Glycine max
  Coding DNA Sequence Number=SeqID_12650
MGLQKGKINISLRIPLLQRMTKTLNQHHHQFKNHVSEDGDNHSVNKNHVFEDAETKSYGTDEEEGTLPHAWMKKVELPTFEGIEPLS

SEQ ID NO: 129429 - protein, 64 aa, Glycine max
  Coding DNA Sequence Number=SeqID_12651
  Homolog annotation: Hit_ID=Q657I0; Match level="QueryCoverage=83%, HitCoverage=5%, E-value=3e-17, Identity=72%"; Hit description =Transmembrane domain, a coiled coil-4 domain, of eukaryotic origin (91.3 kD)-like protein
MAMIDKVCKEEANSFILFDPDVVKGLYSRGLIYFDVPVYPDDRFKVAHPATFLSNDPITGIAVH

SEQ ID NO: 129430 - protein, 130 aa, Glycine max
  Coding DNA Sequence Number=SeqID_12652
MPPNSNGVAGFKWRHHGGCHRLNSGGGMAHAARELQRQHEQHTPARAAGSRQHAPATTAPCTSASSLTVSPEVDDSTTHHTHEQRTATATATDCDGNTLPSSTNYNGSNHHLMLQPLLCTLHYAFILLLF

SEQ ID NO: 129431 - protein, 388 aa, Glycine max
  Coding DNA Sequence Number=SeqID_12653
  Gene Ontology: Mol. function=cation transporter activity; Cellular component=integral to membrane; Biological process=zinc ion transport
  Homolog annotation: Hit_ID=Q6DBM8; Match level="QueryCoverage=99%, HitCoverage=99%, E-value=5e-84, Identity=42%"; Hit description=Metal tolerance protein B
  Pfam annotation: Domain name=Cation_efflux; Domain location=67-388; Score=220.7; E_value=3.2e-63; Accession=PF01545.11; Description =Cation efflux family
MEHEKAPILVEERTMQEIEIPIASERLDVLPMKADSSCSSVCPFSGQENSVVASKESSKSAKKLSGLIVFYAIVMVVELIGGIKAHSLAVISDAAHLLSDIAGFSISLFAVWASGWEATPHQSFGYNRLEVLGALASVQLIWLISGFLIYEAIGRILVRNASVKGKLMLAIAALGFVLNFIMVAWIGHDHSHHHHHHHHGCESSGHDHNHHQCQTDHDHGKEEQSIITDEENVTLVSSIQTNTNVLNINLQGAYLHVMADMIQSVGVMVAGAIIWAKPEWFMVDLVCTLLFSVLSLSTTLPMLRNIYGILMERTPSEIDISKLENGLLNIKGVQDVHDLHVWAITVGKCVLSCHVVAEPGISSIDLLGTIKHYCEKKNQIQHVTIQIE

SEQ ID NO: 129432 - protein, 249 aa, Glycine max
  Coding DNA Sequence Number=SeqID_12654
MAINSSIPFQHQFLHDERGEHILPPIPIPSRDPNHTNCNNNNNNISGHDLKPPELLIPVPNMPHFMPQDNTKFDSSSIGSDHLESLWDSVSSPQSTLSSTLISIQGSSEDSSQEPSPNSYDFCWNSTYDVVEMLEKMKLDERDSSKYNPGYGNHRLEISNVGACSLLHEQIQAIQLSRVRQEQILSEKHKLTAYRGKNHGQISQQFQKKVKGIDDGCDKGWRTRPPWHNRSHQQAGSRGKSCGTGVFLP

SEQ ID NO: 129433 - protein, 230 aa, Glycine max
  Coding DNA Sequence Number=SeqID_12655
  Gene Ontology: Mol. function=nucleotide binding; Cellular component =membrane; Biological process=small GTPase mediated signal transduction
  Homolog annotation: Hit_ID=Q40193; Match level="QueryCoverage=99%, HitCoverage=99%, E-value=1e-109, Identity=88%"; Hit description=Ras -related protein Rab11C
  Pfam annotation: Domain name=Arf; Domain location=1-187; Score=-86.1; E_value=0.004; Accession=PF00025.11; Description=ADP-ribosylation factor family
  Pfam annotation: Domain name=MMR_HSR1; Domain location=13-142; Score =14.5; E_value=4.7e-05; Accession=PF01926.13; Description=GTPase of unknown function
  Pfam annotation: Domain name=Miro; Domain location=14-142; Score =71.8; E_value=2.2e-18; Accession=PF08477.3; Description=Miro-like protein
  Pfam annotation: Domain name=Ras; Domain location=14-189; Score =309.3; E_value=7.2e-90; Accession=PF00071.12; Description=Ras family
  Pfam module annotation: Pfam domain module=Arf::MMR_HSR1::Miro::Ras; Domain location=1-187::13-142::14-142::14-189
MAHRVDHEYDYLFKIVLIGDSGVGKSNILSRFTRNEFCLESKSTIGVEFATRTLQEFDVNKLDVAIKIVVEGKTVKAQIWDTAGQERYRAITSAYYRGAVGALLVYDITKRQTFDNVQRWLRELRDHADSNIVIMMAGNKSDLSHLRAVSEDDGQALAEREGLSFLETSALEATNIEKAFQTILTEIYHIVSKKALAAQEAAVGTILPGQGTTINVGDASGNTKRGCCSA

SEQ ID NO: 129434 - protein, 174 aa, Glycine max
  Coding DNA Sequence Number=SeqID_12656
  Homolog annotation: Hit_ID=Q9FI91; Match level="QueryCoverage=76%, HitCoverage=73%, E-value=5e-12, Identity=34%"; Hit description =Arabidopsis thaliana genomic DNA, chromosome 5, TAC clone:K18J17
MKDGNKGLVAPDLCTYNSRITALCSIVFKGGNVGYIMALEGIVNVNSLFTLALFLGIITTTNTLIRDDNAACAAGASISKGFIELHVYSFSSFLFSSLIALALKNIMNFSKDVDNGEIVLDNNNNNNNWVHSVAKINTVVLRLGTLVLAFGSVFRCGFLVIALVDLVQNVGRAE

SEQ ID NO: 129435 - protein, 173 aa, Glycine max
  Coding DNA Sequence Number=SeqID_12657
  Homolog annotation: Hit_ID=Q9FI91; Match level="QueryCoverage=98%, HitCoverage=95%, E-value=3e-23, Identity=40%"; Hit description =Arabidopsis thaliana genomic DNA, chromosome 5, TAC clone:K18J17
MALDGIVNVNSLFTLALFLGITTTSTTNTLIGDDNAACAAGASISEGLIAFHVYSFSSFLFSSLIALALKNIINFSKDIKDGDVVLDNNNNNWVHSAAKINTVVLRLGTLVSAFGSVFGCGFLVMALVDLVQIKLGTLACGSPHTFAAVAPLLVLVPTALLIYVVLVLYSFTR

SEQ ID NO: 129436 - protein, 255 aa, Glycine max
  Coding DNA Sequence Number=SeqID_12658
  Homolog annotation: Hit_ID=Q84ZC4; Match level="QueryCoverage=79%, HitCoverage=77%, E-value=6e-79, Identity=66%"; Hit description =Pentatricopeptide (PPR) repeat-containing protein-like
  Pfam annotation: Domain name=PPR; Domain location=142-176; Score =30.7; E_value=5e-06; Accession=PF01535.11; Description=PPR repeat
  Pfam annotation: Domain name=PPR; Domain location=177-211; Score =14.2; E_value=0.16; Accession=PF01535.11; Description=PPR repeat
  Pfam module annotation: Pfam domain module=PPR::PPR; Domain location =142-176::177-211
  Subcellular localization annotation: CTP_CleavageSite=42; ConfidenceScore=5.06e-01
MASRSFFKNLKNRDLASLLLVEFTRSSKPIKHISSTSSPFVECNSFKTASCFRQYHDGRPRGPLWKGKKLIGKEALFVISGFKRFNDDEDKLHKFIKTHVLRLLKMDMIAVLTELERQEQVSLALMMFKVMQKQDWYKPDAYLYKDLIIALARAKKMDEVLQLWESMREENLFPDSQTYTEVIRGFLNYGSPADAMNIYEDMKNSPDPPEELPFRILLKGLLPHPLLRNKVKQDFEEIFPDSSIYDPPQEIFGAR

SEQ ID NO: 129437 - protein, 161 aa, Glycine max
  Coding DNA Sequence Number=SeqID_12659
  Subcellular localization annotation: CTP_CleavageSite=65; ConfidenceScore=5.69e-01
MRARSSKWKQPTLSHFELLALSLSTHSTSAPPMTSSLQRSTLPSSTRAPAPTAKPTPTPSSPPPLTAAASPILPKRKRGRKPKVKLHLDHCYHEIDIIVNPNGVVMDLHQLANSQDPFAEELKRRTEGLHNKEELLGFLRDLPGQWGSRWYGERSEYVLRN

SEQ ID NO: 129438 - protein, 111 aa, Glycine max
  Coding DNA Sequence Number=SeqID_12660
MGAKYLEAVKQRLHAIKQWSPYEIRQHSARRPQSRSPPTEVSVGLCHRDIGIAPIRHLVDPEESNRALGFPALVTGLCQSYRVPLPPSKGSCMQDTQWTRRNPTGCWGFQL

SEQ ID NO: 129439 - protein, 186 aa, Glycine max
  Coding DNA Sequence Number=SeqID_12661
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q5W7F2; Match level="QueryCoverage=40%, HitCoverage=9%, E-value=8e-29, Identity=84%"; Hit description=ARF-GAP
MQIAPLGYFKQGYELLHQMEPYINQGSSSQHPGQRNSSELASGLLSRWLSFHHHGGVHDEKSIAHHTVNLLTSTIKVDTDQSDLRFCFRFISPTKNYTLQFNITGLQPFVTLFHWDLPQALQDEYGGFLNPRIINDFQDYAELCFKEFGDRLVYSFLRKVRSFHESFLHSAGILDYVKLGTKPHKF

SEQ ID NO: 129440 - protein, 132 aa, Glycine max
  Coding DNA Sequence Number=SeqID_12662
  Gene Ontology: Mol. function=sequence-specific DNA binding; Cellular component=nucleus; Biological process=regulation of transcription
  Homolog annotation: Hit_ID=Q1S442; Match level="QueryCoverage=96%, HitCoverage=16%, E-value=4e-33, Identity=63%"; Hit description=DNA -binding WRKY
  Subcellular localization annotation: CTP_CleavageSite=80; ConfidenceScore=5.43e-01
ETKRSIAERRGFNSNAARINTALFRTATSTTNPSPSLAARSPRLTIPPGISPTDLLDSPIMLPNSQAISPTTGSFFMLPPLSHEGSMLTTEQGNVDVSTASDVDASFKFKPRGHFDPNHLPPYSASLNQLLI

SEQ ID NO: 129441 - protein, 161 aa, Glycine max
  Coding DNA Sequence Number=SeqID_12663
MACRDKLWSFCALLSSRGGEPDDMRRQIMVIPHTFLPFGDNRVRWHAKINYGHSAPFCHPEAASPMTCGDKLWSFQTPFVIQIRSCLMARGDKLWSFRTICHPETIVSDGTQIQIMVILRLSSSRGGEPDDMRRYHYGHPRLSSIERNEFGSIRMMLVIRC

SEQ ID NO: 129442 - protein, 359 aa, Glycine max
  Coding DNA Sequence Number=SeqID_12664
  Gene Ontology: Mol. function=sequence-specific DNA binding; Cellular component=nucleus; Biological process=regulation of transcription
  Homolog annotation: Hit_ID=Q1S442; Match level="QueryCoverage=99%, HitCoverage=63%, E-value=1e-120, Identity=58%"; Hit description=DNA -binding WRKY
  Pfam annotation: Domain name=WRKY; Domain location=103-162; Score =148.9; E_value=1.3e-41; Accession=PF03106.6; Description=WRKY DNA -binding domain
ERTPTTSAVTELSDPISTNNAKSLCMLESEDTPELSSTLASHDGDEDGTAQALVSAEDEAENDELDSKRRKKESYAVEPNLPPTRAVREPRVVVQIESDVDILDDGYRWRKYGQKVVKGNPNPRSYYKCTSAGCMVRKHVERASQNLKYVLTTYEGKHNHEVPTARTNNQVNSSDGGLPPNGANGQVALTLPKPETHQTLFGHHFDRKPEFSNEFLRASLVGSFSNDMKFGPSTLCQMKYPSLNNTMPYGSYGLNHEHCTAPQAGSIASMFPDFPMPLPLNLPSSGLNFNCVKPMNRVQSFLSGQQVKDIDAGFLRPKQEQKDDTMYGSCMPPLDHSNASLTSSPSPSIYQRMMQNFPS

SEQ ID NO: 129443 - protein, 608 aa, Glycine max
  Coding DNA Sequence Number=SeqID_12665
  Homolog annotation: Hit_ID=Q5H6D1; Match level="QueryCoverage=41%, HitCoverage=99%, E-value=4e-89, Identity=67%"; Hit description =Carboxylesterase bioH
VDSRGSHEITGRRTTGIVDQDVHLRAGGQRRRAAGLGGDVGGDGAHLTGTGQCTQFVGGDLQCSLATRHDHHVHALAYERTRAAQAQPLACAADQCPAAVDTQIHASILRNSEGAHCPPSAGDRPATKCCRAAATSSAWPRKGACPPWPMVSACAPGASAAAACIAAGETSRSRWPAIHRLGLPSVASAPRRSVLSSRRRPSSRARSVGAPRSTSRCRSVRSSSRACAEPITSSARKRSSVPPKSVASSRPNCSNTAGSTACGQSSPRTKRGVAAIIARPRTFGSVAAACSANRPPSDQPHHTVGGVAAAMALTTNGRRSGVVSSRLWPWPGRSTRCRVNWSARRCTSGANTPPCRAQPWISTRSGPRPVTSICMGNDTELRQKRAAAVARLHARPGSRDRARWRWPPPGHAPVPAYAARTVSRAGVPCLPAPSAGGLHRPASRPVPAPWTSPRRCGHRRTAAAGSVFPKPSGPGHGDALQCGTARSGRSALCDASGRGAPGALLQAQQRPSPVARRWCRCTGARFRPDARSGRRGPAPAHRNRPSALPSVTSCSGTSSTPQPGGGHGTTAITDHADTGAHHPHRTAPAVGRATSDKCTQRCDVAIPC

SEQ ID NO: 129444 - protein, 119 aa, Glycine max
  Coding DNA Sequence Number=SeqID_12666
  Homolog annotation: Hit_ID=Q2HW10; Match level="QueryCoverage=74%, HitCoverage=81%, E-value=6e-26, Identity=51%"; Hit description =Wiscott-Aldrich syndrome, C-terminal
  Pfam annotation: Domain name=PBD; Domain location=54-82; Score=14.4; E_value=0.0037; Accession=PF00786.18; Description=P21-Rho-binding domain
MERLVILPFSAGCISEASVAVGVPYPRRSKPDTNAPPPTIMEKDEFEEVEIDMEIGCPTDVQHVTHIGWDGIATSAADPIMKGWDALIPHELLSLSSSQSLQHHQDLPNLDAKHDDSPN

SEQ ID NO: 129445 - protein, 269 aa, Glycine max
  Coding DNA Sequence Number=SeqID_12667
  Gene Ontology: Mol. function=chlorophyll binding; Cellular component =photosystem I reaction center; Biological process=photosynthesis
  Homolog annotation: Hit_ID=Q2HW07; Match level="QueryCoverage=75%, HitCoverage=95%, E-value=2e-86, Identity=76%"; Hit description =Photosystem I reaction centre, subunit XI PsaL
  Pfam annotation: Domain name=PsaL; Domain location=109-267; Score =367.6; E_value=2e-107; Accession=PF02605.5; Description=Photosystem I reaction centre subunit XI
MGCFKEFPHELELACEVLMNGKKKHQVGLQDGLTQPKGAHHEDIKISILYGKAIIMAAASPMASQLKSTFTRTLVAPKGLSASSPLHLVPSRRQFSFTVKAIQSEKPTYQVIQPINGDPFIGSLETPVTSSPLIAWYLSNLPAYRTAVSPLLRGIEVGLAHGYLLVGPFVKAGPLRNTEIAGQAGSLAAGGLVVILSLCLTIYGISSFNEGAPSTAPSLTLTGRKKEPDQLQTADGWAKFTGGFFFGGISGVIWAYFLLYVLDLPYYIK

SEQ ID NO: 129446 - protein, 277 aa, Glycine max
  Coding DNA Sequence Number=SeqID_12668
  Gene Ontology: Mol. function=alpha-1,4-glucan-protein synthase (UDP -forming) activity; Cellular component=cellulose and pectin -containing cell wall; Biological process=cellulose biosynthetic process
  Homolog annotation: Hit_ID=O24548; Match level="QueryCoverage=85%, HitCoverage=68%, E-value=1e-139, Identity=97%"; Hit description=Type IIIa membrane protein cp-wap13
  Pfam annotation: Domain name=RGP; Domain location=2-261; Score=543.9; E_value=1.6e-160; Accession=PF03214.4; Description=Reversibly glycosylated polypeptide
MLSTNCRHDFLNISYFHVQVAKDPSGKDINALEQHIKNLLCPSTPFFFNTLYDPYRAGADFVRGYPFSLREGAPTAVSHGLWLNIPDYDAPTQLVKPLERNTRYVDAVLTIPKGTLFPMCGMNLAFDRQLIGPAMYFGLMGDGQPIGRYDDMWAGWCVKVICDHLGLGVKTGLPYIWHSKASNPFVNLKKEYKGIFWQEEIIPFFQSATIPKECTSVQKCYIELSKQVKEKLGAVDPYFTKLADAMVTWIEAWDELNSTTSEEASSKSANGAAAATK

SEQ ID NO: 129447 - protein, 227 aa, Glycine max
  Coding DNA Sequence Number=SeqID_12669
  Gene Ontology: Mol. function=binding; Cellular component=nucleus; Biological process=metabolic process
  Homolog annotation: Hit_ID=Q7XHP5; Match level="QueryCoverage=98%, HitCoverage=64%, E-value=1e-32, Identity=29%"; Hit description =Putative pentatricopeptide (PPR) repeat-containing protein
  Pfam annotation: Domain name=PPR; Domain location=194-227; Score =18.5; E_value=0.024; Accession=PF01535.11; Description=PPR repeat
  Pfam annotation: Domain name=PPR; Domain location=93-127; Score=29.4; E_value=1.2e-05; Accession=PF01535.11; Description=PPR repeat
  Pfam module annotation: Pfam domain module=PPR::PPR; Domain location =194-227::93-127
MVECGTEFSVVTFSIALILSSSLSLVELGRQLHGMVLKFGFCRDGFIRSSLVEMYCKCGRMDNASIVLKDVPLDFLKNGNAGVTCKELKAGIVSWGLMVSGYVWNGKYEDGLKTFRLMVRELVVVDIRTVTTIISACANAGILEFGRHVHAYNHKIGHRIDAYVGSSLIDMYSKSGSLDDAWTIFRQTNEPNIVFWTSMISGCALHGPRKQAICLFEEMLNQGIITK

SEQ ID NO: 129448 - protein, 1145 aa, Glycine max
  Coding DNA Sequence Number=SeqID_12670
  Gene Ontology: Mol. function=protein serine/threonine kinase activity; Cellular component=integral to membrane; Biological process=protein amino acid phosphorylation
  Homolog annotation: Hit_ID=Q9LHP4; Match level="QueryCoverage=91%, HitCoverage=91%, E-value=0.0, Identity=64%"; Hit description =Receptor protein kinase-like protein
  Pfam annotation: Domain name=LRRNT_2; Domain location=47-90; Score =26.1; E_value=0.00013; Accession=PF08263.3; Description=Leucine rich repeat N-terminal domain
  Pfam annotation: Domain name=LRR_1; Domain location=118-140; Score =13.4; E_value=0.83; Accession=PF00560.23; Description=Leucine Rich Repeat
  Pfam annotation: Domain name=LRR_1; Domain location=142-164; Score =18.7; E_value=0.021; Accession=PF00560.23; Description=Leucine Rich Repeat
  Pfam annotation: Domain name=LRR_1; Domain location=166-188; Score =18.3; E_value=0.028; Accession=PF00560.23; Description=Leucine Rich Repeat
  Pfam annotation: Domain name=LRR_1; Domain location=190-212; Score =12.3; E_value=1.4; Accession=PF00560.23; Description=Leucine Rich Repeat
  Pfam annotation: Domain name=LRR_1; Domain location=214-237; Score =6.5; E_value=17; Accession=PF00560.23; Description=Leucine Rich Repeat
  Pfam annotation: Domain name=LRR_1; Domain location=239-261; Score =13.6; E_value=0.7; Accession=PF00560.23; Description=Leucine Rich Repeat
  Pfam annotation: Domain name=LRR_1; Domain location=263-285; Score =10.7; E_value=2.8; Accession=PF00560.23; Description=Leucine Rich Repeat
  Pfam annotation: Domain name=LRR_1; Domain location=287-309; Score =11.5; E_value=2; Accession=PF00560.23; Description=Leucine Rich Repeat
  Pfam annotation: Domain name=LRR_1; Domain location=311-333; Score =9.8; E_value=4.1; Accession=PF00560.23; Description=Leucine Rich Repeat
  Pfam annotation: Domain name=LRR_1; Domain location=335-357; Score =14.2; E_value=0.48; Accession=PF00560.23; Description=Leucine Rich Repeat
  Pfam annotation: Domain name=LRR_1; Domain location=359-381; Score =12.9; E_value=1.1; Accession=PF00560.23; Description=Leucine Rich Repeat
  Pfam annotation: Domain name=LRR_1; Domain location=383-405; Score =11.5; E_value=2; Accession=PF00560.23; Description=Leucine Rich Repeat
  Pfam annotation: Domain name=LRR_1; Domain location=407-429; Score =5.3; E_value=29; Accession=PF00560.23; Description=Leucine Rich Repeat
  Pfam annotation: Domain name=LRR_1; Domain location=431-453; Score =17.9; E_value=0.037; Accession=PF00560.23; Description=Leucine Rich Repeat
  Pfam annotation: Domain name=LRR_1; Domain location=455-477; Score =7.1; E_value=14; Accession=PF00560.23; Description=Leucine Rich Repeat
  Pfam annotation: Domain name=LRR_1; Domain location=479-501; Score =14.9; E_value=0.3; Accession=PF00560.23; Description=Leucine Rich Repeat
  Pfam annotation: Domain name=LRR_1; Domain location=503-525; Score =15.9; E_value=0.15; Accession=PF00560.23; Description=Leucine Rich Repeat
  Pfam annotation: Domain name=LRR_1; Domain location=527-549; Score =14.2; E_value=0.47; Accession=PF00560.23; Description=Leucine Rich Repeat
  Pfam annotation: Domain name=LRR_1; Domain location=551-573; Score =13.6; E_value=0.74; Accession=PF00560.23; Description=Leucine Rich Repeat
  Pfam annotation: Domain name=LRR_1; Domain location=575-597; Score =14.2; E_value=0.49; Accession=PF00560.23; Description=Leucine Rich Repeat
  Pfam annotation: Domain name=LRR_1; Domain location=599-621; Score =17.5; E_value=0.047; Accession=PF00560.23; Description=Leucine Rich Repeat
  Pfam annotation: Domain name=LRR_1; Domain location=648-669; Score =15.9; E_value=0.14; Accession=PF00560.23; Description=Leucine Rich Repeat
  Pfam annotation: Domain name=LRR_1; Domain location=671-694; Score =12.3; E_value=1.4; Accession=PF00560.23; Description=Leucine Rich Repeat
  Pfam annotation: Domain name=Pkinase; Domain location=792-1071; Score= 151.6; E_value=2.1e-42; Accession=PF00069.15; Description=Protein kinase domain
  Pfam annotation: Domain name=Pkinase_Tyr; Domain location=792-1071; Score=111.3; E_value=2.7e-30; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::...
  Pfam module annotation: Pfam domain module=Pkinase::Pkinase_Tyr; Domain location=47-90::118-140::142-164::166-188::190-212::214 -237::239-261::263-285::287-309::311-333::335-357::359-381::383 -405::407-429::431-453::...
  Pfam module annotation: Domain location=455-477::479-501::503 -525::527-549::551-573::575-597::599-621::648-669::671-694::792 -1071::792-1071
  Subcellular localization annotation: CTP_CleavageSite=46; ConfidenceScore=5.56e-01
KCFIVSMLTSRQSLYISPSSPSPSPSSSLFFIILLQLTFLYGLAFSANHEASTLFTWLHSSSASSSPPPSFSNWNLLDPNPCNWTSITCSSLGLVTEITIQSIALELPIPSNLSSFHSLQKLVISDANLTGTIPSDIGHCSSLTVIDLSSNNLVGSIPPSIGKLQNLQNLSLNSNQLTGKIPVELSNCIGLKNVVLFDNQISGTIPPELGKLSQLESLRAGGNKDIVGKIPQEIGECSNLTVLGLADTRISGSLPASLGRLTRLQTLSIYTTMLSGEIPPELGNCSELVDLFLYENSLSGSIPSELGRLKKLEQLFLWQNGLVGAIPEEIGNCTTLRKIDFSLNSLSGTIPVSLGGLLELEEFMISDNNVSGSIPSSLSNAKNLQQLQVDTNQLSGLIPPELGQLSSLMVFFAWQNQLEGSIPSSLGNCSNLQALDLSRNALTGSIPVGLFQLQNLTKLLLIANDISGFIPNEIGSCSSLIRLRLGNNRITGSIPKTIRSLKSLNFLDLSGNRLSGPVPDEIGSCTELQMIDFSSNNLEGPLPNSLSSLSSVQVLDASSNKFSGPLPASLGRLVSLSKLILSNNLFSGPIPASLSLCSNLQLLDLSSNKLSGSIPAELGRIETLEIALNLSCNSLSGIIPAQMFALNKLSILDISHNQLEGDLQPLAELDNLVSLNVSYNKFSGCLPDNKLFRQLASKDFTENQGLSCFMKDSGKTGETLNGNDVRKSRRIKLAIGLLIALTVIMIAMGITAVIKARRTIRDDDSELGDSWPWQFIPFQKLNFSVEQVLRCLTERNIIGKGCSGVVYKAEMDNGEVIAVKKLWPTTIDEGEAFKEGKSGIRDSFSTEVKTLGSIRHKNIVRFLGCYWNRKTRLLIFDYMPNGSLSSLLHERTGNSLEWELRYRILLGAAEGLAYLHHDCVPPIVHRDIKANNILIGLEFEPYIADFGLAKLVDDGDFGRSSNTVAGSYGYIAPEYGYMMKITEKSDVYSYGIVLLEVLTGKQPIDPTIPDGLHVVDWVRQKKGLEVLDPSLLLSRPESEIEEMMQALGIALLCVNSSPDERPTMRDIAAMLKEIKHEREDYAKFDVLLKGSPANGACGNKSIGGVLPTSSSSVPVMQTLKTKNDNSSFSVSSLLHSSSSVMMGSK

SEQ ID NO: 129449 - protein, 48 aa, Glycine max
  Coding DNA Sequence Number=SeqID_12671
  Gene Ontology: Mol. function=nucleic acid binding; Cellular component= nucleus
  Homolog annotation: Hit_ID=Q9SWF9; Match level="QueryCoverage=87%, HitCoverage=69%, E-value=1e-19, Identity=75%"; Hit description=Zinc finger CCCH domain-containing protein ZFN-like
  Pfam annotation: Domain name=zf-CCCH; Domain location=10-36; Score =44.1; E_value=4.7e-10; Accession=PF00642.15; Description=Zinc finger C-x8-C-x5-C-x3-H type (and similar)
MESGPYPEHPGEPDCSYYIRTGLCRFGATCRFNHPPNRKLNIPRRCNQ

SEQ ID NO: 129450 - protein, 100 aa, Glycine max
  Coding DNA Sequence Number=SeqID_12672
  Homolog annotation: Hit_ID=Q9ZPQ0; Match level="QueryCoverage=62%, HitCoverage=40%, E-value=4e-12, Identity=57%"; Hit description=Low molecular weight heat-shock protein
  Subcellular localization annotation: CTP_CleavageSite=33; ConfidenceScore=5.15e-01
MVISHIGTAPTMSTKSLFFPIGSCIGSIKKFMVAFAFGAFNLNDPDIPIRSGLMKLGNSDKENPVTHVGFELFEVTVVGDLKPRQEVTTLHADLEHPLVL

SEQ ID NO: 129451 - protein, 314 aa, Glycine max
  Coding DNA Sequence Number=SeqID_12673
  Gene Ontology: Mol. function=transferase activity, transferring hexosyl groups; Cellular component=cytoplasm; Biological process =metabolic process
  Homolog annotation: Hit_ID=Q9LTH2; Match level="QueryCoverage=98%, HitCoverage=74%, E-value=9e-67, Identity=42%"; Hit description=UDP -glycose:flavonoid glycosyltransferase-like
MYSIDSVARELQLPSIVLRTTSATNLLTYHAFVQRQSKGFLPSQDFMSLDLVPELEPLRFKDLPMFNSGVMQQQIAKTIAVKPSLGVICNTVDCLEEESLHRLHRMYEVSFFPIGPLRVIAEEYSSYSCFLDEDYSCIEKELTEVACGLANSKQNFLWVIRTGTINNDVSEWLKSLPKDVRVATEERGYIVKWAPQGEVLAHQAVGGFWSHCGWNSTLESLCEGVPIMCQPHFGDQRVNARLLSHAWKVGIEWSYVMERDEIEEAVRRLMVNQEGMEMRQRALKLKNEIRLAVKGASSYDALNRLVKSILSANL

SEQ ID NO: 129452 - protein, 161 aa, Glycine max
  Coding DNA Sequence Number=SeqID_12674
  Gene Ontology: Mol. function=protein-tyrosine kinase activity; Cellular component=membrane; Biological process=protein amino acid phosphorylation
  Homolog annotation: Hit_ID=Q56I14; Match level="QueryCoverage=90%, HitCoverage=29%, E-value=2e-69, Identity=87%"; Hit description=TPR -containing protein kinase
MGARCSKFSLCWWPSHLKSNLHNLSDNDDDGKRNEKDPCGGFSEYSLDQLRVATSGFSPDNIVSEHGEKAPNVVYRGMLEDDRLVAVKRFNKSAWPDSRQFLDEARAVGQLRSERLANLVGCCCEGEERLLVAEFMPNETLSKHLFHSINRREDLILMSFC

SEQ ID NO: 129453 - protein, 194 aa, Glycine max
  Coding DNA Sequence Number=SeqID_12675
  Gene Ontology: Mol. function=protein binding; Cellular component =integral to membrane; Biological process=xylan catabolic process
  Homolog annotation: Hit_ID=Q1S5Q9; Match level="QueryCoverage=90%, HitCoverage=20%, E-value=1e-38, Identity=47%"; Hit description =Leucine-rich repeat
  Pfam annotation: Domain name=LRR_1; Domain location=22-44; Score =14.4; E_value=0.43; Accession=PF00560.23; Description=Leucine Rich Repeat
  Pfam annotation: Domain name=LRR_1; Domain location=46-68; Score =14.3; E_value=0.45; Accession=PF00560.23; Description=Leucine Rich Repeat
  Pfam annotation: Domain name=LRR_1; Domain location=70-91; Score =11.6; E_value=1.9; Accession=PF00560.23; Description=Leucine Rich Repeat
  Pfam module annotation: Pfam domain module=LRR_1::LRR_1::LRR_1; Domain location=22-44::46-68::70-91
MIDLASNKLSGAIPSEISKLSALRFLNLSRNHLSGGIPNDMGKMKLLESLDLSLNNISGQIPQSLSDLSFLSVLNLSYNNLSGRIPTSTQLQSFEELSYTGNPELCGPPVTKNCTDKEELTESASVGHGDGNFFGTSEFYIGMGVGFAAGFWGFCSVVFFNRTWRRAYFHYLDHLRDLIYVIIVLKVRRLLGKL

SEQ ID NO: 129454 - protein, 125 aa, Glycine max
  Coding DNA Sequence Number=SeqID_12676
MGVVKYMTMDELKRLGIPSEMLKFFNHSSFPHKGHPTRVFQRKRKNIQWWFQSKKRCKDKLNLTRNKRRITVTSKKTTKVRLSFVLYRNRETSLEDSAPIEGFLSVWVFNGELWRFVVATGGCGW

SEQ ID NO: 129455 - protein, 771 aa, Glycine max
  Coding DNA Sequence Number=SeqID_12677
  Gene Ontology: Mol. function=transporter activity; Cellular component= outer membrane; Biological process=nutrient import
  Homolog annotation: Hit_ID=Q6FC78; Match level="QueryCoverage=92%, HitCoverage=68%, E-value=1e-139, Identity=38%"; Hit description =Putative receptor protein
MVLSIYAGEAHRLAVAQIGTSGRRETHRRRERRQPGVIAVPFVAPGHRLHRPAPDPAADVGAEDHRQQPGDGGDLTVEAGIGGPAVVAVSIGQPGNAVLDLPGCLVLAQQVGQRLIDDPAHADAVPEFPLALECVDLALQAVRPRRQFIHPVLCFARHDRGRLQFRVGLQEVVERPVTAVTHAGIEGQEVDRTPFQREVALALLATAGTRVHAPAVGRAEIRVTRTELLVLPVAAHGQVQGRTQGEAVAQGQAGPVVARICQRGVAQNRAGAGIPVRIARGEVRKAACGVGIAVRLCAPQVGVDVQPAAAGRLEAVLQIPSIGRNPAERPLDAPIVRCRQDARRHDLAVVRQRSPPGRLQLLVIVDLPAALDQPGLLFAGSIGHFIARLEVARQRGDVVDALVLELLAPVLVVVGAALGPGEVVAALAPGVGGHQVDVVATHAQRQAPGLVLAIEGVVATARLHRHHQGAVVVGRVRRALRKPRHGAVILAGVQPRQAWRHRIAAAFDLQLPAEALTRFHDVIDVDGLDHQRATDPAVHIAHQPWPLDDLDATHQVGIDVIAVADAVVAAPDRERLFATVDADRHPPRPLDAADVDVQRAAVARIATEHTDQILYHVGRVGAAIALHPVAPRIRRGQVQREHIIVAAPITRLAPFRLQAAGHVQCFGHPHPVPLTRLRCGPQAPGTVHAALCTHAAAAQQLLQCLHLAVLTTHCTGAAALHQARTASARGCSGMVYWRNGATTTGCACTAGTQASGSNAVEMARARTVARR

SEQ ID NO: 129456 - protein, 74 aa, Glycine max
  Coding DNA Sequence Number=SeqID_12678
MGWPITGNRHTTTTFRVHLSSSTKRLERCLRHMADQQATKSKAKGKQSTRTHLVAHDPGNLNKTSASSEGRKIP

SEQ ID NO: 129457 - protein, 64 aa, Glycine max
  Coding DNA Sequence Number=SeqID_12679
MPPKLYMIDRKVNKFHRENAIDQLISEKVTEQFANTGGLTMITDIQEGNMSVYAQQCIAIPRLR

SEQ ID NO: 129458 - protein, 91 aa, Glycine max
  Coding DNA Sequence Number=SeqID_12680
MDALLSKGEDHISIVKIEDKLSMVEIKAQMLPKSCVLPVVDLVDLVFEDEEKDLEEDTSIKKDPSMDEEAPITELKPMEKDSSQDSSDDSY

SEQ ID NO: 129459 - protein, 167 aa, Glycine max
  Coding DNA Sequence Number=SeqID_12681
MDLIQKAISSRRLKFEDNLMKVYTDPFVVQANYVDHVHILMFDVVPENHIQPVLILMVDVVPEIDEQKSFGSNDSLDRLLEEFEKENIEVYPKVRDTLAEFLTGKKNAKKEVMLCPRCGAVFDKEATNSLNRFESMRRAYEDVAQRELNKCLQIGGSAKAQDEVERG

SEQ ID NO: 129460 - protein, 75 aa, Glycine max
  Coding DNA Sequence Number=SeqID_12682
MDKANIQEKKFESSQKRHTNMMNSVKDDRKGQNTLNGDGVCTLTSSNRLEVGFLLREETNGNCLDKKNKKWGVQH

SEQ ID NO: 129461 - protein, 88 aa, Glycine max
  Coding DNA Sequence Number=SeqID_12683
MVQKTMLVSVRQRARLPLIDERYGCRNLPFGGRATRDSRDACSTKGIRAESPPTFIRGKRRKNRKDAIYELLVEGSGVVFTHGEGVGP

SEQ ID NO: 129462 - protein, 132 aa, Glycine max
  Coding DNA Sequence Number=SeqID_12684
DKINTSSFPYFNSSRGGGVERKRSHSILGLGRERFQPSSQLRQQTIEQKCLFTASGEGEASAYQTDSLGSGAERDGFPIGFRDEYGKSESKSQRTSSATSFAIDGTSRSRSAASAVEAVDGRAKANKSHVCI

SEQ ID NO: 129463 - protein, 165 aa, Glycine max
  Coding DNA Sequence Number=SeqID_12685
  Homolog annotation: Hit_ID=Q5Z401; Match level="QueryCoverage=96%, HitCoverage=60%, E-value=1e-50, Identity=46%"; Hit description =Putative lysine ketoglutarate reductase trans-splicing related 1
  Pfam annotation: Domain name=DUF707; Domain location=1-164; Score =90.3; E_value=5.8e-24; Accession=PF05212.3; Description=Protein of unknown function (DUF707)
MAVGIKQKDLVNKMVKKFLVSNFVVMLFHYDGIVDEWNDFEWNNQVIHVAVANQSKWWFAKRFLHPDIVAEYGYIFLWDEDLGVEHFHPDRIYKSGVSGKRCDGSSTAPPCTGWVEMMAPVFSRAAWRCIWYMIQGDRTKNVGVVDAEYIVHYGHPTLGGLDVHE

SEQ ID NO: 129464 - protein, 136 aa, Glycine max
  Coding DNA Sequence Number=SeqID_12686
  Gene Ontology: Mol. function=transporter activity; Cellular component= integral to membrane; Biological process=auxin mediated signaling pathway
  Homolog annotation: Hit_ID=Q673E6; Match level="QueryCoverage=99%, HitCoverage=37%, E-value=2e-46, Identity=70%"; Hit description =Putative auxin efflux carrier protein 9
  Pfam annotation: Domain name=Mem_trans; Domain location=2-136; Score=- 125.3; E_value=0.055; Accession=PF03547.8; Description=Membrane transport protein
MKLVWRKLATNPNSFGCVIGISWAFISNRWNLEMPSMLEGSIQIMSKAGTGTAMFSMGTFMALQEKVIACGPSMTIIGLVLKFIAGPAATAIGAIVVGLRGDVLRVVIIQAAVPQSITSFIFAKEYGLHPEVLSTA

SEQ ID NO: 129465 - protein, 127 aa, Glycine max
  Coding DNA Sequence Number=SeqID_12687
MEESLQWKQFLSKNLNVYRIGILVGTSDENPEIDQIQAKGPSGEGQSPRVEKDEGPEAETLSRLLTTYQGNPCGVYPDLSSFTGSGVYPDLSCFTESGVIQISLACIKRSAPVRFTSSAIRASALDT

SEQ ID NO: 129466 - protein, 294 aa, Glycine max
  Coding DNA Sequence Number=SeqID_12688
  Homolog annotation: Hit_ID=Q5JJJ9; Match level="QueryCoverage=92%, HitCoverage=73%, E-value=5e-75, Identity=56%"; Hit description=CBS domain containing protein-like
  Pfam annotation: Domain name=CBS; Domain location=96-272; Score=15.3; E_value=0.0027; Accession=PF00571.18; Description=CBS domain
  Subcellular localization annotation: CTP_CleavageSite=67; ConfidenceScore=5.27e-01
MMKQGVKRLLVPKSVAWKGMSKRFSVIYYGKWLKNSESPGNSSNNLPLNMNRSPSTSITPIRDRYCCLSREDVLRFIIGCLGALAPLPLTSIASLGAINSNYNYIESSTPAIEATQKLPQDPSAVAVIESTSDGQCKIIGEISASWALANLSAGQFVMGVEDNVTPRSLPQFSLDLASGENDLANGGGSRKPRKFSSRSVGFFSNTASHSFGSRSMYRGRSAPLTCKITSSLAAVLAQMLSHRATHVWVTEDENDEVLVGVVGYADILAAVTKPPTAFIPANRSTEGFGNEIQC

SEQ ID NO: 129467 - protein, 119 aa, Glycine max
  Coding DNA Sequence Number=SeqID_12689
  Gene Ontology: Mol. function=nucleoside-triphosphatase activity; Cellular component=membrane; Biological process=transport
  Homolog annotation: Hit_ID=Q6ASX4; Match level="QueryCoverage=90%, HitCoverage=38%, E-value=2e-46, Identity=83%"; Hit description=ABC transporter ATP-binding protein, putative
MSKGKKRDVDSDNLTYIARRVLLYDEPTAGLDPIASTVVEDLIRSVHIKGRDARGKPGNIASYVVVTHQHSTIKRAIDRLLFLHKGKIVWEGMTHEFTTSTNPIVQQFASGSLDGPIRY

SEQ ID NO: 129468 - protein, 279 aa, Glycine max
  Coding DNA Sequence Number=SeqID_12690
  Gene Ontology: Mol. function=protein kinase activity; Cellular component=cytoplasm; Biological process=protein amino acid phosphorylation
  Homolog annotation: Hit_ID=Q5QLZ5; Match level="QueryCoverage=68%, HitCoverage=23%, E-value=2e-83, Identity=79%"; Hit description =Putative kinase-like protein splice variant 1
MGFIEFQRCDDDDGQMVMTSDFEKKKESEFRGRWLLLLLLGVGGDLILFSIFLLSKVSIGVTLDWDWEAKKTNQRYVWAMAIYHHSSSMFKFLKEVVGGSGTGVKDLPYTIAEPYPSAWGSWTHSRGTSKDDGSPVSVFSLSGSNAQDGHLAAARNGVKRLRTVRHPNILSFLHSAEIETYDAGSPKVTIYIVTEPVMPLSEKIKELGLEGTQRDEYYALGLHQIAKAVSFLNNDCKLVHGNICMASTVVTPTLDWKLHALDVLSEFDGSSEASSGQML

SEQ ID NO: 129469 - protein, 701 aa, Glycine max
  Coding DNA Sequence Number=SeqID_12691
  Gene Ontology: Mol. function=receptor activity; Cellular component =integral to membrane; Biological process=protein amino acid phosphorylation
  Homolog annotation: Hit_ID=Q9SPE8; Match level="QueryCoverage=97%, HitCoverage=95%, E-value=0.0, Identity=58%"; Hit description =Receptor-like protein CLAVATA2
  Pfam annotation: Domain name=LRRNT_2; Domain location=26-64; Score =40.2; E_value=7e-09; Accession=PF08263.3; Description=Leucine rich repeat N-terminal domain
  Pfam annotation: Domain name=LRR_1; Domain location=117-139; Score =15.2; E_value=0.24; Accession=PF00560.23; Description=Leucine Rich Repeat
  Pfam annotation: Domain name=LRR_1; Domain location=141-164; Score =10.9; E_value=2.6; Accession=PF00560.23; Description=Leucine Rich Repeat
  Pfam annotation: Domain name=LRR_1; Domain location=167-189; Score =12.1; E_value=1.5; Accession=PF00560.23; Description=Leucine Rich Repeat
  Pfam annotation: Domain name=LRR_1; Domain location=191-210; Score =5.2; E_value=30; Accession=PF00560.23; Description=Leucine Rich Repeat
  Pfam annotation: Domain name=LRR_1; Domain location=212-233; Score =5.0; E_value=34; Accession=PF00560.23; Description=Leucine Rich Repeat
  Pfam annotation: Domain name=LRR_1; Domain location=236-258; Score =12.7; E_value=1.2; Accession=PF00560.23; Description=Leucine Rich Repeat
  Pfam annotation: Domain name=LRR_1; Domain location=260-279; Score =7.3; E_value=12; Accession=PF00560.23; Description=Leucine Rich Repeat
  Pfam annotation: Domain name=LRR_1; Domain location=284-306; Score =11.9; E_value=1.7; Accession=PF00560.23; Description=Leucine Rich Repeat
  Pfam annotation: Domain name=LRR_1; Domain location=311-333; Score =15.1; E_value=0.25; Accession=PF00560.23; Description=Leucine Rich Repeat
  Pfam annotation: Domain name=LRR_1; Domain location=335-357; Score =15.7; E_value=0.17; Accession=PF00560.23; Description=Leucine Rich Repeat
  Pfam annotation: Domain name=LRR_1; Domain location=359-381; Score =16.2; E_value=0.12; Accession=PF00560.23; Description=Leucine Rich Repeat
  Pfam annotation: Domain name=LRR_1; Domain location=383-405; Score =11.8; E_value=1.8; Accession=PF00560.23; Description=Leucine Rich Repeat
  Pfam annotation: Domain name=LRR_1; Domain location=407-429; Score =10.0; E_value=3.8; Accession=PF00560.23; Description=Leucine Rich Repeat
  Pfam annotation: Domain name=LRR_1; Domain location=431-453; Score =8.5; E_value=7.3; Accession=PF00560.23; Description=Leucine Rich Repeat
  Pfam annotation: Domain name=LRR_1; Domain location=455-477; Score =12.5; E_value=1.3; Accession=PF00560.23; Description=Leucine Rich Repeat
  Pfam annotation: Domain name=LRR_1; Domain location=479-502; Score =8.9; E_value=6.1; Accession=PF00560.23; Description=Leucine Rich Repeat
  Pfam annotation: Domain name=LRR_1; Domain location=544-566; Score =7.8; E_value=9.8; Accession=PF00560.23; Description=Leucine Rich Repeat
  Pfam annotation: Domain name=LRR_1; Domain location=568-589; Score =12.7; E_value=1.2; Accession=PF00560.23; Description=Leucine Rich Repeat
  Pfam annotation: Domain name=LRR_1; Domain location=591-613; Score =15.9; E_value=0.15; Accession=PF00560.23; Description=Leucine Rich Repeat
  Pfam annotation: Domain name=LRR_1; Domain location=615-634; Score =6.2; E_value=20; Accession=PF00560.23; Description=Leucine Rich Repeat
  Pfam annotation: Domain name=LRR_1; Domain location=69-91; Score=6.8; E_value=15; Accession=PF00560.23; Description=Leucine Rich Repeat
  Pfam annotation: Domain name=LRR_1; Domain location=93-115; Score =9.5; E_value=4.7; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1; Domain ...
  Pfam module annotation: Pfam domain module=location=26-64::117 -139::141-164::167-189::191-210::212-233::236-258::260-279::284 -306::311-333::335-357::359-381::383-405::407-429::431-453::455 -477::479-502::544-566::568-589:...
  Pfam module annotation: =:591-613::615-634::69-91::93-115
  Subcellular localization annotation: CTP_CleavageSite=62; ConfidenceScore=5.24e-01
MGHTTPLTLLCMILLFATPSLSIDVHPQDRISLSLFRSSLPNPNQSLPSWVGSNCTSWSGITCDSRTGRVLSINLTSMNLSGKIHPSLCHLSYLNKLGLSHNNFTAPLPECFGNLLNLRAIDLSHNRFHGGIPDSFMRLRHLTELVFSGNPGLGGPLPAWIGNFSANLEKLHLGFCSFSGGIPESLLYMKSLKYLDLENNLLFGNLVDFQQPLVLLNLASNQFAGTLPCFAASVQSLTVLNLSNNSIAGGLPACIASFQALTHLNLSGNHLKYRIYPRLVFSEKLLVLDLSNNALSGPIPSKIAETTDKLGLVLLDLSHNQFSGEIPVKITELKSLQALFLSHNLLSGEIPARIGNLTYLQVIDLSHNSLSGTIPFSIVGCFQLYALILNNNNLSGVIQPEFDALDILRILDISNNRFSGAIPLTLAGCKSLEIVDFSSNELSGSLNDAITKWTNLRYLSLAQNKFSENLPSWLFTFNAIEMMDFSHNKFTGFIPDINFKGSLIFNTRNVTVKEPLVAARKVQLRVSAVVSDSNQLSFTYDLSSMVGIDLSSNSLHGEIPRGLFGLSGLEYLNLSCNFLYGQLPGLQKMQSLKALDLSHNSLSGHIPGNISILQDLSILNLSYNCFSGCVPQKQGYGRFPGAFAGNPDLCMESSSGLCDDGRTQSAQGSTFREDRMDDPISVGIFFISAFVGEGSARNMPD

SEQ ID NO: 129470 - protein, 200 aa, Glycine max
  Coding DNA Sequence Number=SeqID_12692
  Pfam annotation: Domain name=Transposase_24; Domain location=15-133; Score=-23.2; E_value=0.059; Accession=PF03004.5; Description=Plant transposase (PttaEnSpm family)
MKSQKDVKKPKWMFDRVWNGLLAKWNLPKYRIKCLQAQKNQNSEKGGSLHIGGSLNTHKHAICMAMEYGRPVHVDETRFSQARSKAESCGGSSDISPLDPAEEVRLRTQTFVVGASGFKKGWIYGTGELTHGYKCVDILTQMIHEGSSHSQDLEEIVQLKKELMHVTCFTNNKSNHISKSNNHNKSSNMTNSNNTNSVTL

SEQ ID NO: 129471 - protein, 207 aa, Glycine max
  Coding DNA Sequence Number=SeqID_12693
  Homolog annotation: Hit_ID=Q1T097; Match level="QueryCoverage=62%, HitCoverage=10%, E-value=5e-32, Identity=49%"; Hit description =Transposase family tnp2, putative
MWMYPFESKLRCPLKLTHWAIYLDSSFLQSRQLTKSNPYRRIHVDFPKWFKEQVKNEPLSVKNLHFMDLSLGPFTCIKELHTFFENGYKFHTHAWSEGKNNGVYVKGLTKGGDDDFYGIIQHIYKLEYDTSTSPKRVVLFYCDWFDPTCRELDEEEEKANDFDNKEEEFKDNDLEEDNEEEEFEDSDFEEDNRDGGFKDDIEDSSSE

SEQ ID NO: 129472 - protein, 73 aa, Glycine max
  Coding DNA Sequence Number=SeqID_12694
MACLCVLREPPMCELLTLDGIDNDLGTGSGEGIARDEEGIGDATVEDEEDVNAGSGATVGAIWKGIGATTRDG

SEQ ID NO: 129473 - protein, 152 aa, Glycine max
  Coding DNA Sequence Number=SeqID_12695
MSLNNLEKLCIRFLTLNIDGLGDLVGKSERSKHQGLRQTMLMFMGLILTYMVFNLPIPTRCGTSPHTCNPTIVLSSSLTMIAPPLPSHCRQHALVHCIVMLSTTSWSQDTPPCLHAWTNTQGRLSIQGISMSTDSLPPFYSFESVTKSNYLL

SEQ ID NO: 129474 - protein, 111 aa, Glycine max
  Coding DNA Sequence Number=SeqID_12696
REYIYLVVQREQGRAHPLWLFACKGFYKVIGNLKNRGLLRDWIDDSRKVLRYFAVFLKISNASEAKLVSAINAIEQAYNRNWQSLRLECDSSLVIQVVNNPHIVPQELLNK

SEQ ID NO: 129475 - protein, 162 aa, Glycine max
  Coding DNA Sequence Number=SeqID_12697
WVPRKGPLLYSALISLDQHDLSMTVKEFICKDGPWDLNNLEQLLLRPLCEDISLLNPPKDDAGEDYVIWKGTNDGIFSAKWKGTKRMRPLMWKIVNVDVAIRSSDNEVACSGIVRHHHGCVFSHVFRNHNRVADELARRAFKGKTKSLGEEESSWAKRPSNK

SEQ ID NO: 129476 - protein, 99 aa, Glycine max
  Coding DNA Sequence Number=SeqID_12698
MSFPETHRGLMNDASSSNFNPQFDYITEDYNMGFPFPPREKVITPIDLTLENIKSKGKRMPIEPTFNMPSLLLNIGSIDPQLLPNYMEQWTSVVIRDYK

SEQ ID NO: 129477 - protein, 201 aa, Glycine max
  Coding DNA Sequence Number=SeqID_12699
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=Q1EP29; Match level="QueryCoverage=82%, HitCoverage=40%, E-value=1e-56, Identity=59%"; Hit description =Glycosyl transferase family 14 protein
  Pfam annotation: Domain name=Branch; Domain location=2-84; Score= -74.4; E_value=0.0094; Accession=PF02485.11; Description=Core-2I -Branching enzyme
QLVEGGAQHKAEYGIEGEIEQDENRRKDEKTSPKCSAWMVLSRSFVEYVVWGWDNLPRTLLMYYTNFISSPEGYFQTIACNEPELAKTIVNSDLHYISWDNPPKQHPHVLTINDTAKMIASNTAFARKFKHNDPVLDVIDKKLLHRENEQLFTPGGWCSGNPRCFKVGNIYKITPGPGSKRLRFLVTRLTWMAKFGQKQCK

SEQ ID NO: 129478 - protein, 131 aa, Glycine max
  Coding DNA Sequence Number=SeqID_12700
  Gene Ontology: Mol. function=protein disulfide oxidoreductase activity; Cellular component=chloroplast; Biological process=cell redox homeostasis
  Homolog annotation: Hit_ID=Q84Y95; Match level="QueryCoverage=67%, HitCoverage=51%, E-value=4e-37, Identity=77%"; Hit description =CAXIP1 protein
  Pfam annotation: Domain name=Glutaredoxin; Domain location=58-122; Score=114.9; E_value=2.4e-31; Accession=PF00462.14; Description =Glutaredoxin
MRFWWASPSAAVKLCLGNQLIMGSPYFYIARSLLTPGYITLTPQLKSTLDQVIASNKVVVFMKGTKDFPQCGFSNTVVQILKSLNVPFETINVLENDLLRQGLKEYSSWPTFPQVYIEGEFFGGCDITVGM

SEQ ID NO: 129479 - protein, 290 aa, Glycine max
  Coding DNA Sequence Number=SeqID_12701
  Gene Ontology: Mol. function=hydrolase activity; Biological process =metabolic process
  Homolog annotation: Hit_ID=Q53P31; Match level="QueryCoverage=79%, HitCoverage=76%, E-value=2e-69, Identity=56%"; Hit description=HAD -superfamily hydrolase, subfamily IA, variant 3, putative
  Pfam annotation: Domain name=Hydrolase; Domain location=58-270; Score= 30.4; E_value=6.1e-06; Accession=PF00702.16; Description=haloacid dehalogenase-like hydrolase
  Subcellular localization annotation: CTP_CleavageSite=41; ConfidenceScore=5.34e-01
MVLMGGVGVPSISICCLFQTRPTRHLCLKFRLKPSLSHSITSMALTNNNNTNTNERKLPILLFDIMDTLVRDPFYQDVPAFFGMSLKELIDCKHPTAWIEFEKGLIDEVKRMNFEYEPSFVMELARKFFKDGRDFDLEELLRFLVKDQADSDELKIGDGLKSCMRSGYSYIEGSEQLLLSLKQNNYEMHAFTNYPIWYQLIEDKLKLSKYLSWTFCSWAFGKRKPDTEFYKEVVRHLKVDPTNCIFVDDRQKNVEAAIEVGIRGVHFQNVNSLCEKLSLMGIDISTDEDI

SEQ ID NO: 129480 - protein, 416 aa, Glycine max
  Coding DNA Sequence Number=SeqID_12702
  Gene Ontology: Mol. function=protein kinase activity; Cellular component=cytoplasm; Biological process=protein amino acid phosphorylation
  Homolog annotation: Hit_ID=Q5QLZ5; Match level="QueryCoverage=85%, HitCoverage=40%, E-value=2e-95, Identity=55%"; Hit description =Putative kinase-like protein splice variant 1
  Pfam annotation: Domain name=HEAT; Domain location=140-176; Score =24.9; E_value=0.00029; Accession=PF02985.12; Description=HEAT repeat
VYPHVATGFSDTSAFLRELTLKSIKLLSLIKQRSKLCQSWGNSTDLLLLFVVSKDNVRVIIEVSVKVAGHRSFFEVDEEPAIRTNTTILLGNIGSYLNEGTRKRVLINAFTVRALRDTFPPARGAGIMALCATSSYYDITEVATRILPNVVVLTIDPDSDVRTKAFQAVDQFLQIAKQHYEKTNAADTSCGVGSSSVPGNASLLGWAMSSLTLKGKPSDHAPVASASSTAITSTSSNGTAGIETPSTAAAHVSSTADLAEHPVPTSPTSTDGWGELENGIDEEHGSDRDGWDDLEPLEETKPAPALANIQAAQRRPVSQPISHTKQASNLLSKSTPKLNKDEDDDLWGSIAAPAPKTARPLNLKSAQTDDDDPWAAIAAPAPTIKAKPLSAGRGRGAKPAAPKLGAQRINRTSSGM

SEQ ID NO: 129481 - protein, 336 aa, Glycine max
  Coding DNA Sequence Number=SeqID_12703
  Gene Ontology: Mol. function=nucleotide binding; Cellular component =membrane; Biological process=translation
  Homolog annotation: Hit_ID=Q1RCT6; Match level="QueryCoverage=99%, HitCoverage=78%, E-value=1e-108, Identity=60%"; Hit description =Hypothetical protein ycgF
  Pfam annotation: Domain name=BLUF; Domain location=1-72; Score=85.5; E_value=1.7e-22; Accession=PF04940.3; Description=Sensors of blue -light using FAD
  Pfam annotation: Domain name=EAL; Domain location=135-336; Score =85.4; E_value=1.7e-22; Accession=PF00563.11; Description=EAL domain
  Pfam module annotation: Pfam domain module=BLUF::EAL; Domain location= 1-72::135-336
MVGKANKKNEVSDVTGILLFEGRHFFQLLEGPDQAVQGIYDRICRDARHHNLVELMHDFAPARRFGNVGMELFDLREHDKSSVLQAVLDKGTSRYQLTYDDRALQFLRTFVEAREKENYFEIPPANTWEFITDAESQRQLESLQHYVQDCRFAFQPIVDPFSRRITAYEALIRTPDGGSPQEYFSAFGGDAIYHADIQSKSLAFNLAKNLGLGEQTLTINLLPMSLVTVPNAVDFLLQEIAANGLVPEQIVVEVTENEIISRAEEFTAEVRKLKAAGISLALDDFGAGFAGLSLLSKFQPDKIKIDREIISDVHKSGPKQAIVHAIIKCCASLEIA

SEQ ID NO: 129482 - protein, 136 aa, Glycine max
  Coding DNA Sequence Number=SeqID_12704
MASCKWKAPASVSQARRKVERRNWHKELINFSEGSINVVIVKEFYANLYDPEDKSPKQVRVRGHLIKFYADAINTFLKTPVVIEEGESLPVYSRFANLRPIPQELAAHLCIPGRGFELNADGLPLKILRKNLTTLA

SEQ ID NO: 129483 - protein, 237 aa, Glycine max
  Coding DNA Sequence Number=SeqID_12705
  Homolog annotation: Hit_ID=Q9FFD1; Match level="QueryCoverage=94%, HitCoverage=38%, E-value=4e-90, Identity=69%"; Hit description =Genomic DNA, chromosome 5, P1 clone:MQK4
  Subcellular localization annotation: CTP_CleavageSite=12; ConfidenceScore=5.07e-01
MEFNITTVSSMSCANLRNLGNVVTGNPGFIDQRVVPLSTLANYSCYNSSTGPTVVFKCKNCKVIYDHMYISWQFVDLPNNPATAVGFEFKLTSMDIAKKHVSFVSGTLKNGSNFDNSPVTFRGKQSNILKFNLFPRIYHNLHELKLIQPLFHEFLPGSASRDTNELRASLESSTDGLVNTTLFINFLSDYVVEIDKENILGPVSFLADLGGLYCISIGIFFYLLIQNCMFQCNSATQ

SEQ ID NO: 129484 - protein, 109 aa, Glycine max
  Coding DNA Sequence Number=SeqID_12706
MKTKTPPSLLSLTVDSAVLNLSDISDLSHVPDHILLDLFLASYAAASSLAFLFLSFSRILKAGKLTEKVLRLFIATGKDEVLSFVQALNIQHILTPVLPTRCSEAKSDF

SEQ ID NO: 129485 - protein, 103 aa, Glycine max
  Coding DNA Sequence Number=SeqID_12707
MASNIISNRDSEELTLGTFDRMMKLEETLSQFMQVSMSNRKSTESTIKNLEVQAIMTRSKMVSMNKGEKRIGEGKQQLVIETEIDPMVEPLSEIEEDVKAEDD

SEQ ID NO: 129486 - protein, 223 aa, Glycine max
  Coding DNA Sequence Number=SeqID_12708
  Gene Ontology: Mol. function=binding; Cellular component=integral to membrane; Biological process=protein insertion into membrane
  Homolog annotation: Hit_ID=Q8L718; Match level="QueryCoverage=72%, HitCoverage=28%, E-value=8e-25, Identity=44%"; Hit description=Inner membrane ALBINO3-like protein 2, chloroplast precursor
  Pfam annotation: Domain name=TPR_1; Domain location=125-158; Score =2.3; E_value=2.8; Accession=PF00515.18; Description=Tetratricopeptide repeat
  Pfam annotation: Domain name=TPR_1; Domain location=91-124; Score =13.9; E_value=0.12; Accession=PF00515.18; Description=Tetratricopepti de repeat
  Pfam annotation: Domain name=TPR_2; Domain location=125-158; Score =11.8; E_value=1.4; Accession=PF07719.7; Description=Tetratricopeptide repeat
  Pfam annotation: Domain name=TPR_2; Domain location=91-124; Score =17.4; E_value=0.051; Accession=PF07719.7; Description=Tetratricopepti de repeat
  Pfam module annotation: Pfam domain module=TPR_1::TPR_1::TPR_2::TPR _2; Domain location=125-158::91-124::125-158::91-124
MGSQLYWVTNSSLTLIQQITLRHPAVLAKLGLLDNSPKGASEEIGASKTAPSPGLQDNIPTAAIKETVSPEKNPLDSPEKWHRIPIEEMSPKELITLAVLFLNSDDKESAIPLLKLALDKDPEYVRALVLMGRVLLLKHVNDEAHEYFERAISKLSLAEEVDLPRGLELPANGRGNTLFSEKTFVSQRESLDTLRVECMPKPDTLCCYLKDNCTSIPNYWQAI

SEQ ID NO: 129487 - protein, 155 aa, Glycine max
  Coding DNA Sequence Number=SeqID_12709
  Homolog annotation: Hit_ID=Q2HV86; Match level="QueryCoverage=99%, HitCoverage=100%, E-value=6e-41, Identity=50%"; Hit description=Late embryogenesis abundant protein
  Subcellular localization annotation: CTP_CleavageSite=29; ConfidenceScore=5.38e-01
MASFTLVTSLPKFGHAGARIARSRAWNPRVFAAATPRPIQVPREGPATAEGTTQGASETVINSLNEAQDKAYSTAEHVANKKNEMANKTNKMAGQMSASAQNMADKAKQTMQEAWESTKNTANRAADNVVGKTKESAEYVKDNAETVKQNMNSKN

SEQ ID NO: 129488 - protein, 108 aa, Glycine max
  Coding DNA Sequence Number=SeqID_12710
MTRGNLGDLQPFDPEIDRTFHRLVRHSVHLDYSEHFVPFEHPEHSVIGESEHSVVGDFEHPDFEHSNFEHCENMAQPPPRERTLREMVAPDFTYESLCIQYPDEDVPY

SEQ ID NO: 129489 - protein, 158 aa, Glycine max
  Coding DNA Sequence Number=SeqID_12711
MGKLGLPIMSRVPLPLPLPLPWWFAFFWVVHSSIALFKFEASQGSFVSHRRQDVLIAAIGQPEHPSRVRAAKADATIKQYFGSAPRTDSAANGILQLDAVPISVADAIIGTCTASGARGRLYEGSTMVHNIPLLHDQVKVGVEEVIDAEALIPVPTDK

SEQ ID NO: 129490 - protein, 119 aa, Glycine max
  Coding DNA Sequence Number=SeqID_12712
MAVSLFSPRSAALTVWLEAVLHPSASTAMLESLVAHISVQVLPTISSSSFLVLLARTKAYNIFIFRTLRIEKGIQCGIPPYETLRQGEFCSPSLRVRDSFPQVVCIDNEVKAGLTQDLM

SEQ ID NO: 129491 - protein, 75 aa, Glycine max
  Coding DNA Sequence Number=SeqID_12713
MYKCIFSVRDSFEAQVTQGSFVPRGRQDVLIAAIGCPEHRGRVRAAGAGVTIKQYFGSAPRTSHISSSLPPEELQ

SEQ ID NO: 129492 - protein, 568 aa, Glycine max
  Coding DNA Sequence Number=SeqID_12714
  Gene Ontology: Mol. function=monooxygenase activity; Cellular component=membrane; Biological process=electron transport
  Homolog annotation: Hit_ID=Q2HV82; Match level="QueryCoverage=99%, HitCoverage=81%, E-value=0.0, Identity=77%"; Hit description=E-class P450, group I
  Pfam annotation: Domain name=p450; Domain location=97-526; Score =214.1; E_value=3.2e-61; Accession=PF00067.12; Description=Cytochrome P450
MEGLAKVGAPNEVLEFLSGWVEGGGLQPKIPEAKGSIKAIRSVAFFIPLYELYLTYGGIFRLTFGPKSPCGYGDPMNLDVEVEIAVVDPFLKPCVIPMGFDTLTCLILCLWFSMALEKGETPLTPNFINEQKGTGILAEILDFVMGKGLIPADGEIWRVRRRAIVPALHQKYVAAMIGLFGQASDRLCQKLDAAASDGEDVEMESLFSRLTLDIIGKAVFNYDFDSLSNDTGIVEAVYTVLREAEDRSVAPIPVWEIPIWKDISPRLRKVNAALKFINDTLDDLIAICKKMVDEEELQFHEEYMNEKDPSILHFLLASGDDVSSKQLRDDLMTMLIAGHETSAAVLTWTFYLLSKEPRVVSKLQEEVDSVLGDRYPTIEDMKKLKYTTRVINESLRLYPQPPVLIRRSLEDDVLGEYPIKRGEDIFISVWNLHRSPKLWDDADKFKPERWALDGPSPNETNQNFKYLPFGGGPRKCVGDLFASYETVVALAMLMRRFNFQIAVGAPPVEMTTGATIHTTQGLKMTVTHRIKPPIVPSLQMSTMEVDPSISLSDQDEVSQKGEIYQAQS

SEQ ID NO: 129493 - protein, 197 aa, Glycine max
  Coding DNA Sequence Number=SeqID_12715
  Gene Ontology: Mol. function=transferase activity, transferring hexosyl groups; Cellular component=membrane; Biological process =carbohydrate metabolic process
  Homolog annotation: Hit_ID=Q2HV81; Match level="QueryCoverage=89%, HitCoverage=29%, E-value=4e-94, Identity=88%"; Hit description =Glycosyl transferase, family 28
MTTSLENYLWDYLQLLWHTHVAEYLNVPLHIFFTMPWTPTSEFPHPLSHVKQPIGYRLSYQIVDALIWLGMRDLINEFRKKKLKLKPITYLSGSYTHPFDVPHGYIWSPHLVPKPKDWGPKIDVVGFCFLDLASNYVPPKSLVDWLEEGEKPIYVGFGSLPLQEPEKITRIIIQALEETGQRGIINKGWGGLGSCES

SEQ ID NO: 129494 - protein, 68 aa, Glycine max
  Coding DNA Sequence Number=SeqID_12716
MSFSSMAYKARECGLKRWCILAMIMTYAQNSASPPVTFLRQFTATNLSSYECSKPYECSKHMQTSSHT

SEQ ID NO: 129495 - protein, 148 aa, Glycine max
  Coding DNA Sequence Number=SeqID_12717
  Gene Ontology: Mol. function=RNA-directed DNA polymerase activity; Cellular component=nucleus; Biological process=RNA-dependent DNA replication
  Homolog annotation: Hit_ID=Q1T3B0; Match level="QueryCoverage=86%, HitCoverage=46%, E-value=3e-31, Identity=49%"; Hit description=RNA -directed DNA polymerase
MDKIEPKVEDANLLRQLDVLLVRIWAVMHKVVENTQSAFVGRRQMLDSVLVANEVIHEAKSKRKPSQIFKVDFEKAYNAVNWKFSYYMMAKLGFCNRWVSWIKGCLESSSISVLVKGRATREFNVHRGIRQGNPIAPFLFLIVAKGLG

SEQ ID NO: 129496 - protein, 402 aa, Glycine max
  Coding DNA Sequence Number=SeqID_12718
  Gene Ontology: Mol. function=nucleoside-triphosphatase activity; Cellular component=intracellular; Biological process=transport
  Homolog annotation: Hit_ID=Q1GXE1; Match level="QueryCoverage=100%, HitCoverage=72%, E-value=1e-125, Identity=57%"; Hit description=Type II secretion system protein E
  Pfam annotation: Domain name=GSPII_E; Domain location=71-349; Score =338.2; E_value=1.4e-98; Accession=PF00437.11; Description=Type IIIV secretion system protein
MRIALSGSTHLLVLDELRHMLGGSMQLEVVLATEAHLEQALDKFYGHSLSLDSILQDIEQEHTTGLPSLQQESRPVIRLVNALLIDAVKQGASDIHFEPEQAFLRIRYRIDGVLWQIRCLHGRYWPAICVRLKILAGMDIAEQRLPQDGRVDLFLCGRQIDFRVSSHPTLYGENIVLRVLDRDKAIIALDAMGLAAPKLSQVKAMLAKPEGLLILTGPTGSGKTTTLYSMLSHLNHEHVNIMTLEDPVEYPHPLMRQTSINAANKVDFSNGIRAILRQDPDIILIGEVRDESTAAMAMRAAMTGHLVMTTLHTNSAAAAFARLQDLGVSPHMMAGCLVGVIAQRLLRRLCFYCKRNLEVDHELTQWLGQVTGVEQSALQLFEAEGCVHCRMSGYRGRLVIME

SEQ ID NO: 129497 - protein, 92 aa, Glycine max
  Coding DNA Sequence Number=SeqID_12719
LQRVVTGGEVDVVEMGDHMRHVARALVIGEIATTLEDAIDSIRGGKDGEVIVVGEGDEVDKGGEERVIGVFFSKTQYELGLKGDLQESDRNS

SEQ ID NO: 129498 - protein, 123 aa, Glycine max
  Coding DNA Sequence Number=SeqID_12720
RPTQGDAPQAADVPPPHQAGPAGSFDSEQYLRHLVRQQAANHRAHVQIHDCIYQLSLNLQSQGFTSFPCPTPDQFRAEVVWPRDWPEAQAGEAPTEAPGEADEARKDEEMTDLLDLLGGSGAT

SEQ ID NO: 129499 - protein, 91 aa, Glycine max
  Coding DNA Sequence Number=SeqID_12721
  Gene Ontology: Mol. function=RNA-directed DNA polymerase activity; Biological process=RNA-dependent DNA replication
MAVLDESMGCMLGQHDDSEKNERGVYYLSKKFTVCEMNYSLLERTCCALVWAAHHLRQYMLSHTTWLLSKMDPIKYIFEKPALTGWIARWQ

SEQ ID NO: 129500 - protein, 103 aa, Glycine max
  Coding DNA Sequence Number=SeqID_12722
MRGLPGAGGISTGGLIRHCLILAVATYPSAGGRSVTRGMCLPRKEYARSHHQRLFEENVGKTGKYAIYELLSEKVRELYLRTGKGVSLCSYVFLNWDEEIRPT

SEQ ID NO: 129501 - protein, 103 aa, Glycine max
  Coding DNA Sequence Number=SeqID_12723
  Subcellular localization annotation: CTP_CleavageSite=31; ConfidenceScore=5.06e-01
MPISPYGSISWDRAHKTPSGPKEVQQGPGVSSSSYGPLSVPQGIAPARHPVDPEKSNRLLRFLALITGLCQFYGVPIAPNKVIRPPINRAFVKKYYASQAGAG

SEQ ID NO: 129502 - protein, 251 aa, Glycine max
  Coding DNA Sequence Number=SeqID_12724
MRSWVRGQWIPFDADALSQFLGYPLVLEEGQECEYGQRRNRADGFDEEAIAQLLCILGQDFARTAAGRRVQIMRTNMTTLTQIWMTLLLSNIQPSDHNSDLPLPKCMAPTRHPLDPDKSNRALGFPVLITGLCQSFKAADAPPPHQAGPAGSFDTEQYLRHLVHQQAANHRVHVQTHDCLYQLSLSLQSQGFASFSCPTPDQFRAEVAWPGDWPEARAGEAPAEAPDEADEAREDEEMTDLLDFLGGSGAT

SEQ ID NO: 129503 - protein, 83 aa, Glycine max
  Coding DNA Sequence Number=SeqID_12725
MQRIAGNQAKIEALGLSKLATIFKDRIQKVKKKDKKKANDDDEDYVPEYEWGLGSNSSSENYENYKRDEFAATNYLESRKRKA

SEQ ID NO: 129504 - protein, 146 aa, Glycine max
  Coding DNA Sequence Number=SeqID_12726
  Gene Ontology: Mol. function=nucleotidyltransferase activity
MYEHLIINWIKGHYVIWEYHGEVISEPDEFDDDDDDQNNCNDEVHDMLHDLGSAMNIENIIGAEEINYTTSTNTNSVNEEEDKFSKLLFIAEQELYPGCENFSKLSFIVQLLNIKCLFGLSGKAIDALLSLLAKTFPHENKVHVSY

SEQ ID NO: 129505 - protein, 68 aa, Glycine max
  Coding DNA Sequence Number=SeqID_12727
VSSSEEDPEEDPEELPPEPAVDALDLPEDDEDPLLDVDFPEDIMSASEADSTEESGPGGTANSEDSSS

SEQ ID NO: 129506 - protein, 324 aa, Glycine max
  Coding DNA Sequence Number=SeqID_12728
  Gene Ontology: Mol. function=nucleoside-triphosphatase activity; Cellular component=membrane; Biological process=oligopeptide transport
  Homolog annotation: Hit_ID=Q8UB02; Match level="QueryCoverage=81%, HitCoverage=99%, E-value=1e-118, Identity=83%"; Hit description=ABC transporter, nucleotide binding/ATPase protein
  Pfam annotation: Domain name=ABC_tran; Domain location=92-283; Score =193.5; E_value=4.9e-55; Accession=PF00005.17; Description=ABC transporter
  Pfam annotation: Domain name=oligo_HPY; Domain location=286-323; Score=-8.2; E_value=0.0079; Accession=PF08352.2; Description =Oligopeptidedipeptide transporter, C-
  Pfam module annotation: Pfam domain module=ABC_tran::oligo_HPY; Domain location=92-283::286-323
MALAAIIVAAAILTEAALSFLGLGDPNIVTWGSMIAEGRNVLRSAAHQQSAGDREASAMSGNALCRIDDLSVWYAASDAPALQNVSLTIRQGQRLAIIGESGSGKSTLGKAIAGLLPGHAKVSGDISWSRDSLFYGRPLPGRDIGTIFQDTGATLNPVLTIGEQVAEGAVRHLGLSWRQARDLARDLLERVRLPHPSHLIRAYPHQLSGGQRQRVTIAAAIAASPSILIADEATSALDTVSQAAIATLLDDLVRRENKTLVFITHDIGLASSLADEIAVLRAGLLVEHGPTRRVLSAPVHDYTRALLADYLDLSTPPLVSEAAS

SEQ ID NO: 129507 - protein, 82 aa, Glycine max
  Coding DNA Sequence Number=SeqID_12729
MTETVCTDNRLGISVRHLTSRVRMTESAEDDVNLHVSTGSLAQIDKGSSESQVTIEKGGVVDKKRGFCSYVSSICDKELRPT

SEQ ID NO: 129508 - protein, 114 aa, Glycine max
  Coding DNA Sequence Number=SeqID_12730
MSASQFGGECAYCNSLAVEESEYAFMDVVESDSLEIGSTNVDSDSSDMELDMGDEMTTLSMMKNKQEKQQKMQQTRNVIHIELCSKGEREKNKKEHAQDYVVHLEKGYTHGREK

SEQ ID NO: 129509 - protein, 212 aa, Glycine max
  Coding DNA Sequence Number=SeqID_12731
  Gene Ontology: Mol. function=amidase activity; Cellular component =cell surface; Biological process=translation
  Homolog annotation: Hit_ID=Q6D1E9; Match level="QueryCoverage=66%, HitCoverage=28%, E-value=1e-45, Identity=66%"; Hit description =Probable amidase
MTTPQPDWHAYLAQMETVLGVTLDDARRAELQVQFSRIASMAAPLMALPLDDRLEIAGALSAGELSAHEIAGQTLEAIARVNPQINAWTAVTEARMLAEAANIDTLRREKRPLPPLAGVPYAVKNLFDVAGHTTLAGAELFSQRPPAATDSFAVRQLRSAGGLLTGMVNMDAYAYGFTTENSHYGATHNPHDLTRISGGSSGGSAAAVAAGL

SEQ ID NO: 129510 - protein, 162 aa, Glycine max
  Coding DNA Sequence Number=SeqID_12732
GAKDDVSLCVLSGFLSYRQQKVYTDNHSGISARQRDSKVSMTDLVSAEDDQKVYTDNHSGISARQRDSKVSMTDLVSAEDDVAEDDVSLCVLSGFSSYRQQKVYTDNHSGISACQRDSKVNMTDLVSAEDDQKVYTNNHSGISARQRDSKVSMTDLVSAEDD

SEQ ID NO: 129511 - protein, 417 aa, Glycine max
  Coding DNA Sequence Number=SeqID_12733
  Gene Ontology: Mol. function=nucleic acid binding; Cellular component= nucleus
  Homolog annotation: Hit_ID=Q287W3; Match level="QueryCoverage=86%, HitCoverage=41%, E-value=1e-106, Identity=45%"; Hit description=SNF2 domain-containing protein
  Pfam annotation: Domain name=SNF2_N; Domain location=44-335; Score= -62.6; E_value=9.1e-05; Accession=PF00176.13; Description=SNF2 family N-terminal domain
MALASSYLEETEEKVNKVDDLHLFLTHAPTDEHNSMEHDNVWKVFRAKTYGCGIQCVISHAPGAGKTFLIIAFLVSYLKQFPGKKPLILAPKNTLYTWCREFSKWEIFMPVYPIHGRGGTQRDTEQNSIALPGFPNPNKEVKHVLNCLEKIKLWQEKPSVLVMSYTAFLALMREGSEFAHRKYMVKALREGPGILILDEGHNPRSTKSRLRKGLMKVETDLRILLSDNIAKKIDSGIENERVQGLNMLRGTTNGFVDAYESANFDSTPGLLMNTTDKQHEILLKLHTRMDECIGYSLELELLLLEEYKYDMKAGSKVKFVLSLVFRVMPREKILLINGELDIFERGKVIDKFEEHGGASKAIARAFRPGQEKMVYVYQLLATGTLEEDKYIRTTWKEWVTSMIFSEAFEENPSHSRA

SEQ ID NO: 129512 - protein, 167 aa, Glycine max
  Coding DNA Sequence Number=SeqID_12734
  Gene Ontology: Mol. function=solute:hydrogen antiporter activity; Cellular component=integral to membrane; Biological process =regulation of pH
  Homolog annotation: Hit_ID=Q1S134; Match level="QueryCoverage=99%, HitCoverage=24%, E-value=5e-48, Identity=50%"; Hit description =Probable Na/H antiporter [imported]-Arabidopsis thaliana, putative
MVSCVHTDEDVHNMIALIEACNPTTQSPLYVYVVHLIELVAKSTPILLPMNKNNRKSLSVDYPNTNHILRAFENYSNNSSGPLTVHSYVNVAPYRSMHGNHVANTIRNLNTKGTSGILVDRYSVLSWSSSKLSFDVGIFFIGGKDDREALALGIQMLERPNTRVTLF

SEQ ID NO: 129513 - protein, 101 aa, Glycine max
  Coding DNA Sequence Number=SeqID_12735
  Gene Ontology: Mol. function=solute:hydrogen antiporter activity; Cellular component=integral to membrane; Biological process =regulation of pH
  Homolog annotation: Hit_ID=Q1S134; Match level="QueryCoverage=98%, HitCoverage=12%, E-value=2e-21, Identity=50%"; Hit description =Probable Na/H antiporter [imported]-Arabidopsis thaliana, putative
  Subcellular localization annotation: CTP_CleavageSite=25; ConfidenceScore=5.29e-01
MYDSLIGFPGGVLSTTIFTSGRIIRSNNTANPVAPVKNTIVNCKLNFVLNWSSIVIHCNISLIMAEDRAIWPNSVATRLRSIKVSDKTAKLLKVKMLGKWY

SEQ ID NO: 129514 - protein, 52 aa, Glycine max
  Coding DNA Sequence Number=SeqID_12736
MFLLTSALKRFNDIQGSKSKATTKWIAIKVNFESLIEFSIINKEEALSATIM

SEQ ID NO: 129515 - protein, 806 aa, Glycine max
  Coding DNA Sequence Number=SeqID_12737
  Gene Ontology: Mol. function=protein-tyrosine kinase activity; Cellular component=integral to membrane; Biological process=protein amino acid phosphorylation
  Homolog annotation: Hit_ID=Q8L3Y5; Match level="QueryCoverage=99%, HitCoverage=94%, E-value=0.0, Identity=79%"; Hit description =Receptor-like kinase RHG1
  Pfam annotation: Domain name=LRRNT_2; Domain location=24-66; Score =33.8; E_value=5.8e-07; Accession=PF08263.3; Description=Leucine rich repeat N-terminal domain
  Pfam annotation: Domain name=LRR_1; Domain location=117-139; Score =11.9; E_value=1.7; Accession=PF00560.23; Description=Leucine Rich Repeat
  Pfam annotation: Domain name=LRR_1; Domain location=141-163; Score =13.7; E_value=0.69; Accession=PF00560.23; Description=Leucine Rich Repeat
  Pfam annotation: Domain name=LRR_1; Domain location=165-187; Score =13.3; E_value=0.91; Accession=PF00560.23; Description=Leucine Rich Repeat
  Pfam annotation: Domain name=LRR_1; Domain location=189-211; Score =14.6; E_value=0.35; Accession=PF00560.23; Description=Leucine Rich Repeat
  Pfam annotation: Domain name=LRR_1; Domain location=218-240; Score =14.0; E_value=0.53; Accession=PF00560.23; Description=Leucine Rich Repeat
  Pfam annotation: Domain name=LRR_1; Domain location=242-264; Score =14.2; E_value=0.47; Accession=PF00560.23; Description=Leucine Rich Repeat
  Pfam annotation: Domain name=LRR_1; Domain location=266-288; Score =16.4; E_value=0.1; Accession=PF00560.23; Description=Leucine Rich Repeat
  Pfam annotation: Domain name=LRR_1; Domain location=290-312; Score =9.3; E_value=5.2; Accession=PF00560.23; Description=Leucine Rich Repeat
  Pfam annotation: Domain name=LRR_1; Domain location=314-336; Score =14.8; E_value=0.31; Accession=PF00560.23; Description=Leucine Rich Repeat
  Pfam annotation: Domain name=LRR_1; Domain location=338-360; Score =12.5; E_value=1.3; Accession=PF00560.23; Description=Leucine Rich Repeat
  Pfam annotation: Domain name=LRR_1; Domain location=362-385; Score =9.0; E_value=5.9; Accession=PF00560.23; Description=Leucine Rich Repeat
  Pfam annotation: Domain name=LRR_1; Domain location=93-115; Score =12.7; E_value=1.2; Accession=PF00560.23; Description=Leucine Rich Repeat
  Pfam annotation: Domain name=Pkinase; Domain location=520-788; Score =95.1; E_value=2.1e-25; Accession=PF00069.15; Description=Protein kinase domain
  Pfam annotation: Domain name=Pkinase_Tyr; Domain location=519-788; Score=56.8; E_value=5.9e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR _1::Pkinase::Pkinase_Tyr; Domain location=24-66::117-139::141 -163::165-187::189-211::...
  Pfam module annotation: Domain location=218-240::242-264::266 -288::290-312::314-336::338-360::362-385::93-115::520-788::519-788
LVVLPSCVRPALCEDESWDGVVVTASNLLALQAFKQELVDPEGFLRSWNDSGYGACSGGWVGIKCAQGQVIVIQLPWKGLKGRITDKIGQLQGLRKLSLHDNQIGGSIPSTLGLLPNLRGVQLFNNRLTGSIPSSLGFCPLLQSLDLSNNLLTGAIPYSLANSTKLYWLNLSFNSFSGTLPTSLTHSFSLTFLSLQNNNLSGNLPNSWGGSPKSGFFRLQNLILDHNFFTGNVPASLGSLRELSEISLSHNKFSGAIPNEIGTLSRLKTLDISNNAFNGSLPVTLSNLSSLTLLNAENNLLENQIPESLGTLRNLSVLILSRNQFSGHIPSSIANISMLRQLDLSLNNLSGEIPVSFESQRSLDFFNVSYNSLSGSVPPLLAKKFNSSSFVGNIQLCGYSPSTPCLSQAPSQGVIAPTPEVLSEQHHRRNLSTKDIILIVAGVLLVVLIILCCILLFCLIRKRSTSKAENGQATGRAAAGRTEKGVPPVSAGDVEAGGEAGGKLVHFDGPLAFTADDLLCATAEIMGKSTYGTVYKAILEDGSQVAVKRLREKITKGHREFESEVSVLGKVRHPNVLALRAYYLGPKGEKLLVFDYMPKGGLASFLHGGGTETFIDWPTRMKIAQDMARGLFCLHSLENIIHGNLTSSNVLLDENTNAKIADFGLSRLMSTAANSNVIATAGALGYRAPELSKLKKANTKTDIYSLGVILLELLTRKSPGVSMNGLDLPQWVASIVKEEWTNEVFDADMMRDASTVGDELLNTLKLALHCVDPSPSVRPEVHQVLQQLEEIRPERSVTASPGDDTI

SEQ ID NO: 129516 - protein, 56 aa, Glycine max
  Coding DNA Sequence Number=SeqID_12738
MSELRDIPFAFLTVGICEKYSQREKTESHKAVQNGGLNPFFSLTFGNPIRVIRGRT

SEQ ID NO: 129517 - protein, 113 aa, Glycine max
  Coding DNA Sequence Number=SeqID_12739
MNQRFDFGNLPVEDRRTKKNDEEYSRNRSSEMSRKRYGSASAWIFVTETIFLTNFKRILNTRRVERNYSALFPIFIGKMREMVAAQLAQASWVASTRKAPPFVGISWKAQVGL

SEQ ID NO: 129518 - protein, 131 aa, Glycine max
  Coding DNA Sequence Number=SeqID_12740
MQFIETTKSTQQALQSVEIQVGELAKAVTQFMSRQEKSFVEAEAQEKSPVKEHESREKDEEKDEEQAQQQWEKYSIVENQQENILQSNNLTHQLIDMKGRQEEHEETLSAILSLITNTFLEMIWNVLPDYM

SEQ ID NO: 129519 - protein, 143 aa, Glycine max
  Coding DNA Sequence Number=SeqID_12741
  Homolog annotation: Hit_ID=Q10DP5; Match level="QueryCoverage=28%, HitCoverage=19%, E-value=3e-11, Identity=82%"; Hit description=Maf -like protein, expressed
MGEIKEECTSLDKSEQEKQLHSKVSKVALYSSGESKAIASACETASSLGSNVIDEGGYRIVYHGLFPDGTKIAGDLDLICPKVFGAPGGSHYAHYHLVGRRTARREILAEMGYEFTVMTADIDEKGIRREKPEDLVMALVEAK

SEQ ID NO: 129520 - protein, 497 aa, Glycine max
  Coding DNA Sequence Number=SeqID_12742
  Subcellular localization annotation: CTP_CleavageSite=82; ConfidenceScore=5.33e-01
MAYNFPDVFCWIQSLPPISEWETSSMSLNICSSSSSSCQPRLNLTVSKNNSNNHSSSNLYFVIIADCNIPIHLWTSKPFKPSSTTITNKTHNNNKLIDDEETISNLFVNFIQAILLYGSNKNSTPFLRFPNLDSITSNNFSDVFNLSFFTLLFLVCIYEAPAADFRSGCISNLKDHLTGSNLEEHWMRSLNLAVTNWVGELEAHNNPFRTPCPLFSYAFSTIGLWKVQLYCPLLVMDVENSKSNPASERLQFSLRYHHVEGVLQFNHKVLIKEEWAEIMVDIDNIRCDVIKLVNESLMSQRGVGAAEKHFPSRISLQLTPTLQDQVLSLSVGKSSENPRKEIGVDKSVEASFEPSNPLALKVSAGESSTVSLKPWKFEESVYGYSANLNWFLHDSVDGKEVFSSKPSKFAMLNPKSWFKNRYSSAYRPFNKEGGVIFAGDEYGEKVWWKVDKGAIGKTMEWEIRGWIWLTYWPNKRVTFYNETRRLEFREIVHLDVA

SEQ ID NO: 129521 - protein, 331 aa, Glycine max
  Coding DNA Sequence Number=SeqID_12743
  Homolog annotation: Hit_ID=Q1S125; Match level="QueryCoverage=65%, HitCoverage=72%, E-value=1e-64, Identity=59%"; Hit description =Single hybrid motif
MSHVRASLEKQAVVPIHNAGWNSKSRLFIQHLAYGQKHINSHTKGKNTLISCGKTAEAINASKSDASSDNTPQGSLEKKPLQTATFPNGFEALVLEVCDETEIAELKVKVGDFEMHIKRNIGATKVPLSNISPTTPPPIPSKPMDESAPGSLPPSPPKSSPEKNNPFANVSKEKSPRLAALEASGTNTYVLVSSPTVGLFRRGRTVKGKKQPPICKEFRAQLCTVSCPIPGQQVEIGLSQNKFPKPWKEKRINPDEQRVGLEGIARGYGGGGVRILLGSSWGDVIKEGQVIGYLDQFGTGLPIKSDVAGEVLKLLVEDGGIIMSITCYKNA

SEQ ID NO: 129522 - protein, 167 aa, Glycine max
  Coding DNA Sequence Number=SeqID_12744
  Subcellular localization annotation: CTP_CleavageSite=37; ConfidenceScore=5.24e-01
MASSLVNRFIWVANASTCSSSLFPPCHVNFIGLWQMSLMGAGCRDRVHVVVFLNLLVLFSKGDVLPSEVLHLLGILLLHAIHLPLQGNDQGMILMAGMPNKLATYPSGGLWLPVEVLSLFVTINDDDVVEGKFFLGLTVDAKCSYHIQQDLLTMVLFHKPLHELRWE

SEQ ID NO: 129523 - protein, 732 aa, Glycine max
  Coding DNA Sequence Number=SeqID_12745
  Gene Ontology: Mol. function=solute:hydrogen antiporter activity; Cellular component=integral to membrane; Biological process =regulation of pH
  Homolog annotation: Hit_ID=Q9SIT5; Match level="QueryCoverage=88%, HitCoverage=78%, E-value=1e-110, Identity=33%"; Hit description =Putative Na/H antiporter
  Pfam annotation: Domain name=Na_H_Exchanger; Domain location=43-430; Score=112.5; E_value=1.2e-30; Accession=PF00999.11; Description =Sodiumhydrogen exchanger family
MAAASEIGNKSMVCQDPHSFGHLDIWKGGNPLESPSCLLYMQVSLMTMVTQFMDACLKSLGQSSIVSQIMGGVLFGPSMLGNKKILGLALFPTKGAVVLDTVSLFGLMFFFFIWCVKMDIATLMKTEKVAITLGISVFAFTLIIPTGLAFLMMKYIAMDGSLAKALPFLAMSQTLTVFISIAVLLTDLKVLNTDIGRLTMSAAMFADVAGFILTVILFAILQDQSGSFVRLACILLSIVGVWLLVIFVMRPTIIWMVKHPGRGSVNEICLVCIFLLVLLSAFVSELIGQHFIMGPILLGLAVPEGPPIGTALMSKLETICTAFLYPIFLAVNGLQTDFFKIDKQSLWIVCVILIVAFFVKIGAVMLPGYYYNLPLKQCFVIGLFLNGRGIAELATYNMWKRGKLISEQEFALMVASIIVVNCILVPLIRYIYDPSELYQTGKRCTIQHTRRDLELRVMVCIHNNENLPMILNLLEASYASRESRIEVTALVLVELQGRARPILFANQEQPHDEMRSMSCNASHIDNALRQYAQQNEGYVSVQSFTSISTFETMYDDICKISLDTGSNILILPFHKRWEIDATVEISHRTIQTMNIEVLERAPCSVGILVDRGILSPSPSLLMARAAFYVAVFFIGGQDDAETLAYASRMVRHECVYVTVGHDQWSECQELGVIGDMLASPDFVTKASLLVVQQQKIRGTLVKHNVNANPVPNHRDQLVYDIPNDTVDKYDRV

SEQ ID NO: 129524 - protein, 68 aa, Glycine max
  Coding DNA Sequence Number=SeqID_12746
  Homolog annotation: Hit_ID=Q1S120; Match level="QueryCoverage=46%, HitCoverage=20%, E-value=3e-07, Identity=75%"; Hit description=Sel1 -like repeat
MTAVNLNYVIGMLLAASQLQVTVYTVTNFVYRGMFGLVKHQEIEIQFGKCAVNGQDTEQAILIHELEN

SEQ ID NO: 129525 - protein, 210 aa, Glycine max
  Coding DNA Sequence Number=SeqID_12747
  Gene Ontology: Mol. function=nucleic acid binding
  Homolog annotation: Hit_ID=Q9LRR6; Match level="QueryCoverage=94%, HitCoverage=48%, E-value=6e-70, Identity=67%"; Hit description =Similarity to RNA-binding protein
  Pfam annotation: Domain name=RRM_1; Domain location=84-146; Score =2.0; E_value=0.093; Accession=PF00076.12; Description=RNA recognition motif. (a.k.a. RRM, R
MIFIVSFELKVIDCRICGDPHSVLRFAFVEFADEYGARTALNLGGTVLGYYPVRVLPSKTAILPVNPTFLPRSDDEREMCARTVYCTNIDKKVSQAEVKNFFESACGEVMRLRLLGDHVHSTRIAFVEFAMVTNFTKWDKVFVVLCTMAFTMLTCTRGTIILADFVFLLEQAESAIIALNCSGMLLGTQPIRVSPSKTPVRPRVTRPASH

SEQ ID NO: 129526 - protein, 62 aa, Glycine max
  Coding DNA Sequence Number=SeqID_12748
MDVALREKLNKIMSSEYFTTTPEMKALVEVVAAAIGGNYVSFHVLVRGSVVPVEVEQPVFQS

SEQ ID NO: 129527 - protein, 184 aa, Glycine max
  Coding DNA Sequence Number=SeqID_12749
  Gene Ontology: Mol. function=protoporphyrinogen oxidase activity; Cellular component=chloroplast; Biological process=porphyrin biosynthetic process
  Homolog annotation: Hit_ID=Q9LRI8; Match level="QueryCoverage=72%, HitCoverage=25%, E-value=6e-24, Identity=48%"; Hit description =Protoporphyrinogen oxidase
MTSPGPRSIIESASVTPIHPIAGGTPNELQLGRINHRYSTNFVRTWKIDMLKILSTGVYAGDPSKLSMKVAFGKVWRLEKKWWYHNWWNCQSNRREKWRRPPKPKGQTVGSFWKGLTMLPGAIFARLGNKVKLSWKLSSISKLDSGEYNLTYETPEGVVSLQCKIVVLTILSYVASTLLCSLSV

SEQ ID NO: 129528 - protein, 297 aa, Glycine max
  Coding DNA Sequence Number=SeqID_12750
  Homolog annotation: Hit_ID=Q2HRX8; Match level="QueryCoverage=39%, HitCoverage=17%, E-value=8e-11, Identity=36%"; Hit description=IMP dehydrogenase/GMP reductase
MNLHGAVLLGQFDSELAVVGGATTVDSENLDDVRVVEGQNVREVGRKWLKNNTMAQRMGVRAEACQPRCPGASAPYSSATQQPGCLPLVRMGSSYTGMPLQPSLLCKPSWVFTHLPSVGYLEPEDYVVEDPIATRWKALKGIRCALPVRKKLDDLQIDVVLWCPYEDHKDMRPLAQQTFFFGFTRCWTYVRPYCLERVLRQFGHVCTSNYLPWFYKASYPCVILPKEGQSLPSLVCLPPIKVQLKHRQPLANYVPRSILDDIRSYAKHVEPLSCAREHESSSSHTTSFATVGGGLSN

SEQ ID NO: 129529 - protein, 359 aa, Glycine max
  Coding DNA Sequence Number=SeqID_12751
EAPAGAPDDAEEARMDEEMTDLLDFLGGSGATSPSYFVTVFATYHFVCFLFTLWLDTNYVYTPPIDVDKEVLGAHVSTKGSNAEIFVHTSGEEHDGNVISTMGLYVHGDNCTCLVALGNIHDGGSIIHNVAYVDDVVRALDAFIAWTTNLVKLVSHEDSHVTPKKVDEHVQRKNDVGAEDPLCQLIRTLYDIYNKPVELLWDGSKYGIPNADASFFLTFSYVNEIVTDRFMDEWSLTLGHGLVYGIPTAHWQLLVLCPTKDVVVWFCSLHKKPDNHIKAVANNSAMKTLKSSLDGHIDKVATQWIEIKSHVQTGRYECGYYVMHWMWNIVSEGLKNDLSMWFGVCTPLDMETMTTIRKK

SEQ ID NO: 129530 - protein, 256 aa, Glycine max
  Coding DNA Sequence Number=SeqID_12752
  Gene Ontology: Mol. function=nucleotide binding; Cellular component =endoplasmic reticulum; Biological process=response to unfolded protein
  Homolog annotation: Hit_ID=Q1SEZ8; Match level="QueryCoverage=46%, HitCoverage=19%, E-value=4e-36, Identity=69%"; Hit description=Heat shock protein Hsp70
MAGLDLGTASHFVQSLHRPDFNQQQQQESEEDTKPQDGPQQSDVVGRRPQAPRTSPSRRSSLCGRAPTPSAPTSSKSTAAAMSSKVSPAWVLYPQQQQNDTLPDGIVPSSAGSVGGNESQHIPHRRIGAAEEVSSMVLTKMREIVEDYLEAPVKNVVTMPAYFNDSQRKATKDVGVIVALNVMGIINEPTTAAIAYGLHKCTICVREGNIFIFDLRGGTFNLTCLSSQFSIKVKEFQVKTTPGKTHLGERTLTTEW

SEQ ID NO: 129531 - protein, 281 aa, Glycine max
  Coding DNA Sequence Number=SeqID_12753
  Homolog annotation: Hit_ID=Q2PEP9; Match level="QueryCoverage=24%, HitCoverage=17%, E-value=3e-12, Identity=62%"; Hit description =Putative RuvB DNA helicase-like protein
  Pfam annotation: Domain name=VQ; Domain location=206-236; Score=45.9; E_value=1.3e-10; Accession=PF05678.4; Description=VQ motif
MTFTYLVIWLTNNPELWGFEAEGLGHAHGDGSLAGVRLACKEDCEVDDLVIFYHLEDHTGGLRSDNFPDHAVQDDTQDDAWDQANISSHYPTIQIEAITVKNKVFVDPNNMTKFLVPTMKNIHDSLVKTTSAKTLESPHPSHFCFSLQFLSPAPMTTPTTIVSGSNMNGVLAEPLLGDKDNVGDAHDNHEVDLEGGGRGKAPVKVVIINTQYVETDATSFKSVVQKLTGKDSDILDAKVQRKRHDHKGGVEGRSFLMRDMSFKEFDRLLSEMPPLNDLWAD

SEQ ID NO: 129532 - protein, 206 aa, Glycine max
  Coding DNA Sequence Number=SeqID_12754
  Gene Ontology: Mol. function=molecular_function; Cellular component =cellular_component; Biological process=cell cycle
  Homolog annotation: Hit_ID=Q93YY3; Match level="QueryCoverage=64%, HitCoverage=16%, E-value=5e-42, Identity=69%"; Hit description =Putative cullin protein
  Pfam annotation: Domain name=Cullin; Domain location=3-183; Score= -65.8; E_value=0.00032; Accession=PF00888.12; Description=Cullin family
MGVNLHQQIEKECEAHISAALQSLVGQSPDLVVFRSLVERCWQDLCDQMLMIRGIALYLDRTYVKQTANVRSLWDMGLQLFRKHLSLSPEVEHKTVTGLLRMIESESAFLCEKLESVDREMSNPLSAEIESKSFSPSRSMASSVTLGLVARVLRRRVVDLELFGESGGERLSELIELINEGEEGGCDEAAEATTNARMRESGMYPA

SEQ ID NO: 129533 - protein, 57 aa, Glycine max
  Coding DNA Sequence Number=SeqID_12755
MSISHIISAVYTSLTCKTSFHSAYKWNGRLPIYTTYWCCYFWCLRRSGPGDEKPSSV

SEQ ID NO: 129534 - protein, 74 aa, Glycine max
  Coding DNA Sequence Number=SeqID_12756
  Subcellular localization annotation: CTP_CleavageSite=25; ConfidenceScore=5.03e-01
MPMKKKGGMSKKEGSFFTLTSCLARVFALSVPLGFLVSIFHAKPELRTERECALSLDLPAKRECAPSLNCALSE

SEQ ID NO: 129535 - protein, 159 aa, Glycine max
  Coding DNA Sequence Number=SeqID_12757
  Homolog annotation: Hit_ID=Q1S119; Match level="QueryCoverage=65%, HitCoverage=97%, E-value=5e-35, Identity=70%"; Hit description=Wound- induced WI12
NQTGYGFPDPTGDAAFPDTGQTAGAGASRNNLAGIVDAGDGEGGVEVLSDLSNYPIRDGAGVDPGNVAGGVAALDDDGGAEGGDGLRKEAEGVVGSGVAGEHAHQKLGVIQCEHQPLVAGISVRTTCLRVSQFEKRDSALRLEMGRKRGLYRKSAWGSL

SEQ ID NO: 129536 - protein, 565 aa, Glycine max
  Coding DNA Sequence Number=SeqID_12758
  Gene Ontology: Mol. function=nucleotidyltransferase activity
  Homolog annotation: Hit_ID=Q1S118; Match level="QueryCoverage=99%, HitCoverage=97%, E-value=0.0, Identity=68%"; Hit description =Uncharacterized Cys-rich domain
  Pfam annotation: Domain name=PLAC8; Domain location=330-462; Score =148.6; E_value=1.7e-41; Accession=PF04749.7; Description=PLAC8 family
MVSVDNGIGNSKDEIEESNGNKVNEFTSIDISTTHKTFVNSEDPQRRLQGTLGSSVPNRINFLKFDSASAKFRRLATERDQVSLSVPSPRPKSLRSRFSGMFAQKLDWGSVKKMFIEWIRSPMNMALFVWIVCVAVSGAILFLVMTGMLNGLLPRKSQRNTWFEINNQILNALFTLMCLYQHPKRFYHLVLLIRWRPTDISRLRKVYCKNGTYKPHEWTHMMVVVILLHVNCFAQYALCGLNLGYKRSERPAIGVGICISFAIAAPAIAGLYTILSPLGKDYDCEMDEEAQVQVTASQGQEQLREKPFEKNYSFASKDDRQRFVENRPKWSGGILDIWNDISLAYLSLFCTFCVFGWNMERLGFGNMYVHIATFMLFCMAPFWIFFLASVNIDDDNVRQALAAVGIILCFLGLLYGGFWRIQMRKRFNLPAYDFCFGKHSVSDCILWLCCCWCTLAQEARTGNNYDLVEDKFSRKETDTRDEKPSISPLAREDVVSTKSGTSSPLGSTSNSSPYVMKTSSPPNSSNVLKGYYTSDRMLSNLNQENCERGKDGTMNPPAPSLIQRE

SEQ ID NO: 129537 - protein, 181 aa, Glycine max
  Coding DNA Sequence Number=SeqID_12759
MEHPDVYVDGLRIHEEADMEFNIPEPTENEHKTYHFLLSFIRVRVVRKPLKESKRIKRAGGQATEVHFKFEGLGPFCYLCGLMDHVDNRRCIRNWGLELKAELRKPIGRGGSRWLRDGADKKEWSAPGGPSVTNAVINCNQSSGAINDTNGDEIRSLFIYGGIFKNSSTSRNNQSQPTNAR

SEQ ID NO: 129538 - protein, 437 aa, Glycine max
  Coding DNA Sequence Number=SeqID_12760
  Gene Ontology: Mol. function=L-aspartate transporter activity; Cellular component=membrane of vacuole with cell cycle-correlated morphology; Biological process=amino acid transport
  Homolog annotation: Hit_ID=Q1RXL8; Match level="QueryCoverage=93%, HitCoverage=93%, E-value=1e-174, Identity=76%"; Hit description =Amino acid/polyamine transporter II
  Pfam annotation: Domain name=Aa_trans; Domain location=20-437; Score =107.8; E_value=3.2e-29; Accession=PF01490.8; Description =Transmembrane amino acid transporter protein
  Pfam annotation: Domain name=Trp_Tyr_perm; Domain location=22-435; Score=-271.0; E_value=0.029; Accession=PF03222.4; Description =Tryptophantyrosine permease family
  Pfam module annotation: Pfam domain module=Aa_trans::Trp_Tyr_perm; Domain location=20-437::22-435
  Subcellular localization annotation: CTP_CleavageSite=65; ConfidenceScore=5.41e-01
MSPVAGVSAPLLGESKAATPPASVPGAVFNVATSIVGAGIMSIPAIMKVLGVVPAFAMILVVAVLAELSVDFLMRFTHSGETMTYAGVMREAFGSAGALAAQVCVIITNVGGLILYLIIIGDVLSGKQNGGEVHLGILQQWFGIHWWNSREFALLFTLVFVMLPLVLYKRVESLKYSSAVSTLLAVAFVGICCGLAITALVQGKTQTPRLFPRLDYQTSFFDLFTAVPVVVTAFTFHFNVHPIGFELAKASQMTTAVRLALLLCAVIYLAIGLFGYMLFGDSTQSDILINFDQNAGSAIGSFLNSLVRVSYALHIMLVFPLLNFSLRANIDEVLFPKKPMLATDNKRFMILTLVLLVFSYLAAIAIPDIWYFFQFLGSSSAVCLAFIFPGSIVLRDVHGISTRRDKIIALKNLFGERGCDWGDSRGNLVAVAIVLLL

SEQ ID NO: 129539 - protein, 157 aa, Glycine max
  Coding DNA Sequence Number=SeqID_12761
  Gene Ontology: Mol. function=transcription regulator activity; Cellular component=nucleus; Biological process=regulation of transcription
  Homolog annotation: Hit_ID=Q10LR1; Match level="QueryCoverage=95%, HitCoverage=89%, E-value=1e-40, Identity=61%"; Hit description=BHLH transcription factor bHLH033, putative, expressed
MVSREQKRAALHEKLQLLRSITNSHALNKTSIIIDASKYIEELKQKVERLNQHVANAQTSSDQNTLPMVTVETLEKGFLINVYSAKTCPGLLVSILESFEEIGLNVLEARVTCTDTFRFHAVGGKNEEQGDEGIDAQTVKQELGQAIKNWSQNADQK

SEQ ID NO: 129540 - protein, 125 aa, Glycine max
  Coding DNA Sequence Number=SeqID_12762
  Homolog annotation: Hit_ID=Q75H93; Match level="QueryCoverage=88%, HitCoverage=47%, E-value=4e-41, Identity=73%"; Hit description =Expressed protein
  Pfam annotation: Domain name=Arm; Domain location=83-124; Score=17.5; E_value=0.049; Accession=PF00514.13; Description=Armadillobeta -catenin-like repeat
MCTCVVCSRLLVVNDELTIEEEAERKVGWLLKTIFFVTAGVAGYHFFPYMGDNLMQQSVSLLRVKDPLFKRMGASRLARFAVDDERRKKIVEMGGAKELLNMLSTAKDDRTRKEALHALDALSQS

SEQ ID NO: 129541 - protein, 266 aa, Glycine max
  Coding DNA Sequence Number=SeqID_12763
  Gene Ontology: Mol. function=transporter activity; Cellular component= integral to membrane; Biological process=siderophore transport
  Homolog annotation: Hit_ID=P24077; Match level="QueryCoverage=78%, HitCoverage=50%, E-value=1e-55, Identity=52%"; Hit description =Enterobactin exporter entS
MLTVRFGSILSPAIGGLVIAHMGIAWNYGLAAFGTLLTLLPLLSLPQLMPPPQPREHPLRALAGGFAFLFQNKVIGMVALIGALLTMASAVRVLYPAMAESWHIDAAHLGYMYAAVPLGAAIGAFTSGRVAHVARPGWVMLLTAIAAFAAIGLFGLMPWYSLALLCLVAFGYLSALNSLLQYGLIQSLTPDNFLGRINGLWTAQNVVGDALGALLLGAMGAFMLPAMSASGFGFGAALLGILLLFAMTGLRQVTLHKPEPQPATEK

SEQ ID NO: 129542 - protein, 86 aa, Glycine max
  Coding DNA Sequence Number=SeqID_12764
MVGYAPSSYADLVFTGKRIEAGLKRVKFDHRALMNEKTRANEMRKEPMLRLPFLHGQISHQPNNVITQPIPALLITHHLVIHKGHP

SEQ ID NO: 129543 - protein, 49 aa, Glycine max
  Coding DNA Sequence Number=SeqID_12765
SHFQKKNRGTKREEWKRLVGEFMLVLRGRVLEGDVVYDVGDAEVVFAVT

SEQ ID NO: 129544 - protein, 235 aa, Glycine max
  Coding DNA Sequence Number=SeqID_12766
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=1e-33, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MDIFTFRGLHALTFRGLHVLAFRGLHVLTIKGQHVLVIRGLHALVFRELHAHAFKGIHFLTFRGLHVLAFRGLHALPSRGGLHVLPCRGGLHVLPCRGLHVLPCRGLHILDFRGLHVLAFRGMDVLTLRGLHALTFRRLYVLPFRGLHALAFRGLHALISRGLHVLTFRGLHALNFRGLHVLAIRGLHALTIRGLHVLDIRGLHVLAFRGLHNLAFRGLQVLNFRGLHVLAFRGL

SEQ ID NO: 129545 - protein, 533 aa, Glycine max
  Coding DNA Sequence Number=SeqID_12767
  Gene Ontology: Mol. function=transcription regulator activity; Cellular component=nucleus; Biological process=regulation of transcription
  Homolog annotation: Hit_ID=Q2HUL6; Match level="QueryCoverage=62%, HitCoverage=51%, E-value=1e-26, Identity=53%"; Hit description=Helix- loop-helix DNA-binding
  Pfam annotation: Domain name=HLH; Domain location=259-328; Score =11.7; E_value=0.0082; Accession=PF00010.16; Description=Helix-loop -helix DNA-binding domain
MERYTLPAPPINIILEEEEEEENIAIAMGAPLIPSFKSMLQHQQQQPDSYFNFNFNSSISSATIPFVPNMESFPSLDPFSPSLSSLPFFNNNSSNNMAFDPGFDLGLDTTGLHSSVPPAPHLFSQAQMGFEFSELEALTGPGNGNNAPFADGAKVAAAMLLRPPPLDGAQQQQQQPTLYRKRRGTAAEIPGLETVRRKGRKWEEGGRGGEGEEGSSADVDGSGLNYESDEQNENNGNNGLKLSENNGGDNKGKRKGLPAKNLMAERRRRKKLNDRLYMLSLEYCVGLIVVAIDWFIKAKTLPLCVGNLRMMDRASILGDAIDYLKELLQRINDLHNELESTPPGSLLTPSSTSFQPLTPTLPTLPCRVKEELYPGTLPSPKNQAAKELGKSVGQCSNYSYESREKFTPLLIPPPLPSLMSCCHLSFWLDPSLFHLTDFSNSFPLLLLPYLLVFFLVEVRVREGRAVNIHMFCTRRPGLLLSTMRALDNLGLDVQQAVISCFNGFALDVFKAEPSSQPRLVGDSEKAWWWCTDC

SEQ ID NO: 129546 - protein, 770 aa, Glycine max
  Coding DNA Sequence Number=SeqID_12768
  Gene Ontology: Mol. function=catalytic activity; Cellular component =intracellular; Biological process=metabolic process
  Homolog annotation: Hit_ID=Q60D18; Match level="QueryCoverage=99%, HitCoverage=95%, E-value=0.0, Identity=47%"; Hit description =Pentatricopeptide repeat domain containing protein, putative
  Pfam annotation: Domain name=PPR; Domain location=192-226; Score =39.3; E_value=1.3e-08; Accession=PF01535.11; Description=PPR repeat
  Pfam annotation: Domain name=PPR; Domain location=29-63; Score=5.4; E_ value=1.7; Accession=PF01535.11; Description=PPR repeat
  Pfam annotation: Domain name=PPR; Domain location=293-327; Score =24.8; E_value=0.00031; Accession=PF01535.11; Description=PPR repeat
  Pfam annotation: Domain name=PPR; Domain location=394-428; Score =37.6; E_value=4.2e-08; Accession=PF01535.11; Description=PPR repeat
  Pfam annotation: Domain name=PPR; Domain location=429-463; Score=5.6; E_value=1.6; Accession=PF01535.11; Description=PPR repeat
  Pfam annotation: Domain name=PPR; Domain location=495-529; Score =41.7; E_value=2.5e-09; Accession=PF01535.11; Description=PPR repeat
  Pfam annotation: Domain name=PPR; Domain location=530-564; Score =10.1; E_value=0.47; Accession=PF01535.11; Description=PPR repeat
  Pfam annotation: Domain name=PPR; Domain location=566-600; Score =12.6; E_value=0.24; Accession=PF01535.11; Description=PPR repeat
  Pfam annotation: Domain name=PPR; Domain location=633-667; Score=4.2; E_value=2.4; Accession=PF01535.11; Description=PPR repeat
  Pfam annotation: Domain name=PPR; Domain location=91-125; Score=43.7; E_value=6.2e-10; Accession=PF01535.11; Description=PPR repeat
  Pfam module annotation: Pfam domain module=PPR::PPR::PPR::PPR::PPR::PP R::PPR::PPR::PPR::PPR; Domain location=192-226::29-63::293-327::394 -428::429-463::495-529::530-564::566-600::633-667::91-125
NLGALTSSPKRHLYVDASMIKTGFDPNTYRYNFQVQIHLQRGDLGAARKLFDEMPHKNVISTNTMIMGYIKSGNLSTARSLFDSMVQRSVVTWTMLIGGYAQNNRFPEAFGLFADMCRHGTVPDHIILATLLSGFTEFESVNEVAQVHAHVVKLGYISTLMVCNSLLDSYCKTRSLGLACQLFEHMPEKDNVTFNALLMGYSKEGFNHDAINLFFKMQDLGFRPSEFTFAAVLTAGIQLDDIEFGQQVHSFVVKCNFVWNVFVANSLLDFYSKHDRIVEARKLFDEMPEVDGISYNVLIMCCAWNGRVEESLELFRELQFTRFDRRQFPFATLLSIAANALNLEMGRQIHSQAIVTEAISEILVRNSLVDMYAKCDKFGEANRIFADLAHQSSVPWTALISGYVQKGLHEDGLKLFVEMQRAKIGADSATYASILRACANLASLTLGKQLHSHIIRSGCISNVFSGSALVDMYAKCGSIKDALQMFQEMPVKNSVSWNALISAYAQNGDGGHALRSFEQMVHSGLQPTSVSFLSILCACSHCGLVEEGQQYFNSMAQDYKLVPRKEHYASIVDMLCRSGRFDEAEKLMAQMPFEPDEIMWSSILNSCSIHKNQELAKKAADQLFNMKVLRDAAPYVSMSNIYAAAGEWNNVGKVKKAMRERGVRKVPAYSWVEIKQKTHVFSANDTSHPQMKEITRKLDELEKQMEEQAYKPDSGCALYNVDEEVKNLRACDDCHAAIKVISKIVNREITVRDSSRFHHFRDGSCSCKEY

SEQ ID NO: 129547 - protein, 211 aa, Glycine max
  Coding DNA Sequence Number=SeqID_12769
  Gene Ontology: Mol. function=metal ion binding; Cellular component =integral to membrane
  Homolog annotation: Hit_ID=Q67UM6; Match level="QueryCoverage=45%, HitCoverage=13%, E-value=8e-38, Identity=74%"; Hit description =Putative ring finger protein 10
MVTSGCYNTCLFQAADGQHLILHPLNMKCLLHHYGSYDMLPHRISGRILQLETVTQTEAIRRRYRFLSHFPLTTTFQLCEVDLSEMLPPEALAPFIDEIKKRANQRKQLAKKEKKEKIKAEATAAYSLPISLSHQFTSRDDPPTFSMDDFEGFCCNLSAIPQDRVIVRGSSTMEIVQNLNTNKEQGTEPPGLTPERQTSCRHSTKGILNFG

SEQ ID NO: 129548 - protein, 638 aa, Glycine max
  Coding DNA Sequence Number=SeqID_12770
  Gene Ontology: Mol. function=hydrolase activity, acting on glycosyl bonds; Cellular component=beta-galactosidase complex; Biological process=carbohydrate metabolic process
  Homolog annotation: Hit_ID=Q4QYX3; Match level="QueryCoverage=97%, HitCoverage=89%, E-value=1e-138, Identity=38%"; Hit description=Beta- galactosidase
  Pfam annotation: Domain name=Gal_Lectin; Domain location=531-627; Score=53.6; E_value=6.8e-13; Accession=PF02140.8; Description =Galactose binding lectin domain
  Pfam annotation: Domain name=Glyco_hydro_35; Domain location=1-174; Score=-100.2; E_value=8.8e-09; Accession=PF01301.10; Description =Glycosyl hydrolases family 35
  Pfam module annotation: Pfam domain module=Gal_Lectin::Glyco_hydro _35; Domain location=531-627::1-174
MHLRFHRMKGHLQLMAKEESYSLVPFIILAGLLKGLPVWLHNIPNMEFRTHNRAFMEEMKTFTSKIVDMMQDETLFAIQGGPIIIAQIDSSNGYYCDQFQPNDNHKPKIWTENWTGGYKNWGMQNPHRPAEDVAYAVSNLVAHFKIIICTMVVPTLNELPEAHMSLLRMTMTLLWKNMAIVYTYDGKSVCFIGNAHQSKDATINFRNNEYTIHAWEELFVQIKDGLITGIIDLTARKLLDQKVVTNDSSDYLWYITSIDIKGDDDPSWTKEYRLRVHTSGHVLHVFVNGKHVGTQHAKNGQFKFVSESKIKLTTGKNEISLLSTTVGLPNYGPFFDNIEVGVLGPVQLVAAVGDYDYDDDEIVKDLSKNKGSYKVGLHGEHEMHYSYENSLKIWYTDAIPTERIFVWYKTTFKSPIGDDPVVVDLSGLGKGHAWVNGNSIGRYWSSYLADENGCSPKCDYRGAYTSNKCLSMCAQPSQRWYHVPCSFLRDDDQNALVLFEELGGHPYDVNFLTVTVGKVCANAYEGNTLELACNKNQVISEIKFANFGLPKGECESFQKGNCESSEALSVIKAVMCHAMPLNFFSVPLGKMQCIGKDKCSIQVSEKTLGPTRCRVAENRRLAVEAVCDINVSGEGRKH

SEQ ID NO: 129549 - protein, 127 aa, Glycine max
  Coding DNA Sequence Number=SeqID_12771
  Gene Ontology: Mol. function=transferase activity, transferring glycosyl groups; Cellular component=integral to membrane; Biological process=metabolic process
  Homolog annotation: Hit_ID=Q8S9A3; Match level="QueryCoverage=67%, HitCoverage=26%, E-value=1e-25, Identity=58%"; Hit description =Glucosyltransferase-6
MPNSVLYVSFGSVCALNQQQINELALGLELSDQKFFWVFRAPSDLDVKNDDPLEFLPHGPPQTQILSHTSTGGFVTHCGWKSLIESIVAGKGIHQRIGKLKDAAADALKEHGSSTRALSQFGTELEN

SEQ ID NO: 129550 - protein, 61 aa, Glycine max
  Coding DNA Sequence Number=SeqID_12772
MKKQHKGGCYLCQSFIKIVGGKVIAADEIVVVTTTSKGNHLTTIFGCKAKYGKKQEGMATE

SEQ ID NO: 129551 - protein, 56 aa, Glycine max
  Coding DNA Sequence Number=SeqID_12773
MATSLWIMDRAFELMQRRVCSHMIHHHLLLLRSGHTTINIGFGIDAQVTWHVAVTC

SEQ ID NO: 129552 - protein, 84 aa, Glycine max
  Coding DNA Sequence Number=SeqID_12774
MTKLGLCLSSGPPPLDDKRVRITIRMTKLGLCLSSGPPPLDDKKVRITIRMTKLGLCLSSGPPPLDDKKGADNRKVSPRIMGAE

SEQ ID NO: 129553 - protein, 108 aa, Glycine max
  Coding DNA Sequence Number=SeqID_12775
MAGDASKIIHISPKDSEYVIYGDNKQRIIKQGCFQDHFNKHSKVKHCFKIKTRLLQQINIASRFIQDQLLPQNTLFPTRQGSGNRLPGSVIDYQKTSLQISFLKGFEI

SEQ ID NO: 129554 - protein, 72 aa, Glycine max
  Coding DNA Sequence Number=SeqID_12776
MDNEKGVQEQMKADLSALKDQMASITEAMLKLQKTIEDNATATASNTTREAEPVLQPAINLGRDRNMTVFSR

SEQ ID NO: 129555 - protein, 192 aa, Glycine max
  Coding DNA Sequence Number=SeqID_12777
  Gene Ontology: Mol. function=chlorophyll binding; Cellular component =integral to membrane; Biological process=photosynthetic electron transport
  Homolog annotation: Hit_ID=P56777; Match level="QueryCoverage=100%, HitCoverage=48%, E-value=1e-87, Identity=68%"; Hit description =Photosystem II P680 chlorophyll A apoprotein
  Pfam annotation: Domain name=PSII; Domain location=1-192; Score=81.2; E_value=3.2e-21; Accession=PF00421.9; Description=Photosystem II protein
MGLPWYRVHTVVLNDPGRLLSVHIMHTALVAGWAGSMALYELAVFDPSDPVLDPMWRQGMFVIPFMTRLGITNSWGGWNITGGTITNPGIWSYEGVACFGFGAFHVTGLYGPGIWVSDPYGLTGRIQSVNPAWGVEGFDPFVPGGVASHHIAAGTLGILAGLFHLSVRPPQRLYKGLRMGNIETVLSSSIAA

SEQ ID NO: 129556 - protein, 83 aa, Glycine max
  Coding DNA Sequence Number=SeqID_12778
MCHKISKSSNTLQSNHHCYSTHDFFQAAHHNYCWYQEMVYPSGTRHESLKHVVKGLNPDECIYGENLVEREIPLMSANRSLGG

SEQ ID NO: 129557 - protein, 297 aa, Glycine max
  Coding DNA Sequence Number=SeqID_12779
  Gene Ontology: Mol. function=transporter activity; Cellular component= periplasmic space; Biological process=transport
  Homolog annotation: Hit_ID=Q926H2; Match level="QueryCoverage=87%, HitCoverage=62%, E-value=5e-93, Identity=61%"; Hit description =Putative sugar uptake ABC transporter periplasmic solute-binding protein
  Pfam annotation: Domain name=SBP_bac_1; Domain location=5-297; Score =62.2; E_value=1.7e-15; Accession=PF01547.15; Description=Bacterial extracellular solute-binding protein
MKNQMKGCFAAVLFACAGSAAAATTTLNALFMTQAAYSENDIRAMTQAFQTAHPDVQVNLEFVPYEALHDKIVAARGAGGNGYDVVLFDAIWPAEFSKFDLLQDVSSRISADEKEKIFPGAMNTVVFKGKTLGMPWILDTKYLYYNKAMLEKAGIKDLPQTWQQVMDDARIIKQKNIVKYPLVWSWSQAEALVCDYTTLISGFGGKFYNNGKLDFSTPASLQAVKLMKSSLDEGLTNPASREYLEEDVRKAFSNGDAAFALNWTYMYNMANDAKQSKVAGQVGIMPAPGDAPNRFGA

SEQ ID NO: 129558 - protein, 65 aa, Glycine max
  Coding DNA Sequence Number=SeqID_12780
MWDQHRLKGALKSSAFTPKEDPMVKESMIVSLLEQVYAGKREGFGKGRRENEIERKRKRRDILLV

SEQ ID NO: 129559 - protein, 94 aa, Glycine max
  Coding DNA Sequence Number=SeqID_12781
MVGDRTRKQRVRRDRWTFSTNRTQLTTFFFTNFPKDQNEENLWGITRPGVKGGGVKHLRGTMNDPQARRGVSYAQMVSKGKPIWVTKDKGSIGQ

SEQ ID NO: 129560 - protein, 193 aa, Glycine max
  Coding DNA Sequence Number=SeqID_12782
MTATTEIENKEKMIGKQRMEMVSLEVSFLHPELCSLESMVEISSRGGDVGGGGHSCYGDSVRGQNLVSPASLEADSRNLVAVVVAVTTVGDAEQQGNGWSAGSGTAMGSRAGLGAGLGCMEVGHGIGACIGVSVGGDCVEEEDMECWLDTMVFIFKRMTSSLEAMEAWVMLDEEGSTSTIGGRLVKPIDRNRG

SEQ ID NO: 129561 - protein, 185 aa, Glycine max
  Coding DNA Sequence Number=SeqID_12783
  Homolog annotation: Hit_ID=P52425; Match level="QueryCoverage=41%, HitCoverage=20%, E-value=3e-24, Identity=69%"; Hit description =Glycerol-3-phosphate dehydrogenase [NAD+]
  Pfam annotation: Domain name=NAD_Gly3P_dh_C; Domain location=1-77; Score=-58.4; E_value=0.04; Accession=PF07479.4; Description=NAD -dependent glycerol-3-phosphate deh
MNNRKVVGSYARNGGKRTFDELEAEMPQGQKLQGALIAQEVHEVLSHHGWLHMFPLFSVVHAISTGHLPPSAIVKISYQKPRYTLCYRLRVAACIITKHTLDAFTRIEGRDNSEKGNIVACGGPTRRDAETKDARQCTLPSFDQRHDGATEMQANSRGHNRNFRQMGRELERGRSVHQLERKSGI

SEQ ID NO: 129562 - protein, 257 aa, Glycine max
  Coding DNA Sequence Number=SeqID_12784
  Pfam annotation: Domain name=Transposase_23; Domain location=144-214; Score=-13.5; E_value=0.035; Accession=PF03017.5; Description =TNP1ENSPM transposase
MCSSQDAFEEQASQGSFVAHGRHDVLTAAIGRPEHPGRVRAVGVGITIKQYFESASRTSYTSSFIAPEDLQQLTQQIRDQLEDSITEKVTQQLMLSLSQMQSQFQLQMQSQGLALPPEPDVGPLATRVSTKESCVDPLGNDPYTSDSNKCELYIEEYPPRLVSLGRVYEGSTTVHNILLLYDQVKVGVKEVRDADALIPVPTKEVKVMGQALNTFLAWPTHLVKRLSEQGAVELAKPADRPDHEIDDPLYLMTLTIP

SEQ ID NO: 129563 - protein, 77 aa, Glycine max
  Coding DNA Sequence Number=SeqID_12785
MAESSERPMQSVLTKIWNRDTSGWMWLSGVPNFTCQLGEVPLTGGRDLQNKRGATEPVFILVECGYRSLFVGAVVAL

SEQ ID NO: 129564 - protein, 61 aa, Glycine max
  Coding DNA Sequence Number=SeqID_12786
MNERIEGLFSIKSLRWILRIPLRLKCSFLYGGRAASNGGSWWALVVVGGEEEDLALTSLSR

SEQ ID NO: 129565 - protein, 146 aa, Glycine max
  Coding DNA Sequence Number=SeqID_12787
MAQSNSFRLGFLALITALCRSRGAASDSLVLENLSPVINLAYIRKNCWNPVDLIVTIRGARRAKARPIEAPSTSAAPPPAPRPGTQPPLHREAESLTAQAADPSTPEDQTTPILSPNTSPPATPMLHLIDEEDVQTQDTQDRSQDF

SEQ ID NO: 129566 - protein, 301 aa, Glycine max
  Coding DNA Sequence Number=SeqID_12788
MAGPSIGERGQPVKEVGPIAIVVAVEVTPSAPSSILEKTKRDNAVGPSGHKKSKAHMSLRALRQAAGLMPIVGHPSTVQDVPLAPPIIEFVPGIASTPVTSSTPAPSPTSTVVEAVVPTIQVDSIVASSSTIVAPLLSGGVATTGAPTVLPPSSTSPVASPSTVLAVVASPISSSRPHISLYHLYTSSDADSLWGTTYKTKQKIPVVFVSAFDKNLIRLAEFGDFGGEWTVAPRGYAKGGILGGGGRQAEKIDPGGKVESLAAERDGLAKVLVDLEARLKESDSRLEESEGCQGEGGQTRA

SEQ ID NO: 129567 - protein, 60 aa, Glycine max
  Coding DNA Sequence Number=SeqID_12789
MSTPRYQQKGKQGKGSQELPRLLAKAKAMADTYSAPKEIHGLLSYCQHMIDLMDHMIRNR

SEQ ID NO: 129568 - protein, 96 aa, Glycine max
  Coding DNA Sequence Number=SeqID_12790
GTSFVVQVEGTSTWVVVTENKREYISCGSVQVEGTSTWLFKENKGGKSLIKSSNIKKDRSNNQVRDRRVALSSRKGAEAIWSCSEQPMPSTAASHV

SEQ ID NO: 129569 - protein, 111 aa, Glycine max
  Coding DNA Sequence Number=SeqID_12791
GTSIVVQVKGTSTWVVVTENKRGYISCGSVQVEDTSTWLFNENKGGYIPCGSLLVKVFTRLKEISRTSGCMGTGCRHGLLPNQYKILVFVFFFPTLFNFLCALLIIAFTFG

SEQ ID NO: 129570 - protein, 139 aa, Glycine max
  Coding DNA Sequence Number=SeqID_12792
MDFFSDESFECIQAFQNSNLIPFMSLKLPVYSELVKAFYSNLEIQESTLISEVYGIKMIIDQSLFYDLTQLSSKGVPFEGTLDDDWIFDFSVHDACRLVCTNKADMTGRLLAGSLALESQILHYLIVHILLPRSSNLAQ

SEQ ID NO: 129571 - protein, 220 aa, Glycine max
  Coding DNA Sequence Number=SeqID_12793
  Pfam annotation: Domain name=zf-CCHC; Domain location=93-110; Score =21.2; E_value=0.00031; Accession=PF00098.13; Description=Zinc knuckle
MREKERKPQEANINLPYFYGKDNVEANLDWEIRVKQQLKRKSTSKSYGSHSYPKKDQGQGILGVTPFKLKDDKGKTIERQPLKASMQEKTRFIKCFKCLGRGHITFQCPTKKTMIMRGQYIYGSQDEATTFPSSSESKEAKGEESSEEIYPQEERQPLMVKEECKEASVSSKRLAKKERYLEIQTNITVISPLRQPPHFLLCEKTLVSIATPLRLEFIPQ

SEQ ID NO: 129572 - protein, 39 aa, Glycine max
  Coding DNA Sequence Number=SeqID_12794
MLRLAPSTRLARRAEAALGDGYALSPIAELSSTVTFSTS

SEQ ID NO: 129573 - protein, 170 aa, Glycine max
  Coding DNA Sequence Number=SeqID_12795
  Gene Ontology: Mol. function=transferase activity, transferring glycosyl groups; Biological process=carbohydrate metabolic process
  Homolog annotation: Hit_ID=Q2HV81; Match level="QueryCoverage=99%, HitCoverage=29%, E-value=3e-41, Identity=53%"; Hit description =Glycosyl transferase, family 28
  Pfam annotation: Domain name=Glyco_transf_28; Domain location=57-156; Score=-16.3; E_value=0.071; Accession=PF03033.10; Description =Glycosyltransferase family 28 N-terminal domain
MQWIKQASILKDDGTVGIKVPGAGSNIEHDVKCNESYDEIYNAIHSQDIQPIEPLQIVMLIVGTRGDVQPFVAMGKRLQACSFTLWVEIPKFSLVCFFSVHAFKLFKYMISSDMVKNKGFLPSGPSEIHIQRYQIKDIINSLLNACDSRYPESNAPFQAEAIIANPPAYG

SEQ ID NO: 129574 - protein, 370 aa, Glycine max
  Coding DNA Sequence Number=SeqID_12796
  Gene Ontology: Mol. function=DNA binding; Biological process =regulation of transcription
  Homolog annotation: Hit_ID=Q2HV80; Match level="QueryCoverage=90%, HitCoverage=37%, E-value=1e-82, Identity=53%"; Hit description =Homeodomain-like
MFGNKVFLTYKRKRQSLNSSFIHGNCSKNSVYEDAHNDKQTAEKSSEKHEEKPMDTTSDGKRPCFKQPICSSLLPLQNICDPKTGELVNYDATQIRATTHESSSATNPSEDNIKRDVSELPLVENASQNDCDTQRNSYADESSGNGCDNCSNNINSLPVELDAGDDLNLVKSETLIIREFSSACVNKSPVSNNSVDEPTDSHSNVNFKNPSGDMVLQTNLTSPIITFNRCYKRKKGLEQSNLSHKKESISALTKWSMLANGNPGLSNESSSEESPVDNVPDLNQSVGLSERGQALSETQDETSCRSCSMVFQTDLNQSAELSERGELCQTEEKVRLPGNLDLKIYSVSQRDFEFVTCFDADHHRLQTSCE

SEQ ID NO: 129575 - protein, 39 aa, Glycine max
  Coding DNA Sequence Number=SeqID_12797
  Homolog annotation: Hit_ID=Q2HV66; Match level="QueryCoverage=92%, HitCoverage=20%, E-value=8e-08, Identity=70%"; Hit description=Zinc finger, RING-type; RINGv
MLSRFVAEAQWLLPRLQKLAASDAAFYAAAGGGAALSTN

SEQ ID NO: 129576 - protein, 714 aa, Glycine max
  Coding DNA Sequence Number=SeqID_12798
  Gene Ontology: Mol. function=transition metal ion binding
  Homolog annotation: Hit_ID=Q00WZ0; Match level="QueryCoverage=38%, HitCoverage=71%, E-value=1e-19, Identity=27%"; Hit description =Homology to unknown gene
MIEQYKAEIKRLQASEAEIKALSVNYAALLKEKEVFPCFSSDYLSFEPLFSLGTPLNLEATSPASANGAYTVKGSNDQSPNRLHRFTTQMKNRYATNNGTTSALESDASQSKMVSKHSNLQVKGKEQADMIEGKSSPPAAVQHTHDIRKMKLELEQERKKLVNIQLKLQETANNLDLSLMPEEEKLNKSFQEELKLLKLERDKLTRREDEEAGDSVDSFKRLIETIEKENTTLKLEKDELEAALKSRRMASQMSPDDSQIQNKVPSSNSDEQLPDPSKSFPGKEDLERSLHKLSKELKETQKERDKAVQELTRLKQHLLEKEFEESEKMDEDFKIIEELRDSNNYLRAQITHLERTLKQATASQEKLTMANDNEILKSREIIDDLNKKLTNCMSTIDAKNTELLNLQTALGQYYAEIEAKEHLEGDLARAKEETSKLSQLLKFHPYRQKRIISGERLNGCQDADCRANVLISEKEEILAKLSRSEKVQSEWRSRVSKLEEDNSRLRLAVEQSMTRLNRMSVDSDFLVDRRIVIKLLVTYFQRNHSKEVLDLMVRMLGFSNEDKQRIGVAQQGPGKGVVRGVLGLPGRLVGGILGGSGSSESAANVGADNQSFADLWVDFLLKETQEREKRESEERDKSMDDSHDKSLNTNSSSPPPSNQSFSTRTASINSPTYQNISSHPRGYFKHSEQIGSEFSTVPLTSSDSKTTSSRLPRY

SEQ ID NO: 129577 - protein, 666 aa, Glycine max
  Coding DNA Sequence Number=SeqID_12799
  Gene Ontology: Mol. function=protein serine/threonine kinase activity; Cellular component=integral to membrane; Biological process=protein amino acid phosphorylation
  Homolog annotation: Hit_ID=Q2HV73; Match level="QueryCoverage=97%, HitCoverage=95%, E-value=0.0, Identity=74%"; Hit description=Protein kinase; Peptidoglycan-binding LysM
  Pfam annotation: Domain name=LysM; Domain location=122-167; Score =1.2; E_value=0.45; Accession=PF01476.10; Description=LysM domain
  Pfam annotation: Domain name=LysM; Domain location=188-237; Score =20.2; E_value=0.0041; Accession=PF01476.10; Description=LysM domain
  Pfam annotation: Domain name=LysM; Domain location=69-106; Score=2.5; E_value=0.32; Accession=PF01476.10; Description=LysM domain
  Pfam annotation: Domain name=Pkinase; Domain location=353-623; Score =137.4; E_value=4e-38; Accession=PF00069.15; Description=Protein kinase domain
  Pfam annotation: Domain name=Pkinase_Tyr; Domain location=353-623; Score=106.5; E_value=7.8e-29; Accession=PF07714.7; Description =Protein tyrosine kinase
  Pfam module annotation: Pfam domain module=LysM::LysM::LysM::Pkinase:: Pkinase_Tyr; Domain location=122-167::188-237::69-106::353-623::353 -623
MELFHNLKILSTILLLCMFPHSLKCQQAYLNGTVYDCSDNPSVPKGYLCNGLQKSCTSFLLFRSKPPYDSPEKIAYLLGSEASTIASINMISRNDKIPSNKSIIVPVFCSCSGNIYQHNTPYTASKNDTYYELVKETFQGLTTCQAMMGRNYYAPVNIVIGAELTVPKLCACPTENQTARGITSLLVYLVNYGDTIKSIGRAYGVDEQSVLEANKLAEPQSSNRSMDLFALTPILVPLIGKSCKENPDKFYCRCYQAPDGILKGPFCGESDGQKFPAKLVAGLGVGIGAGFLCLFLLGYKSYQYIQKKRESILKEKLFRQNGGYLLQEKLSYGNGEMAKLFTAEELQRATDNYNRSRFLGQGGYGTVYKGMLPDGTIVAVKKSKEIERNQIKTFVNEVVILSQINHRNIVKLLGCCLETETPILVYEFIPNETLSHHIHRRDNEPSLSWVSRLRIACEVAGAVTYMHFSASIPIFHRDIKPTNILLDSNYSAKVSDFGTSRSVPLDKTHLTTAVGGTFGYIDPEYFQSSQFSDKSDVYSFGVVLVELITGRKPISFLYEDEGQNLVAQFISLMKKNQVSEIFDARVLKDARKDDILAVANLAMRCLRLNGKKRPTMKEVSAELEALRKAQSSLQMSHDHEHTTSNIVQECTEESISLSLHLESTSF

SEQ ID NO: 129578 - protein, 403 aa, Glycine max
  Coding DNA Sequence Number=SeqID_12800
  Gene Ontology: Mol. function=DNA binding; Biological process =regulation of transcription
  Homolog annotation: Hit_ID=Q2HV80; Match level="QueryCoverage=99%, HitCoverage=43%, E-value=1e-122, Identity=58%"; Hit description =Homeodomain-like
MLISEGKAIDGVCSSSTQPQLMMSEERMNVQHTKTDQPKLMPVISLSLGLSLPMEHKTGCSDSVNSLSVLSLSNSTTEARDIVQDGFCWSSSVNRRSLLPRHQVVLDNIVHRTRALNERGNFQEYLKPHPIMWSEEELDFLWIGVRRHGRGNWDAMLRDPRLWFSPLRVPGDLAERWEDEQLKLLNDISVPQFMYPAAASLQGNFCYLDPKSSFWESNPLKKSLPRYNFQSNTTAHSHRPTIHSRKASYNNIDKYELGFFNSPGSLGISRENSYSNDYSFNCSAVTNSLPHWLREAVNTPPIQPNMSAAISLSSHPEIPGTSDRCFSAGKSCFVPQNWFNGLTPNEIYMSNGSHYSTYSRRKYGVVKMNKSLEQRVHKPDNLIIIDSDTSSEETISDDHRSSL

SEQ ID NO: 129579 - protein, 93 aa, Glycine max
  Coding DNA Sequence Number=SeqID_12801
MQIYNFVYFVSPYNKFWREATGRGKKKHNMKRCSPWWSRDLKEDGSYEGKVGVEERVEDETDKEVLGSWKVWRRRKCEGRRQEETSRGRGERD

SEQ ID NO: 129580 - protein, 664 aa, Glycine max
  Coding DNA Sequence Number=SeqID_12802
  Gene Ontology: Mol. function=identical protein binding; Cellular component=cytoplasm; Biological process=negative regulation of enzyme activity
  Homolog annotation: Hit_ID=Q2HV71; Match level="QueryCoverage=91%, HitCoverage=89%, E-value=0.0, Identity=62%"; Hit description =Protease-associated PA; Proteinase inhibitor I9, subtilisin propeptide
  Pfam annotation: Domain name=Peptidase_S8; Domain location=98-527; Score=17.5; E_value=1e-07; Accession=PF00082.12; Description =Subtilase family
MNKRNNLVNKSRSLLVEVRVVGDKMETEGEGDDDMGRGMKGELAMNVLEGNAEEREKSIYGFSAVLSSEELKAIKNTHGLVAAYPDRNVTLDTTHTSEFVSLDSSSGLWHASNFGENVIVGVIDTVQDFNTSMCNLKLIGARYFNKGVIAANSKVKISMNSARDTSRHGTHTSSTVAGNYVSGASLAMLKVWLESLHQELGLPYVLAGMDQAIADGVDVISISMVFDGVPLYEDPKAIASFAEMKKGVVVSSSAGNEGPDLGTLHNGIPRLLTAAASTIDRTFGTLILGNGQTIIGWTLFPANALVENLPLIYNRIIPACNSVKLLSKVATKGIIVCDSEPDPNLMFKQMRLVNKTSLLGAVFTYNSPLLNEIGSVSSPTIVISAKDTPPVIKYAKSHNKKLTATIKFQQTFVGIKPTPAVNFNSSRGPSPSYHVVLKPGIMAPGSNVLAAYVPTEPTATIDTNVMFSSGYKLLSGTSMACPHASGVAALLKAAHPQWSAAAIRSALVTTASPLDNTQNPIRDYGYPSQYASPLAIGAGQMDPNTALDPGLIYDATPQDYVNLLCALNNKTRPIVHKFRRTVTNVGSGTATYRAKVTQPKGSVVIVSPERLAFRYKNEKLSYDVVIKYSKYNKENISFEDLVWIEDGGEHSVRSSILVAPSGIV

SEQ ID NO: 129581 - protein, 255 aa, Glycine max
  Coding DNA Sequence Number=SeqID_12803
  Subcellular localization annotation: CTP_CleavageSite=14; ConfidenceScore=5.07e-01
MAEPSKKRKGTSSRSQRHSGSQETPIPSSIPSRSLFSSEEQRIREGVPFEGALIDEWKFDFSVHDARRLVCTNQADMTGRLLAGSLAFESRILHYLIVRILLPRSSNLAQVSEEDLIVMWAFHKGLQIDWAHLVRYRMNKALRLNAPLPYPHLITLFLQHFNIPLDSEPYVPIKRSFLIGASVIASFGYIKEDDGSWILKRFDGLQTFVGERFDTLELQVDMRFNEMESRMTKVEEDVSYIRSSFDLPPPPPPSS

SEQ ID NO: 129582 - protein, 254 aa, Glycine max
  Coding DNA Sequence Number=SeqID_12804
  Gene Ontology: Mol. function=methyltransferase activity; Cellular component=nematocyst; Biological process=pathogenesis
  Homolog annotation: Hit_ID=Q2HRW2; Match level="QueryCoverage=98%, HitCoverage=84%, E-value=4e-49, Identity=38%"; Hit description=SAM dependent carboxyl methyltransferase
  Pfam annotation: Domain name=Methyltransf_7; Domain location=28-253; Score=167.5; E_value=3.3e-47; Accession=PF03492.6; Description=SAM dependent carboxyl methyltransferase
MTGEGLKKIKTEYNNINKKLMLKAKPILEETIMRLYRDFSPNCMKVANLGCSVGPNALLVISNIIDIVNTACTSLNREPPKFQFYLNDLFGNGFNTIFKSLPNFYTILVEDKGHKFGPCFVNATPGSFYGRLFPSNSINLFHSSNSLHWLSQELVPGGAMVLVVLGNHETPRRIGCELVSLKLNDMFLEGLIEEEKLDSFNIPVYEPTVEEIRHVIEEEGSFFVQRFEILTLPWVEGLNEGGDNSFLDGNIKAR

SEQ ID NO: 129583 - protein, 152 aa, Glycine max
  Coding DNA Sequence Number=SeqID_12805
  Gene Ontology: Mol. function=methyltransferase activity; Cellular component=nucleus; Biological process=fatty acid biosynthetic process
  Homolog annotation: Hit_ID=Q2HRW2; Match level="QueryCoverage=68%, HitCoverage=28%, E-value=2e-15, Identity=40%"; Hit description=SAM dependent carboxyl methyltransferase
  Pfam annotation: Domain name=Methyltransf_7; Domain location=16-149; Score=-174.1; E_value=0.00013; Accession=PF03492.6; Description=SAM dependent carboxyl methyltransferase
MGSLGASNGREPLLHVNGGKGESSYANNSSFQETKSLNKGNCHIVSSSPSEGLIEEAKLDSFNIPTYEPTIEEIRHLIKEEESLFLQRLEVFTVPRDEGVSECGDDSFLDGNIRAEFIATYTRAAMEPLLSPKFEAQIINELFIKFKRNLCK

SEQ ID NO: 129584 - protein, 119 aa, Glycine max
  Coding DNA Sequence Number=SeqID_12806
  Gene Ontology: Mol. function=methyltransferase activity
  Homolog annotation: Hit_ID=Q2HRW2; Match level="QueryCoverage=88%, HitCoverage=29%, E-value=4e-17, Identity=45%"; Hit description=SAM dependent carboxyl methyltransferase
  Pfam annotation: Domain name=Methyltransf_7; Domain location=1-118; Score=-210.6; E_value=0.023; Accession=PF03492.6; Description=SAM dependent carboxyl methyltransferase
MPGGAMVLVFPGRNETPRRSLREVISLTLNDMLLEVLIEDEKLDSFNIPVYEPTVEEIRHVILEEESLFLQRLDIFTMSWDEGINDSFLDGNIRAEFVAKYTRAVMERLFYLQSSRQKL

SEQ ID NO: 129585 - protein, 275 aa, Glycine max
  Coding DNA Sequence Number=SeqID_12807
  Homolog annotation: Hit_ID=Q84VH5; Match level="QueryCoverage=81%, HitCoverage=46%, E-value=2e-80, Identity=56%"; Hit description =Envelope-like protein
GQDVGGGEVPGNVPDAPLDNISFHSIGNVERTGKRCLGLQGDHGPHQGCWIADTVTKLGDCYVCQIKHRIAKEITAKQVQHWPKKGKLSAGKLSVKYAILHRIGAANWVPTNHTSTVATESFAVKLPIAFPTVLCGIMSSQHPNILNYTDSVMKRESPLSLHYKLFEGTHVPDIVSTSGKAAASGAVSKDALIAELKDTCKVLEATIKATTEKKMELERLIKRLSDSGIDDGEAAEEEEAAEEEEKAEEEEEAAEEEEDAAEDTESDDDDSEATP

SEQ ID NO: 129586 - protein, 337 aa, Glycine max
  Coding DNA Sequence Number=SeqID_12808
  Gene Ontology: Mol. function=ADP-ribose diphosphatase activity; Cellular component=cytosol; Biological process=carbohydrate biosynthetic process
  Homolog annotation: Hit_ID=Q94B74; Match level="QueryCoverage=67%, HitCoverage=82%, E-value=5e-79, Identity=61%"; Hit description=Nudix hydrolase 2
  Pfam annotation: Domain name=NUDIX; Domain location=170-300; Score =100.6; E_value=4.8e-27; Accession=PF00293.18; Description=NUDIX domain
  Subcellular localization annotation: CTP_CleavageSite=62; ConfidenceScore=5.88e-01
MMSSRASKLVSSSLLAASKLLLKSSSSAPPLQTTALVGSMVPKVQGPKHSSGFPRSYMSATLASLAKEEEVPSKGINTLRAIEDQHGGVIVNIENPMDSSVFSSLLEASISQWREQGKKGVWIKLPREHSNLVDSAVKAGFRFHHAEPDYLMLVNWIPNTPDTLPANASHRVAVGAFVMNANREVLVVQESNGRFSGQGIWKLPTGGVDEGEDICTAAVREVKEETGIDTKFVEVIAFKERHKSFFRKSELFFICMLQPHSFKIQRQVSEIEAAQWMAIEDYMAQPFVRENELFDFLTKIGLSKFNGKYSGFSTVLSSTSSCKKSYFYFNNNDAGHI

SEQ ID NO: 129587 - protein, 147 aa, Glycine max
  Coding DNA Sequence Number=SeqID_12809
  Homolog annotation: Hit_ID=Q6IEM3; Match level="QueryCoverage=22%, HitCoverage=18%, E-value=2e-11, Identity=88%"; Hit description=WRKY transcription factor 58
  Pfam annotation: Domain name=WRKY; Domain location=113-147; Score =4.4; E_value=0.00021; Accession=PF03106.6; Description=WRKY DNA -binding domain
MESQDPPNPPPQNNPFIFTPNSMLQNPNWDPQEQSGLCDIDWGNLFSAQNGLLLNGDAKDAIECASSFSFVAQNKGVCEEEKGNKEKRKGGRMKKTTRVPRFAFHTRSADDILDDGYRWRKYGQKAVKNSTYPRLSKYNFNSNLKIT

SEQ ID NO: 129588 - protein, 532 aa, Glycine max
  Coding DNA Sequence Number=SeqID_12810
  Gene Ontology: Mol. function=aminopeptidase activity; Biological process=proteolysis
  Homolog annotation: Hit_ID=Q9M314; Match level="QueryCoverage=87%, HitCoverage=88%, E-value=1e-151, Identity=57%"; Hit description =Prolyl aminopeptidase-like protein
  Pfam annotation: Domain name=Abhydrolase_1; Domain location=193-470; Score=-10.9; E_value=0.056; Accession=PF00561.10; Description =alphabeta hydrolase fold
  Subcellular localization annotation: CTP_CleavageSite=54; ConfidenceScore=5.68e-01
MLLLHAPPLPFLRTLLHFPLNSIHHSSRAFSSLSHFTKPFSVSNRFSSHSRRSSLQMNGEGLAADDSSPDHVTKDWYSVPELRLRDHRFKVPLDHSLGPHSSPKITVFAREVVAEYVTYGHWAINNRFPQFIYCLLDECSCLVLYITHSSPSSPWHAFLQNSVILLQLGKKRKTCHTYYICKVDLGLSAGGQLNQRGTGLSTPLTVSSMSQFKSADELADFLKYFRADNIVNDAEFIRVRLVPDAGPWTILGQSYGGFCAVTYLSFAPQGLKQVLITGGIPPIGSGCPADSVYKAGFEQAIHQNEKYYKRFPQDIKIVQELVNYLAEQEGGGVALPSGGFLTPRGLQTLGLSGLGSRAGFESMHYLFESVWDPTLVPGAPKRISYNFLSSGSANKWSANSVRTAVGDKFDAIRAARERLPVLFTGEMIFPWMFDEIHALKPFKEAAHILAEKKDWPPLYDVQVLNNNKVPVAAAVYYEDLYVNFKLAMETASQIAGIRPWITNEFMHSGLRDDGSKVIDQLLGMLNGRKPLF

SEQ ID NO: 129589 - protein, 141 aa, Glycine max
  Coding DNA Sequence Number=SeqID_12811
  Gene Ontology: Mol. function=3-methyl-2-oxobutanoate hydroxymethyltran sferase activity; Biological process=pantothenate biosynthetic process
  Homolog annotation: Hit_ID=O82357; Match level="QueryCoverage=60%, HitCoverage=27%, E-value=4e-32, Identity=70%"; Hit description=3 -methyl-2-oxobutanoate hydroxy-methyl-transferase
  Pfam annotation: Domain name=Pantoate_transf; Domain location=31-141; Score=-114.5; E_value=2.8e-07; Accession=PF02548.6; Description =Ketopantoate hydroxymethyltransferase
MQFLVALSRASSTVTNHCLRHLRSTCNVAAEKVTLTRLKQKHRKQEPITVVSTHDYPSAVHVDVAGIDVCHVGDSVSMVIHGHDTTIPITLEQMLAKRPLLVGDLPFGTYESSSNQDFHNPTVCLFLPLKGSTGGGVKTYT

SEQ ID NO: 129590 - protein, 126 aa, Glycine max
  Coding DNA Sequence Number=SeqID_12812
MGVYSGNFIQNTLEGEVNLSITGCVHESSSGSLWATTTSILLKNGIRGIWGFRNAFVKFQKTLGVLGEKTCFREENPSQGAAVRLSRRFHEQISEDFPPRVLHRSSSILRSFFGLQPLLTSFLPFI

SEQ ID NO: 129591 - protein, 220 aa, Glycine max
  Coding DNA Sequence Number=SeqID_12813
  Homolog annotation: Hit_ID=Q1S757; Match level="QueryCoverage=34%, HitCoverage=27%, E-value=4e-28, Identity=80%"; Hit description=HhH -GPD
SPEPVLDGLVRTVLSQNTTEANSQKAFASLKSSFPSWEHVLCAESKDVENVIRCGGLAPTKASCIKNVLRCLRERRGYHTFSGSFIISLFSLLQQLLPKTFALVQLPAVVSGDCIGKEEEKEADGGAADAAGHASQGGHNGQGCCLRSAERQHWYFDTLVGDAAAKRWRCRRQTLEMPPPNVGDASGPRRHQTLEMPPLPDPATTGLVLLRSASAVVACR

SEQ ID NO: 129592 - protein, 927 aa, Glycine max
  Coding DNA Sequence Number=SeqID_12814
  Homolog annotation: Hit_ID=Q9FNE4; Match level="QueryCoverage=94%, HitCoverage=97%, E-value=1e-79, Identity=31%"; Hit description =Arabidopsis thaliana genomic DNA, chromosome 5, P1 clone:MPO12
  Pfam annotation: Domain name=PWWP; Domain location=173-246; Score =64.4; E_value=3.6e-16; Accession=PF00855.8; Description=PWWP domain
MGTVEARSKEPSGCSSPSPENDKNELREALCALKNGASENQGSGDGGVVEMGKSRVSETKVSDEKGFEGRELEDGCVGLADSEMNGVSSLLKMRESGRNLMFSYGGETESAGKLNPEGGSFEVGVEGGKRDWKKIEGEDDRNGKTVTMDVSIADTSENKDVEMEDLGDEGCGRFSVGDFVWGKIKSHPWWPGRIYDPSDASDLALKLRQKNRLLVAYFGDGTFAWCHPSQLKPFEDNFKDMVKQSSSRAFVNAVHEAVSEVGRLLNLKMSSSCAADKTSSEFVRPLAANSGVKEGILIPENGIEKLSDVLIDPAELLSQLKQIAKIISIANILELEILKARLSAFYLSRGGYRLPMYEVPQPVPRLEDSLRDRTVNVGSSECAVEAPAHGPFEEEYSTMPMSPKSGELSHSHGISGNRLNHRIKQKSIAEIMGEDKDANTKNKQGDATEKVSVRKKRKGSEDTMASKSVQKRKGLFLNTDRNAAGAENDGGSWGKEDGDNGTLAQLKKKKKSFGIGNTSSGSKKETDHEGKAKVKNGKGSLSRERKKSKYLSPPFAIPAREQRKGERETESPKVSGKDQQSEPLTRASDQLLKSPVPLKLNDEPFQENVSKELVIDQDLPDSSNYRTPEYDENKTIDTTKIQVPSGEVLSEVCYAAINPQTPMNINSLERIVDFIFIYRSSLYRQGSYYKIYKKHKPSKKGKKPESDLGILRKDQIQSDKKSANNDSEPKKRRKNETTSSLPKEKQSAAAKTGKKGIDKKASGASLFISFGPGSSLPSNSDLTTLYGKFGALNESETSMLSSDCTARVFFLKASDAEKALSHSQNMNPFGSSEASFRLEYLSAGSKSEKSKFKASSTKKKDKTPAKPSASLSPGGEASKLNYIKEKLQGLTSMLEASDAKLPDIKTKLESEMKQLLEDVNRMVESSS

SEQ ID NO: 129593 - protein, 107 aa, Glycine max
  Coding DNA Sequence Number=SeqID_12815
MEEALELPHTKEGIASVECHYQLLEACVREICCIELTNGGLVPISEALKVCVLCCVAHSPHLHKEKRERKKRKRKQQVKRDEEPEPKLVCAGPIRINNVKDPFSSHA

SEQ ID NO: 129594 - protein, 66 aa, Glycine max
  Coding DNA Sequence Number=SeqID_12816
MPSIRLWSTVHYGFRWQKLGIVVILDAGNYEEMVCLNTRSRCPHNFLIGCYRHGTMEVKRSIDLAI

SEQ ID NO: 129595 - protein, 105 aa, Glycine max
  Coding DNA Sequence Number=SeqID_12817
MRATKENPKIGENEWVVSFTGNKEDQVSSSSDRESTNDAPISHLCKHVPSTQPCPPPAPSIWKAPCGACRPWIFFINGVLCFLKINGSGIGDGRKMIGDATSSRR

SEQ ID NO: 129596 - protein, 338 aa, Glycine max
  Coding DNA Sequence Number=SeqID_12818
  Gene Ontology: Mol. function=peroxidase activity; Biological process =response to oxidative stress
  Homolog annotation: Hit_ID=Q1SFR5; Match level="QueryCoverage=20%, HitCoverage=12%, E-value=2e-16, Identity=55%"; Hit description =Integrase, catalytic region
MESKHIDDAMQDDNWVRAMQEELDQFQKNNVWKLVKLPKGKKAIGAKWIFCNKLDENGKVVRNKARNVEFVNKKTIASKVLGVQIMLSNDIITKATGCLREGSTYQEGWEKNYDSHVTRALYWENIEKAGDQKTTVYNLMCEKAKIWANILNKSVLYKADSKTTLLDLHKNLKGLAGLDDIYHAAFINKMLWDKGVYHVFSKMDDDSKHTLVVKGSVDLDAINKRKQKRLAKAIADDDQGLKNFGISKNIQKIMTEEQKRKKTRKHYKKEEEEEELLVREHKTKKRHELSTASTYVHPTVATSIPQRLKKLSEIDEEDEGFVQVVLQKRKATALVAPT

SEQ ID NO: 129597 - protein, 71 aa, Glycine max
  Coding DNA Sequence Number=SeqID_12819
MWLVQNFHNARNHAPLNNKDFIFLINKRLIWNMISRHFQRKRKRDRESISWWKEGITIADWQRRPTTCESN

SEQ ID NO: 129598 - protein, 155 aa, Glycine max
  Coding DNA Sequence Number=SeqID_12820
  Gene Ontology: Mol. function=3-methyl-2-oxobutanoate hydroxymethyltran sferase activity; Cellular component=mitochondrion; Biological process=pantothenate biosynthetic process
  Homolog annotation: Hit_ID=O82357; Match level="QueryCoverage=92%, HitCoverage=42%, E-value=3e-48, Identity=65%"; Hit description=3 -methyl-2-oxobutanoate hydroxy-methyl-transferase
  Pfam annotation: Domain name=Pantoate_transf; Domain location=1-104; Score=-87.7; E_value=3.1e-09; Accession=PF02548.6; Description =Ketopantoate hydroxymethyltransferase
MKVVEMALAFQEAGCFSVVIECVPAPVAAAVTAALQIPTIGIGAGPFCSGQVLVFHDLLGMLQHPHAKVSPKFCKQYACVGKVIKQALLEYKEDVINGSFPGSLHIPYKICEAEANGFINELQRLGLDKAASAAVEAVQNMDTSKSNGKGNSTKD

SEQ ID NO: 129599 - protein, 58 aa, Glycine max
  Coding DNA Sequence Number=SeqID_12821
  Homolog annotation: Hit_ID=Q56BA4; Match level="QueryCoverage=67%, HitCoverage=7%, E-value=9e-12, Identity=77%"; Hit description=MLO1
  Subcellular localization annotation: CTP_CleavageSite=52; ConfidenceScore=5.09e-01
MSIRYKLIKFDAIPLPKRFRLAKDTTFGQRHLNKWSQSSFSLWMVSFFRQFSGSVKES

SEQ ID NO: 129600 - protein, 90 aa, Glycine max
  Coding DNA Sequence Number=SeqID_12822
MSNSKAYLSQFPNSLVSSFKYQLNHVAHSPTRTSSFYEIYIEILQCGKDKGLMIDEEEVEGIGYWCGKIVSAIFLIMFLVEIEFSREEWR

SEQ ID NO: 129601 - protein, 340 aa, Glycine max
  Coding DNA Sequence Number=SeqID_12823
  Gene Ontology: Mol. function=nucleic acid binding; Cellular component= chromatin; Biological process=DNA integration
  Pfam annotation: Domain name=RVP_2; Domain location=248-340; Score= -45.5; E_value=0.0035; Accession=PF08284.2; Description=Retroviral aspartyl protease
  Pfam module annotation: Pfam domain module=RVP_2::Retrotrans_gag; Domain location=248-340::53-130
ALNNLAQVMANQGGDGGAAAYQGLDRFQRNDPPTFKGGYDHEGAEVWLREIEKILWVTKVLVDNTHPRLEGASDVVPWGTFRQTFLEKYFPEDVKNRKEIEFLELKQESMTVAEYETRSKCVKFMNGLQLEVKMMVNYHDINNFAQLTNMCRIFDEGQWEKGAFYKNTNANHGKEKKPVTHSRAKSKGFQPADGSSQPTNRFDHIAHECIDRKVTWFNYRGKGHISTSCPHLRKQKRSESLNNQSGRSRTTRRVFSLSGTDATQSDDLIQGATHSFISRVCVEKLALLASSLKSGLIVDTPANGFVLTSDVGLQCPILISDRQFLIDLVVLPLSQIDVIL

SEQ ID NO: 129602 - protein, 98 aa, Glycine max
  Coding DNA Sequence Number=SeqID_12824
MRGLPGAGGISTGGLIRHCLILAVATYPSAGGRSVTRGMCLPRKEYARSHHQRLFEENVGKTGKYAIYELLSEKVRELYLRTGKVLAPHTSVPRDVSL

SEQ ID NO: 129603 - protein, 225 aa, Glycine max
  Coding DNA Sequence Number=SeqID_12825
  Gene Ontology: Mol. function=RNA-directed DNA polymerase activity; Biological process=RNA-dependent DNA replication
MAVLDESMGCMLGQHDDSEKNERGVYYLSKKFTVCEMNYSLLERTCCALVWAAHHLRQYMLSHTTWLLSKMDPIKYIFEKPALTGWIARWQVLLSEFDIFYVTQKAIKGSTLRFDWVLTAPTTWASMRLIRQALKSVVFHLLAKSICLGVGGPPSKAIHAEPYYLVLLSEFDIVYVTLKVIKGSTLADYLAQQPLNDYQPMHPKFPDEDIMALFMEKLEDEDKDK

SEQ ID NO: 129604 - protein, 73 aa, Glycine max
  Coding DNA Sequence Number=SeqID_12826
GISSLSLPFSISLPFIFQEAKESIDEEDPRPSSSNGAYITHLVRGYAKLLLERPLLRDELVVECQMQANVEAY

SEQ ID NO: 129605 - protein, 116 aa, Glycine max
  Coding DNA Sequence Number=SeqID_12827
IPEHKGWVVPVWFRLCNGFYKDSGNLKWVAGVLDPIPLKSIEATRSITMGPKSTLRLMRTLGPSLASLVQSSWSLLSNALGGATDVKIVVDKVCPHLPVCYAAKNKGFELYYNEEC

SEQ ID NO: 129606 - protein, 203 aa, Glycine max
  Coding DNA Sequence Number=SeqID_12828
  Gene Ontology: Mol. function=RNA-directed DNA polymerase activity; Biological process=RNA-dependent DNA replication
MVERGKLDHIEERLRAIEGGGDYAFADMEELFLVPNMAIPPKFKTSDFDKYKGTTCPKNHLKMYCQKMGAYSKDEKLFMHFFQESLSGAAVTWYTNLETSRVHYWKDLMLQNLCKKEHDSFKEYAQRWRDLAAQVAPLMVEKEMITMILDTLLVFYYERMVGYTPSSFADLVFVGERIEVGLRRGKFDYPALMNGKPGANGEN

SEQ ID NO: 129607 - protein, 109 aa, Glycine max
  Coding DNA Sequence Number=SeqID_12829
MFEDDELNIKILNCLTRTREPMITMIKEFKDLASLSMEAFFGKLLEECKESFSDDEDAKNLSLMELRSICGHVGSPTSLMTMKPHLEFSPFSDALSLIVPIAIMYYLRG

SEQ ID NO: 129608 - protein, 169 aa, Glycine max
  Coding DNA Sequence Number=SeqID_12830
EELATQLAQASSARPGEPGCFLQKQQPSGGRIWKAQVEIPSESPSSPMDVVMSSAGSDSSSDDSKASPYVLISPWSRPPEPQVPLSGPYRLSLTKTKAQRVALTVVDLVDLESDDEEEDSEEDPSIEEDLSMEKKYLMKGLLGEPLTSDYTSFLVQLTLGLGIGDCSES

SEQ ID NO: 129609 - protein, 104 aa, Glycine max
  Coding DNA Sequence Number=SeqID_12831
MQPPSVNGISDPGISTQNVNVQYAAPGQLGTGHAMVPHVYPYPDPYYRSIFAPYDTQPYPPQAYSGQPMWLLVSFSDPPIIKPYPVPGPSSVNGNSASWCSSAN

SEQ ID NO: 129610 - protein, 162 aa, Glycine max
  Coding DNA Sequence Number=SeqID_12832
  Subcellular localization annotation: CTP_CleavageSite=71; ConfidenceScore=5.25e-01
MEVVTFALAVFVPLILAGASSARELRPSDHGLTFQTLSPAGAHSSPEMRSFFNSADSSPSMSSSSDVALPRAMDSGDASPPEWWKPDGGHSGEGVGKALTVASLVCGVAGAVLLVASGLIYLFKYRNRNRKQKLNAAFCGENENQGGNDEDKNKLQLVVRNP

SEQ ID NO: 129611 - protein, 311 aa, Glycine max
  Coding DNA Sequence Number=SeqID_12833
  Gene Ontology: Mol. function=phosphatidylinositol-3,4,5-triphosphate binding; Cellular component=intracellular; Biological process =regulation of GTPase activity
  Homolog annotation: Hit_ID=Q1RV25; Match level="QueryCoverage=99%, HitCoverage=90%, E-value=1e-145, Identity=80%"; Hit description=C2; Arf GTPase activating protein
  Pfam annotation: Domain name=ArfGap; Domain location=1-120; Score =152.6; E_value=1e-42; Accession=PF01412.9; Description=Putative GTPase activating protein for Arf
  Pfam annotation: Domain name=C2; Domain location=157-236; Score =102.7; E_value=1.1e-27; Accession=PF00168.20; Description=C2 domain
  Pfam module annotation: Pfam domain module=ArfGap::C2; Domain location=1-120::157-236
MKDLLLQKDNRFCADCNAPDPKWASANIGVFVCLKCCGVHRSLGSQISKVLSVTLDEWSSDEIDAMIEVGGNSSANSIYEAYFPEGYTKPGSDASHEQRAKFIRLKYERQEFLKPSLRIVSGKSNPPSSISKGVKDSFRITSDSQHMEGMVEFIGMLKVKVIKGTDLAVRDMMTSDPYVILKLGQQTVQTTVIKSNLNPVWNEELMLSVPQQFGILNLNVFDYDLFSADDIMGEADIDLQPLITSAIAYGDARMFDDMQIGKWLKSQDNALIYDSTVNIVDGKVKQDMSIKLQNVESGELDLELEWIPLDY

SEQ ID NO: 129612 - protein, 1284 aa, Glycine max
  Coding DNA Sequence Number=SeqID_12834
  Gene Ontology: Mol. function=transmembrane receptor activity; Cellular component=membrane; Biological process=defense response
  Homolog annotation: Hit_ID=Q1SGR7; Match level="QueryCoverage=13%, HitCoverage=15%, E-value=3e-49, Identity=59%"; Hit description=TIR; Disease resistance protein; AAA ATPase
  Pfam annotation: Domain name=LRR_1; Domain location=1040-1061; Score =0.5; E_value=2.3e+02; Accession=PF00560.23; Description=Leucine Rich Repeat
  Pfam annotation: Domain name=LRR_1; Domain location=1066-1089; Score =2.2; E_value=1.1e+02; Accession=PF00560.23; Description=Leucine Rich Repeat
  Pfam annotation: Domain name=LRR_1; Domain location=1121-1144; Score =1.1; E_value=1.8e+02; Accession=PF00560.23; Description=Leucine Rich Repeat
  Pfam annotation: Domain name=LRR_1; Domain location=712-732; Score =3.6; E_value=60; Accession=PF00560.23; Description=Leucine Rich Repeat
  Pfam annotation: Domain name=LRR_1; Domain location=734-757; Score =9.6; E_value=4.6; Accession=PF00560.23; Description=Leucine Rich Repeat
  Pfam annotation: Domain name=LRR_1; Domain location=759-780; Score =13.0; E_value=1.1; Accession=PF00560.23; Description=Leucine Rich Repeat
  Pfam annotation: Domain name=LRR_1; Domain location=782-804; Score =6.1; E_value=21; Accession=PF00560.23; Description=Leucine Rich Repeat
  Pfam annotation: Domain name=LRR_1; Domain location=806-827; Score =14.6; E_value=0.36; Accession=PF00560.23; Description=Leucine Rich Repeat
  Pfam annotation: Domain name=TIR; Domain location=16-143; Score =116.0; E_value=1.1e-31; Accession=PF01582.10; Description=TIR domain
  Pfam module annotation: Pfam domain module=LRR_1::LRR_1::LRR_1::LRR _1::LRR_1::LRR_1::LRR_1::LRR_1::TIR; Domain location=1040-1061::1066 -1089::1121-1144::712-732::734-757::759-780::782-804::806-827::16-143
  Subcellular localization annotation: CTP_CleavageSite=43; ConfidenceScore=5.15e-01
MASSALTQSSSFSYDVFLSFHATDTRSNFTDFLFQALIRKGIVAFKDESRAPDQAIEDSRLFIVVLSKNYAFSTQCLHELSQIFHCVEFSPRRVLPIFYDVDPSDVRKQTGWYEKAFSKYEERFLVNKKGMETVQTWRKALTQVANLSGWYIRNKPQYTEIEEFVQYTISILSSKFSTLQNKAEGTLSDKDEFSYNELSGEAEGTLSDKDEFSYNELSGEAEGTLSDKDEFSYNELSGLMRIRDFISLVLTYPVKLVEEDILRSWISAFPEWKAQLLSTGDDTVMDKPWCVLTKKALGSMKGFMPMEIISKVERGRRSIFSRNDVEAIPEAILHQTVDLAVNQLIQTLFCGDYCSRYIRLLTRNLAEKRYVVDKIVAAVEDKHNMFGIDKDFLRALWINASTYETDAEFRVQEEINTMMEVDDMWPMEVDNMLGTLFIEEKMGSNGQLVIVVDADSNKKLDLQKLRFPTGIVVLITTEPSTQAEKDGDFRIACTMDLNIWTQDHLLPWKVFCSYVGSCISSSMVSSSMAIQKIAVEIVKECHGHLLAIVLLSKYLMYVQDFKQWELALDKLSSLNPSYDYQDSDRIGISRVMVNAFVNIIWEDIDDAQKLCLELSLPVHNIKNGVRDDILVSDWAKIILGYTQELGEYRRQLQYHMKELLDRFVLLKYESGDVYLPIETYDIIKSLHTSKPSILRHGALGLTEPPYIGRWHSLIRIELMDNKICELPQSPDCPKLKVLLLQGNVDLMDIPDSFFNHMPLLQHLDLSYTSIRDLPPSVSKLIQLQKFYLRGCDLFMELPHQIGQLKNLKELDLDGTLITHLPIEIRELINLQILSLCFDGTSRSTIIPPGLVSNLTQLNYLSINVDPEDEQWNENVISVLGEIFFGLWNLQRLSIYIPKADLLEFIPAEKSLNFRLVVGQHMRRLISRVPPELETKFKHCDYSIKFVNGVNIPNGVKMNLGRFKALYLDRHMTIKSLSDFDLRNLWGLEVCILAECNEMETIVSGSNSPDGPASLMLKFLSVFYMKNLRSVCEGSSPFFLFLKSIALHTCPMLTTIFTLDSLKKLSFLEEIIVEDCPKLTTLISHATPEQKPVFFLPKLRIISLLYLPELVNIFNGMHVGPFIEEMIFYYCPRLQSLSKSELSSKSLKIIKGESIWWEALKWNEAEWGDAGRPNYFERIFSPINEEADMMNQLAALQETQLNEYHNTTYQTPAKPQGATKPCTHFFADISHSFQITQHKLNGKKFQEWCQSVLVIKGKGKMCYLTGDISTPKLYCEDMVNQFDGG

SEQ ID NO: 129613 - protein, 268 aa, Glycine max
  Coding DNA Sequence Number=SeqID_12835
  Homolog annotation: Hit_ID=Q9LEU7; Match level="QueryCoverage=44%, HitCoverage=32%, E-value=1e-10, Identity=32%"; Hit description =Serine/threonine protein kinase-like protein
  Subcellular localization annotation: CTP_CleavageSite=38; ConfidenceScore=5.43e-01
MSPRNKSSEPTPWFQIWCLSTTPWVSSSPSLTFIVFVRATTPPCIAPGSLKHGLGFDSRLGFNNMKVRDGGGMKREWGNAAVGTTLRCSMPRPSSSSVTSGFTNSILIEAQISLVRNTLRDQITSLSSVVKFTALSEIFGDGGSGCGGGGFCQENHDFRHNSRVVVLEGLFFVLCVELVPVGETRGPYDYGGRKQFQGAQVLQHDVPEQEEDTGGVHVKVLRGGDCGEVCGSGVGAEVPRGGGQGLQDPAARCDGGEEGEASGHGGGV

SEQ ID NO: 129614 - protein, 61 aa, Glycine max
  Coding DNA Sequence Number=SeqID_12836
MKIFTRCSKNKKVDVEIQEAVSLVLSMVESANAREQYHRMLEKYRKAKILQSGVHVDIGVS

SEQ ID NO: 129615 - protein, 74 aa, Glycine max
  Coding DNA Sequence Number=SeqID_12837
  Subcellular localization annotation: CTP_CleavageSite=20; ConfidenceScore=5.23e-01
MHFYGISSSKQSIAKILAPVSSVGRGSSNSEAQKRKVVAEPKIFQEVTKKLPIATNSGASAELHYRAARACYEN

SEQ ID NO: 129616 - protein, 91 aa, Glycine max
  Coding DNA Sequence Number=SeqID_12838
MSGLEVVAPLVGEVGAHGIGELHSTIASKIASSRNLDDNYNILLKDMEMLLAIKKDKEREVQRNNHKDTTNAYKLWTNRVSDAAEEVQKLK

SEQ ID NO: 129617 - protein, 362 aa, Glycine max
  Coding DNA Sequence Number=SeqID_12839
  Gene Ontology: Mol. function=oxidoreductase activity; Cellular component=integral to membrane; Biological process=potassium ion transport
  Homolog annotation: Hit_ID=Q2R0H4; Match level="QueryCoverage=98%, HitCoverage=99%, E-value=1e-142, Identity=67%"; Hit description =Oxidoreductase, aldo/keto reductase family protein, expressed
  Pfam annotation: Domain name=Aldo_ket_red; Domain location=9-355; Score=113.2; E_value=7.3e-31; Accession=PF00248.11; Description =Aldoketo reductase family
MSGVPLFNLAPNLTVSRLCLGTMTFGEQNTLAESFQLLDQAFHAGINFFDSAEMYPVPQRPRTCGRSEEYLGRWISQRKIPRDSLVIASKVAGPSGQMTWIRGGPKCLDADNITEAIDNSLSRMQMDYIDLYQIHWPDRYVPMFGETEYDPVQQYASISIDEQLEALSAAVKAGKASGIIRFVGLSNETPYGLMKFIQVAEKYASHLKIVSLQNSYSLLCRTFDSAMAECCHHERISLLAYSPLAMGILSGKYFSPGGGPTDARLNLFKGKYSEGESRYNLSNKIIKAATVKYLNIAKTHGLHPVSLAIAFVLRHPLVASAVFGATKSWQLREVLNACKIELTFEVIEEINKIHSRFPNPCP

SEQ ID NO: 129618 - protein, 887 aa, Glycine max
  Coding DNA Sequence Number=SeqID_12840
  Homolog annotation: Hit_ID=Q1SJW0; Match level="QueryCoverage=98%, HitCoverage=98%, E-value=0.0, Identity=65%"; Hit description =Ubiquitin-associated
  Pfam annotation: Domain name=DUF1296; Domain location=13-72; Score =134.6; E_value=2.7e-37; Accession=PF06972.2; Description=Protein of unknown function (DUF1296)
  Pfam annotation: Domain name=UBA; Domain location=16-57; Score=17.9; E_value=0.027; Accession=PF00627.21; Description=UBATS-N domain
  Pfam module annotation: Pfam domain module=DUF1296::UBA; Domain location=13-72::16-57
MSGKGGGGQKAGIPPASRKMVQSLKEIVSNIPEHEIYATLKDCNMDPNEAVSRLLSQDTFHEVKSKREKKKEGKDTTDSRSRVVSNTSSRGGGARVSADRYVGRGGATQFSSGGGKRMLGKPVLKKENGTPAYGGLTAPASSALDNNVNRQLPSYRMEHLMNVRNCCSDSVRVCDGLSSSQYGGMQSPWVANPGQVSMADIVRMGRPQAKASMHNSSLHSGSHQNVFAPPEASHNNLHSLQGHASKVSETNNDRGFAINSNVEQNDEWPLIEHQPAVSVSSVVDDHPTSEYHTNSSNSGEANQQLKTHVNEFVAEDDPVENPDNVGSASISEENPESTSVFDGSTYKDINSYQSHRHPFETNEAEGGVSSVAANLEQLNLHSNDQGTEQEEENSSVVIPNHLQLHSAECLNLSFGSFGSANDASLSGSGPYASRPLKSNLEDTSGANDVSTIGNPDYYGDEHLTTTSDGNVAHITGVDAGTYEHSSISQSEALKSEPPETAQENQYSFPSSHEFTYENAQQPDVTYPHSQTSSQIQNLSPFSSVMAYTNSLPSALLASTVQTAREDIPYSPFPATQSMPAKYSNIASSIGGPTINMSEGVRYLENRGKSKTTNMDVSVSVLNMDLIQVSVHYMRALRANNISTPQPNPQALPGANVATGPALPQHLAVHPYSQPTLPLGHFANMISYPFLPQSYTYMPSAFQQAFPGNSTYHQSLAAMLPQYKNSISVSSLPQSAAAAAVASGYGFGSSTSIPGGNYPLNPPAAPTSTTIGYDDVINSQFKENNHIISLQQNENSPMWVHGPSSRTMSAVPPSTYYSFQGQNQQPGGFRQSQQPSQQHFGSLGYPNFYHSQTGISLEHQQQNPREASLAGSQSQPPKQSQQIWQNSY

SEQ ID NO: 129619 - protein, 135 aa, Glycine max
  Coding DNA Sequence Number=SeqID_12841
  Gene Ontology: Mol. function=NAD+ ADP-ribosyltransferase activity; Cellular component=nucleus; Biological process=protein amino acid ADP-ribosylation
  Homolog annotation: Hit_ID=Q1T4R9; Match level="QueryCoverage=98%, HitCoverage=40%, E-value=8e-13, Identity=35%"; Hit description=IMP dehydrogenase/GMP reductase
MGFVGHATNVMALYKNILSFSVARQARWVSFKIFSKAVAIKCGGDANVGYAWYGGSLDDLLEIVSAGFNGCKNHNANDDDGDKDECHGIGMPLFAANFSIDRHVLLCKVILGNVEAVPAGSKQSQPSSKQYDTGG

SEQ ID NO: 129620 - protein, 876 aa, Glycine max
  Coding DNA Sequence Number=SeqID_12842
  Gene Ontology: Mol. function=nucleoside-triphosphatase activity; Cellular component=membrane; Biological process=defense response
  Homolog annotation: Hit_ID=Q9T048; Match level="QueryCoverage=90%, HitCoverage=79%, E-value=2e-41, Identity=25%"; Hit description =Putative disease resistance protein At4g27190
  Pfam annotation: Domain name=LRR_1; Domain location=418-441; Score =7.0; E_value=14; Accession=PF00560.23; Description=Leucine Rich Repeat
  Pfam annotation: Domain name=LRR_1; Domain location=443-464; Score =11.3; E_value=2.2; Accession=PF00560.23; Description=Leucine Rich Repeat
  Pfam annotation: Domain name=LRR_1; Domain location=466-488; Score =3.0; E_value=78; Accession=PF00560.23; Description=Leucine Rich Repeat
  Pfam annotation: Domain name=LRR_1; Domain location=490-511; Score =10.5; E_value=3.1; Accession=PF00560.23; Description=Leucine Rich Repeat
  Pfam annotation: Domain name=LRR_1; Domain location=738-762; Score =11.8; E_value=1.7; Accession=PF00560.23; Description=Leucine Rich Repeat
  Pfam annotation: Domain name=LRR_1; Domain location=764-788; Score =1.9; E_value=1.3e+02; Accession=PF00560.23; Description=Leucine Rich Repeat
  Pfam annotation: Domain name=LRR_1; Domain location=794-815; Score =1.1; E_value=1.7e+02; Accession=PF00560.23; Description=Leucine Rich Repeat
  Pfam annotation: Domain name=LRR_1; Domain location=819-841; Score =9.4; E_value=4.9; Accession=PF00560.23; Description=Leucine Rich Repeat
  Pfam annotation: Domain name=NB-ARC; Domain location=22-324; Score =109.2; E_value=1.2e-29; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::NB-ARC; Domain location=418-441::443 -464::466-488::490-511::738-762::764-788::794-815::819-841::22-324
MEKKCNYVRELKKDECLRDFLVDKPPEPVLKELNVPQISGYPTLQGALKNMLGLLKNNKIKVIGVCGTKGVGKTTIMQNLNNNEEVAKLFEIVIFVKATADDHKLQEKIANRLMLDIETNKKHSGDVARRIHKELEKKKYLLILDEVEDAINLEQLGIPSHVNNGGKVVIATRLPRVYKLNKVQRVIKVMELSPEEAWKMFRDTVHAFNPKIDSLEIQPIAKLVCKRCSRLPLLIYNIANSFKLKESASSWSAGLEDLKPWPELQNQGLEELYSCLKFCYDELKDKKKQKCFLYTSLYPANSKVYTDYLVECWAAQGLLGDINDKRSYRSARNCGINILEHLANVSLLEKGESMIYVNMNHCMRQLALHISSKDPECSFYLQDGEESENLSNSRAWQQARWVSMRQLLDFPTSQDSSMILTLLLRKNPKLTTIPPTFFENMSSLLLLDLYNSMITQLPSSLSKLTCLRGLFLNSCELLESLSSEIGSLQFLEVLDIRDTKVTFIPLQIGCLTNLRCLRIPFIVSEDNEAQNVHVISKLHRLEELTIQVISYEQWCNDAENVLQHVASLENVTHLRCCFPSSIILGEFLSRSKSWSCKQQNSFRFFVGCQNSRRPQILESFEYKITNYLRYCNGGQKDDSAIIEVLPKTDAFELVCHKDIKKLTNFAGVVCLERIRGLLITRCNKVLTIVSADTSSNTMNGIQIETRVILPNLEQLYLENLLNLKCVFRGPLHSGTFSRLQTLSLKNCPSLSDIFSNGAIQHFSELQNLKLEDCSKIEVLIREEDIEGERDVLPKLEILLLVNLPNFKTICSTHTLAWSSLELLRIHNCPKLKTLPLDSDNAVNLKSIKGQQEWWDELEWTNNKVRPIFAASNEYFS

SEQ ID NO: 129621 - protein, 211 aa, Glycine max
  Coding DNA Sequence Number=SeqID_12843
  Gene Ontology: Biological process=response to stress
  Homolog annotation: Hit_ID=Q1SJW3; Match level="QueryCoverage=99%, HitCoverage=100%, E-value=9e-66, Identity=60%"; Hit description=UspA
  Pfam annotation: Domain name=Usp; Domain location=17-189; Score=38.3; E_value=2.7e-08; Accession=PF00582.16; Description=Universal stress protein family
MAQGMASNRNRSASAQEARKVMVVADPTRESAGALQYALAHAVIEQDELILLHVENPSSWRHTISTFLKMPSLGSSTTASLDLGGGGAAADGEGFDFLEEMKHACRVSQPKMKVRVMKVETDGRDKASTILSQSKTHGVDVVVIGQKRNITSALLGYKRPAGGSMKGVKAIDTAEYLIQNSSCTCVSVQRKGQNGGFVLNSKTHRNFWLLA

SEQ ID NO: 129622 - protein, 44 aa, Glycine max
  Coding DNA Sequence Number=SeqID_12844
MEFYSFRSNPSALQRNKNLCDSSASCLWWSHRGDCTGPHARPSS

SEQ ID NO: 129623 - protein, 177 aa, Glycine max
  Coding DNA Sequence Number=SeqID_12845
  Gene Ontology: Mol. function=serine-type peptidase activity; Cellular component=chloroplast; Biological process=proteolysis
  Homolog annotation: Hit_ID=Q1SJV5; Match level="QueryCoverage=99%, HitCoverage=39%, E-value=1e-75, Identity=79%"; Hit description =Peptidase S41
  Pfam annotation: Domain name=PDZ; Domain location=1-80; Score=29.8; E_ value=9.9e-06; Accession=PF00595.14; Description=PDZ domain (Also known as DHR or GLGF)
MARYDMTGVGINLKEVPDENGDLRLEVLGIILDGPAHSAGVRQGDEILAVNNMEVKGKSAFEVSSLLQGPNGTSVTIQVKHGNCGPVESIEVQRQLVARTPVFYRLEQLDNGVTSVGYIRLKEFNALARKDLVIAMKRLQDMGASYFILDLRDNLGGLVQVAFAYNPIYLYHFDSLL

SEQ ID NO: 129624 - protein, 175 aa, Glycine max
  Coding DNA Sequence Number=SeqID_12846
TVTDVSWLPNTEHRGVRAFQEISSFQGQLRWGPMIVTVRPERVVRQFGYIQSIPSPPLSARLSHDQIDDMRMEFCGSLTTCGQLTSRGMHQLQTLRTTYSPPSPQVPVAFDPPPHVDDYEGYEAIAQRLERVLNLRIVTAGTELYDIMQDCLTIARGGPSADGTIWARQRRRTDH

SEQ ID NO: 129625 - protein, 44 aa, Glycine max
  Coding DNA Sequence Number=SeqID_12847
MSCEKLLIEALQKGENYEGAKVGVSLSLNHALSETKPLSETAVA

SEQ ID NO: 129626 - protein, 47 aa, Glycine max
  Coding DNA Sequence Number=SeqID_12848
MAVKNLIERLGVHDRKHHMGKKIATCEGSFSYQRYYFTNPNFRDVHK

SEQ ID NO: 129627 - protein, 91 aa, Glycine max
  Coding DNA Sequence Number=SeqID_12849
MRGSGESVPFLDTTSRGSEMPQRTFLRRRHGPSVGLFTVGIKTEPICNAYAKDTMRECAQGIIPFEEHIVAVGTTSNNRFSKRKALDEGSL

SEQ ID NO: 129628 - protein, 249 aa, Glycine max
  Coding DNA Sequence Number=SeqID_12850
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=9e-37, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHILAFRGLHVLTFRGLHVLAIRGLHVLAIRGLHILAIRGLHVLAIRGLHVLAIRGLDVLAIRGLHALTFRGLHVLTFRGLHALTFRGLHVLTFRELHALTFRRLHILAIRGLHVLAIRGLHALNFRGLHVLTFRGLHAFTFRGLHVLAIRGLDALAIRGMHALTFRGLHVLVLTFRGLLALTFRGLQVLAFRGLHVLTLRGLHILAFRGLHAFAFRGLHILTFRGLRVLTFSGLHIRTLREFKVFCP

SEQ ID NO: 129629 - protein, 94 aa, Glycine max
  Coding DNA Sequence Number=SeqID_12851
MTTCNKAQATTSRPELRLPDPGHNLPRDGEPLAPPFLASPSCLPSSCLSDSSSFLVELSIKTFSPPLFGLSLESEPLCVGRLSTQSNSLPIGRQ

SEQ ID NO: 129630 - protein, 109 aa, Glycine max
  Coding DNA Sequence Number=SeqID_12852
MGEVDAVQEWIKADIEALKEQMATMMEAMMSMKKTMEVNVAAVAATSAVVEVDPTPPSGLNQINHPTSDMVGQGGKEWGSTGDSHFVQVQNKHAFPPYSLPPIYTPPNL

SEQ ID NO: 129631 - protein, 174 aa, Glycine max
  Coding DNA Sequence Number=SeqID_12853
MTDIPFLLKKQIFRATAVADDTTQSLLKYILFMRVYEGCCLRCQNCDRSFLVITISLLQSLLRFSLEKEAAPVAAVPVQAPPPPSQQASSLPNWIPVPIENGVGSVIPIAMARVTKLHSRRPGRWLKNWSSSLNASTIAQRDEPTWRSGLVSICGLACMWRLSAHLRLSLHLAA

SEQ ID NO: 129632 - protein, 163 aa, Glycine max
  Coding DNA Sequence Number=SeqID_12854
  Gene Ontology: Mol. function=serine-type peptidase activity; Cellular component=integral to membrane; Biological process=proteolysis
  Homolog annotation: Hit_ID=Q1SJV5; Match level="QueryCoverage=61%, HitCoverage=21%, E-value=1e-35, Identity=78%"; Hit description =Peptidase S41
  Pfam annotation: Domain name=Peptidase_S41; Domain location=3-102; Score=52.5; E_value=1.4e-12; Accession=PF03572.8; Description =Peptidase family S41B
MDPMGYSLIIKDTGGPQKKIRKPLFKNILVNDKTASASEIVASALHDNCRAVLVGKRTYGKGLIQSVFELDDGSGVVITVGKYVTPNHKDINGNGIEPDFQKLPGIKQSLWYSDAIYCFGLIILIETFDESARWKLLCISQEFQVNIDICLNGLPSLLGYNGI

SEQ ID NO: 129633 - protein, 296 aa, Glycine max
  Coding DNA Sequence Number=SeqID_12855
  Gene Ontology: Mol. function=hydrolase activity, hydrolyzing O -glycosyl compounds; Cellular component=cell wall; Biological process= carbohydrate metabolic process
  Homolog annotation: Hit_ID=Q8LG58; Match level="QueryCoverage=91%, HitCoverage=93%, E-value=1e-108, Identity=67%"; Hit description =Probable xyloglucan endotransglucosylase/hydrolase protein 16 precursor
  Pfam annotation: Domain name=Glyco_hydro_16; Domain location=31-212; Score=337.2; E_value=2.7e-98; Accession=PF00722.11; Description =Glycosyl hydrolases family 16
  Pfam annotation: Domain name=XET_C; Domain location=236-290; Score =85.2; E_value=2.1e-22; Accession=PF06955.3; Description=Xyloglucan endo-transglycosylase (XET)
  Pfam module annotation: Pfam domain module=Glyco_hydro_16::XET_C; Domain location=31-212::236-290
MAKYETYLRVSALLLASLLMCLFGVTAEGNFYEDIDITWGEHGGVNILGSNSLVLSLDQSSGSGFRSKAEYLYGRIDMQIKLVSGNSAGTVTAYYLSSEGPNHDEIDFEFLGNLSGEPYIVHTNIYTQGIGNREQQFYLWFDPTKHFHTYTIVWNPQRIIFMVDSIPIRVFNNYEARGVPFASSQPMRLYSSLWCADQWATKGGLVKTNWSFAPFKAYYRNFDAKACVWSKGSSSCPSNSASMTHYNNTWQAQDLDAYGRRSLRWVQKYYMIYSYCKDYKRFPQGRPRECRLSRFS

SEQ ID NO: 129634 - protein, 781 aa, Glycine max
  Coding DNA Sequence Number=SeqID_12856
  Gene Ontology: Mol. function=translation elongation factor activity; Cellular component=intracellular; Biological process=signal transduction
  Homolog annotation: Hit_ID=Q1SFH4; Match level="QueryCoverage=79%, HitCoverage=87%, E-value=0.0, Identity=80%"; Hit description=Zinc finger, RanBP2-type; AAA ATPase; Translation elongation factor Tu
  Pfam annotation: Domain name=GTP_EFTU; Domain location=362-586; Score= 251.0; E_value=2.5e-72; Accession=PF00009.17; Description=Elongation factor Tu GTP binding domain
  Pfam annotation: Domain name=GTP_EFTU_D2; Domain location=596-663; Score=49.9; E_value=8.6e-12; Accession=PF03144.15; Description =Elongation factor Tu domain 2
  Pfam annotation: Domain name=GTP_EFTU_D3; Domain location=669-777; Score=51.8; E_value=2.3e-12; Accession=PF03143.7; Description =Elongation factor Tu C-terminal domain
  Pfam annotation: Domain name=MMR_HSR1; Domain location=365-514; Score= 9.9; E_value=0.00012; Accession=PF01926.13; Description=GTPase of unknown function
  Pfam annotation: Domain name=zf-RanBP; Domain location=45-74; Score =25.2; E_value=0.00024; Accession=PF00641.9; Description=Zn-finger in Ran binding protein and others
  Pfam module annotation: Pfam domain module=GTP_EFTU::GTP_EFTU_D2::GTP_ EFTU_D3::MMR_HSR1::zf-RanBP; Domain location=362-586::596-663::669 -777::365-514::45-74
MPRKVNYGLDYDDDFYDDDYDDYAYDDADAEDYAEGPDTKQETIKPGLWQCSICTYDNDESMTFCDICGVVRRSLVNTGTSNSNKTVEDISKSPGASKLARSLFQSLQQQIPKEIVLFPKPDDGFLTDDSNFYKLENVRGEFHEIHKAFSTQSHPHLNIDPFKFDVPSPDDVVYTGLRSSKTGLKDKATNTKSSQLSSSIREKNELSVQSNAESSDNLSSLTRKSKQDSSAKSKLSKNVAIDLQTSGKTSNSLPESLSKDKGNNINKINSLKNGTIDIQSSKEKSGSLSALSKVKESDNISFSSIKDGKPESISSSFNNMALNVRSGNSSGNSDNTNAKGTRSHVSYKPEKWMLPQQAEDTLTQLNLAIVGHVDSGKSTLSGRLLHLLGRISQKEMHKYEKEAKLQGKGSFAYAWALDESSEERERGITMTVAVAYFDTKRYHVVVLDSPGHKDFVPNMISGATQADAAILVIDASLGSFEAGMDGSKGQTREHAQLIRSFGVDRVIVAVNKMDAVVYSKDRFDFIRQQLGVFLHSCGFKDSSLSWIPMSAMENQNLVASPSDARLKNWYGGPYLLDAIDSLQPPTREFSKPLLMPVSASGKLEAGALRSGSKVLVMPSAVVGTVRSLERDSNACTVARAGDNVAVMLQGVDGNHVMAGDVLCHPDFPVAVAKHLELKVLVLDGASPILVGTQLEFHIHHAKEPGRVSRILSVLDPKTGKVTKKSPRCLTAKQSAVIEVILNETVCVVEFSSCKALGRVSLRSMGRTIAVGVVTRIIEEQG

SEQ ID NO: 129635 - protein, 389 aa, Glycine max
  Coding DNA Sequence Number=SeqID_12857
  Homolog annotation: Hit_ID=Q1SFH9; Match level="QueryCoverage=99%, HitCoverage=100%, E-value=1e-142, Identity=70%"; Hit description =SH3; tRNA-binding arm
  Pfam annotation: Domain name=SH3_1; Domain location=310-376; Score =38.2; E_value=2.8e-08; Accession=PF00018.18; Description=SH3 domain
  Pfam annotation: Domain name=SH3_2; Domain location=311-376; Score =30.2; E_value=7.1e-06; Accession=PF07653.7; Description=Variant SH3 domain
  Pfam module annotation: Pfam domain module=SH3_1::SH3_2; Domain location=310-376::311-376
MDALRKQASKLREQVAKQQQAVIKQFSSSGYESSDVVVIDEVEMQRHHQLEKLYRATRAGKDFQKEIVKAAETFTAIGYKHIETGTKLSEDCCKYGAENNSDNILSKAASVYGDARKHVEKEHEELNRLLSTQVDFSYVVQVLDPLRQMINGVPLEDARHLAQRYSRMRQEAEAQTPDSCYMITMLIELEKLSPKKREEIARRQARVREAPTAEQVAKLHAAEARMQELKANMAVLGKEAAAALAAVEAQQQRLTFQRLVAMVEGEKTFHLRVAAILGEIEAEMVSDRQKKESAPPVGISENGTEKTMYFLAEATHPFSGESEKELSFSKGDFVVVRKPPCLPNFQMLTQVSQSGWSEGECNGKAGWFPSAYVEKRQRIPSSNMAGEVY

SEQ ID NO: 129636 - protein, 496 aa, Glycine max
  Coding DNA Sequence Number=SeqID_12858
  Gene Ontology: Mol. function=exonuclease activity; Cellular component= intracellular; Biological process=DNA repair
  Homolog annotation: Hit_ID=Q8L6Z7; Match level="QueryCoverage=98%, HitCoverage=66%, E-value=1e-125, Identity=51%"; Hit description =Exonuclease, putative
  Pfam annotation: Domain name=XPG_I; Domain location=138-260; Score =29.2; E_value=1.8e-06; Accession=PF00867.9; Description=XPG I-region
  Pfam annotation: Domain name=XPG_N; Domain location=1-99; Score =109.7; E_value=8.4e-30; Accession=PF00752.8; Description=XPG N -terminal domain
  Pfam module annotation: Pfam domain module=XPG_I::XPG_N; Domain location=138-260::1-99
MGIQGFLPLLKSIMVPIHIKDLKGCSVAVDTYSWLHKGALSCSTELCKGMPTTRHIEYCMHRVNLLRHFGVKPILVFDGGLLPMKSEQENKRARARKDNLARAVEHESDGNSAAAYECYQKAVDISPQIACELIQVLKQENLQYIVAPYEADAQMTFLAISGQVDAVITEDSDLIPFGCPRSLSGMGLKRAHASIKKFRSYDKVLKHLRYSGVSVPPFYEESFKKAILTFQYQRVYDPINENIVHLSNISDDIGDDYTLTWDTTMPKDIAQRIAKGDLDPITKMPFEGENLTARLAIVETSQFKTHSESAKKKIDLPVQKNLLTKYFCILQSILLELILICLACLKGRNAGQHSMQKGNSELLGCHLLLLMKQRTLLHIDSENWGSVPPPNIHIGYSSATNNSEFTESPCHEKKSPEHTVLRKPRQPIHKPCLGLHGHTNVQDTAEGKTREEATRKVTVRSAYFQHKQVEKNVYGEKQDCLSSGIAIDERKNALSE

SEQ ID NO: 129637 - protein, 70 aa, Glycine max
  Coding DNA Sequence Number=SeqID_12859
  Gene Ontology: Mol. function=glutathione-disulfide reductase activity; Cellular component=chloroplast; Biological process =glutathione metabolic process
  Homolog annotation: Hit_ID=P48640; Match level="QueryCoverage=84%, HitCoverage=10%, E-value=1e-13, Identity=66%"; Hit description =Glutathione reductase, chloroplast precursor
MAMGRVGYGKSCFADAFGDFRGDSGERKLTDGYGSVVVGSEVSGSDIVAVGTNGEEVEVVVCGGGVSAVL

SEQ ID NO: 129638 - protein, 296 aa, Glycine max
  Coding DNA Sequence Number=SeqID_12860
  Gene Ontology: Mol. function=nucleotidyltransferase activity; Cellular component=ribosome; Biological process=metabolic process
  Homolog annotation: Hit_ID=Q1SFI4; Match level="QueryCoverage=68%, HitCoverage=38%, E-value=6e-76, Identity=60%"; Hit description =Photosynthetic reaction centre, H-chain, cytoplasmic
MAIVFLLNEEERQGSISDSNMIENEAIDTSVLRMFQKEEKLPVVSSLPEGQNKYKILMKSPWEILQSPVGSGGLISLFSKHSIVDNLIDMGVEYIEFCCPSERTAGGNSLLFGLINSREAKIGIQISPKITDLEENFDMIFSMDFVKKLTKQSNKLQFDAIPKAHSFVEKVDKEWVTVTSSTPNSYELSCSIHDSLNACSLDKAVKKHIGKEENKKHFIEFVTSEFRNNRNLSDNVAIQQKIKLARDYTFLLNSVHHHKDLLFSYNIAVDRSDEVKRTLGKSASSVGLQLPEVYQP

SEQ ID NO: 129639 - protein, 905 aa, Glycine max
  Coding DNA Sequence Number=SeqID_12861
  Gene Ontology: Mol. function=alpha,alpha-trehalose-phosphate synthase (UDP-forming) activity; Cellular component=cytosol; Biological process=trehalose biosynthetic process
  Homolog annotation: Hit_ID=Q9ZR75; Match level="QueryCoverage=86%, HitCoverage=84%, E-value=0.0, Identity=51%"; Hit description=SL-TPS/P
  Pfam annotation: Domain name=Glyco_transf_20; Domain location=116 -535; Score=558.7; E_value=5.7e-165; Accession=PF00982.11; Description=Glycosyltransferase family 20
  Pfam annotation: Domain name=Trehalose_PPase; Domain location=569 -816; Score=219.3; E_value=8.6e-63; Accession=PF02358.7; Description =Trehalose-phosphatase
  Pfam module annotation: Pfam domain module=Glyco_transf_20::Trehalose_ PPase; Domain location=116-535::569-816
MSQVGIFCCLRYNLLVLPGVILSITAKRMPGNNYNCVPLTPRSRLERLLRERELRKSFKLIQPTEEARDGSKEGEQFYGDSCISENEILGIHKEEEVTETSFTDRSQRQDERPSKQRLLVVANRLPVSAVREGVESYRLEISVGGLVSALLGKKILSPCINCFFGVKEFDTRWIGWAGVNVPDDVGQRALTKALAEMRCIPVFLDEEIVNQYYNGYCNNILWPLFHYLGLPQEDRLATTRTFQSQFDAYKKANQMFADVVNKHYEKGDVVWCHDYHLMYLPKCLKEYNEQMKVGWFLHTPFPSSEIHRTLPSRSELLRSVLAADLVGFHTYDYARHFVSACTRILGLEGTPEGVEDHGKLTRVAAYAVSDSILIMTMFYFLGVKLQFPIGIDSDRFIQALELPEVQEHMKELKERFAGRKVMLGVDRLDMIKGIPQKLLAFEKFLEENSLWRDKVVLLQIAVPTRKDVPECAAQSLGAGAILVNPWNITEVAASIGYALEMSADEREKRHQFNFKHVETHTSQEWAATFVSELNDTIVEAQLRTRQVPPLLPNKVAVDCYSKSNNRLIILGFNATLNEPVGRAGQIRELELKLHPNMKEPLKKLTDDPKTTIVVLSGSSRAVLDKNFSEFNMWLAAENGMFLRRTSSEWMTTMPENLNMDWVDSVKHVFEYFTERTPRSHFELRETSVVWNYKIQARDLLQHLWTGPISNAYLDVVQGGRSVEVRTVGVSKGAAIDRILGEIVHSKGMKTPIDYVLCIGHFLAKSGSNPNDRTSIDKDEDVYTFFEPELPSESPPLPRAMLSKSNSYRPSSLPKLPATKTGSKAAKYRKQRSLSNIEKREIDQWRPKYRDKIALHEGSSVLDLNGDNYFSCVVGRKRSSARYLLKTSDDVVNLLSDLAEHSSSPT

SEQ ID NO: 129640 - protein, 180 aa, Glycine max
  Coding DNA Sequence Number=SeqID_12862
  Gene Ontology: Mol. function=hydrolase activity, hydrolyzing O -glycosyl compounds; Biological process=carbohydrate metabolic process
  Homolog annotation: Hit_ID=Q8RZK0; Match level="QueryCoverage=44%, HitCoverage=28%, E-value=5e-30, Identity=74%"; Hit description=Beta 1,3-glucanase-like
  Pfam annotation: Domain name=X8; Domain location=89-170; Score=153.7; E_value=4.7e-43; Accession=PF07983.3; Description=X8 domain
MNARSCHLVLLFSLCLFFGSGLGTTKILTNDKKQEIFSSSELGTQLDDVPIVGNPNTPPQTPDTSGQNPTAPNTNPTTPTTTPTSSGGQWCVAKQGASDADLQVALDYACGIGRADCSAIQPGASCYNPNTVRDHASYAFNNYYQKNPIPNSCVFGGTASLTSNDPSKNFFKLKSMIIFL

SEQ ID NO: 129641 - protein, 286 aa, Glycine max
  Coding DNA Sequence Number=SeqID_12863
  Gene Ontology: Mol. function=hydrolase activity, acting on ester bonds; Cellular component=nucleus; Biological process=lipid metabolic process
  Homolog annotation: Hit_ID=Q1SQ99; Match level="QueryCoverage=95%, HitCoverage=78%, E-value=1e-99, Identity=63%"; Hit description =Lipolytic enzyme, G-D-S-L
  Pfam annotation: Domain name=Lipase_GDSL; Domain location=17-265; Score=58.2; E_value=2.7e-14; Accession=PF00657.12; Description=GDSL -like LipaseAcylhydrolase
MAWRNSSKTVICPELLGLENFIPPFANTGVSDILKGVNYASGAAGIRNETGTHLLQNHKVIVSQITQKLGGPDQAQHHLNKCLYYVNIGSNDYLNNYFLPEHYPSSRTYSPEQYAVALVQEYARNLKDLHALGARRFALIGLGLIGCIPHEISIHGENGSICVDEENRAALMFNDKLKPVVDRFNKELPDAKFIFINSAVISLRDSKDFNTSKLQGISEVAVCCKVGPNGQCIPNEEPCKNRNLHVFFDAFHPSEMTNQLSARSAYNAPIPTLAHPMDISHLVKLK

SEQ ID NO: 129642 - protein, 244 aa, Glycine max
  Coding DNA Sequence Number=SeqID_12864
  Homolog annotation: Hit_ID=Q1SL67; Match level="QueryCoverage=37%, HitCoverage=19%, E-value=2e-14, Identity=59%"; Hit description=TGF -beta receptor, type I/II extracellular region
MGFGYDNSSDTYKVVAVVGDGEYSPETAEVRVHCMGDNCWRKVVSWNGFPKLMTVQGCHGGHYVSGHLNWVAAVKSRADTRYLSFVICSFDLRNETCRYLLPLECLYTTLVMLDLYPDLGEFGVVESWISLLNISCLQLHLRDPSLRMSPLIMTENGDVIFTASSLLLSLATPFLLTSMIAAIAMEMEESIRPTPMRCKCVMPVGIPPTGMTGRDVKMFCDPCVQWWSLVEQRRFGVVLSKGSL

SEQ ID NO: 129643 - protein, 119 aa, Glycine max
  Coding DNA Sequence Number=SeqID_12865
MDLCFHCFLKEVQKNGNAMELCLCLPLLLPLLFTSSDLNHNRVVRCHHHHHTDNIIMVPSTPYQQHHHMLKQHPYQRRKASEVEVVRIGSLEGVACANLEFGTTHNIVRTMMVLCVGDN

SEQ ID NO: 129644 - protein, 50 aa, Glycine max
  Coding DNA Sequence Number=SeqID_12866
MTISDSFIVETQSCLGKTMIPDSLTVGFFRNFDTLFETQFRTLSPLGFAR

SEQ ID NO: 129645 - protein, 134 aa, Glycine max
  Coding DNA Sequence Number=SeqID_12867
  Gene Ontology: Mol. function=transporter activity; Cellular component= membrane; Biological process=oligopeptide transport
  Homolog annotation: Hit_ID=Q1SQ95; Match level="QueryCoverage=99%, HitCoverage=31%, E-value=2e-44, Identity=55%"; Hit description=TGF -beta receptor, type I/II extracellular region
MATLSLAENFVSYFTGIIHYELADAANIATDYMGVSYMLSIVVAGLALLTVQAHMGSLTPPICNVAGLKASLPSHGAPQFDERDPKEAIQMSSFFNGLLLAVCIGGAVTLTSNVYIQDCYGWDWGFGISTGALV

SEQ ID NO: 129646 - protein, 600 aa, Glycine max
  Coding DNA Sequence Number=SeqID_12868
  Gene Ontology: Mol. function=protein serine/threonine kinase activity; Cellular component=membrane; Biological process=protein amino acid phosphorylation
  Homolog annotation: Hit_ID=Q9FXF2; Match level="QueryCoverage=97%, HitCoverage=57%, E-value=0.0, Identity=57%"; Hit description =Receptor-like serine/threonine kinase
  Pfam annotation: Domain name=Pkinase; Domain location=291-560; Score =164.4; E_value=3e-46; Accession=PF00069.15; Description=Protein kinase domain
  Pfam annotation: Domain name=Pkinase_Tyr; Domain location=291-560; Score=164.8; E_value=2.2e-46; Accession=PF07714.7; Description =Protein tyrosine kinase
  Pfam module annotation: Pfam domain module=Pkinase::Pkinase_Tyr; Domain location=291-560::291-560
MSILDRRGLLPCSKISNCPAYSHCFHVNCGGKNVKVMENDENIQYVGDDGALGSSAAKYFIDYENHWGFSSTGDFLDDGDYLNSRYIRSLPSSNLPELYKTARVAPISLTYFRYCMENGKYTVKLHFAEIQFSNDNTYSSLGRRLFDIYVQGALFRKDFNIEGETHVAQKPYILSLYNVNVTDNILEIQFYWAGKGTTRIPVSGVYGPLISAFSIVSDSKPCTDQKNVRHKIIVGVGFGVTALCLVIIIVGIFWWKGYFKGIIRKIKDTERRDCLTGTFTLKQIRDATEDFSPDNKIGEGGFGPVYKGQLSDGTLVAVKQLSSRSRQGNGEFLNEIGMISCLQHPNLVKLHGFCIEGDQLILVYEYMENNSLAHALFSSKDQLKLDWATRLRICIGIAKGLAFLHEESRLKIVHRDIKATNVLLDGNLNPKISDFGLARLDEEKTHVTTRIAGTIGYMAPEYALWGYLSYKADVYSYGVVVFEVVSGKNYKNFMPSDNCVCLLDKAFHLQRAENLIEMVDERLRSEVNPTEAITLMKVALLCTSVSPSHRPTMSEVVNMLEGRISIPNAIQQPTDFSEDLRFKAMRDIHQQRENHSLSTS

SEQ ID NO: 129647 - protein, 607 aa, Glycine max
  Coding DNA Sequence Number=SeqID_12869
  Gene Ontology: Mol. function=transporter activity; Cellular component= membrane; Biological process=oligopeptide transport
  Homolog annotation: Hit_ID=Q1SQ95; Match level="QueryCoverage=96%, HitCoverage=99%, E-value=0.0, Identity=74%"; Hit description=TGF -beta receptor, type I/II extracellular region
  Pfam annotation: Domain name=Cation_efflux; Domain location=60-338; Score=-120.7; E_value=0.016; Accession=PF01545.11; Description =Cation efflux family
  Pfam annotation: Domain name=MFS_1; Domain location=50-544; Score =3.6; E_value=0.00022; Accession=PF07690.6; Description=Major Facilitator Superfamily
  Pfam annotation: Domain name=PTR2; Domain location=112-528; Score =333.3; E_value=4.3e-97; Accession=PF00854.12; Description=POT family
  Pfam module annotation: Pfam domain module=Cation_efflux::MFS _1::PTR2; Domain location=60-338::50-544::112-528
MDENRVVDGNVERMQREERADELVVHGKVDWKGRKALKHKHGGMKVSLLVLAAFGMENLATLSLAVNFVSYFTGIMHYELADAANMVTNYMGVNYMLSIVVAVLADTWIGRYKSVVISGIVESLGLALLTIQARVGSLTPPICDLYNVRDAHCEKLSGKQEAFLFIGLYLLAFGSAGLKASLPSHGADQFDERDPKEAMQMSSFFNGLFLALCVGGAVSLTFNVYIQDNNGWIWGFGISTVAIVLGTIIFASGLPLYRIHAAHSTNGILEIIQVYVAAIRNRNLPLPANPIQLYEIQQDKEAAVEIEYQPHRDIFRFLDKAAIKSRSDEQPENQETPNPWKLCRVTQVENAKIILSMLPIFCCSIIMTLCLAQLQTFSIQQGSTMNTRIAKHFNIPPASIPIIPVAFLIVFVPFYDRICVPFLRKFTGIPTGITHLQRIGVGLILSSISMAVAAIIEVKRKGVARDNNMLNALPVLQPLPISIFWISFQYFVFGIADMFTYVGLLEFFYSEAPKSLKSTATCFLWCAMALGYFLSSIMVKIVNSATKNITASGGWLQGNNINRNHLNLFYLLLSILSLINFFVYLFVSKRYKYRPQHPAVTGGNSEE

SEQ ID NO: 129648 - protein, 93 aa, Glycine max
  Coding DNA Sequence Number=SeqID_12870
MHRQEYQQVWSEGGIILIFTLKLSLCLERTIFLTGNMLSGNLPESLLKDGSSLDLSYNNFTWQGPDQPACRDYLSECKVFRNNYSCAFVTYTP

SEQ ID NO: 129649 - protein, 113 aa, Glycine max
  Coding DNA Sequence Number=SeqID_12871
MVEKGVVNVNFDDEFHLELGTTWKFFDNKMHVTSDQLSFYGLACYMCRSYTLRSNTSEEQLIFDLEIEKTLKKNRSKRSHNKEIWPKRPFLQGLLLRIMPHTLGLCTKTQFQG

SEQ ID NO: 129650 - protein, 154 aa, Glycine max
  Coding DNA Sequence Number=SeqID_12872
MTIEESIHVSFDESDVISPRKDVLDDVSDFLEEMHTHERDSKRKRDESNEDSQDYETKVNNDLPKEWKASRNHPFDNIISNISKEVAFELPQGVCFCLIDIQCLIVIIKKGEIVEAKLSKFILMMPKTQVKNQDSSEDSREDSRYARTSRKSSR

SEQ ID NO: 129651 - protein, 123 aa, Glycine max
  Coding DNA Sequence Number=SeqID_12873
  Gene Ontology: Cellular component=integral to membrane
  Homolog annotation: Hit_ID=P25743; Match level="QueryCoverage=72%, HitCoverage=41%, E-value=3e-39, Identity=94%"; Hit description =UPF056 membrane protein yhcE
  Subcellular localization annotation: CTP_CleavageSite=56; ConfidenceScore=5.38e-01
MVELIAPGPAISGSASGTTPMLSRIAVSDFSCLFCLSSPSLPLIIDMAMVTTRMPPAMRKESIEIPNRCRIPSPRNSEVQRIIATARFAVRGNLSPSELNPVTQVILAEKHFLVSNGTGIAIT

SEQ ID NO: 129652 - protein, 59 aa, Glycine max
  Coding DNA Sequence Number=SeqID_12874
MSRLLTDTHLEDYYTGLNWLSTKRDFSGVKRVETTSMRRMKVNSRSLTTLGYYINNFVI

SEQ ID NO: 129653 - protein, 154 aa, Glycine max
  Coding DNA Sequence Number=SeqID_12875
MWLPPKPWNEKPRGLVGKNTAGTNSEGLCRAYSRSKRSLSQRLCKTETNMLAIITKYQEELNLAATHEHRVADEYAHVYTEKEARGRVIDSLHQEAMMWMDRFSLTLNGSQELPRLLAKAKAKADTYFAPEEIHGHLGYCQHMIDLMAHIIRNR

SEQ ID NO: 129654 - protein, 204 aa, Glycine max
  Coding DNA Sequence Number=SeqID_12876
  Homolog annotation: Hit_ID=Q9FFD9; Match level="QueryCoverage=100%, HitCoverage=49%, E-value=9e-25, Identity=34%"; Hit description =Genomic DNA, chromosome 5, P1 clone:MQK4
MRQVLNFDYTKQSPVAFVPVMSCDGVGGAHDSEKGIAVREWMGRRVIPANQKVQVTVSLVVPESEYNTNLGIFQIRVDFLSSDGKTIWSSNQPCMLKFTSEPIRLITTFLKIVPLVTGYISETQTLNVKMRGFVEGDVPTSCLKVTLEQRAEYSPGAGIPQMYDSSVVIESELPLFKRIIWHGKICIFLWITMMAFMMELLLVL

SEQ ID NO: 129655 - protein, 169 aa, Glycine max
  Coding DNA Sequence Number=SeqID_12877
MVHLNFYRNRSRRDELYGEKWSERTRVVKKEEVEAETTLASFNDSACFIQRHWLPPRHRQTTIVLGHTYPPPSHTVTPIHHTTTWSHVSTLVLGRGRRSELVLPMTQKIHAAEHLPSCSCLTLSLLLTLEFVDLVIMLGRLKIPYVFLTFLHSTDLSLHFFLDDDMKEI

SEQ ID NO: 129656 - protein, 169 aa, Glycine max
  Coding DNA Sequence Number=SeqID_12878
MCHLTAYVCVYYDGQICNTNEGTTFVSNNTKTFMVDKVITFTQLLELVHQKLNIDPEQHIQHLHFRCPIFESGQRYMYTSFILRDDADVRQMFNIFYNNPSLPFVELFAIICHNNDPPGNQHGSTSNLEDLGEYETCWLKNHDSDTDSSSGPEGSNLSPSHEPIFKRDW

SEQ ID NO: 129657 - protein, 124 aa, Glycine max
  Coding DNA Sequence Number=SeqID_12879
MVVCARLTKSIMVYSYGAYLFLKDYDNLSTRVKKSFPRRYKNLPGYNNLSSRVKLIYSRDITTYPPEGYNNLSTKLKLVCSGDIPSYPPELALSFRVGTKPYSGTKPGGDNLSWEWAPSPGGGQ

SEQ ID NO: 129658 - protein, 90 aa, Glycine max
  Coding DNA Sequence Number=SeqID_12880
  Gene Ontology: Mol. function=transporter activity; Cellular component= integral to membrane; Biological process=transport
  Homolog annotation: Hit_ID=Q6QIL2; Match level="QueryCoverage=93%, HitCoverage=31%, E-value=1e-38, Identity=91%"; Hit description=NIP2
IGELAGIAVGSTVLLNVMFAGPITGASMNPARSIGPAIVHKEYRGIWIYLVSPTLGAVAGAWVYNSIRYTDKPLREITKSASFLKGVASR

SEQ ID NO: 129659 - protein, 59 aa, Glycine max
  Coding DNA Sequence Number=SeqID_12881
MAKAHSIHDVHHVDDTTKEVFQQPQEAAVDAQGFLGESRDTSVLTAYVDHVVVIVWNGE

SEQ ID NO: 129660 - protein, 105 aa, Glycine max
  Coding DNA Sequence Number=SeqID_12882
  Gene Ontology: Mol. function=DNA binding; Biological process=DNA integration
  Homolog annotation: Hit_ID=Q1SKC8; Match level="QueryCoverage=56%, HitCoverage=14%, E-value=4e-15, Identity=60%"; Hit description =Integrase, catalytic region
MVYEKSCHLPVEMEYKAYWALKFLNFDETASREQKRLQLLEMEEIRLIAYESSKLYKDRIDRKRLRNFFAIVYMLSADLVLSAQSSRAKPSLLTLSAQTPDWLAE

SEQ ID NO: 129661 - protein, 63 aa, Glycine max
  Coding DNA Sequence Number=SeqID_12883
MNALGGATLFCKITRAPNIFMICVHRDSLGVPMNPKRIKVIPEWPAPPSVLREKAQSFKNLGI

SEQ ID NO: 129662 - protein, 66 aa, Glycine max
  Coding DNA Sequence Number=SeqID_12884
MTSYGGELLLDSSSPSFSTPLPFIFQEAKESVDEEDPRPTSSNRAYITGPLFKFFLQYPNSAQDKL

SEQ ID NO: 129663 - protein, 132 aa, Glycine max
  Coding DNA Sequence Number=SeqID_12885
MIVVVDTTAIVHDDDDHGGGGGEYSNDHTSKGGDNHGDGAHPEYSGKAIASGGSNPSELGSNHLPHFLIKWCEGAEFEGFNTLIAHKSLKISEEKKKEGKNTSRDSSITLQRCFRDQICESFTMPLPNVCYN

SEQ ID NO: 129664 - protein, 164 aa, Glycine max
  Coding DNA Sequence Number=SeqID_12886
MEVDLGQSGVWVIGAPTPPPEPSLRVGELGLPGVSVGTISRRSNTREREMASQQYDSQGPQTQRGANRDCRAWIKSDQDVNWSLLVLHWNHAKRQAFMLQCRMIFEELIDLKDPTKREKSQKREWRMKMKGDGELRDSVLQKIGVGFGSRGLCHGYLSMKAPKR

SEQ ID NO: 129665 - protein, 214 aa, Glycine max
  Coding DNA Sequence Number=SeqID_12887
  Gene Ontology: Mol. function=calpain activity; Cellular component =intracellular; Biological process=proteolysis
  Homolog annotation: Hit_ID=Q1SPD3; Match level="QueryCoverage=94%, HitCoverage=45%, E-value=2e-25, Identity=36%"; Hit description =Cyclin-like F-box; F-box protein interaction domain
  Pfam annotation: Domain name=F-box; Domain location=1-48; Score=46.5; E_value=8.9e-11; Accession=PF00646.23; Description=F-box domain
MAMAQLPQDLIEEILSWLPVKSLMRFRCVSRTWNSLIFQAHFVKLNLQRSSRNTHVLLRCQINTVFEDMRDLPGIAPCSICSLLENPSSTVDNGCHQLDNRYLFIGSCNGLVCLINMVARGEFSEYRVWFCNLATRIMSEDSPHLCLRTCNYKLWWYQVKCGFGYDDRSDTYKVVLVLSNIKSQNREVRVHRLGDTHWRKVLTCPAFPILGEKC

SEQ ID NO: 129666 - protein, 87 aa, Glycine max
  Coding DNA Sequence Number=SeqID_12888
MKCKDWTSSKLLAYREFAKRNLQWLSARKHPEEDELSSLLSAPLQVIKRTASDHPLSQTSVLSQNPLMRAQRYRYALSARARTRPPI

SEQ ID NO: 129667 - protein, 80 aa, Glycine max
  Coding DNA Sequence Number=SeqID_12889
MLTSPGRVQMTTLVSACQSGLGSLNDGVRITERCLRMLPDSWVMIAKGGEVDKSEAFAPTCPQFVMRNSDLRSSFFVRLK

SEQ ID NO: 129668 - protein, 199 aa, Glycine max
  Coding DNA Sequence Number=SeqID_12890
  Gene Ontology: Mol. function=nickel ion binding; Biological process =nitrogen compound metabolic process
  Homolog annotation: Hit_ID=P18318; Match level="QueryCoverage=92%, HitCoverage=82%, E-value=5e-65, Identity=65%"; Hit description =Urease accessory protein ureF
MVAQRNDQLLRGLLPKRHQLDARHYRALDPAIAETQGQLAHANAPAYAEPRHAAELALHKQRLPPGRAVRLPAFNETRKGCTAIALFFPQFTGFPAGEKVSRPAFCCRKVALFTGPVQPDKQRQVNAEKALLHLLRLPAFKGVGIRDPACFHGPLQPLRPGKRPDRQAAAGELHQAQPLAGMLHQLISASRAETISPPP

SEQ ID NO: 129669 - protein, 144 aa, Glycine max
  Coding DNA Sequence Number=SeqID_12891
MPISPCRCIGWDRAHKTPSGPEEVQQGPGVSSSGYGPLSVLQGVRSPNEESHPQRHPVDPEKSNRALGFPALVTGLCSPTGCPFPLARSHHHRDRACKTPSGPEEVQQGLGLPVTSSKGIRPPTNRAFIKKYCVSRQAQGETPQ

SEQ ID NO: 129670 - protein, 299 aa, Glycine max
  Coding DNA Sequence Number=SeqID_12892
  Homolog annotation: Hit_ID=Q12HY0; Match level="QueryCoverage=65%, HitCoverage=31%, E-value=8e-07, Identity=25%"; Hit description =Peptidase S8 and S53, subtilisin, kexin, sedolisin precursor
MAQMKKSILSLLICAAVASSAYAEAATKVEFAQEGVTYTAIVVKLKPGKPLLKATNTATTTASDELTLGDPSLVANKMFRSNKLRSTQSDELTKLDATYGFDRYMRIDIPENKSQDKAFINHAIAELEQNPKVELVYAEAMPVSLDEYQHDNTTPPLLRQSAGNATLTATAVPDFRNLQDYLKSSAEKRPGYYMGGVNRDGVSGYAGSDGTGVTIISTENCAWNTSHVNLPAMALSQGDRTWKPGCGDHDSSSVGIMAGKDIGSGIRGFAWNSKVGYAAWQTNNLYNMIPLLKAGDVVQ

SEQ ID NO: 129671 - protein, 61 aa, Glycine max
  Coding DNA Sequence Number=SeqID_12893
MGSSQAPWLKKRFYQVKIRSLGVVSLKELGQLMGQLQRQAFRKAYDAAEDKGEEVRGGAIH

SEQ ID NO: 129672 - protein, 100 aa, Glycine max
  Coding DNA Sequence Number=SeqID_12894
MWQTKTYIQKAYWTIEITQDMLGAPEPLKLPPSTKVPLNACGHHMIALFNYGMTSLWKATSIMEMKSPFTIDIMKKFGKLSLEDKRIGMIVILIKVSFVV

SEQ ID NO: 129673 - protein, 438 aa, Glycine max
  Coding DNA Sequence Number=SeqID_12895
  Gene Ontology: Mol. function=nucleic acid binding
  Homolog annotation: Hit_ID=Q1T493; Match level="QueryCoverage=73%, HitCoverage=70%, E-value=8e-31, Identity=26%"; Hit description =Nucleic acid-binding, OB-fold, subgroup
  Pfam annotation: Domain name=DUF223; Domain location=77-172; Score= -13.5; E_value=0.052; Accession=PF02721.5; Description=Domain of unknown function DUF223
  Pfam annotation: Domain name=Rep_fac-A_C; Domain location=272-405; Score=-67.7; E_value=0.062; Accession=PF08646.1; Description =Replication factor-A C terminal domain
  Pfam module annotation: Pfam domain module=DUF223::Rep_fac-A_C; Domain location=77-172::272-405
MEIPRIPMPEATTAVHFLGFLVLWHMEISKMPVPEAVAAVYFIGVCFCLLRSSVCYEKSSQVCYKKSRCLLLFAAFLGLLREVKGDAIHVVCKQYQLKFWKTDLKENLTYVMHNFKVTKNDGQFRVCDLEYKLSFTEVTIVRQSNMEDLPFRKFRFVDFSTAIVGDFETGLLVDIIGVVDEVLFRYVSSKNTSGQVLSCTLWENYCLQFLSYLSEVEDERPIVILLTHARIKEGQGSYATSISNSLKASKLMTNELVFEIQEFKGRLLDLGIEVRSVLTSGGQGSSQVSACSQCHKKTDIATVSFTCPCGKDNDQVVLRYRIEVMVDHKGKQMKFLLLDCECVELIGQSADEVNMLKIADGDADLNASPQTLDRLLGCFLAFKVKVHPRFRNVVVLEYSDESDLINVVLDMLPDTEPCCKIQSLVLESTDATELESIN

SEQ ID NO: 129674 - protein, 480 aa, Glycine max
  Coding DNA Sequence Number=SeqID_12896
  Gene Ontology: Mol. function=nucleic acid binding; Cellular component= mitochondrion; Biological process=DNA integration
  Homolog annotation: Hit_ID=Q1RWP6; Match level="QueryCoverage=100%, HitCoverage=38%, E-value=1e-138, Identity=47%"; Hit description=Zinc finger, CCHC-type; Polynucleotidyl transferase, Ribonuclease H fold
MEPRTFHQAIKHTCWQHAMQQEFQALMRNNTWSFVPCPTNANIVGCKWIFKIKRRVDGSIEHHKARLVAQGFKQEAGIDYFDTFSPVIKPTTIRLVLSVALSHGWCRRQLDINNAFLNGDLTEIVYMQQPRGFEDKSNPSHVCRLHNAIYGLKQAPRAWFNKLKSYLIQHGFKACRSDTSLFVHYSSNSIIYILVYVDDLILTGTNAAHIQSFITKLHVVFALKDLGSLHYFLGLQIHRTSTGLTLSQENYIHDILCRSKMSEASSISTPADPGSRLHSEGAPSEDPKLFRRVVGSLQYVTITHPDITYAVNRVCQFMHSPTTLHWQATKRILRYLKGTSTHCLHFKPTQAQSLLAYSDAGWLSDPKDSRSQYSTESEYRSLAYTAAELIWIQQLLTDLYMPLIRPPLLLCDNVGAIFMTKNPVIQTRSKHIALDFHFIRELVESNSLHVRHISSVDQMADIFTKALSKDRIFQLRSKLQ

SEQ ID NO: 129675 - protein, 320 aa, Glycine max
  Coding DNA Sequence Number=SeqID_12897
  Gene Ontology: Mol. function=nucleic acid binding; Cellular component= chromatin; Biological process=DNA integration
  Pfam annotation: Domain name=zf-CCHC; Domain location=289-306; Score =15.1; E_value=0.0032; Accession=PF00098.13; Description=Zinc knuckle
  Pfam module annotation: Pfam domain module=Retrotrans_gag::zf-CCHC; Domain location=97-186::289-306
MATSNLSLLALANTTTSNLNLQLPSINIKLDRDNYSLWRSTIISALETFDLESFILNPSPPLETRILTTSDGITTTETNPEFILWRKRDRFVLLWLKSTLSEQALSLVVRATSSHMAWTAFGKTFQAQTQARRMAMKSQLQSLTKGSLSMLEYIERKRSISDSLAENLHPILDEDLVGYIPNGLDPSYGPFTTTFMMKSEDVLVDDLAGLLLQEEAQLEHDHAHQPVIVTQPPIVISQAPNSAPLLPTPTAYTTNLSTSRPTSNTYQPYGAGQSLDHTFDNRRRPNIRPLCQICNKSGHEAIDCWHRANQTAYPSRRPNP

SEQ ID NO: 129676 - protein, 87 aa, Glycine max
  Coding DNA Sequence Number=SeqID_12898
MDDVKQGYFDVYAIKGQQTKRLALLVTDDDSELKLLWVESEDESEVMLVSIDSDDDLGVRQELAKICEWGNINEFGNCPALNAGSKD

SEQ ID NO: 129677 - protein, 121 aa, Glycine max
  Coding DNA Sequence Number=SeqID_12899
MPLHQPGMEIGREREKLFAVREMKGNKKIVQIFLPTPASKFVYGSKKYITLQRGLGKRTQWQVTIHDGVPSIADPWFQYLHEKKLMAGDEVVFYFRFDDHAWELLIRKDIEWDEEYIHLDD

SEQ ID NO: 129678 - protein, 168 aa, Glycine max
  Coding DNA Sequence Number=SeqID_12900
  Gene Ontology: Mol. function=RNA-directed DNA polymerase activity; Cellular component=signal recognition particle, endoplasmic reticulum targeting; Biological process=RNA-dependent DNA replication
MKVEQLFACHHTRRGTSPSYYERELMDKLQRLRQGSVSVEEYRQQIKLLVLRAGLREEEKISIVRFLSGLNMDVRDKVELLPYRDLDDLVQLCIMIEQQLKRKPTSKFYGSHSYPKKDQGQGILGTSPSKPKDDKGKTIENQPLKASIQEKTNSIKCFKCLERGHIVF

SEQ ID NO: 129679 - protein, 149 aa, Glycine max
  Coding DNA Sequence Number=SeqID_12901
  Pfam annotation: Domain name=zf-CCHC; Domain location=77-94; Score =14.5; E_value=0.0041; Accession=PF00098.13; Description=Zinc knuckle
EHEMKLQRLNQNEETDKKKRSIALKAFSSMQEENEEEDEEDFSLFVKKFQKFVKKRRIERRQNFNNGRKSQEDSQILRCYKYNQLGHIKANFPSNEEWPEKSDKKRYEERRTKKAYIAWDDNDSSDGSEKEINLLTKDYESDENISQED

SEQ ID NO: 129680 - protein, 82 aa, Glycine max
  Coding DNA Sequence Number=SeqID_12902
MGVKYLEAVKRRLHAIKQWSPNEIRAINSWGSGLDGGGYMNSARQSIHGAPDSDLMVEDARTALRNQFVGLRTRWWRMHEQR

SEQ ID NO: 129681 - protein, 136 aa, Glycine max
  Coding DNA Sequence Number=SeqID_12903
  Gene Ontology: Mol. function=oxidoreductase activity
  Homolog annotation: Hit_ID=A0AXN7; Match level="QueryCoverage=99%, HitCoverage=37%, E-value=1e-33, Identity=50%"; Hit description =Alcohol dehydrogenase GroES domain protein
LTGTAEIDIAAMKHMAGGPIDAVLDFLPPSAQASVARNAIMSVRPYGRAVLMGGVGMLGGDDLSLPYPWIMRNLITVKGQWMYEPSAVHTLCGLIRAGLLDLSHYDVTEFPLERVNDSVAYAAKNSGPFKLTVVRP

SEQ ID NO: 129682 - protein, 97 aa, Glycine max
  Coding DNA Sequence Number=SeqID_12904
  Homolog annotation: Hit_ID=Q5PEL9; Match level="QueryCoverage=62%, HitCoverage=82%, E-value=7e-12, Identity=53%"; Hit description =Possible lipoprotein
  Pfam annotation: Domain name=DUF903; Domain location=1-30; Score=1.3; E_value=0.0015; Accession=PF06004.3; Description=Bacterial protein of unknown function (DUF903)
  Pfam annotation: Domain name=DUF903; Domain location=32-95; Score =62.6; E_value=1.3e-15; Accession=PF06004.3; Description=Bacterial protein of unknown function (DUF903)
  Pfam module annotation: Pfam domain module=DUF903::DUF903; Domain location=1-30::32-95
AIKTTDGRTIVTDGKPQVDSDTGLVSYKDAQTAIVALSALTGCTRTSYAIHTNDGRTIVSDGKPQEAESGLLGYVDANGVKQQINKADVKEVSEIPH

SEQ ID NO: 129683 - protein, 342 aa, Glycine max
  Coding DNA Sequence Number=SeqID_12905
  Gene Ontology: Mol. function=transferase activity, transferring nitrogenous groups; Cellular component=intracellular; Biological process=regulation of transcription, DNA-dependent
  Homolog annotation: Hit_ID=Q4J0C1; Match level="QueryCoverage=99%, HitCoverage=74%, E-value=1e-123, Identity=66%"; Hit description =Regulatory protein, GntR:Aminotransferase, class I and II
MAAAEAGGQLQVGQRFDPVVACSDVATARSGRQGLGEAADVDHPRQPIQRSKARCRLQFEVGEDVVLDDDQFAAFGQPQQPMRGAGREHCAGRVVQARVGDVQPWRMRLKCLRERLQVRAAVRVRHADGLHLVCLEQRVVIEVARIIHQHAVAGLEQETADQVDRVCPGFGQQDLLHRCIDAQRGAAPLQQLAQCGQPEWAGVVDQVHCIGTRQPTQAAAHAIVIQPVTGQPAAPRLEVARRGFQRLPRHPQRVHRAVQPGFHLGQCQRCGRPIDVKAGTGPRADQPFGSEAFVGLDHGGDRHAHRCRLRAHRRQAGAGAIHPRGDAVADGLDDRFDAGKGA

SEQ ID NO: 129684 - protein, 89 aa, Glycine max
  Coding DNA Sequence Number=SeqID_12906
  Gene Ontology: Mol. function=ferric-transporting ATPase activity; Cellular component=membrane; Biological process=transport
  Homolog annotation: Hit_ID=UPI00006DB189; Match level="QueryCoverage =98%, HitCoverage=14%, E-value=4e-27, Identity=61%"; Hit description =COG0488: ATPase components of ABC transporters with duplicated ATPase domains
LGFEPAQCDLPVDGVFDGGTVQRGRFLRHVRHAPTGGVIEVALVGVQRAAQQAEQARLAGTVGAHQADLVSGVEQQVDLVEQGLDAAHQ

SEQ ID NO: 129685 - protein, 213 aa, Glycine max
  Coding DNA Sequence Number=SeqID_12907
  Gene Ontology: Mol. function=nucleic acid binding
  Pfam annotation: Domain name=zf-CCHC; Domain location=47-64; Score =9.3; E_value=0.029; Accession=PF00098.13; Description=Zinc knuckle
MWKGSRNLTSVLPPEYKRGLGKPKKIRRREPDKESNPTKLRRKTTKYQCSRCGKSSHNSRRCPLPSTVVEEPPASNDGSPVDASTITGRNQVDWNQDATIANQGPLVQSQMSENESSANFEKPQVNNQRKLGTTSKHDKASKTSNGIKEKTQTSTKTRKTRKQMTPIAPTYRKANSTPSTNLAPSPSISTSTPTPSKLQPPSSTISGEIQLIH

SEQ ID NO: 129686 - protein, 86 aa, Glycine max
  Coding DNA Sequence Number=SeqID_12908
KVGRSTTYKVKTYRPKNTCGRAFKNINATSKWVSKVAVESLRTRNDVKLAQIIDDVRFKYSIGICLVVAWKARMIARAIVDRDVVR

SEQ ID NO: 129687 - protein, 82 aa, Glycine max
  Coding DNA Sequence Number=SeqID_12909
MEAVGASSSSIGSNGVEVKNCRFWVRDDDLKKSLNQDFESNGGVGSNVGNMGCGSNMDVNHLLSQMEELKLRIATNEERICL

SEQ ID NO: 129688 - protein, 304 aa, Glycine max
  Coding DNA Sequence Number=SeqID_12910
  Gene Ontology: Mol. function=methyltransferase activity; Biological process=metabolic process
  Homolog annotation: Hit_ID=Q9LDW4; Match level="QueryCoverage=94%, HitCoverage=98%, E-value=5e-86, Identity=59%"; Hit description =Arabidopsis thaliana genomic DNA, chromosome 3, P1 clone: MJK13
  Pfam annotation: Domain name=Methyltransf_11; Domain location=120 -235; Score=62.6; E_value=1.3e-15; Accession=PF08241.2; Description =Methyltransferase domain
  Pfam annotation: Domain name=Methyltransf_12; Domain location=120 -233; Score=7.3; E_value=0.093; Accession=PF08242.2; Description =Methyltransferase domain
  Pfam module annotation: Pfam domain module=Methyltransf _11::Methyltransf_12; Domain location=120-235::120-233
MGKTSSREWTRIYLIYGMDQWQTFVFLLCQAVLFSVLSILYLLYFNDISHTFQSLLSIASVPCSAARFAAGFMGSVTALSALCLFYAAANFFYSAVPLHSEMAQHIVDTVNDWPTVRQVLDLGCCGRGILLNAVAARLKKEGSSGRVIGLSGQNKTELAATLRAAKVEGVEEYVTCRTGDATTLPFLDDSFDAVVSGTFVHTVGWGHAADVAAAERGRVVAEVVRVLKEGGVGVVWDLVHVPEYVRRLQEMKMEDIRMSERVTAFMVSSHVVSFRKPTHHVHGPPEVRKTVLGWEAKSNHANCK

SEQ ID NO: 129689 - protein, 113 aa, Glycine max
  Coding DNA Sequence Number=SeqID_12911
WLRRENQHIGNDDLIVFRRKLDIMKQHEFLWEPYTTTVMSVLPPICLVGSVLWCAVGPSQPLNIHGLTLKGKQDENWFQLLAPMISQWNNRADFRVDVYPRQEGLLSFNSDYM

SEQ ID NO: 129690 - protein, 255 aa, Glycine max
  Coding DNA Sequence Number=SeqID_12912
MEELFVAVLSMLLVAALIPLYLWKRRQDSKPPPPHRDEAPQAPRRETVARATATRRMRRRPTASGASTSADPPATQEESAGESDDEAAGGGYYEAKAPKKKETKKQEREARRQAEEAARESRQAKQDRYSEMRRLKDEEREAEERKLEEEARAQKAKEEEAAALEFEKWKGEFSVDDEGTLEEVQGNTEDLLGNFVEYIKKHKCVPLEDLAAEFKLRTQKNIRVLEWGDGRRQNGDARQMPHREQTLSIHNKEEA

SEQ ID NO: 129691 - protein, 71 aa, Glycine max
  Coding DNA Sequence Number=SeqID_12913
MERRGKPCSVSFSGCFGGQIEVRSFFENQFQEKGDDRPTLDGVPFKKIKEVDNTFGKEVWRGRSTTSFEGL

SEQ ID NO: 129692 - protein, 616 aa, Glycine max
  Coding DNA Sequence Number=SeqID_12914
  Gene Ontology: Mol. function=GPI anchor binding; Cellular component =anchored to membrane; Biological process=root hair cell differentiation
  Homolog annotation: Hit_ID=Q1SC56; Match level="QueryCoverage=99%, HitCoverage=91%, E-value=0.0, Identity=70%"; Hit description=Cobra -like protein 10
  Pfam annotation: Domain name=Phytochel_synth; Domain location=195 -376; Score=345.1; E_value=1.2e-100; Accession=PF04833.5; Description= Phytochelatin synthetase-like conserv
MTELDACNGVFLTYALLGRVKEYPHVTNTSKQAWAFKAEASLTNVGDEEVPGWKMFVGFQHREILVSADGAVLIDAGDFPAEVGNGTTLVGTATTDLKTAIDTAGDINQMSVRIQMTGTQFGLGAGATPMPKTIRLENDGFKCPAPSRRATRMFVCCKKDPKVKAKQAKKTKYPPRRKGDITIAYDVLQAFQNNYYAEVRIDNNHPLGRLDHWNLTWEWQKGEFIYSMKGAFARRKDPSECLYGLAGKFYKDMDFSNVATCEKKPTISDLPSERKEDEKVGKLPWCCRNGTVLPPIMDKNKARSMFQMQVFKIAPDSDNRTALTPPTKWNIDGVINPKYKCSAPVRVDPQVFPDPSGLRAITTAVASWQIVCNITKPKPQENRCCVSFSAFYNESAIPCNTCACGCDDTRKCSSRASPLLLPPDALLVPFVNRTVKARAWAKLKHLHVPSKLPCGDNCPVSINWHVSSDHKDGWTARITLFNWEEYSFDDWFTAIQLKRTFEDFHDVYSFNGTRIPGLKTVFLEGLKGLNYLSGETNGTHANDPRVPGKQQSVLSFSKKHIKDFDVTHDGFPTKVFFNGMECSLPPIRPAKSSGHKSSSISVIALIFTAFVTFLMI

SEQ ID NO: 129693 - protein, 348 aa, Glycine max
  Coding DNA Sequence Number=SeqID_12915
  Gene Ontology: Mol. function=Rab GTPase activator activity; Cellular component=intracellular; Biological process=regulation of Rab GTPase activity
  Homolog annotation: Hit_ID=Q1SC55; Match level="QueryCoverage=91%, HitCoverage=76%, E-value=1e-132, Identity=68%"; Hit description=TBC domain, putative
  Pfam annotation: Domain name=TBC; Domain location=41-251; Score= -71.2; E_value=0.017; Accession=PF00566.9; Description=TBC domain
MQYATWKEECRQLFPLVGSGRFVTAPVITEDGQPIQDPLVLKETSPAKGLAVHPQHNNSPSSMDAANNLEKVTDKAVVQWMLTLHQIGLDVVRTDRTLVFYEKQENLSKLWDILAVYAWIDKDVGYGQGMCDLCSPMIILLDDEADAFWCFERLMRRLGCESCNKPILEPSTISLNFLRGNFRCTESSVGVAAQLSNLASVTQMMWALEYDPDLFLMYEMPQSASEKAEGSKGKTKSIRQCGKYEREIVKSGAKNAEAPLPMSVFLVASVLKDKSAKLLQEARGLDDVVKILNDTTGNIDAKKACCGAMKLHKKYLKKYFRVIGGKANYMIASKLHLIIVINSSRCRG

SEQ ID NO: 129694 - protein, 305 aa, Glycine max
  Coding DNA Sequence Number=SeqID_12916
  Gene Ontology: Mol. function=isomerase activity; Biological process =cell redox homeostasis
  Homolog annotation: Hit_ID=Q1SC51; Match level="QueryCoverage=67%, HitCoverage=43%, E-value=7e-91, Identity=77%"; Hit description =Thioredoxin, putative
  Pfam annotation: Domain name=Thioredoxin; Domain location=211-301; Score=-17.2; E_value=0.0042; Accession=PF00085.10; Description =Thioredoxin
MISSSKIKSVDFYSCNSIRFAVVMHLIKVFKNDRSYGFSSSSLILWEIANNCGYITVGHSRDLEVAAENTIVDMGLPVSSVYRKIPRDLTEASLSGAGLSIVAALAMIFLFGMELNSYLSVSTSTQVIVDKSSDGDYLRIDFNISFPALSCEFAAVDVSDVLGTNRLNLTKTVRKFSIDSNLRPTGAEFHSEPAANSIKHDNEVNEESVEGSVVLTTQNFDKYAHQFLITVVNFYAPWCYWSQRLKPSWEKTAKIIKERYDPEMDGRIILGRVDCTEDGDLCRRNYIQEVRIMPRSWIITNKFMI

SEQ ID NO: 129695 - protein, 207 aa, Glycine max
  Coding DNA Sequence Number=SeqID_12917
  Pfam annotation: Domain name=Arm; Domain location=148-188; Score =22.9; E_value=0.0011; Accession=PF00514.13; Description =Armadillobeta-catenin-like repeat
MVARRCHTKKQEPASKLRQHEGKEKGERLRHKGKGTGAKVQNNGKGNGCWGSTKGFRGVCKITSSASGVVAIKSDGFKNFNLRRQCSYKLVKGLGIKNEKKKKGLASAPKHTHPLRIIKLSEKLTNRNLNAKIEVTREIRKMVRKSSSPKTRAKLATAGVIEPLVLMLSSSNVDARQSSLLTLLNLVVRNERYPPSSLPRCMLFCEL

SEQ ID NO: 129696 - protein, 52 aa, Glycine max
  Coding DNA Sequence Number=SeqID_12918
  Homolog annotation: Hit_ID=Q1SC55; Match level="QueryCoverage=71%, HitCoverage=9%, E-value=3e-07, Identity=65%"; Hit description=TBC domain, putative
MWRDPGVPADSFYEIRPECTDVPVTRFKIKKYLVDENWCWSFMSNACEFEVL

SEQ ID NO: 129697 - protein, 223 aa, Glycine max
  Coding DNA Sequence Number=SeqID_12919
  Gene Ontology: Mol. function=isomerase activity; Cellular component =endoplasmic reticulum; Biological process=cell redox homeostasis
  Homolog annotation: Hit_ID=Q1SC51; Match level="QueryCoverage=99%, HitCoverage=46%, E-value=1e-101, Identity=79%"; Hit description =Thioredoxin, putative
  Pfam annotation: Domain name=DUF1692; Domain location=9-220; Score =291.2; E_value=1.9e-84; Accession=PF07970.2; Description=Protein of unknown function (DUF1692)
MENLVASLPSESQKLPLEDKSNVATNTKRPAPSTGGCRIDGYVRVKKVPGNLIISARSNAHSFDASQMNMSHVINHLSFGRKVSLRVMSDVKRLIPYVGSSHDRLNGRSFINTHDLGANVTIEHYLQIVKTEVITRKEYKLVEEYEYTAHSSVAQSLHIPVAKFHLELSPMQVLITENQKSFSHFITNVCAIIGGIFTVAGIMDAIFHNTIRLMKKVELGKNF

SEQ ID NO: 129698 - protein, 218 aa, Glycine max
  Coding DNA Sequence Number=SeqID_12920
  Homolog annotation: Hit_ID=Q47522; Match level="QueryCoverage=21%, HitCoverage=59%, E-value=1e-21, Identity=97%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGNARVFPVTTLNSITCLRRPRHPGRSTPLCPFKEHLVCPGAPPPHARKKRTADPEGPAVNRGARYQLLFPLVRVNFELGVIMVIAVSFGKPVVPAALMNRPTRGERRFAYWALAECILAYYVGTDEGVSEVLHVAGEKRLH

SEQ ID NO: 129699 - protein, 312 aa, Glycine max
  Coding DNA Sequence Number=SeqID_12921
  Homolog annotation: Hit_ID=P76111; Match level="QueryCoverage=47%, HitCoverage=100%, E-value=1e-67, Identity=87%"; Hit description =Inner membrane protein ydcZ
  Pfam annotation: Domain name=Acetyltransf_1; Domain location=13-96; Score=89.1; E_value=1.4e-23; Accession=PF00583.14; Description =Acetyltransferase (GNAT) family
  Pfam annotation: Domain name=FR47; Domain location=21-104; Score=6.5; E_value=0.0032; Accession=PF08445.1; Description=FR47-like protein
  Pfam module annotation: Pfam domain module=Acetyltransf_1::FR47; Domain location=13-96::21-104
MVEARSLAGYPVLVSEEDGVITGYASFGDWRAFDGFRHTVEHSVYVHPAHQGKGIGRTLMKALINEARAIGKHVMVAGIEAQNHASIHLHETLGFVTTGQMPQVGTNCSWTSAAIRTRSHESVTDAGVSGRGGHRSGGAKHSDGAYHPVLLHHSHRDAAEFAGRHRAVCHYSAAETGRGRIQRAGRDGALVDAYPGASGVVFRVCQHQRLSECWRGDDHRRAGRKPADWRAGAGRAEEPWHPAARPDRPGVRRGDAGGRGLAGGATPVLMVTVWCRLSSAVPHARPSPLYAACRGAKSRCADAAAGCSDLHG

SEQ ID NO: 129700 - protein, 218 aa, Glycine max
  Coding DNA Sequence Number=SeqID_12922
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=100%, E-value=6e-27, Identity=27%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLAFRGVHVLALRGLHVIALGGLHVLPFKGVHVLHIRGLHVLAFGGLHVLALRGLHVFTFRGLHALTFRGLHVLTFRGLHVLTFRGLHNLAFRGLDALAFRGVHILPLRGLHALAFVGLHTLTFKGVHGYTSSPSEGYTSSTSEDYMPIPSKDTFIGLHALGFVRLHALTFRGLHMLAYRGLHAFTFVGLHALTFRGLHILVFRAIHALAFRGLHA

SEQ ID NO: 129701 - protein, 40 aa, Glycine max
  Coding DNA Sequence Number=SeqID_12923
MTHSLNDAQPVPATPASFCNPTNCNIGCDDVVQNQKNEAK

SEQ ID NO: 129702 - protein, 145 aa, Glycine max
  Coding DNA Sequence Number=SeqID_12924
MTIKKRDFLLETSLIDLGGQTSLKNLVHGIIDHMPFIRVLLMTIESSLEAPSTKKRIIHIIIFNIVMPKNSSRDYVSDRGRFYIYNVMVGKKKRNIESKIIRFKFVEAMPSKVIWMMPKNQESSKFQRFKNEVFKNQVSRIKIQE

SEQ ID NO: 129703 - protein, 40 aa, Glycine max
  Coding DNA Sequence Number=SeqID_12925
MPRALNSTTHQSAYFRKRALEACLNSVCSWFDQPFVCLVR

SEQ ID NO: 129704 - protein, 234 aa, Glycine max
  Coding DNA Sequence Number=SeqID_12926
  Gene Ontology: Mol. function=nucleoside-triphosphatase activity; Cellular component=membrane; Biological process=cell division
  Homolog annotation: Hit_ID=Q1SK92; Match level="QueryCoverage=52%, HitCoverage=30%, E-value=4e-21, Identity=63%"; Hit description=AAA ATPase, central region; DEAD/DEAH box helicase, N-terminal
MLKEFEKRIRSEVIPANEIDVTFFDIGALDETKESLQELVMLPLRRPDLFTGGLLKIMVGPPYVENMEKILRTLLAKEKVDNELEFKELATMTEGYTGSDLKNLCTIAAYQPVRELIQQERLKSLTKMMTKSPKNDFKIESTSSRSRLISSFKNQDSRIIKIKIQDSRFKNQEEDSVKISIKKFFKTLSSTRSFHKIFYQRVLLSGNRLPEGSNRLPVASIVFQTDLQSCNRLP

SEQ ID NO: 129705 - protein, 114 aa, Glycine max
  Coding DNA Sequence Number=SeqID_12927
MSTISKDSSSSKNMTSECDSSEESGWTKYFEDFFDNHNIDDDDDQKCSMSSFSGVDSYYSTSFVSDSATKKLTDNTQAEEYDHQSSLKKRKKIKTALVDDALEDTASSPIKGSK

SEQ ID NO: 129706 - protein, 195 aa, Glycine max
  Coding DNA Sequence Number=SeqID_12928
MIWHAEFVSYYLLLKLSDFLFAIPIILRIYFIFKSGKCYLVISKPRTNFWELSPHALTPMHGRVNVWPKQMLCGYLKSREANIVEVIEGGAKSLFDIIAYAYSDVDHRVWIAIIKCEAPCGSSSPTTQFTKVSVGEKSVVPARISGPGVLHYSCKTVGNYVKLNHFYSCNFTRGVTLFWGLQQLFTDEVLVHNKC

SEQ ID NO: 129707 - protein, 126 aa, Glycine max
  Coding DNA Sequence Number=SeqID_12929
MDSSRDSENEVVNLSIMAKNYESEEEFKEEIKDLKNSLAKFTIGKTNLDIDAILPRKGPVTRAMSKRLQEDWARAAEEGSRVLMNLRVDFLAHGPRLGPIIFVHIRLGCPYIWSLYLGLHNVGRVP

SEQ ID NO: 129708 - protein, 555 aa, Glycine max
  Coding DNA Sequence Number=SeqID_12930
  Gene Ontology: Mol. function=heme transporter activity; Cellular component=membrane; Biological process=cytochrome c oxidase complex assembly
  Homolog annotation: Hit_ID=Q7CJB8; Match level="QueryCoverage=99%, HitCoverage=86%, E-value=0.0, Identity=76%"; Hit description =Cytochrome c-type biogenesis protein
  Pfam annotation: Domain name=Cytochrom_C_asm; Domain location=54-264; Score=316.5; E_value=4.8e-92; Accession=PF01578.11; Description =Cytochrome C assembly protein
  Pfam annotation: Domain name=MFS_1; Domain location=103-470; Score= -38.7; E_value=0.019; Accession=PF07690.6; Description=Major Facilitator Superfamily
  Pfam module annotation: Pfam domain module=Cytochrom_C_asm::MFS_1; Domain location=54-264::103-470
MALARPLTWGMFLCIAAAFLVLVHAFVVNDFTVGYVATNSNSLLPVYYRIAATWGAHEGSLLLWVLLLSTWTLAVAIFSRGMPQDALARVLAVMGMINLGFLLFIILTSNPFTRTLPNFPIDGRDLNPMLQDIGLIFHPPLLYMGYVGFSVAFAFAIASLMAGRLDTAWARWSRPWTTAAWVFLTIGIVLGSAWAYYELGWGGWWFWDPVENASFMPWLAGTALMHSLAVTEKRGSFKSWTVLLAITAFSLSLLGTFLVRSGVLVSVHSFASDPARGMFILAFLVIVIGSSLLLYALKGGQVRSRVQSEAWSRESFLLGNNVLLIAAMLVVLLGTLLPLVHKQLGLGSISVGEPFFNTMFTWLMAPFALMLGIGPLVRWRRDEPQKLWKRLGVGLLVTLILSIVLPWLLQDRIEAMTVIGLLMAIWVILLTLMELHERATHRHRFLAGLRHLSRSHWGMVLGHLGVAVTVVGIAFSTQYSVERDVRMKAGDSVDIHNYHFIFRDVHNLQGPNYSARSGAACREALLYRSAHHDDGSGDQRRLHARSLRGAGRRAG

SEQ ID NO: 129709 - protein, 111 aa, Glycine max
  Coding DNA Sequence Number=SeqID_12931
MGSKIYPKVHENPRAFFSSSSPSLLESSIQYPWGVGLHHSDGREEEDVQSFEKKDAESFESENLTPIVIKFKRFLKKKDLKGKTFQHKKNFKNIDSTLQTSLVLNVENQAT

SEQ ID NO: 129710 - protein, 221 aa, Glycine max
  Coding DNA Sequence Number=SeqID_12932
  Gene Ontology: Mol. function=kinase activity; Cellular component =integral to membrane; Biological process=regulation of transcription, DNA-dependent
  Homolog annotation: Hit_ID=Q1H1L7; Match level="QueryCoverage=77%, HitCoverage=50%, E-value=3e-37, Identity=48%"; Hit description =Putative FecR
  Pfam annotation: Domain name=FecR; Domain location=1-94; Score=113.9; E_value=4.7e-31; Accession=PF04773.4; Description=FecR protein
MAAQNPVGQIAIKTLDDGTKVTLSAKSDMEVTYYRHERHVLLKEGEAVFEVTKDADRPFVVETDTAKVTVLGTRFAVNRLEQMVRVSVDHGRVKVEPKLAGATAKTDNPLDISREITNGQVVEVYPNHAMVLVNRPASDAFAFLKGRLVFDRADTSEIAYTVSRYRPKPVQSQGKQPFWKIPPELPRRQRSSLHSNNGWKLCSASLTVCHPNAVRRSGYIG

SEQ ID NO: 129711 - protein, 163 aa, Glycine max
  Coding DNA Sequence Number=SeqID_12933
MVCIDQADMTGRLLAGSLTFDCRIMHYIIVRILMPCSFNLAQASEEDLILMWAFLTGHPIDWAHLVCYRMHKALRSGAPLPYPQLVTLFLRHFEIPLDSEPFVLVKRSFAIGASAVTSFGYRKDVDGQWLKKDAQPPQDERTPSPPPPQDDSSALMNEVLSEL

SEQ ID NO: 129712 - protein, 141 aa, Glycine max
  Coding DNA Sequence Number=SeqID_12934
KVIRPPITRAFIEKYCTQRQAQGDAPQVADASPPHQAGPAGSFDTEQYLRHLVHQQAANHRAHVQTHDCLYQLSLSLQSQGFTSFPCPTPDQFRAEAAWPGDWPEARAREAPAEASDEADEAREDEEMTDLLDFLGGSRAT

SEQ ID NO: 129713 - protein, 249 aa, Glycine max
  Coding DNA Sequence Number=SeqID_12935
  Gene Ontology: Mol. function=RNA-directed DNA polymerase activity; Cellular component=chromatin; Biological process=chromatin assembly or disassembly
  Homolog annotation: Hit_ID=Q8S823; Match level="QueryCoverage=95%, HitCoverage=15%, E-value=8e-30, Identity=36%"; Hit description =Putative retroelement
  Pfam annotation: Domain name=zf-CCHC; Domain location=205-222; Score =28.1; E_value=2.3e-05; Accession=PF00098.13; Description=Zinc knuckle
  Pfam module annotation: Pfam domain module=Retrotrans_gag::zf-CCHC; Domain location=17-96::205-222
  Subcellular localization annotation: CTP_CleavageSite=45; ConfidenceScore=5.07e-01
MLSMRHISCNDPLGFGGPITVPPTQNGPQSLGTAFRGNYIPPGVVEMKVGEFMRLSQGTKSVKEYLHAFNNLARYAPEFVNTEAKKIASFQRGLNPKMLKTMGTGARATFNAYISDCLTQENNNNNYSASKSRKRAFEAGSSQSRAPVAGRPQYRPPAPGARFRPPQRRNTGPPTQQKPYKVAIASAKLKAIQAAAPTVNNAPKGPCYNCHKMGHFAKECPYPKRQQPTYPARVHHTSIEEIPDGEPVS

SEQ ID NO: 129714 - protein, 108 aa, Glycine max
  Coding DNA Sequence Number=SeqID_12936
MAKFICKYFPRSKSNKKRLLYLPSNKHTMNPLEKLGKDLEGLKALSKLMLDALAAGKISLKIPREAIQIIENMIVNATTIKEKFNTSTTNGKGTTKTTTIKDTNLIQA

SEQ ID NO: 129715 - protein, 67 aa, Glycine max
  Coding DNA Sequence Number=SeqID_12937
  Gene Ontology: Mol. function=catalytic activity; Biological process =metabolic process
  Homolog annotation: Hit_ID=Q1SI48; Match level="QueryCoverage=83%, HitCoverage=14%, E-value=7e-17, Identity=78%"; Hit description=AMP -dependent synthetase and ligase
MWYLWSQFCIMDYEHAGVGAIEFIICHSEVSIALAEEKKIPELFKTFPNATKYLKTINEYNFFVQWK

SEQ ID NO: 129716 - protein, 238 aa, Glycine max
  Coding DNA Sequence Number=SeqID_12938
MASRKCKSIGSRPTTQYARRRFHSLDAWNWYTNNVLGRNILLERKVELYHTELDDFKTKLERRNFHKCLTNLVDGSIDLALVKEFYGNLYSSVGPSPKQARVRGHLVKIDADNLNTFLETPVVLAEGKTLPTYSRYCRLPTDYREIEATLCIPGRGFILNAEGHPGRILRKDLTTLAQVWSVLSYSNLAPTSHTSNLTVDRARLIFSLVSRMDMNIGALMKGSDSSQLNLNSNVQMHW

SEQ ID NO: 129717 - protein, 169 aa, Glycine max
  Coding DNA Sequence Number=SeqID_12939
  Gene Ontology: Mol. function=RNA-directed DNA polymerase activity; Biological process=RNA-dependent DNA replication
  Pfam annotation: Domain name=RnaseH; Domain location=19-120; Score= -32.7; E_value=0.065; Accession=PF00075.14; Description=RNase H
FLNEDIMTLFEEEVEDEDRDKWIVWFDGVSNALGQGVRAVLVTPDDQCIPFTSRLGFDCTNNMADYKACALGILAAIDFKVKLLKAYIRMLIEFFDDISFHHIPREENQMADALATLASLFQLTPHGDLLYIEFRCRGRPAHCCLIEEKQDGKPWYFDIKQYIEDKKYP

SEQ ID NO: 129718 - protein, 90 aa, Glycine max
  Coding DNA Sequence Number=SeqID_12940
MPLPSTVHASSTNESGAPRSAVHVSSTYEFGAMRIDCLVQFSVLAFFPEPHKCHCLVLFMHPPPTSLEPREGIAYHCSPILHSPLLFGAP

SEQ ID NO: 129719 - protein, 54 aa, Glycine max
  Coding DNA Sequence Number=SeqID_12941
MEVEKTYQGLWLPLQYQVDNGARMAFVDNWVVGKEKVCYWMSNDIVGLVENLAV

SEQ ID NO: 129720 - protein, 64 aa, Glycine max
  Coding DNA Sequence Number=SeqID_12942
MGDEMPLELVVLDLARRFLFSIFVELLQGCREKDGSGGGLLLLTRFGSIGTTIFSLMLFFMAIN

SEQ ID NO: 129721 - protein, 74 aa, Glycine max
  Coding DNA Sequence Number=SeqID_12943
AQLKPTSISSGGRSGGVVQLGLPFDMEISALSFLVCIPDKIRRGSESRTSLALSKTKRRMEDGLLNELSRFTLS

SEQ ID NO: 129722 - protein, 518 aa, Glycine max
  Coding DNA Sequence Number=SeqID_12944
  Gene Ontology: Mol. function=nucleoside-triphosphatase activity; Cellular component=membrane; Biological process=methanol metabolic process
  Homolog annotation: Hit_ID=Q1GZN0; Match level="QueryCoverage=58%, HitCoverage=89%, E-value=1e-118, Identity=69%"; Hit description =ATPase associated with various cellular activities, AAA_3
  Pfam annotation: Domain name=AAA; Domain location=21-208; Score= -13.2; E_value=0.0021; Accession=PF00004.19; Description=ATPase family associated with various cellular activities (AAA)
  Pfam annotation: Domain name=AAA_3; Domain location=21-154; Score =97.0; E_value=5.7e-26; Accession=PF07726.2; Description=ATPase family associated with various
  Pfam annotation: Domain name=AAA_5; Domain location=21-160; Score =38.9; E_value=1.7e-08; Accession=PF07728.4; Description=ATPase family associated with various
  Pfam module annotation: Pfam domain module=AAA::AAA_3::AAA_5; Domain location=21-208::21-154::21-160
VVVGMPEQIRALAIAIFSRGHVLLEGDVGVGKTTLLRAAAHLLGGGYQRIEGAIDLMPSDFLYHAYIDEQGQAAVKPGPLLQHDEALSVFFFNEINRARPQAHALFLRLMAERSVNAFNREYHFPHLTVFADRNRLEREETFEIPAAARDRFLMEISIKAPDARDLQRALMFDTRFYDVDRLVDGLPVGLTPYAQLNQVAEAVQASVRAEVPLQDYAVDLWRTLKDPQAAGIQLPDVDMSRLLAGGASPRGMAMLMRSGRTRAWLEGRDYLTPDDIRAVWPFVVTHRVFLNGAYALQHEHLSSPAPEVHATFEPRLFFYNINWRSRSYHAGATLTGHHGNGSDFAGFAPLLSCPDPKRIDIRASVRSTPRQWLVRTYLERAAIHVYAVVDVSSSMLFQGHDQLRQLVTEFVSSLAWSATRQGDAFGMRGAHDTPQAVWQVMPTFQPATAQGVAQKITRYWQDATVNAAEKGHGAAGIPAAIESLGARRALVFLLSDFYWPDALMQQVLKAAQAHDVSQ

SEQ ID NO: 129723 - protein, 214 aa, Glycine max
  Coding DNA Sequence Number=SeqID_12945
  Gene Ontology: Mol. function=nucleic acid binding; Cellular component= oxygen evolving complex; Biological process=DNA integration
  Homolog annotation: Hit_ID=Q1SPP8; Match level="QueryCoverage=86%, HitCoverage=13%, E-value=5e-48, Identity=47%"; Hit description =Integrase, catalytic region; Zinc finger, CCHC-type; Peptidase aspartic, catalytic
MLFQKDYGSQILVVKIYVDDTIFSATNDLLCEDFSKLMQAEFEMSIMGELKFFLGLQIKQTNNGIYTHQTKYMKELLKKLKMDDENQMKTLMHPTTVLGLGKESKRVDEKTYKEMIGYLLYVIESRPDIMFSRKGIWLLDYCDADFARDRVERRNTSGGCHFIGGCLVSWTSKKQGTIALSTAEAEYIFDTCDDHEHCSWKQNDSSRVQEVRFW

SEQ ID NO: 129724 - protein, 68 aa, Glycine max
  Coding DNA Sequence Number=SeqID_12946
MRVDVSQQGYVEFGKKLKQYELCIKRFIYLYLYEIQAKNMNIKVLDDSQSISQWTILSQHPFLRRQLL

SEQ ID NO: 129725 - protein, 60 aa, Glycine max
  Coding DNA Sequence Number=SeqID_12947
MAFFLSYTKAKAETLNCKPSFEKIQQLTKAGGSFLPRQLHVASLRSFIKRLPQEASSWLL

SEQ ID NO: 129726 - protein, 260 aa, Glycine max
  Coding DNA Sequence Number=SeqID_12948
  Gene Ontology: Mol. function=protein serine/threonine kinase activity; Cellular component=coated vesicle membrane; Biological process=intracellular protein transport
  Homolog annotation: Hit_ID=Q9SB50; Match level="QueryCoverage=98%, HitCoverage=55%, E-value=1e-110, Identity=78%"; Hit description =Clathrin coat assembly like protein
  Pfam annotation: Domain name=Adap_comp_sub; Domain location=1-260; Score=285.5; E_value=1e-82; Accession=PF00928.11; Description =Adaptor complexes medium subunit family
MKGYILTSEIDGTIQMKSYLSGNPEIRLALNDDLSIGRSQGSAFGYRSSSDSGTVILDDCNFHESVRLDSFDIDRTLSLVPPDGEFPVMNYRLTQEFRPPFRINALIEEAGSLKAEVILKVSAEFASSVTANTIKVQMPLPKYSRVVSVAYDHWVSFELEPGAVGQTTDFKEANKRLEWSLRKIVGGSEHTLRAKLTFSQESPVNVTKESGPVSMTFTIPMHNVSRLQVKYLQIAKKSATHEPYRWVRYVTQANSYVARI

SEQ ID NO: 129727 - protein, 55 aa, Glycine max
  Coding DNA Sequence Number=SeqID_12949
MIVGIDCKTIRVGRMIWKTLNDRDISGGYTYGAVIPFCGISLQPNIYGDELRDLN

SEQ ID NO: 129728 - protein, 117 aa, Glycine max
  Coding DNA Sequence Number=SeqID_12950
  Homolog annotation: Hit_ID=Q9C6F5; Match level="QueryCoverage=34%, HitCoverage=14%, E-value=1e-10, Identity=75%"; Hit description =Carbonic anhydrase, putative
MVWSIRSRISSLLCSKAPLVGSYVYDSCWCLCFSAPTSSSIARPWPNFMDWVQMDRCRAAASLPLIKEQNGPSESNAALEFAVTTLQVENILVIGHSSCAGIEALMNMQEDVESGYL

SEQ ID NO: 129729 - protein, 251 aa, Glycine max
  Coding DNA Sequence Number=SeqID_12951
  Gene Ontology: Mol. function=transcription regulator activity; Cellular component=nucleus; Biological process=regulation of transcription
  Homolog annotation: Hit_ID=Q69MD0; Match level="QueryCoverage=61%, HitCoverage=62%, E-value=2e-17, Identity=38%"; Hit description=BHLH -like protein
  Pfam annotation: Domain name=HLH; Domain location=39-99; Score=46.8; E_value=7.5e-11; Accession=PF00010.16; Description=Helix-loop-helix DNA-binding domain
MVPFRRFYGFERWLDHHAAHSPMELNAARSKTERKSTEACKSHREAERRRRQRINSHLSTLRSLLPNAAKRGKFKHRVVLQSDKASLLGEVVEHVKRLRKQADDVARGDSSSSSRSAQPGSVRSEAWPFPGECDEATVSFCDGGEPKRVKATVCCEDRAGLNRDVGQVIRSVRAKPVRAETMTVGGRTKSVVVVEWEKEEEVGELERALRAVVENRALVGFGMGHVFVGQKRGRDCCEVDSDFLLRNGSFC

SEQ ID NO: 129730 - protein, 32 aa, Glycine max
  Coding DNA Sequence Number=SeqID_12952
MEDLVFQKNFVDEVGIVDVIHKQCKLTFSNHY

SEQ ID NO: 129731 - protein, 57 aa, Glycine max
  Coding DNA Sequence Number=SeqID_12953
GSGYKNLVVYVCLNAVLVEFSLTRGICGRGLIRARLGYHDESGSSSPRDNTGTHEHC

SEQ ID NO: 129732 - protein, 240 aa, Glycine max
  Coding DNA Sequence Number=SeqID_12954
  Gene Ontology: Mol. function=hydrolase activity, acting on acid anhydrides, in phosphorus-containing anhydrides; Biological process =nucleobase, nucleoside, nucleotide and nucleic acid metabolic process
  Homolog annotation: Hit_ID=Q2CU82; Match level="QueryCoverage=98%, HitCoverage=27%, E-value=6e-57, Identity=47%"; Hit description =Helicase c2:DEAD/DEAH box helicase, N-terminal
MEEIRKLVSAIAENLNVVVIVPSKERAKFWKDVAHQTLDKDNIQAGIQHLKDGIVGLTVLINKYDGIDLPGKACELLVIDGLPEVYGLGERREMLLLDGTKRQLVRQVQRIEQGMGRGVRSSDDHCVVLLLGGRLTQRLHQPEAETMFSSATRAQIDLGKSVAEQLRGQSLEKLEEIMDLCLAQDDNWVQAGRNAVVNAPPITEGRIDANQVLLREAFDAARVSRHDIAKNKTQVAVTQQ

SEQ ID NO: 129733 - protein, 253 aa, Glycine max
  Coding DNA Sequence Number=SeqID_12955
  Gene Ontology: Mol. function=heat shock protein binding; Cellular component=integral to membrane; Biological process=protein folding
  Homolog annotation: Hit_ID=Q9ZU99; Match level="QueryCoverage=98%, HitCoverage=69%, E-value=8e-39, Identity=37%"; Hit description =Expressed protein
  Pfam annotation: Domain name=AT_hook; Domain location=240-252; Score =15.2; E_value=0.054; Accession=PF02178.9; Description=AT hook motif
  Pfam annotation: Domain name=DnaJ; Domain location=1-42; Score=21.5; E_value=3.6e-05; Accession=PF00226.21; Description=DnaJ domain
  Pfam module annotation: Pfam domain module=AT_hook::DnaJ; Domain location=240-252::1-42
YRRLALLLHPDKSRFHLAGHAFKLVADAWTLLSDPVKKSVYDKDLTFFSRVDLSVPEWVQQQEKLPVRRPGPGPSAGRNSAAAREDILADENSRRRRRRRKRSSTFWTACPYCYRLYEYPRVYEGYCLRCQNCDRSFHGVTVPSLPPLVPGQEAYYCCWGFFPVGFVVGGFGSPPEKEAAPVAAMPVQAPPPPPQQASSLPNWMPVPAENGAGSVTPVATARVTSSGAAMTNGVGSGTGPKKRGRPRKYPLPS

SEQ ID NO: 129734 - protein, 312 aa, Glycine max
  Coding DNA Sequence Number=SeqID_12956
  Gene Ontology: Mol. function=RNA-directed DNA polymerase activity; Biological process=RNA-dependent DNA replication
MPSSNSPRTKLGYDNAQADIDSYPLFTAERPAPNALPQPNTTKVSQPRPMQPLHFSVGGPPPVVEGREKLDLMEEKLRAVEGFGDYPFADMTDLCLVSDVVILPKFKVPDFDRYKGTTCPKNTLKMYYRKMGAYSRDEKLLMHFFQDSLAGPVVIWYTKASLVCSWKHLITAFIRQYQYNTDVAPDRAQLQNMSKREHRSFKEYAQRWRDLAAQVAHPLVEREMITMIVDTLPVFYYEKLVGYMPSSFADLVFTGERIEVGLKRGRFDYVSLANTNSRRSGPTRAKRKEGDAHAVTSAPASPKFLQTPHNTH

SEQ ID NO: 129735 - protein, 218 aa, Glycine max
  Coding DNA Sequence Number=SeqID_12957
  Gene Ontology: Mol. function=helicase activity; Biological process =protein amino acid phosphorylation
  Homolog annotation: Hit_ID=Q9FYQ9; Match level="QueryCoverage=88%, HitCoverage=46%, E-value=1e-41, Identity=43%"; Hit description =Similarity to helicase
  Pfam annotation: Domain name=DUF889; Domain location=108-218; Score= -45.1; E_value=2e-08; Accession=PF05970.5; Description=Eukaryotic protein of unknown function (DUF889)
MCHKFAFEALDKSLKDIMQNNLPFGGIASLLLPGGQTAHSKFAIPVPATENSTCNIHQGSELAELLKVTKLIVWDEAPMCHKFSFEALDKSRKDIMQNNLPFGGKIIVFGGDFRQILPIVPKATYPSLIDNYSDTDYLQKRVVLASKKEIVDKINDYVLSLIPNNEKEHCSADNIDKSDELLNPAFALLPPEFLYSLQTSGIPNHKLKLKVGTPIMLI

SEQ ID NO: 129736 - protein, 150 aa, Glycine max
  Coding DNA Sequence Number=SeqID_12958
MVQYRFRTLLVNLELSSFPTPLTHFSNSSSPHPPHHHYYYYPPPRAFHLKITPPDLCSVPSNDVVAVVAAVATSLWPLSTSDSPSKFHFGGGITVIQDEDNLAGLNLVVAERTRGTRACTWAIASKPRDPRTWLDKPWKKPKSHWRSNQN

SEQ ID NO: 129737 - protein, 81 aa, Glycine max
  Coding DNA Sequence Number=SeqID_12959
  Subcellular localization annotation: CTP_CleavageSite=53; ConfidenceScore=5.50e-01
MPPLYNQCHFSDAKRSSRAKRTLWAQCASTAKRSFSALSMTRESRRAQELRPRAKHEINSLSETIVSYQAQRTTGTEPKST

SEQ ID NO: 129738 - protein, 1345 aa, Glycine max
  Coding DNA Sequence Number=SeqID_12960
  Gene Ontology: Mol. function=microtubule motor activity; Cellular component=microtubule associated complex; Biological process =microtubule-based movement
  Homolog annotation: Hit_ID=Q9FME7; Match level="QueryCoverage=93%, HitCoverage=97%, E-value=0.0, Identity=53%"; Hit description=Kinesin- like protein
  Pfam annotation: Domain name=Kinesin; Domain location=63-396; Score =502.2; E_value=6.1e-148; Accession=PF00225.13; Description=Kinesin motor domain
MDEDEDDDVPQPPSNIMEDVNPNESNIGEESHSFDGEGSPEADSNWWEMENSDSAQCVRVAVNIRPLITSELMLGCTDCISLVPGEPQVQIGSHAFTYDYVYSSGSPSSTIYDDCVAPLVDALFHGYNATVLAYGQTGSGKTYTMGTNYTGEDNAGGIIPKVMETIFKRVQTMKESSEFLIRVSFIEIFKEEVFDLLDHNSSRGDVAPTAKPAVPSRVPIQIRETVNGGITLAGVTEAEVKTKEEMSSYLSRGSLSRATGSTNMNSQSSRSHAIFTITMEQKSGDDVLCAKLHLVDLAGSERAKRTGADGMRLKEGIHINKGLLALGNVISALGDERKRKEGGHVPYRDSKLTRLLQDSLGGNSKTVMIACVSPADTNAEETLNTLKYANRARNIQNKAVINRDPVGAQMQRMRSQIEQLQSELLLYRGDAGGAFEELQILKQKISLLEASNEELQQELQERRVTCESLSQRACDAQVEKDQLIMKIESIRNGKSWDEIDSNSNQDYDLVKSYVSKIQDLEGELRGLKNLNAKSRHVDWVDSDDSGFRSKNVLFACANEYSSDCDAKSVDITDDMEDHAKEIEHSSLQEKLDRELKELDKKLEQKEAEMKMFNNSDTSVLKHHYEKKVLELEQEKKFLQKEIEELKYNLANISSSSGDGAQKLKEEYLQKLNALEAQVSVLKKKQESQAQLLRQKQKSDEAAKRLQDEIQRIKSHKVQLQHKIKQESEQFRLWKASREKEVLQLKKEGRRNEYEMHKLLALNQRQKMVLQRKTEEATLATKRLKELLESRKTSRESAAGGNGPGIQDVLVFKLLLDMCFYLKALMQAIEHELEVTVRVHEVRSAHERQMEERAKMANEIARLKEEADMMKLNNSSDGLASMSPGARNSRIYALEKMIATSSTTLLSMASQLSEAEERERIFSGKGRWNQVRSLPEAKNLMNHLFNLASSSRCLLRDKEVTCREKGMEIRDLKEKVVRLSCSLRQLEMQKSELIHQLKLLSAKRYSESLGGLVYPDINGGHKYDLRKMDMDLSVSDTESDDYVADATDDEWVASEKIHVRKRKSRSRHVSMENNQSNISSEDVKDNSTEGVGGASGETVSDICCSCSKSSSCKTNKCKCRTLGGICGSSCGCLASKCANRASGSNESPVEGTGNDSSIQEADKDHLLAAQGAELLQGALIGGPAEAHSDHGPRKPLSDIGNTLAKSNAQKPNQRREWKNIKRKSTLSTVVLNVVPPTSSQSDNSEVPKKENNSISEANVSNIPQKMHSSRPENVPVVPKVEKNVIEPDIRLPRAMRKSVSPNGGGLPLGDMNASKPDEPVNKESEVMIEARTPVKQKRTLEKENNG

SEQ ID NO: 129739 - protein, 79 aa, Glycine max
  Coding DNA Sequence Number=SeqID_12961
  Pfam annotation: Domain name=zf-C2HC_plant; Domain location=23-71; Score=41.0; E_value=4.2e-09; Accession=PF07567.3; Description =Protein of unknown function, DUF1544
MSSAEASSSQETSTPNTSQNVRGKNYPTWGHLICIYCDKRVKGGGTNRFKAHLTRQKGQVEACKKVPTDVQHQMKQLLE

SEQ ID NO: 129740 - protein, 77 aa, Glycine max
  Coding DNA Sequence Number=SeqID_12962
MRPRCGNELQRADSGVRHCGVAVSSWLRATMCKPRWRCGEFEYEDEEKGPVGICKIGQVAGFPQNGWVCPGYPRPHV

SEQ ID NO: 129741 - protein, 96 aa, Glycine max
  Coding DNA Sequence Number=SeqID_12963
FFRKCASSGILPDEPLLPESSRKRFSGSLPEEVFFRKTFDYFRKNTSSGNFPEKVLPELPEEPLTGLPEVSAVSLFSPFFPASSPLVCYPKVTILR

SEQ ID NO: 129742 - protein, 38 aa, Glycine max
  Coding DNA Sequence Number=SeqID_12964
MVLRVVCMMEGLIASFQSPPTLASTYFAQKDEVLAQRQ

SEQ ID NO: 129743 - protein, 968 aa, Glycine max
  Coding DNA Sequence Number=SeqID_12965
  Gene Ontology: Mol. function=kinase activity; Cellular component =proton-transporting two-sector ATPase complex; Biological process =ATP synthesis coupled proton transport
  Homolog annotation: Hit_ID=Q94CG5; Match level="QueryCoverage=98%, HitCoverage=96%, E-value=1e-146, Identity=34%"; Hit description =Kinase interacting protein 1
  Pfam annotation: Domain name=KIP1; Domain location=1-52; Score=71.3; E_value=3.1e-18; Accession=PF07765.3; Description=KIP1-like protein
MEEKVAETLTILCDEGDSFAKRAEMYYKKRPELVNFVEEAFRAYRALAERYDHLSKELQSANRTIASVFPDQVPYHIEEDDEEESDTGTNSSSPDPNNQTHNRPSIPKVPKTPKKDFRSPSMLLSRKAPLKRISSSAKYVPTISSSGLTKVEALADIDKLQKEILSLQTEKEFVRSLYERAYEKYWEIEDQITATQKRVCSLQDEFGVGTVIEDNDARALMATTALKSCQETLDKLKEIQAQSSKDAKEEYQRVKKAHEMFETLRDQFIAKYTSQQDQDDVDKSESVGTDKKCIDEEMDHLEQEKHDVGMLREKIKQKLDEDSSNSLTVTEMAECIDELVNKVCTLETAVSSQTGMVKRLKSETDGLQTNIKKLEEDREMLIEGSEVTNKKLKELEEELWRVKMLNRDVRTQDNTLQTHFTEASCNLEHLSGKLNNMKPNEEEENLVLYKKKRTASDVNLFVDNSDVKTLKEDGGANVDTNKSNLNDSTLMNERIQKLVLQQDKDDLSDTPSNLDTESQDLDISEEDQPNWRQMFISGLDDREKILLEEYTSVLMNYKDVRVKLNDVEKKNRDSIFELTLQVEYFNTVAKTIQEFLLTNRVHSTPTKVEFPVQLREMKNALDTKDKEIQVLHQKLDNPDANPYESPCTITTEYKYTPHEALLRKAGQGADVSDSEIWPSNLDANAATTPFTEQVETERTGKNAFSSVRMTLEKLMAHQDKRQDLSNLEQKFRSDINDLLEENLEFWLRFSTSVHQIQKFQNSIQDLKAELKIIREKNKKSEGYSHSKQQPIQSQLRPIFRHLREIRTELSLWVEHNAVLQDELQGRYASMSNIQDEIARAGNTESGADTAELISKYQAAKFQGEILNMKQENSKVASELQAGLSLVKGMKNDVEKTLDELDEAIGVNSSVPKNNGQMKHSSSRARIPLRSFLFGVKLKKQKHHPSLFACVNPALQRQYSVNDEAPAPI

SEQ ID NO: 129744 - protein, 162 aa, Glycine max
  Coding DNA Sequence Number=SeqID_12966
  Homolog annotation: Hit_ID=Q9LSM6; Match level="QueryCoverage=96%, HitCoverage=93%, E-value=1e-09, Identity=31%"; Hit description =Arabidopsis thaliana genomic DNA, chromosome 5, TAC clone:K19O4
  Subcellular localization annotation: CTP_CleavageSite=48; ConfidenceScore=5.12e-01
MSVAFTNLSWWLWSGKHQDPRISNGSSINSSGDSNLWESDVLRFPLVKANVGSSSRKVKRKWHSREERKVDREYDVVLVPSDGGCVSGSESDDSDWSIGWLEPHGPGFPSDDETDNSFAVIVPCYGRDYGRIVEDPKGNLLRGVGNFPDSYSDVSNLAFDCG

SEQ ID NO: 129745 - protein, 433 aa, Glycine max
  Coding DNA Sequence Number=SeqID_12967
LISWAKCASTTKRSFNMLIMIEESGRASISRSRAKREISALSAAVIFSQAQRMTGAKRNVAWYVLLSPTVGAKCSYQNLKSSHIKVDVAEWGPERHTSAWRVPHPRILIEVPLIVSPPLLKGQPILVTVILPSSTFGGVRKGSGSGDVRVFPYVRCSLSARSLTSTPIVAGYEWVRDDVLNYRTYLILAVNVVALQCQVKLANPKGLWECHSTIHRFSVCSVGALECGPFPASHGQLSDATNVVADGMSLMLNREWGSLASHSTSSLIPPEGLKSNFGAVAGLASCTCHFVSSFSEQSSCFLDGKCLTCPRLCLRPLVKKVGPAGGIVPPSVVALSARERGQPASEGGPIIVAIEVTPSIPSSVLAKRKRDAVVEPSGHVPLAPPAATVSGVSSIGACRPRIFFINGFLCFLEDEWQWNREGRDRGDATSRRR

SEQ ID NO: 129746 - protein, 183 aa, Glycine max
  Coding DNA Sequence Number=SeqID_12968
  Subcellular localization annotation: CTP_CleavageSite=20; ConfidenceScore=5.43e-01
MTFRGPRKARGKRSEVPTTSAAAETTTPSSSTTPAPPISTLAQTPAIPAPSPFQLPAPLFAGPSEFVFAPQMLHSMLQSLRRGQTIIIQSLQGLGLPSIMSMDEFDAKVARPGAQPSPSGGDVHRAQEEETGTDQIPKPSPASIPDDSMPSTPASELEQPISQDSLVAQVLDLNEHAQEESQE

SEQ ID NO: 129747 - protein, 248 aa, Glycine max
  Coding DNA Sequence Number=SeqID_12969
  Gene Ontology: Mol. function=transcription factor activity; Cellular component=intracellular; Biological process=regulation of transcription, DNA-dependent
  Homolog annotation: Hit_ID=Q122T6; Match level="QueryCoverage=81%, HitCoverage=57%, E-value=1e-39, Identity=43%"; Hit description =Transcriptional regulator, LacI family
MTIISYDNRLAESVPPRARYFDSVSMDNVEAGRLAAQHLLDNGCRNIVFATESGLTLGRSHKILGFQSALSQSGTAARGVVIEGKGNREFGDAEMFELGVSLAQKISALTPRVDGVVAINDALAIGLMVGLRAQGLKIAEDISVIGIDNISLSALSSPGLTSVMAPLSAMASMMVERLVQRITEPGLQTDEFIFAPEVIQRQSGDLYPITFKTHINVGISIPFFCTLTSITGNNDEPTICAIYRKERH

SEQ ID NO: 129748 - protein, 175 aa, Glycine max
  Coding DNA Sequence Number=SeqID_12970
  Gene Ontology: Mol. function=transporter activity; Cellular component= integral to membrane; Biological process=transport
  Homolog annotation: Hit_ID=UPI00005274EB; Match level="QueryCoverage =99%, HitCoverage=37%, E-value=2e-43, Identity=45%"; Hit description =major facilitator superfamily MFS_1
MALEDSLGLTATAFGFASGIFFIGYFMFEIPSNAGTIKFGPRLWFARILITWGIFATLMGFVRTPTELYICRFMLGVCEAGFFPSVVYYFTIFFPPAWRTKILGMFIIVQPLSNAVGSPISGLILHIDNGWFGLESWQWLFILEGIPPIVIGLFIPFIIKNSPEEVGYLNAEEKA

SEQ ID NO: 129749 - protein, 92 aa, Glycine max
  Coding DNA Sequence Number=SeqID_12971
MERAGRTKSVSYLWFPLISDERSFLQKAVASGGSNLARLGELGGKLLPYFAINRGRSEEEKGSAFLALLSLEIVEENYFREENPSRGASSST

SEQ ID NO: 129750 - protein, 84 aa, Glycine max
  Coding DNA Sequence Number=SeqID_12972
  Subcellular localization annotation: CTP_CleavageSite=60; ConfidenceScore=5.20e-01
MSSSINRHVSEAAVTKTSSYGAPFLPKLPTIISDSFLNQITSHKAHFSSFFILFHSNRSKSSITSSNGRIIQEAQGFIYLRYDN

SEQ ID NO: 129751 - protein, 81 aa, Glycine max
  Coding DNA Sequence Number=SeqID_12973
  Gene Ontology: Mol. function=sequence-specific DNA binding; Cellular component=nucleus; Biological process=regulation of transcription
  Homolog annotation: Hit_ID=Q39658; Match level="QueryCoverage=97%, HitCoverage=14%, E-value=1e-20, Identity=62%"; Hit description=SPF1 -like DNA-binding protein
  Pfam annotation: Domain name=WRKY; Domain location=60-81; Score=-2.1; E_value=0.0013; Accession=PF03106.6; Description=WRKY DNA -binding domain
MSDVDNREEVDDGEPNHKRRQSKFLLFRNTDVGVSEVPLSQKTVTEPKIIMQTRSKVDLLDDGYRWRKYGQKVVKGNPHPR

SEQ ID NO: 129752 - protein, 137 aa, Glycine max
  Coding DNA Sequence Number=SeqID_12974
  Subcellular localization annotation: CTP_CleavageSite=86; ConfidenceScore=5.02e-01
MAYYALNRSTRVSKLFSDLGGSPLYQVNVAPLRDVGKTRHKITSSLVWRFACVKKASRCSFGSVVPSYCSRLSGFHPKGCDSPCVRSSKVWADCLSPWGRLTRASSWSCCQMRMQVCERGLASDARLSANYGWMRED

SEQ ID NO: 129753 - protein, 77 aa, Glycine max
  Coding DNA Sequence Number=SeqID_12975
MLAIIPTKVPQSPFSQGYNPKMTCAYHRGVPGHSIEHCMTLKHKVQSLIDAGWLRLEEENRSNCSFYTFGEGAVNDK

SEQ ID NO: 129754 - protein, 117 aa, Glycine max
  Coding DNA Sequence Number=SeqID_12976
  Homolog annotation: Hit_ID=UPI000044A741; Match level="QueryCoverage =61%, HitCoverage=17%, E-value=5e-09, Identity=53%"; Hit description =PREDICTED: similar to Ac1147, partial
IIAIVGLQRGIPSKRESSARVDYVPALCTHRPSLLPIEWSGEVFGLRRREPAEGSLSMPHNQIDPRTCLFIYRREGGDDHGAPCARPPRPRDKHKPRRFVRQGNSNLLSATPGGPET

SEQ ID NO: 129755 - protein, 157 aa, Glycine max
  Coding DNA Sequence Number=SeqID_12977
GSLNAFLFFSSELFTKTCHGKEEGGTSTLGERSTTDSCAMIYFTGEVSAQLVELRSCNWVVAITGWMSNCPGGNDSILYLNRRAVKNVEEGFLIWDPGEEDQAGPCEQLDALSPFNPLSEMWQKEKESMDRPHRLHPVGTTRSPQGRLRHPGVADRP

SEQ ID NO: 129756 - protein, 96 aa, Glycine max
  Coding DNA Sequence Number=SeqID_12978
MGEMLATQLAQASKVASSRSNRLLEESSGGPGPSYYIIIPFLTYGMLRNLTNCATMLPFEFRHVTELHELPDDGCQVPQNGQMKVACHQAKVPGRN

SEQ ID NO: 129757 - protein, 60 aa, Glycine max
  Coding DNA Sequence Number=SeqID_12979
MMQVSREYWRQRLSSNSPPGLKKEERKPQPKCEKWVNGLPSVTSLIVVVLTTQTLRHLTR

SEQ ID NO: 129758 - protein, 212 aa, Glycine max
  Coding DNA Sequence Number=SeqID_12980
  Gene Ontology: Biological process=multicellular organismal development
  Homolog annotation: Hit_ID=Q9M2J7; Match level="QueryCoverage=56%, HitCoverage=56%, E-value=3e-52, Identity=77%"; Hit description=LOB domain-containing protein 29
  Pfam annotation: Domain name=DUF260; Domain location=7-108; Score =224.7; E_value=2.1e-64; Accession=PF03195.5; Description=Protein of unknown function DUF260
MTGSGSPCGACKFLRRKCVRGCVFAPYFCHEQGVTHFAAIHKVFGASNVSKLLAHLPVSDRCEATVTISYEAQARLQDPIYGCVAHIFALQEQVVNLQAQLAYLREQAGQIYLNASATENPNEKLLGKPTTFPQDLQSRFQMENSNMASQFLPNLSTNPSTHYYGNTNSLMEPNPIGNYESSGTVEESISFSSFEESCNSMSYDMQRQWGLS

SEQ ID NO: 129759 - protein, 123 aa, Glycine max
  Coding DNA Sequence Number=SeqID_12981
  Homolog annotation: Hit_ID=P93384; Match level="QueryCoverage=41%, HitCoverage=33%, E-value=1e-16, Identity=75%"; Hit description =Nicotiana tabacum ORF
  Pfam annotation: Domain name=HR_lesion; Domain location=9-104; Score =83.6; E_value=6.2e-22; Accession=PF05514.2; Description=HR-like lesion-inducing
MELDTACEFMHFSVIKYSTYPILSSKQMKFLVAGAIALKGLGGILFILSSSFGAFLLLLHQVITTPILYDFYNYHSEDKEFIQLFIKFTQNMALFGALLFFIGMKNSIPRRQPKKKAAKTKTY

SEQ ID NO: 129760 - protein, 44 aa, Glycine max
  Coding DNA Sequence Number=SeqID_12982
EIKGQGDQKITCIWTKDNADKCLARPVKLNQPQAFNMGPLHVYG

SEQ ID NO: 129761 - protein, 43 aa, Glycine max
  Coding DNA Sequence Number=SeqID_12983
MARFGIMVVKSAGLRAFDGVLQSNITLKTLDLSGNLVGDEGAK

SEQ ID NO: 129762 - protein, 90 aa, Glycine max
  Coding DNA Sequence Number=SeqID_12984
  Gene Ontology: Mol. function=DNA binding; Biological process=DNA integration
  Homolog annotation: Hit_ID=Q1S1X7; Match level="QueryCoverage=58%, HitCoverage=4%, E-value=3e-11, Identity=50%"; Hit description =Integrase, catalytic region; Zinc finger, CCHC-type; Peptidase aspartic, catalytic
MSLSTTIDFKTPIEVWFNKPVEYSMLKVFGCPTYYHVSEGQLEPKAKEGFFMGYGDEVEFKSSTIRNINDQKQFEAPNKIDQDLQMNPQH

SEQ ID NO: 129763 - protein, 191 aa, Glycine max
  Coding DNA Sequence Number=SeqID_12985
  Pfam annotation: Domain name=zf-CCHC; Domain location=139-156; Score =21.2; E_value=0.00031; Accession=PF00098.13; Description=Zinc knuckle
MDDRDKVDKNLGCMVQYLVFYTGHSIFCNLVEHSVTFGQDQFHICFVVDQVNNDQPFYLSSVCAVSSRFYQEDGQIGEILHDEINLQQVAFEMTFVWPLNVGRNGDEAFASGLSMIDSTKGKNNKKGKGGKKRKFDPKDICNYCKELGHWKQNCPKKAKKYYVVALVQNDFSSKNNLVLVVGEQLQQYSEQ

SEQ ID NO: 129764 - protein, 64 aa, Glycine max
  Coding DNA Sequence Number=SeqID_12986
MEERMKLVLPLLQSSKELPCAGKFLRDEKIEIMENRCDLEAQPPMYKAFLLASISNLKRGPMLN

SEQ ID NO: 129765 - protein, 106 aa, Glycine max
  Coding DNA Sequence Number=SeqID_12987
  Gene Ontology: Mol. function=nucleic acid binding; Cellular component= mitochondrion; Biological process=DNA integration
  Homolog annotation: Hit_ID=Q1S1X7; Match level="QueryCoverage=99%, HitCoverage=8%, E-value=6e-27, Identity=56%"; Hit description =Integrase, catalytic region; Zinc finger, CCHC-type; Peptidase aspartic, catalytic
MDEEMESLQKNQTWDLVKLLEGKRVVECKWIFKKKSRLSIEEVVFHKARLVAKGYNKKEGVEYDDVQYTSIRVFLALVATLNMELEQLDVKTAFLHRRLEEDILMQ

SEQ ID NO: 129766 - protein, 370 aa, Glycine max
  Coding DNA Sequence Number=SeqID_12988
  Gene Ontology: Mol. function=enzyme inhibitor activity; Cellular component=cell wall; Biological process=cell wall modification
  Homolog annotation: Hit_ID=Q9MBB6; Match level="QueryCoverage=59%, HitCoverage=37%, E-value=2e-37, Identity=39%"; Hit description =Pectin methylesterase
  Pfam annotation: Domain name=PMEI; Domain location=70-223; Score =126.7; E_value=6.3e-35; Accession=PF04043.6; Description=Plant invertasepectin methylesterase inhibitor
MAFQDFDMITERRRNEQRLKMKKKILISVVSAVLLACVVGAAAFVVVQRTGTNAKHATPMPQNTATPHVDQNSRMVKMICGSAEYKEKCESTLEEALKKDPKLAQPKDLIMVSMILAEKEVTNAFDGTAKMMGNASEEEKGAYEDCKGLFKDAKEELELSITEVGDNDADKLSTKGAELNNWLSAVMSYQQTCIDGFPEGKIKDDFTSMFTNSRELVSNSLAVVSQFSSFFSIFQGAGGIHLPWETTSDDALAPTASGSASGAGAGAGAGSVFGSDPSSFGLGYASAPAGGVALAPGVAPAPGAAPGPVPSLPAGSIPAWTGSVPVWAGPSEFLGSNEKPTPNVTVAQDGSGNFKTISEALAAIPPQYDG

SEQ ID NO: 129767 - protein, 768 aa, Glycine max
  Coding DNA Sequence Number=SeqID_12989
  Gene Ontology: Mol. function=nucleic acid binding; Cellular component= intracellular; Biological process=DNA integration
  Pfam annotation: Domain name=rve; Domain location=389-512; Score =51.1; E_value=3.6e-12; Accession=PF00665.16; Description=Integrase core domain
  Pfam annotation: Domain name=zf-CCHC; Domain location=173-190; Score =24.7; E_value=8.2e-05; Accession=PF00098.13; Description=Zinc knuckle
  Pfam module annotation: Pfam domain module=RVT_2::rve::zf-CCHC; Domain location=642-768::389-512::173-190
MKRKYEGSVRVKRAQLQALRRDFETLAMKDGESVTNYFARTMEISNKMRFHGEKMTDVTIVEKILRSLTTNFNYVVCSIEESKDIDVLFIDELQSSLLVHEQKMHRSSTREERALKASTATNTHSSDFRGRGRGRGRGRGRGRGERGNREDNKNPRANTTSKGRGQYSDRSKLECFRCHKFGHYASECYSRLPNDREKGESSNFTENKEAETLLMAIQEGGKTESDIWYMDIVCSNHMSGLMGKGDVKIKNKSGFVETISNVLYAPDLKSNLLSAGQLQEKGYVNTIQKGACEIYDLVRGAIAIVQMSSNRLFPLKIESIQTCFKTDMEDPSWLWHFRYGHLNFSGLKTLQQKNMVTCLPQINIPSQVCEECVVGKQHRSQFPKGKSWRAKDVLELVHSDICGPMSFKASVENEAGKSIKNLRTDRGGEYCSKEFEIFCAEHGIRRELTTAYTPQQNGVSERKNRTIFNMVRSLLARGNVPKAFWLSSTFSVQNMTPEEAWKGRRPAVDHFRIFGCITYAHVPEIVTSRDVVFDEENTWEWERQQPSQVIYNNDTEHYQISTPYMPENSTNSTPITAVTSPTTTSINEEEAQSHSRVRRRPMWMKDYKVTGIQNPITHFALFADCDPTTFESVVKEEKWRKAMNDEIDAIERNDTWELCDLPRGQKTIGVKWVFKTKLNENGEVDKYKAYLVAKGYKHNMGLITQKCFPRLQDMTQLDWWSRWQHNNPGKFSSSMSNPHPCTDTWKNKYMLINLLVMLRLELRKKFTN

SEQ ID NO: 129768 - protein, 151 aa, Glycine max
  Coding DNA Sequence Number=SeqID_12990
  Gene Ontology: Mol. function=nucleic acid binding; Cellular component= endoplasmic reticulum membrane; Biological process=DNA integration
MQNCNSATTPAAFGCKLHKDHEGKNVDNTFFKQIVGSLMYLTATRPDIMYSVSLVSRYMEYPTEEHLLAAKGILRYLQGTRDFGLFYRKGTKSNLLGFTDSDFAGDQDDRRGTLGYAFMFGTGAITWSSKKQPIVTLSSTEVEFVVATACA

SEQ ID NO: 129769 - protein, 595 aa, Glycine max
  Coding DNA Sequence Number=SeqID_12991
  Gene Ontology: Mol. function=transcription regulator activity; Cellular component=nucleus; Biological process=regulation of transcription
  Homolog annotation: Hit_ID=Q2HVX8; Match level="QueryCoverage=30%, HitCoverage=20%, E-value=1e-50, Identity=56%"; Hit description=Helix- loop-helix DNA-binding
  Pfam annotation: Domain name=HLH; Domain location=415-465; Score=7.3; E_value=0.024; Accession=PF00010.16; Description=Helix-loop-helix DNA- binding domain
MEFVTHIRNLFLSTQNYSILRPSQIQGSLKSSSELDTLKENLSSDIMPTCFYDTQKSMKSETADVLMPLQCSGTGRNYTPSAHEKMSDNVAKQEGPELYNDESSILLQSISNMMNVDCKEFEEMKPLYGMKYEGGSSGDCKDMRLESEKNVSSYLNDFVTDNASFNDLICPSEKVRVDSACFPSVFLDTVVCESDKLHYADINQKGALNFAQPSEANSQQHIEKSKFHTEPCYKDISDFQTEPCYKDASQMLNFPAGCELHEALGPAFSKVGKCFDWPTQVNQEMKPVEMSDEISTSQLTSESCPEHLLEAMLVNINHSNNDVNSELSFCTSKQSAMASAKNHEASIHNVHTINSEGYLMDQLSLVREDKHHSLSSSSGICGVMSSKGVSSTFHSSNSGQLERSSEPSKNSKKRARPGESCRPRPRDRQLIQDRIKELRELVPNGAKCSIDSLLERAIKHLLFLQSITKHADKLTDFADTKSKLHHKEADILGSSSYDQGSSWAMEVGGHLKVHSILVENLGKNGQMLVEMLCEECSHFLEIAEAIRSLGLTILKGATKAHGEKIWICFVVENTDYLLAHCMLKFNYSPSSTSQS

SEQ ID NO: 129770 - protein, 255 aa, Glycine max
  Coding DNA Sequence Number=SeqID_12992
  Homolog annotation: Hit_ID=Q2VWB7; Match level="QueryCoverage=38%, HitCoverage=15%, E-value=4e-09, Identity=38%"; Hit description=Prf interactor 30137
MGADRLILPTVGPPLKRRAGLRRKQAGRGIQILGGVKVSDLLRGATWVPTCTNDSKYLDIADTIAVAEHYLKPCSLVVDVGNLEYGFLLLVVVQFGLKKIVVVVILFGILTWEDAYYSNPDDYDSSENKHCQKTLEQIGCGKFSHSALELAVAKMSYHAYSLGEGIIGQVAVTGKHRWICADNQVAGSGLSFEFADGWQSQFSAGIRNRRYIVPEVLQEATGGRFSWDRKTIAVVAVVPLGVVQLGSLNKHHTVG

SEQ ID NO: 129771 - protein, 55 aa, Glycine max
  Coding DNA Sequence Number=SeqID_12993
MVSKVWSFDGGFNGEEEEGNSNVCHMSPFEWSKKGSTFSLDVTHTQPQEKKNLTF

SEQ ID NO: 129772 - protein, 132 aa, Glycine max
  Coding DNA Sequence Number=SeqID_12994
MRQRDVEVLEFRTPQHPSLGTNNWGGSSPLLARNVPKESLEQKYSRLNSVRTKDEIFPADYEYYVVNPSNETGASASSAKRWNKVRGVLLKLIFVRKENKTTVTLGSRLRKRRWIPRMDPTTRWPQEDEIIF

SEQ ID NO: 129773 - protein, 232 aa, Glycine max
  Coding DNA Sequence Number=SeqID_12995
QRSSVAGESVWHRLPEVPALSPALSLVSALPAAWYAAEHQTPHPSPVPTLPARQTLNLPEVAVLRDIQQHDYAVDYDDSGEPKMFSGTLAAGAQVHIYIDNVLIEVVTGDEQGHWQFAQPADLSATQHVFSAEFVDEQGHVSSRYNKLVTVLPQPAAIITPIDDSDLSAIDCALMELAMQQDDIAPALLPLTFSEAWLDEWNNADSTLTASGNHGGNLPGWDEPLEHHIVWH

SEQ ID NO: 129774 - protein, 897 aa, Glycine max
  Coding DNA Sequence Number=SeqID_12996
  Gene Ontology: Mol. function=identical protein binding; Cellular component=integral to membrane; Biological process=protein transport
  Homolog annotation: Hit_ID=Q3T8Z5; Match level="QueryCoverage=86%, HitCoverage=99%, E-value=0.0, Identity=76%"; Hit description =Autophagy protein 9
  Pfam annotation: Domain name=APG9; Domain location=197-575; Score =727.6; E_value=8.5e-216; Accession=PF04109.6; Description=Autophagy protein Apg9
MFSRQRGASAFSIFKWKHPGASSLTAGLLQEDPPEIELSYYGKIPSPGSESPSGLLNGESLNVEPIADLDLFFERLYSYYCEKGLWCIIIKWIVELLSLGFTICFSGFFLLYVDWNGLRNAKCGMDAVESGIKPCDLAKEALHQHPLTPLTLTKAIIVGYLGIFSIYWIFCFLRFFAQLKDTLEIRHFYYNSLNVTDNEIQTMPWTTILEKVVLVQGSRQLCVVKDLSAHDIIMRLMRKENYLIGMLNKGVLAFPISQWFPGAGPTGKSSSNGTQNRVILTKTLEWTLNWCILQSMFDRRDFVSNPKTLRKRLMVVGLAMLLLSPFLVIFMLVYLFLRHAEQFYNHPSTASSRRWSNLSRWIFREFNEVDHLFKHRINSSVLHASDYLKQFPSPIISIIAKFISFVSGGFAAILIIIAFLEESLLEGHIFGRNLFWYAAVFGTITAISRAAITSEVLVLDADGAMSMVVQHTHYMPKRWRGKESTEMVRVEFETLFQYTGMMLLEEMASIFLTPYLLLCIVPKRVDDILQFIADFTVNIEGVGHVCSFSAFDFQEHGNSRYGSPCNAPRSQRSSQGKMEKSLLSRFKESLRFYHSSFNRCPLSCLQALIAVAMSFQSSYPSWEPSAQGKRFLLNLRRFREEKLSVHGNIHTPSHPRMWRGSPNMGSNSGDRNRFISREMPYSTCDNHLGSLWLIEANQNNHPYLLDWYYTSRSHDTNLGDVPLEEPFGSHDVNLGDVHLEPFGAIEHRSREYLMLSNLTQNESGYEEYSNEFQDGRAASHLGISISVPIFRESMIHDQSCNELSHTSRSHWWARSDPRGGQTQTSFFEPPAFNLQTYDYHDKFSDRGSEDQDQEQRMYSRDDHRLSRTYTDDLGAGEFNLHFDDIYSRPPETPPASF

SEQ ID NO: 129775 - protein, 124 aa, Glycine max
  Coding DNA Sequence Number=SeqID_12997
MDIELVGHGLSGVVWHGLGQVMRKLCGACLSCDTRIGVMHMFECVVGKKGGYSLQLRILIQPDVLLVKGNISYCKYFSPFKSFWNVSVDAEIDHDQDRPVTLEPITKIPLLGGGRAKRSEKGFP

SEQ ID NO: 129776 - protein, 291 aa, Glycine max
  Coding DNA Sequence Number=SeqID_12998
  Gene Ontology: Mol. function=metal ion binding; Cellular component =integral to membrane; Biological process=ubiquitin cycle
  Homolog annotation: Hit_ID=P93823; Match level="QueryCoverage=88%, HitCoverage=88%, E-value=7e-13, Identity=37%"; Hit description=RING -H2 finger protein ATL1A
MALNYNPSYNLVHQAPHANTIIYHTTQPASDLPILAIIVPSIFVTAFILITYLTLVTKCCSNWHQLNPLRWISTLQASQHEHQDHQDPFIALSLSPMMWNHGLDESAIKEIPTLECTKAEAEKNIQSVCGCVDDVIAPSSSPQDSQLLSYMGSDEDFVVIELGGQHVATLPQMMQRERSDTRERNQRIVGYSRSHSTRKCHHVSIMGDECIDVRKKDEQFSIQPIRRSFSMDSANDKQLYLDFQTMIQQNNRHQNQASASEDCNSRSRRSFFPFRYARGSKTLVVPLENKV

SEQ ID NO: 129777 - protein, 42 aa, Glycine max
  Coding DNA Sequence Number=SeqID_12999
MYCDRWLRFKSTGRLGCSTIMVVETVVMETVVVVVEMVVVFE

SEQ ID NO: 129778 - protein, 70 aa, Glycine max
  Coding DNA Sequence Number=SeqID_13000
MAWARRYNRGKVEMKSNAWRCKTILDSGGIDKYPMEKVGGYITCWCGEECGRGKEGLNDVYRLKGLGNRH

SEQ ID NO: 129779 - protein, 41 aa, Glycine max
  Coding DNA Sequence Number=SeqID_13001
VGPNANFVTLSTSNLNPPKRSVMEMEWGIGSFAGDEGNERG

SEQ ID NO: 129780 - protein, 99 aa, Glycine max
  Coding DNA Sequence Number=SeqID_13002
  Homolog annotation: Hit_ID=Q1RSZ9; Match level="QueryCoverage=68%, HitCoverage=5%, E-value=1e-10, Identity=53%"; Hit description =Polynucleotidyl transferase, Ribonuclease H fold
MPWALSPYPYPSSNDPPPSLHWIRPNFQQAEQCQTSILGSKPLEAYTAIAAPPTPIEIEAMIHTLGLNPSYANWYMDTSATSHMASEQGFIDGGKSHEM

SEQ ID NO: 129781 - protein, 164 aa, Glycine max
  Coding DNA Sequence Number=SeqID_13003
  Gene Ontology: Mol. function=N-acetyltransferase activity; Biological process=metabolic process
  Homolog annotation: Hit_ID=Q1T052; Match level="QueryCoverage=55%, HitCoverage=31%, E-value=3e-18, Identity=54%"; Hit description =Oleosin; Casein, alpha/beta
MEHTVLTNLTVSSGGGCLGVECDEGGGVGHEGPAIEEVLLNEEGEEFDVGLGEEHGLGEGRGQEEDGGVGLVGAHDADGEGAAGREVAAVEEGLQEAEAAKLVVGEEAAGVEGIVGDSEGGRGGGMGRGEFKSGEGFRGEARFCGGEREREGLDLRVEGKGEGK

SEQ ID NO: 129782 - protein, 73 aa, Glycine max
  Coding DNA Sequence Number=SeqID_13004
MPLMETLTPLLGRANPSSNAEKKAEPFGTVNGGVEGGEERVVELLVHDLGGEHDRKGAVVEFGEVDKVDVAGA

SEQ ID NO: 129783 - protein, 45 aa, Glycine max
  Coding DNA Sequence Number=SeqID_13005
MKIVSHGDRAEQFIFSIRELVDGTTFEAIKKVGDPVTGPVHSAVL

SEQ ID NO: 129784 - protein, 318 aa, Glycine max
  Coding DNA Sequence Number=SeqID_13006
  Gene Ontology: Mol. function=molecular_function; Cellular component =cellular_component; Biological process=cell differentiation
  Homolog annotation: Hit_ID=Q6Z8B1; Match level="QueryCoverage=99%, HitCoverage=93%, E-value=1e-118, Identity=62%"; Hit description =Putative pollen specific protein
  Pfam annotation: Domain name=Ndr; Domain location=2-276; Score=367.6; E_value=1.9e-107; Accession=PF03096.5; Description=Ndr family
MEHIIRTRHGSVSVAVYGDQDKPALITYPDLALNYVSCFQGLLFCPEAYYLLLHNFCIYHISPPGHELGAAAIDQDHPILSVDDLADQIAEVLNFFGLSAVMCMGVTAGAYILTLFAVMSNLLYFYGMCGVVKEILLKRYFSKEIRGGTQLPESDIVKSCRRLLDERQSLNVWRFLEAINEYDYTFKIVILVFLFEGRVMRPDISEGLRKLHCRSLIFVGDMSPFHSEAVHMTSKLDRRFSALVEVQACGSMVTEEQPHAMLIPMEYFLMGYGLYKPSKLSVSPRSPLSPSCISPELYSPESMGLKLKPIKTRISLEI

SEQ ID NO: 129785 - protein, 78 aa, Glycine max
  Coding DNA Sequence Number=SeqID_13007
MESHGDNIKWRLQSLLPSDVWQPYQSNQREKIEESQEPAKDAAITVGRHLQWGPLMVIFHHGDAAEDKGEEVIGGAIH

SEQ ID NO: 129786 - protein, 489 aa, Glycine max
  Coding DNA Sequence Number=SeqID_13008
  Gene Ontology: Mol. function=aspartyl esterase activity; Cellular component=cell wall; Biological process=cell wall modification
  Homolog annotation: Hit_ID=Q43062; Match level="QueryCoverage=92%, HitCoverage=89%, E-value=1e-147, Identity=56%"; Hit description =Pectinesterase PPE8B precursor
  Pfam annotation: Domain name=PMEI; Domain location=4-149; Score=54.2; E_value=4.4e-13; Accession=PF04043.6; Description=Plant invertasepectin methylesterase inhibitor
  Pfam annotation: Domain name=Pectinesterase; Domain location=197-475; Score=576.5; E_value=2.6e-170; Accession=PF01095.10; Description =Pectinesterase
  Pfam module annotation: Pfam domain module=PMEI::Pectinesterase; Domain location=4-149::197-475
  Subcellular localization annotation: CTP_CleavageSite=24; ConfidenceScore=5.47e-01
MAVFSTKQLSTSTLTTTFIIFFVRSEFTGHGSLRVSPSEFIGSVTTVGDVLQNVTSILKSELRSVKNDFHLPDAAVSTCLDLLDLSADELSWSISAVQSSQGNDNSTGNLSSDLRTWLSAVLANTDTCMDGFEGTNGNVKGLISTVIDQAKWLLQKLLTLVKPYVNDFSSRNSRVKFPSWIEAEDKMLLQTNGVPADTVVAADGTGNFTKVMDAVQAAPVYSMRRFVIHIKKGVYEENVVINKKKWNLVVIGEGMDATVISGNLSRSENLTTFKTATFAVNGRGFIAKGITFRNTAGPQRNQSVALRSDSDLSVFYRCGIFGYQDSLYAHSLRQFYRECRISGTVDFIFGHANAATFQGEMYPNRSSGFSIQFCNISADYDLLPYLNTTSTYLGRPWKPYSRTIFMQSYISDVLSPEGWLEWNGTLYLDTLLYAEYKNYGPGARLDNRVKWPGYHVMNDSREAYNFTVANLILGELWLPSTGVTFTPGL

SEQ ID NO: 129787 - protein, 88 aa, Glycine max
  Coding DNA Sequence Number=SeqID_13009
  Gene Ontology: Mol. function=metalloendopeptidase activity; Cellular component=proteinaceous extracellular matrix; Biological process =peptidoglycan metabolic process
  Homolog annotation: Hit_ID=Q1SAT9; Match level="QueryCoverage=87%, HitCoverage=20%, E-value=6e-22, Identity=67%"; Hit description=H+ -transporting two-sector ATPase, delta (OSCP) subunit; Peptidase, metallopeptidases
  Pfam annotation: Domain name=Peptidase_M10; Domain location=3-88; Score=-38.4; E_value=0.00027; Accession=PF00413.14; Description =Matrixin
MIQKHGPMIGYSSTNERFNLDAAHDWVVSCNMMWLALSTAMDLESVVVHEIGHLLGLGHSSVEETIMFPTTSSRKNKVVLAKDNIKGI

SEQ ID NO: 129788 - protein, 100 aa, Glycine max
  Coding DNA Sequence Number=SeqID_13010
MFGNARKTCKKTRWLGEGMWNRLCLCLNKRNNFKEHILKLGLRLHHLFVNKRLPLLTLLWRRVLSLSVGSKLLVERPRDDFTRLETLLVIIKVEIEASCK

SEQ ID NO: 129789 - protein, 238 aa, Glycine max
  Coding DNA Sequence Number=SeqID_13011
  Gene Ontology: Mol. function=aspartyl esterase activity; Cellular component=cell wall; Biological process=cell wall modification
  Homolog annotation: Hit_ID=Q43062; Match level="QueryCoverage=99%, HitCoverage=47%, E-value=3e-83, Identity=62%"; Hit description =Pectinesterase PPE8B precursor
  Pfam annotation: Domain name=PMEI; Domain location=3-134; Score=42.6; E_value=1.3e-09; Accession=PF04043.6; Description=Plant invertasepectin methylesterase inhibitor
  Pfam annotation: Domain name=Pectinesterase; Domain location=157-238; Score=-111.6; E_value=3.4e-13; Accession=PF01095.10; Description =Pectinesterase
  Pfam module annotation: Pfam domain module=PMEI::Pectinesterase; Domain location=3-134::157-238
TNTVGSELLKVAPSEFEGTVRTVVDVLQEVTSILSEFGSGFGDSRLSNAVSDCLDLLDMSSDELDWSVSATQSPKGKHNSTGNTSSDLRTWLSAALANQDTCIDGFDGTNGMVKGLVSTGIGQVMSLLQQLLTQGQYPSWVKTGERKLLQANVVSFDAVVAADGTGNYTKVMDAVLAAPNYSMQRYVIHIKRGVYYENVEIKKKKWNLMMVGDGMDATIISGNRSFIDGWTTFRSATF

SEQ ID NO: 129790 - protein, 247 aa, Glycine max
  Coding DNA Sequence Number=SeqID_13012
  Gene Ontology: Mol. function=nucleic acid binding; Cellular component= oxygen evolving complex; Biological process=DNA integration
  Homolog annotation: Hit_ID=Q1T010; Match level="QueryCoverage=99%, HitCoverage=21%, E-value=1e-74, Identity=50%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MALASQRNWSVYHLDVKSAFLNGSLNEDVYVTQPPGFEIKRKEKLVYKLNKALYGLKHAPRCWNQKINSFLIKHRFKQCTVEYGVYYKKRDLLVTGSDSYEIGRFKELMKSEFEMSDLGILTYFLSLEFMYTGKGILMHQRKYTTNILKWFKMMDCNHTITPSELNFRKEDTEDEERVDPTHYKLDLSFAVGVASRHMHELRKSHFIASKRILRYLKGYCDLDRCGDKSDRRSTIGYPFKLVGAPIS

SEQ ID NO: 129791 - protein, 188 aa, Glycine max
  Coding DNA Sequence Number=SeqID_13013
  Gene Ontology: Biological process=response to biotic stimulus
  Homolog annotation: Hit_ID=Q6H5Z4; Match level="QueryCoverage=89%, HitCoverage=87%, E-value=1e-56, Identity=61%"; Hit description=Bet v I allergen-like
  Pfam annotation: Domain name=Bet_v_I; Domain location=32-178; Score= -29.8; E_value=0.001; Accession=PF00407.9; Description=Pathogenesis -related protein Bet v I family
  Pfam annotation: Domain name=Polyketide_cyc; Domain location=45-177; Score=18.9; E_value=0.0062; Accession=PF03364.10; Description =Streptomyces cyclasedehydrase
  Pfam module annotation: Pfam domain module=Bet_v_I::Polyketide_cyc; Domain location=32-178::45-177
MASETHHHVQGLTPEELTQLEPIIKKYHLFEASSNKCFSIITHRIEAPASSVWPLVRNFDNPQKYKHFIKGCNMKGDGSVGSIREVTVVSGLPASTSTERLEILDDDKHVLSFRVVGGEHRLQNYRSVTSVNEFHKEGKVYTIVLESYIVDIPEGNTEEDTKMFVDTVVKLNLQKLGVVAMASSMNGR

SEQ ID NO: 129792 - protein, 110 aa, Glycine max
  Coding DNA Sequence Number=SeqID_13014
MASSFLLIACHISASLRPVIRGTQIPFVDGGGYNLLSQHALLRTSEARLMGAFSKGGKCAESPPTFICGKRRKNRRKPVIKNIPSSGVVFTFEEGISTSHVCLKGQQPYF

SEQ ID NO: 129793 - protein, 133 aa, Glycine max
  Coding DNA Sequence Number=SeqID_13015
MGVVVGGLIVRTTNIVAMSCNVMVMKSKENTKVLAVVDQKLKKLKIKGSYSFEQHVVRVKIPRPSSQIKGNRAYLKPISNGNRIAIMVKVMLEEGNNVEDDGIINTRTKVEVSFVGYGIFLIRLIVQKSSRGR

SEQ ID NO: 129794 - protein, 571 aa, Glycine max
  Coding DNA Sequence Number=SeqID_13016
  Gene Ontology: Mol. function=sequence-specific DNA binding; Cellular component=nucleus; Biological process=regulation of transcription, DNA-dependent
  Homolog annotation: Hit_ID=P48731; Match level="QueryCoverage=55%, HitCoverage=62%, E-value=3e-80, Identity=54%"; Hit description =Homeobox protein ATH1
  Pfam annotation: Domain name=Homeobox; Domain location=473-531; Score= -0.3; E_value=0.0053; Accession=PF00046.19; Description=Homeobox domain
  Pfam annotation: Domain name=POX; Domain location=289-429; Score =73.2; E_value=8.1e-19; Accession=PF07526.2; Description=Associated with HOX
  Pfam module annotation: Pfam domain module=Homeobox::POX; Domain location=473-531::289-429
MENNMYSARLDMAGRNSTGIDEIARHLAPKPLIHCYSFDLNNQNHIINGIPVLAGEQGEPANDVHVEGCFLNPASIADSNSFVTSQGKTIVGDASNQINNNDFQEHLVGGRPIASASLSAARIGLQANLESSEALPYSMCSLEALGPYLFNNWQGTSNPLPATFGDHHHAYDELSSIGKWNVNKILRAPEADGTEILAYSSIGSLVQNGWTSSNVANLANFAYNSPHCSNELSLSLARSPQTTGQCSEMSCSGASHSMNGTRSGLEQSSCSSKELCMRLGSNKHVQFSSAILGSRFLVGIQEILAQIATYSFENVEQINCSAAGVRAGGDKSASAFTPKRTVENNQNASMFGAHVEESPLEGLATESNKSQLLMLLQLVDNGYSQCLDEIHTVVSAFHAATELDPHMHAHFALQTISLLYKDLRERISNCILAMGPDFNSLCSEEEKEWSLETSFIQKQWALQQLKRKDQLWRPQRGLPERSVSVLRTWMFQNFLHPYPKDAEKHLLAVKSGLTRSQVSNWFINARVRLWKPMIEEMYAEMSRRKACRNEEGMEITQRTRISMKNQMLNIN

SEQ ID NO: 129795 - protein, 256 aa, Glycine max
  Coding DNA Sequence Number=SeqID_13017
  Homolog annotation: Hit_ID=P11139; Match level="QueryCoverage=38%, HitCoverage=21%, E-value=7e-23, Identity=61%"; Hit description =Tubulin alpha-1 chain
MYFPMFMAKNPKSTKVVDRHAKDPTLGESLRIKSTTSDLAHFFIEAIFGILDDIGFPFYLLQANDHFQPDPIAQTPRQPKSSPHPVSFLAKKKKSSPARITINPSLTPQTGIIFTTTKMIFYDMGSKKSGAIFARASPSVWPTTRTTSSSAKSDPTTSVPHAIFVFLDPTIIDEVCCGTYRQLFHPKQLISGKEDAAKNFSRGHYTVGKEIVDLCLDPKNRLVARVGYFWASIRKSHLQNNFCGIEETDIVMLKDY

SEQ ID NO: 129796 - protein, 78 aa, Glycine max
  Coding DNA Sequence Number=SeqID_13018
QPVSITADHDRSMLGSSEPTELESQSVSVIGDHDPLLKIPLTPTKCVSSNELDNERKNFQISPAEVSSNKLAKHSQLE

SEQ ID NO: 129797 - protein, 178 aa, Glycine max
  Coding DNA Sequence Number=SeqID_13019
  Gene Ontology: Mol. function=nucleic acid binding; Cellular component= intracellular
  Homolog annotation: Hit_ID=Q9FIY6; Match level="QueryCoverage=36%, HitCoverage=47%, E-value=9e-11, Identity=49%"; Hit description =Arabidopsis thaliana genomic DNA, chromosome 5, TAC clone:K9D7
  Pfam annotation: Domain name=zf-C2H2; Domain location=28-50; Score =18.1; E_value=0.031; Accession=PF00096.16; Description=Zinc finger, C2H2 type
MDLNYPEECYSKSSSEETNDDMGIGRSYECIYCKRGFTTAQALGGHMNIHRKERANKTKPSFQPPSSSSNNVDDINNYADLGFYSQISSLSSTAPIDANSYREVFFPTTTASSVRPSSHGEVLCVENQRGHHVFEQDWRKRNLSLYSTNPLCFHEIKDKFEESEENGLDLELRLGYLP

SEQ ID NO: 129798 - protein, 599 aa, Glycine max
  Coding DNA Sequence Number=SeqID_13020
  Gene Ontology: Mol. function=catalytic activity; Cellular component =intracellular; Biological process=metabolic process
  Homolog annotation: Hit_ID=Q9LHZ4; Match level="QueryCoverage=94%, HitCoverage=80%, E-value=7e-84, Identity=32%"; Hit description =Pentatricopeptide (PPR) repeat-containing protein-like
  Pfam annotation: Domain name=PPR; Domain location=178-212; Score=2.3; E_value=4; Accession=PF01535.11; Description=PPR repeat
  Pfam annotation: Domain name=PPR; Domain location=281-315; Score =43.1; E_value=9.4e-10; Accession=PF01535.11; Description=PPR repeat
  Pfam annotation: Domain name=PPR; Domain location=382-416; Score =36.0; E_value=1.3e-07; Accession=PF01535.11; Description=PPR repeat
  Pfam annotation: Domain name=PPR; Domain location=423-457; Score =39.0; E_value=1.6e-08; Accession=PF01535.11; Description=PPR repeat
  Pfam annotation: Domain name=PPR; Domain location=458-491; Score=7.0; E_value=1.1; Accession=PF01535.11; Description=PPR repeat
  Pfam annotation: Domain name=PPR; Domain location=77-111; Score=28.9; E_value=1.8e-05; Accession=PF01535.11; Description=PPR repeat
  Pfam module annotation: Pfam domain module=PPR::PPR::PPR::PPR::PPR::PP R; Domain location=178-212::281-315::382-416::423-457::458-491::77-111
MRSAPTISSQNPLETLRAFFSCAKILSSAQQLHAQVIINGLHKKVFYGSNITNVYIQSGSLPLAKKAFDQISVKNLHSWNTIISGYSKRSLYGDVLQLFRRLRSEGNAVDGFNLVFSVKASQRLLLLHNGRLLHCLAIKSGLEGDLFFAPAILDMYAELGSLDDARKLFERYSYRSSVMWGFMIKGYLNFSLESKVFELFSCMTNYFGFKWDAFTMEGLVRACANLLAGREGKASHGVCIKNNLLVNVCLLTSVIDMYMKCGVTHYAFRLFEKANDLKDVVLWSAVINGCAKKGKFCEALSVFRRMLENSITPNPVTLAGVILACSGVGSLKQGKSVHGFVVRNMVQLDVVNYTSLVDMYSKCGCVKTAYRIFCMMPAKNVVSWTAMINGFAMHGLYFKALSIFYQMTQNSCVISGKHVPNSITFTSVLSACSHSGMVQEGLRIFNSMKDYGISPTEEHCAYMIGVLARVGQFDAALSFLSNMPIKPGPNVLGVLLSACRFHKRVELAEEIAKTLSSLEHNDLSWHASLSNIYSDGRMWGVVEMAMAEEGLNKSLGFSSIEVRNKLCLFSSNDTLAFTSTNISHTWNSLSREMREIALL

SEQ ID NO: 129799 - protein, 337 aa, Glycine max
  Coding DNA Sequence Number=SeqID_13021
  Gene Ontology: Mol. function=deoxyhypusine monooxygenase activity; Cellular component=cellular_component; Biological process=hypusine biosynthetic process from peptidyl-lysine
  Homolog annotation: Hit_ID=Q94JW0; Match level="QueryCoverage=91%, HitCoverage=92%, E-value=1e-119, Identity=74%"; Hit description =Deoxyhypusine hydroxylase
  Pfam annotation: Domain name=HEAT_PBS; Domain location=192-218; Score= 12.5; E_value=1.5; Accession=PF03130.6; Description=PBS lyase HEAT -like repeat
  Pfam annotation: Domain name=HEAT_PBS; Domain location=223-249; Score= 23.6; E_value=0.00069; Accession=PF03130.6; Description=PBS lyase HEAT-like repeat
  Pfam annotation: Domain name=HEAT_PBS; Domain location=256-282; Score= 29.8; E_value=9.9e-06; Accession=PF03130.6; Description=PBS lyase HEAT-like repeat
  Pfam annotation: Domain name=HEAT_PBS; Domain location=65-91; Score =32.2; E_value=1.8e-06; Accession=PF03130.6; Description=PBS lyase HEAT-like repeat
  Pfam annotation: Domain name=HEAT_PBS; Domain location=98-124; Score =20.7; E_value=0.0051; Accession=PF03130.6; Description=PBS lyase HEAT-like repeat
  Pfam module annotation: Pfam domain module=HEAT_PBS::HEAT_PBS::HEAT _PBS::HEAT_PBS::HEAT_PBS; Domain location=192-218::223-249::256 -282::65-91::98-124
MEKFLCELLLDSSQPISERFRALFSLRNLKGPVPRNALICEDKLRTPLPRGSSLCEATRDSSNLLAHEAAFALGQMQDLEAIPALASVLNDLSLHPIVRHEAAEALGAIGSDGNVPFLKSSLDLDPAEEVRETCELALQRIQNLKDAGNTDELSANGVSPFKSVDPAAPAISGSSVDQLRQVLLDEEKGMYERYAALFALRNDGGNEAVTAIIDSLGSKSALLRHEVAYVLGQLQDKAASAALSNILKDVNEHPMVRHEAAEALGSIADDQCVALLEEFSADPEPLVSQSCQVALSMLEFERSGKSFENEWMLENGDTNTVTYKEIECKCGISDFNG

SEQ ID NO: 129800 - protein, 139 aa, Glycine max
  Coding DNA Sequence Number=SeqID_13022
  Gene Ontology: Mol. function=transferase activity, transferring glycosyl groups; Cellular component=intracellular; Biological process=protein amino acid ADP-ribosylation
  Homolog annotation: Hit_ID=Q9ZP54; Match level="QueryCoverage=97%, HitCoverage=13%, E-value=6e-26, Identity=57%"; Hit description=Poly [ADP-ribose] polymerase 1 (EC 2.4.2.30) (PARP-1) (ADPRT 1) (NAD(+) ADP-ribosyltransferase 1)
MEGGIREVGKIVMQDVQEPHCQRNAASRKDGSIHQIRWPHARNIDMHFLLFSFSFNIPHPRSILEDVENLESLRWEDQQKIRKYIESGGGGGGGSSSGSAAKSDSKTVKDTKCGIEVSQNSRATCKDCGQKIIKGEVGL

SEQ ID NO: 129801 - protein, 868 aa, Glycine max
  Coding DNA Sequence Number=SeqID_13023
  Gene Ontology: Mol. function=transferase activity, transferring glycosyl groups; Cellular component=intracellular; Biological process=protein amino acid ADP-ribosylation
  Homolog annotation: Hit_ID=Q9ZP54; Match level="QueryCoverage=98%, HitCoverage=84%, E-value=0.0, Identity=68%"; Hit description=Poly [ADP-ribose] polymerase 1 (EC 2.4.2.30) (PARP-1) (ADPRT 1) (NAD(+) ADP-ribosyltransferase 1)
  Pfam annotation: Domain name=BRCT; Domain location=280-357; Score =47.7; E_value=3.9e-11; Accession=PF00533.16; Description=BRCA1 C Terminus (BRCT) domain
  Pfam annotation: Domain name=PADR1; Domain location=175-228; Score =111.6; E_value=2.3e-30; Accession=PF08063.2; Description=PADR1 (NUC008) domain
  Pfam annotation: Domain name=PARP; Domain location=655-863; Score =389.8; E_value=4e-114; Accession=PF00644.10; Description=Poly(ADP -ribose) polymerase catalytic domain
  Pfam annotation: Domain name=PARP_reg; Domain location=520-653; Score= 90.8; E_value=4.2e-24; Accession=PF02877.5; Description=Poly(ADP -ribose) polymerase, regulatory domain
  Pfam annotation: Domain name=WGR; Domain location=405-493; Score =148.3; E_value=2e-41; Accession=PF05406.5; Description=WGR domain
  Pfam module annotation: Pfam domain module=BRCT::PADR1::PARP::PARP _reg::WGR; Domain location=280-357::175-228::655-863::520-653::405-493
VRISTKPGGQGAKGLAWHHAKCLMELSPSIDVYKLSGWNNLSSSDQSAVSDFAKKVLRIDFLLTAFFSGGSDTKIETEEGKESTQQQTSKGGIKRGKDVDSERKSKVAKAKGDVSVGSAMLVKSGEACDLEKKMETQSKELWDLKDDLKKHVTTTELREMLEANGQDSSGSEIDLRDRCADGMMFGALGLCPICSGFLRYSGGMYRCHGYISEWSKCSYSTCEPNRIEGKWKIPEETNNQYLKKWFKSQKGKKPVRILPLPSPRKSAESQMIASQHHHSSNSENLRDLKVAICGLPNDSIAEWKRKIDGIGGVFHAKVNKDTNCLVVVGSLNDEAEMRKARRMKKPIVREDYLIDCIERKKRLPFDMYKVEMIGETSSMVTIKVKGRSAVHEASGLQDSGHILEEGKSIYNTTLNMSDLSTGTNSYYILQIIEEDKGSDCYVFRKWGRVGNDKIGGTKLEEMSKSDAICEFKRLFYEKTGNPWEAWEQKTIQKQPGRFFPLDIDYGVNKQVPKNKKNDADSKLPPPLIELMKMLFNVETYRAAMMEFEINMSEMPLGKLSKSNIQKGFEALTEIQNLLKISNPDPSVKESLLINASNRFFTMIPSIHPHIIRDEDDFKSKVVKMLEALQDIEIASRLVGFDANNDDSIDDNYKKLHCDISPLPHDSEEFCLIEKFLQNTHAPTHTDWSLELEEVFSLEREGESDKFAPYRDKLGNRMLLWHGSRLTNFVGILNQGLRIAPPEAPATGYMFGKGVYFADLVSKSAQYCFTDKKNPVGLMLLSEVALGNVYELKKAKYMDKPPEGKHSTKGLGKKMPQESEYVKWRGNVTVPCGKPVPSNVKSSELMYNEYIVYNTAQVSFKSGVFAISC

SEQ ID NO: 129802 - protein, 283 aa, Glycine max
  Coding DNA Sequence Number=SeqID_13024
SAKRNTPALSARKNSEEDELYRFAKRTASVHPLSEKGVLSQKSLTLDWDSELCMSRVSRERKVQVPKSFERFCCVKICRDQILKQEPASWYGKLNPLLDLPCRAELLCFHEELGCDKLVEYVCLNAVLVEFSLTRGIYGRCLIRIRLNYHEESGSPSVRYSVLTVLYYLCDPVHLPESRTVVLMLAKNSVKEGSPFFISISKTPPNTMEEFLKRTKTNKPPKSDERLTYKTKLRYDEYTPLNASQGRILNEIMNVKLQDVSLDVQNILATIENLDMTPMIASS

SEQ ID NO: 129803 - protein, 149 aa, Glycine max
  Coding DNA Sequence Number=SeqID_13025
  Gene Ontology: Mol. function=RNA-directed DNA polymerase activity; Cellular component=chromatin; Biological process=RNA-dependent DNA replication
  Homolog annotation: Hit_ID=Q1T193; Match level="QueryCoverage=84%, HitCoverage=47%, E-value=1e-26, Identity=47%"; Hit description=RNA -directed DNA polymerase
MNTKVRIRGNYQNLHIRKEDEQMTSIGADSDNTTMEALSSFLKENGDIFIWKPMDISSIDPKFFYHKLAVNPSTKPVCQRMRKMTPKRLKEIERQVKELQEVRFIREIRYTTWLTNVVLVKKQNEKSRMCVDYTDLTNIVRKTHTHLPT

SEQ ID NO: 129804 - protein, 312 aa, Glycine max
  Coding DNA Sequence Number=SeqID_13026
  Gene Ontology: Mol. function=oxidoreductase activity; Cellular component=proton-transporting two-sector ATPase complex; Biological process=response to gibberellin stimulus
  Homolog annotation: Hit_ID=Q2HRI0; Match level="QueryCoverage=97%, HitCoverage=95%, E-value=2e-93, Identity=52%"; Hit description =Immunoglobulin/major histocompatibility complex; 2OG-Fe(II) oxygenase
  Pfam annotation: Domain name=2OG-FeII_Oxy; Domain location=164-263; Score=64.2; E_value=4.2e-16; Accession=PF03171.10; Description=2OG -Fe(II) oxygenase superfamily
MEFLTQSQLPIVDFTNENLKPGTDAWVSASQVVRSALEDHGGFLALYDKVSLETYDSVYSEMMNFFDLSIKTKRRKTTEKPIFSYSGQLPGIPLYESVGIMNPLSFQDCQKYTHVMWPQGNDHFCESVNSYAKKLVELDHIVKRMVFENYGIETKKFDTLLESTEYVLRAYKYRIPQVGESNLGVAPHSDTAFITILNQKVEGLGVKLKDGKWFEVGASPSLYLVMGGDALMVWSNDRIPACEHRVLINSKIDRYSMGLLSYAAKIMEPQEELVDEEHPLRYKPFDHYGYLRFFLTEEAIKSDSRIKAYCGI

SEQ ID NO: 129805 - protein, 85 aa, Glycine max
  Coding DNA Sequence Number=SeqID_13027
MGVFSSVLITTSIVVDVVPIEGVSSVVATRLVIKEICILDELSPHFEPFFFLLFVGSTDVKHQIDGLKKSTQLDLGHTNTNTLAT

SEQ ID NO: 129806 - protein, 207 aa, Glycine max
  Coding DNA Sequence Number=SeqID_13028
  Gene Ontology: Mol. function=nucleic acid binding; Cellular component= nucleus; Biological process=regulation of transcription, DNA-dependent
  Homolog annotation: Hit_ID=Q1SX77; Match level="QueryCoverage=96%, HitCoverage=81%, E-value=8e-35, Identity=46%"; Hit description=Myb -like DNA-binding region, SHAQKYF class
  Pfam annotation: Domain name=Myb_DNA-binding; Domain location=65-112; Score=60.2; E_value=6.8e-15; Accession=PF00249.21; Description=Myb -like DNA-binding domain
MKRRSLSMNYHLVSSRITSSSPSYNFLLGGGVDENSDKAISDGYIANVGGGGLTSTTRHQERKKGVPWNEEEHRKFLEGLEKLGKGNWRGISKHFVTTRTPSQVASHAQKYFLRQTSFNKRKRRRSLFDVGRYETTTTLEPLNTCLKASGQFGSLFGTIITCPQWVSYKHSVMNWATTSTNYTHQSAAPDLELKLAVPKQTEPCERT

SEQ ID NO: 129807 - protein, 503 aa, Glycine max
  Coding DNA Sequence Number=SeqID_13029
  Gene Ontology: Mol. function=solute:hydrogen antiporter activity; Cellular component=integral to membrane; Biological process =regulation of pH
  Homolog annotation: Hit_ID=UPI000034F37F; Match level="QueryCoverage =75%, HitCoverage=54%, E-value=6e-65, Identity=71%"; Hit description =KEA6; potassium:hydrogen antiporter
  Subcellular localization annotation: CTP_CleavageSite=72; ConfidenceScore=5.57e-01
MRKIINERSQLDPSPITTFKSSTPSCLFALLLVFSHFSTSSLSLRHAGKRSPPSNTTQHRHLLTCAGGAMSRARSRSPSPCCGDTHLVLLLPVMLAVFFHSLLLLPHSSLAIRPTESDRIELANATESSSNASLSRPREGTFADMIDRALEHEFTENDQNEAAPDPGSFNNSVAEQQAVLETVARVTPNKNDTKDEKSFQLHHVFNRAEETPMLIDRKDNVFIISNFKSKYPVLQLDLRLISDLVVAIVSATCGGVAFAFAGQPVITGYLLAGSIVGPGGFNFISEMVQIFLQTLHLNMDNIVGSLNFRNMSTFQPPQEIHPMLSLPFQRGNSVITFQKPGLTRPVGLVQSGPGGITGPVETVAQFGVIFLLFALGLEFSTTKLRVVRAVAVLGGLLQIFLFMCMCGLTVSLCGGKASEGVFVGAFLSMSSTAVVLKFLMEKNTTNALHGQVTIGTLILQDCAVGLLFALLPVLGGTSGVFQGVLSMTKLFFSLLVLTFPKEN

SEQ ID NO: 129808 - protein, 260 aa, Glycine max
  Coding DNA Sequence Number=SeqID_13030
  Homolog annotation: Hit_ID=Q8LRK7; Match level="QueryCoverage=44%, HitCoverage=34%, E-value=1e-44, Identity=79%"; Hit description=HDA2
MGYRLRYHVRFQLKINSHQVKLSNRYISYTPRTEVDDVRLPNNSPNTHAGWLCTSHLSSPGLTLRYWHHHPHSSIPAKRYGQEFDKKLAIVVGEPKLQKPFINSTPKSHTSNVDSSPIPCNWILTVGQLHGSNDAFVDYEARNYINQKVEVKSGTVTEEYLQKLDEALEVAGHRFNPELVIYNAGTDILEGDPLGRLEISPEGITLRDEKVFRFAREKNIPIVMLTSGGYMKSSAGVIADSIVNLSKKCLIETSGAPKST

SEQ ID NO: 129809 - protein, 136 aa, Glycine max
  Coding DNA Sequence Number=SeqID_13031
  Gene Ontology: Mol. function=metalloendopeptidase activity; Biological process=proteolysis
  Homolog annotation: Hit_ID=Q10LS9; Match level="QueryCoverage=67%, HitCoverage=8%, E-value=5e-29, Identity=63%"; Hit description =Insulinase containing protein, expressed
SIINPSEGRGSFLSFLKSRGWATSLSAGVGEEGIYGSSIAYVFVMSIHLTDSGVEKMLDIIGFVYQYLKLLSQDSPQEWIFKELQNIGSIDFKFVEEQPEMIMLLGLQGEDRDELSQGGEERELAEERSVGGRGKE

SEQ ID NO: 129810 - protein, 46 aa, Glycine max
  Coding DNA Sequence Number=SeqID_13032
MRKILAKGCGRINQRCMWMLGPCACSIADGEAKPVEGELSKSLLEN

SEQ ID NO: 129811 - protein, 144 aa, Glycine max
  Coding DNA Sequence Number=SeqID_13033
  Homolog annotation: Hit_ID=Q9LV73; Match level="QueryCoverage=72%, HitCoverage=7%, E-value=3e-20, Identity=57%"; Hit description =Arabidopsis thaliana genomic DNA, chromosome 5, P1 clone:MJE7
MLQRLMISVVSVISARQRIFPECHELLPGIHVVLTRAEEEALAPVQQCTARFGSKTSHAVLDRAKFRSISGFLSPMSVIELMSSIETRRMARSKYFAARSNFQRLCHGVVEATQPQQHTSDTNMERERGRKETKRGARKITVEI

SEQ ID NO: 129812 - protein, 235 aa, Glycine max
  Coding DNA Sequence Number=SeqID_13034
MAFLGETSSHTIVNSILAFIFLNGSIIHNETGVYFQSSTPIPIQVPKDCGFQMLKSRMHNTLQQTDDQYLGEIYYRRSFTDGGNQFLFQSMQLKNDDDVNTKTPNGILNLLQVTMTPTHDALLYYNGRWNMSRQHDFVSYSFTGKNPKQFDIPSGCTINELKDLFKQVAPQGIPSYGIHESQTIRRLFFRQPSHYEYLDKVIKFEIIELKTDDDMLNVLVQSKETIWANTNFSCF

SEQ ID NO: 129813 - protein, 155 aa, Glycine max
  Coding DNA Sequence Number=SeqID_13035
  Homolog annotation: Hit_ID=Q1M2R7; Match level="QueryCoverage=46%, HitCoverage=5%, E-value=2e-28, Identity=87%"; Hit description=PDR -like ABC-transporter
  Pfam annotation: Domain name=ABC_tran; Domain location=16-151; Score=- 61.7; E_value=0.05; Accession=PF00005.17; Description=ABC transporter
MEQFIDNLPPMDLMRSEKMTFVQLIIPVESAHRAISYLGELGLLQFRDVSFLSDPTSLPLDSDFPSLLFFFDFVSEVCANTIVGNAMLRGISGGQRKRVTTGEMLVEPANALLMDEISTGLDSSTTYQILNSLKQCVHILKGTAVISLNFNEISI

SEQ ID NO: 129814 - protein, 104 aa, Glycine max
  Coding DNA Sequence Number=SeqID_13036
METYNSEMQKVKELETNNQTLHHTESSTIIETTPFVDSSTCLISHICFNINEEQSRVEMDIVSTTFLVNLVHVSGAKCRRCIKDSKEYQRTRIDRSSLKTSTRK

SEQ ID NO: 129815 - protein, 196 aa, Glycine max
  Coding DNA Sequence Number=SeqID_13037
  Gene Ontology: Mol. function=chromatin binding; Cellular component =chromatin; Biological process=chromatin assembly or disassembly
  Homolog annotation: Hit_ID=Q1SAV4; Match level="QueryCoverage=74%, HitCoverage=36%, E-value=3e-32, Identity=49%"; Hit description =Integrase, catalytic region
MAAYSGHRWSWVVKRCYMARESNEEAVGTWLTTRDAMIQSLTKKLLKAQQRMKEIMDKQRREVQFTKGDWVLVKLRPCRQSTASGGQYSKLAKRFYDPFQIVQRIGPVAYKLDLPSTSRIHPVFHWSLLRPYHSSLTTTETPIPLPNADEDNQPLLTPLTILDKSGTVQGMTSSYSFWSNGMFSYRRIPLGSPGRY

SEQ ID NO: 129816 - protein, 99 aa, Glycine max
  Coding DNA Sequence Number=SeqID_13038
MEELINKTQLSPQNNPNVITSAPQQNLIPAPYCCHFAPMNKVLDHRRMMHAPDLNSQMQCGTYCIQYQGNSPKRVYTTPHLGNHAVFVEATQSYTVTPP

SEQ ID NO: 129817 - protein, 350 aa, Glycine max
  Coding DNA Sequence Number=SeqID_13039
  Gene Ontology: Mol. function=RNA-directed DNA polymerase activity; Cellular component=chromatin; Biological process=chromatin assembly or disassembly
  Pfam annotation: Domain name=RVP; Domain location=223-327; Score= -10.2; E_value=0.039; Accession=PF00077.10; Description=Retroviral aspartyl protease
  Pfam annotation: Domain name=RVP_2; Domain location=208-341; Score= -27.8; E_value=0.00015; Accession=PF08284.2; Description=Retroviral aspartyl protease
  Pfam module annotation: Pfam domain module=RVP::RVP_2::Retrotrans _gag; Domain location=223-327::208-341::3-85
MEGPVLAWFQWMTRNHQLTTWASFLEAIEARFAHSPYEDPTGILFKLTQKGSMMEYLTQFEALANRIVGLPPSVLLSCFISGLDPDIRCEVQALQPLTLVHTPHNPPPPPPPSNPTISPPPSPSPPTLPLLPILPKQPPLPFKRFTPAELASRRERGLCFNCDEKFMKGHRCAPRFFLLVADEDNPNEPLDPLIPCPDPDLEDQPQPEPPKAQISFYALSGQSAPKTLRLLGRIANQPVVILVDGDSTHNFIQACLVRHLDLAAQPTPPLRVLAGNGNVIDSHQLCVGATIQVQGHAFTTNLLVLPICGVDVVLGVHWLKSLGPILTDYTTLTMKFVHHGKIIKLRGDTT

SEQ ID NO: 129818 - protein, 385 aa, Glycine max
  Coding DNA Sequence Number=SeqID_13040
  Gene Ontology: Mol. function=RNA-directed DNA polymerase activity; Cellular component=chromatin; Biological process=chromatin assembly or disassembly
  Pfam annotation: Domain name=rve; Domain location=279-384; Score=0.3; E_value=0.0056; Accession=PF00665.16; Description=Integrase core domain
  Pfam annotation: Domain name=zf-H2C2; Domain location=220-261; Score =16.9; E_value=0.002; Accession=PF09337.1; Description=His(2)-Cys(2) zinc finger
  Pfam module annotation: Pfam domain module=rve::zf-H2C2; Domain location=279-384::220-261
MNSTFGPYTCKFIIIFFDDILIYSRSFPEHMAHLQTTFEVLHANQFFLKFSKCTFATSEVEYLGHIGSPWGVEPVSAKIEAVQQWPTPQSARALWAFLGLSGFYQRFIKGYSTIAAPLTLLLANEAFCWNDAADQAFHQLKHALCHALVLSLPDSDAGATLELKKELSVNPTFVDYHRRIQANPQKHPDCSISQDFILQNGCIWLPKGSQFISTILAKFHNTLIGGHMGIVKTMARIGENFVWPSMKKDVQLYISTCLVCQQTKNDHQKRVGLLCPLPIPTRPWEDLSLDFIVGLPPCRGNSAVLVIFDRFSKGVHLGSLPAQHTAFEVARLFMEISGKIHGPPRILVSDRDPLFISHFWQELFKLSGTTLKMSTAYHPQTDGQM

SEQ ID NO: 129819 - protein, 341 aa, Glycine max
  Coding DNA Sequence Number=SeqID_13041
  Gene Ontology: Mol. function=hydrolase activity, acting on ester bonds; Biological process=lipid metabolic process
  Homolog annotation: Hit_ID=Q3BX93; Match level="QueryCoverage=56%, HitCoverage=81%, E-value=6e-35, Identity=39%"; Hit description =Putative secreted protein precursor
  Pfam annotation: Domain name=Lipase_GDSL; Domain location=169-336; Score=22.6; E_value=2.5e-05; Accession=PF00657.12; Description=GDSL -like LipaseAcylhydrolase
MKKQLLLFAFSALALTSCEDDNMQAYELDMMKGEWKTSKTEIISGKDNKTVLASDTPSGCSTKNTTVFRTDYFTSYTSYAGVGADCQQNGLSEGTFKYDTDSKDLTITYGNSGELKYRVAILNSTELKLQQLFGNIDINGDQEKKPMFWQDIQNFKKLDKETPPPKDAILLIGSSSFTRWTDVASYFPGKVIINRGFGGSRLTDLNAYADDLLAPYQPKQIIIYCGDNDFADNHDLKADVVVKRFKTFYKKIRQRFPNIEVDYISIKFSPSREILWPQMRETNKQIAAFMKKEKNAEYIDITKAMEDANGNVRRDIFLEDMLHLTPEGNKIWADVIRPYMK

SEQ ID NO: 129820 - protein, 78 aa, Glycine max
  Coding DNA Sequence Number=SeqID_13042
TKFRALLSVSLHSSPSSSKLLSMASYGAKESIDEEDPRPTSSNGAYITQTLQMHSMSYSSLASSKPKRERLLEIGGTT

SEQ ID NO: 129821 - protein, 234 aa, Glycine max
  Coding DNA Sequence Number=SeqID_13043
MAASPNLAGRLHHSVPLTLLTAALVACGGAGETVTHTVTQTVTDQTTIIHEDGGSTSGKKPKDDGLAWVPYGPKDPAFPTPGWDVYVYFLKHDCDSLKNVQNPSGNLYDAAVGVCRAAVNGEESQWDAAANAFAARGAGIEIGPAQCVDDTIAAMITKLLAWHRENPGRQPALTFPQTDGRTACSKDNNSFVPPDENGDTGSSTTSSTTSSTTSSTTTTTTTTTTTTTTTPSAR

SEQ ID NO: 129822 - protein, 303 aa, Glycine max
  Coding DNA Sequence Number=SeqID_13044
  Gene Ontology: Mol. function=oxidoreductase activity, acting on the CH-CH group of donors; Cellular component=mitochondrion; Biological process=electron transport
  Homolog annotation: Hit_ID=Q0LQV7; Match level="QueryCoverage=97%, HitCoverage=76%, E-value=9e-86, Identity=52%"; Hit description=Acyl -CoA dehydrogenase-like
  Pfam annotation: Domain name=Acyl-CoA_dh_M; Domain location=122-173; Score=108.9; E_value=1.5e-29; Accession=PF02770.9; Description=Acyl -CoA dehydrogenase, middle domain
  Pfam annotation: Domain name=Acyl-CoA_dh_N; Domain location=4-118; Score=76.4; E_value=9e-20; Accession=PF02771.7; Description=Acyl-CoA dehydrogenase, N-terminal domain
  Pfam module annotation: Pfam domain module=Acyl-CoA_dh_M::Acyl-CoA_dh_ N; Domain location=122-173::4-118
MTFSSEHDDFRRTIRRYIEEKINPRVDEWEREQMMPLHEVIADMAKLGFVGLEYDPEYGGQGADHLFTLVLAEELGRVDHGSFPMAFGVHVAMATPSLHKHGSDELKREFLAPALRGEQIAAIAVTEPDAGSDVAGIKTHARRDGDDWVINGSKMFITNSVQADWLCVLARTSDEGGYAGMSQIIVPTKAPGYEVRKLDKLGMHASDTGLITFDDVRVPVSNTIGEIGRGFQQQMSQFVMERMFGAYGIPASVNRALQRTKEYALARHVFGKPLTKNQHLAYQYAGLAARADMLEVYNRDIAE

SEQ ID NO: 129823 - protein, 51 aa, Glycine max
  Coding DNA Sequence Number=SeqID_13045
MASATGRIALMPLWLGAIALSLAIPAVAAAAPALPVGGESPSQTISDLEDQ

SEQ ID NO: 129824 - protein, 314 aa, Glycine max
  Coding DNA Sequence Number=SeqID_13046
  Gene Ontology: Mol. function=RNA-directed DNA polymerase activity; Biological process=RNA-dependent DNA replication
MDELCKRAKGYIDMEEMFRFRNEVRQAGKKCDKREEGTKTDSHNLDKRHKPNKRQPLPKGLRYECYIPLTANHTIILKEAFNFEVHIGLPPTQPPTPSLLKGRTTTKQEQDPENSKRSNKGITMQTEEEIEWKIKVDRDTNNSDASDNLYKNRNPPNKSEDFKGINPINRDDPMVVSIIIANFMVSKVLIDQGNSTNILYWKTFQRLEVSHDTVHPYVGPLLGFAGERVETRDYVDLMTTFDQGQLSRSFIIRYLLVDANRSYFALIGRKTLNELGAIVSMPHLKMKFPTLIKEIVAPYPYTREPAKPHPVAAE

SEQ ID NO: 129825 - protein, 205 aa, Glycine max
  Coding DNA Sequence Number=SeqID_13047
  Gene Ontology: Mol. function=xylulokinase activity; Cellular component=integral to membrane; Biological process=carbohydrate metabolic process
  Homolog annotation: Hit_ID=Q2NVD9; Match level="QueryCoverage=99%, HitCoverage=40%, E-value=4e-79, Identity=68%"; Hit description =Xylulose kinase
  Pfam annotation: Domain name=FGGY_N; Domain location=3-204; Score =199.1; E_value=1e-56; Accession=PF00370.11; Description=FGGY family of carbohydrate kinases, N-
MALYAGIDCGTQGTKVVIVDSTQGVILGEGNAPHRLISQANGRREQEADWWIEALVIAFRQAVTHAGVDAREIHALGVSGQQHGFVPLDADGNVLHSVKLWCDTETAEENERLLQQLGGANGSLETLGLRIATGYTASKILWFKTHHPALWAQLHTVLLPHDYLNFWLTGERVAEYGDASGTGLFDVRTRRWSKTAVDLIDDSGR

SEQ ID NO: 129826 - protein, 62 aa, Glycine max
  Coding DNA Sequence Number=SeqID_13048
MEMQQKTKEKRIASECNTRADLLSKLTSTKKTEHLKIIIQKTLQTPTIDTEEVMVGEEEELD

SEQ ID NO: 129827 - protein, 87 aa, Glycine max
  Coding DNA Sequence Number=SeqID_13049
MSSDKADHRPPDGAFKVVLSETQLLVHETNAIYVTQSRWDESLDSLKYLFPKTYTKESIIPADKKKRYLDSMMLSKMYPFGNFSVMA

SEQ ID NO: 129828 - protein, 141 aa, Glycine max
  Coding DNA Sequence Number=SeqID_13050
  Homolog annotation: Hit_ID=Q5QET8; Match level="QueryCoverage=44%, HitCoverage=72%, E-value=9e-12, Identity=57%"; Hit description=Auxin- induced putative aldo/keto reductase family protein
MEAANCLSYESQFGCLCEEEYGDLEVDPASKIGAAGSIVGLESALIRELELEFEYVVGSTEVGLATELLESFLWTFTGTTKIKKLNKNTEALTVKLSEKDPREISEAVPITDVAGGRYYNGLDHFSWKYANTPPKDSKIST

SEQ ID NO: 129829 - protein, 102 aa, Glycine max
  Coding DNA Sequence Number=SeqID_13051
MVIPQGMNPEKPGLVCRLRRSLYGLKRASRQWYARLLSPEVVNLIHNKKLHQETLEGLKTALCATQALLMDAEHKQGELVLEGSFNISSEREYMAGRMTKRP

SEQ ID NO: 129830 - protein, 286 aa, Glycine max
  Coding DNA Sequence Number=SeqID_13052
MARTKKTGQMTFEAAKEIADKITSQGSFVAHGCQDVLIAAIGRPEHPGCVRAARVGVTIKQYFGPAPRTFRTSSSMAPEDLEQLMQKIRDQLEESITEKELALPPKPEVGPSATCVNTKKSCVDPSGNDPNKGELEKCGLDVEENPPHLVALGRLYDESTTVHNIPLGNDQVKAINTFLAWLTHLVKRFSEQGGHGQSGLLDFRTSALRVAFVKRTRGGTCKTKDFDAQGLMELGIYRNGMELQVLVYRALEYGQALSGVESGNLNRCENCRSVKLVKPLCLASVV

SEQ ID NO: 129831 - protein, 688 aa, Glycine max
  Coding DNA Sequence Number=SeqID_13053
MSLPSASDPLTALDGIIGDFAWRPLVKQVGPASGVVPPSTATPVVGEGGQPATKVDPVATEIAPNAPFSVLAKRKQDDGVGPSGHEKSRASSSFHTLRQAARLTLDSGRPSSVQDLPPTPLAIESHTAVVVTLSPPPPSHFLVQEATPIAIEVIAPGALVGSAVVPLSTVTATLLCYYSMAPPPSSLAPMVCPFTALVSTSTFSHLRISLDHIYTSNDVDSLAECPKVASATISLVEAMSSNHQLSSKVGSVLAKLLLSRVEDVVAKRDELAMKVADLEALLKESKSMLKEFELRVAREREANKELEEGLLIFKKGLDLGLFDPFKDVKDSVLLNEDDIATKEEADEEEQGTEEKDDVAIVIMMISVESLMAQEARPCRSRGRTMVGFLLLCGACPLMFVSNMFDLPLDRGLANQSGASPLRVIMSKYDFQPIEVRKTRGYLGFCKSVYQGVNLRFNEPWIEDVFVSGFDKPVELHRGLPRTDLGFYEPCMCSIVVAHTGGVMLCSCKRVTYHKWHVLETWCRARRFSGVLLHTCHSLWVTHTGDLVARSCIHVTRCGSRDLVLEGGLTKCAPWVACCDPKWAFPIGTNLSRSGILSGFTSDLPYEVITSLIVDGSPTSTRIMAFVRAICESTLRLVKSSMHGPKDDSISYLYLIVGLRMFDRGEFLHLTGRNFPQWSCFYPFGEVVN

SEQ ID NO: 129832 - protein, 166 aa, Glycine max
  Coding DNA Sequence Number=SeqID_13054
  Gene Ontology: Mol. function=nutrient reservoir activity
  Homolog annotation: Hit_ID=Q6TLJ2; Match level="QueryCoverage=54%, HitCoverage=52%, E-value=2e-20, Identity=50%"; Hit description=TPD1
MTITNSCPLIIFLCFMMPLFVFCDEGTHSGPSTQILHSSHEDKNRSITVSMKVEHAHSASRKFWLHGTCTSKDISISQSQTSTPGIPQFIVQIVNNCVSGCAPSDIHFHCGMFASARMVNPRLFKRISCDDCLVNGGNPLAPSQIIRFTYSNTFSYPLAFKSAKFC

SEQ ID NO: 129833 - protein, 454 aa, Glycine max
  Coding DNA Sequence Number=SeqID_13055
  Gene Ontology: Mol. function=RNA-directed DNA polymerase activity; Biological process=RNA-dependent DNA replication
MTEELDKLFDGFCASIGGVISLKLSIQAHLADVPLAAVGEVVDSQMEGYALTVTISPVYVGNFIVRWGMETMAPSSLSVFLPIKAKYDVFASTNRYLMDVNGTVLVDKDPRHHEVRDDNGDNHKVLGDGVDALEVPFSGLAGLSSVEKAAINGIDYTSNVLGGLSFRRSLFAIMPLLLGPTVFVIVTSTVVVECFLENRGAIGEEHGMQRYLRIEILDLDSCAPKSIHEPFEGLIICLSQIGQGDRGHAVRLASGVLRIESFDEGIEAVYGPGFACVRKASRCLSVPVVPSYCLRLSGFHPKVLPMRWGCDSPWVHSGKPQAGHGQPVALSTFPHGIAPSPQCGFGVNVECPELHTSAWRGAFDIKGDLKNKGLQCSNKNLCKESKASICYNGARMSEKERGIGLLPCAECVSREGWHDVIWSNLDWEVVVQDDLVECPIYGQGEGEGLGGVGI

SEQ ID NO: 129834 - protein, 77 aa, Glycine max
  Coding DNA Sequence Number=SeqID_13056
MAFALYLSSEFPIARRHSLQRFLEKRRDRLGSKTPYPSSSTTKVADNIENNFCADNAPELISLNRSEEEFQPTVSAS

SEQ ID NO: 129835 - protein, 181 aa, Glycine max
  Coding DNA Sequence Number=SeqID_13057
  Gene Ontology: Mol. function=structural constituent of ribosome; Cellular component=ribonucleoprotein complex; Biological process =translation
  Homolog annotation: Hit_ID=Q9SX68; Match level="QueryCoverage=79%, HitCoverage=74%, E-value=2e-47, Identity=66%"; Hit description=50S ribosomal protein L18, chloroplast precursor
  Pfam annotation: Domain name=Ribosomal_L18p; Domain location=44-181; Score=137.1; E_value=4.8e-38; Accession=PF00861.12; Description =Ribosomal L18pL5e family
  Subcellular localization annotation: CTP_CleavageSite=38; ConfidenceScore=5.58e-01
MLASSLSFLHSCTSPSSSSLLSISPPNPKPSHFLPFVVEAKDRTRREDRTARHTRIRKKVEGTPERPRLSVFRSNKHLSVQVIDDTAMRTLASVSTMQKTVADEFNYSAGPTVSATSVAAVEGSIGNLTISGEVAKRMGEIIAKSCLEKGITKVAFDRGGYPYHGRVQALAEAAREHGLDF

SEQ ID NO: 129836 - protein, 134 aa, Glycine max
  Coding DNA Sequence Number=SeqID_13058
MDVVEWGLELHTSAWRGRVEWFDGTCVYSSLSVVAGPCLADMEGGHMSPGAMLDAHIDFVGHGWHGNLDECESCKSMWLVKPLNLDISDNSALFLTVGDWIEDSLYRLSLVTGACGTRAILLHTCHRQSRHVLE

SEQ ID NO: 129837 - protein, 97 aa, Glycine max
  Coding DNA Sequence Number=SeqID_13059
MTRMDDRGLALTLGHTQGDNLTSPSSLALLAPLEVEGGRITITETSSPTAAEGRKKDIEVDESTFRSRKGKEGKLKAKRAQGIENEQKQARKQEDNE

SEQ ID NO: 129838 - protein, 334 aa, Glycine max
  Coding DNA Sequence Number=SeqID_13060
  Gene Ontology: Mol. function=hydrolase activity; Biological process =aromatic compound metabolic process
  Homolog annotation: Hit_ID=Q9LVU7; Match level="QueryCoverage=97%, HitCoverage=78%, E-value=1e-112, Identity=59%"; Hit description =Genomic DNA, chromosome 5, P1 clone:MNB8
  Pfam annotation: Domain name=Abhydrolase_1; Domain location=83-334; Score=60.5; E_value=5.4e-15; Accession=PF00561.10; Description =alphabeta hydrolase fold
MPFCNVGTQLPSPVADVPLNNDIKIFYRTYGGAAKVLLILWRLNQRSGLAATHEAWGPQIKGLTGATVPDDVVWSEEEGNGGIHVCAFDNRGVGRSSVPVEKSEFSTKIMAKDAIALLDHLGWKKAHVFGHSMGAMIACKVAAMVPDRVLSLALLNVTGGGFQCFPKLDQQTISVAYRFLKAKTPEQRAAVDLDTHYSQEYLEEYVGTDKRRAILYQLTSNISDAFIRQAKLTPVLHIPQYVKGISTTGMQSNYGFDGQLNACWAHKMTETEIEVIKSAGFLVSVIHGRHDIIAQIYYAKRLAEKLHPVARMVDLHGGHLVSHERSEEDALVMD

SEQ ID NO: 129839 - protein, 92 aa, Glycine max
  Coding DNA Sequence Number=SeqID_13061
MATPEIVTPLYKQKILVQTVIQALRMMILFMEMVLLQFLMSTKDIMILVILFINVIIVKRLSGINRGCESTSTPLLPNIIFVLAMVKSSNHY

SEQ ID NO: 129840 - protein, 156 aa, Glycine max
  Coding DNA Sequence Number=SeqID_13062
  Gene Ontology: Mol. function=helicase activity; Biological process =proteolysis
  Homolog annotation: Hit_ID=Q9LTU4; Match level="QueryCoverage=95%, HitCoverage=10%, E-value=6e-41, Identity=51%"; Hit description =Helicase-like protein
MLQSGRLSFIIYNQCKLRVENYSNLDDVDSNNENQGSDIGKRVILPSSFVGGHRYMDQLYFDAMAICNHVGFPYLFITFTCNPYWKEIQRLLTPLNLKVVNQPDIVARVFKIKFQELLTELTKKHVLGKVIAYVYIIEFQKHGLLHTHLIINCKHR

SEQ ID NO: 129841 - protein, 135 aa, Glycine max
  Coding DNA Sequence Number=SeqID_13063
MVICTLFSIWRQSSLIAHGDKTWSFAPFLLSRDNQVRWHTKTNDGHPHPFCYPEIIKSDGMQRQMMVIHTLFAIQRQSSPMARRDKLWSSTPFLLSKDNQVRWHVKTNYGHLLPMPSRENQVHRLLQSPLPSRDK

SEQ ID NO: 129842 - protein, 45 aa, Glycine max
  Coding DNA Sequence Number=SeqID_13064
MLVETPRVFLSWNTHPRVTRRPLAEGGTYFMDYQMRTPMHIWQRT

SEQ ID NO: 129843 - protein, 104 aa, Glycine max
  Coding DNA Sequence Number=SeqID_13065
  Subcellular localization annotation: CTP_CleavageSite=68; ConfidenceScore=5.42e-01
MEAQTRTPQTRTRQCGCSHRSATRFATNTNSDRRRNNNNALGVPFPGLFRFLLFFDLRNGKDDLHSVVAVMEAQASLTQRRSQAEEERRRTIGFKRAGCAISEV

SEQ ID NO: 129844 - protein, 115 aa, Glycine max
  Coding DNA Sequence Number=SeqID_13066
MLNIQNLIYGYGGFHQQTLLPRSEFLIGGYVGARASLLSTTPPFVAMTQELVARGDTLRLSAPRHSVTPSVIDEQRPMWSSAPFPEVSASSGGDFFKSHKVIQNYVGLSSSLEDT

SEQ ID NO: 129845 - protein, 70 aa, Glycine max
  Coding DNA Sequence Number=SeqID_13067
MKKILGLQAPMELTSWLKLHFFEGRGELEMAFKGEFEEASKTSENKIQQRVSLVFRSWVIDYPKLKNFPS

SEQ ID NO: 129846 - protein, 149 aa, Glycine max
  Coding DNA Sequence Number=SeqID_13068
  Homolog annotation: Hit_ID=Q9SVM9; Match level="QueryCoverage=90%, HitCoverage=31%, E-value=2e-37, Identity=54%"; Hit description=Fatty acid elongase-like protein
MVLEESVVHDVRLSSVGPGRATGSDVFHNPGGLDLAMKLHYLRVVYFFDSEAAQDLTIMKIKDGMFTLFNHYFITCGRFRRSDSGRPLIKCNDCGARFIEAKCNKTLDEWLAMKDWPLYKLLVSHQVIGPELSFSPPVLFQMNASEEIA

SEQ ID NO: 129847 - protein, 106 aa, Glycine max
  Coding DNA Sequence Number=SeqID_13069
MTNVIFGRRFSEVHDNNMMVVENYKLISWSSPRIIVNLRLSLSLITIIKVRIMPKKTFYIYKALLDKQEAGTHIQAGFEKMLIAILDKRDIHTYVISVNVDAYSPN

SEQ ID NO: 129848 - protein, 112 aa, Glycine max
  Coding DNA Sequence Number=SeqID_13070
  Gene Ontology: Mol. function=ribonuclease H activity; Biological process=DNA integration
  Homolog annotation: Hit_ID=Q1SYR3; Match level="QueryCoverage=67%, HitCoverage=3%, E-value=1e-23, Identity=68%"; Hit description=RNase H, putative
MKNAFDKKVRLRKFHEGDLVLKKMSHAVKDNRGKWAPNYEGPFIVKRAFSGGALVLTNMDGEELPLLANSDVVMRYHAWNLGQLKMSLHVLLYLCVLHGFPQGFLFAVYFSS

SEQ ID NO: 129849 - protein, 85 aa, Glycine max
  Coding DNA Sequence Number=SeqID_13071
  Homolog annotation: Hit_ID=Q1XPX6; Match level="QueryCoverage=100%, HitCoverage=12%, E-value=2e-20, Identity=55%"; Hit description =Putative alpha-glucosidase precursor
MLVHLVQDKTGWKLDIRFRLFDDGLGFRYEFPVQKDLRHFTISSEKTSFNLGKDYKAFWIPADYDTNEFPVTTSNLSEISNLIDE

SEQ ID NO: 129850 - protein, 175 aa, Glycine max
  Coding DNA Sequence Number=SeqID_13072
  Gene Ontology: Mol. function=hydrolase activity, hydrolyzing O -glycosyl compounds; Biological process=carbohydrate metabolic process
  Homolog annotation: Hit_ID=P80036; Match level="QueryCoverage=87%, HitCoverage=57%, E-value=4e-34, Identity=46%"; Hit description=Endo -beta-N-acetylglucosaminidase
MSTLMGRIAHTVYTYGLDGVDLDDEYADYGNNATGQPNNSSFVMLLQELKAAMPDKLITWYYIGPATTRQAYNGDNAGNYINYGWNAYYGTYNAPSIPPLANSKISAAATWIQNTSASTLSTLATSTKNDGYGVFMWYDLKGTNAASYLSTGSNILYNENTQLSGQLYTWTQGAS

SEQ ID NO: 129851 - protein, 57 aa, Glycine max
  Coding DNA Sequence Number=SeqID_13073
MAMSEKATSSWRDVAMAGTILVIINGNARKMCEIENGKRVTVVVCGNINGFVAAWIE

SEQ ID NO: 129852 - protein, 144 aa, Glycine max
  Coding DNA Sequence Number=SeqID_13074
MSRHDLVHVEAMAGTKVVIGASSDFAHIKGHQPYARTLTLKPLYAQQNNALLTTLHYLKDHPYSDIDVSSIGACRPRIFFINGFLCFLEKRERRRHFQEKMSLEEAHHHRRPWIRAWRKKEMNEGRGREEQEILCSKRALKSEV

SEQ ID NO: 129853 - protein, 77 aa, Glycine max
  Coding DNA Sequence Number=SeqID_13075
  Gene Ontology: Mol. function=zinc ion binding
MSRDKIMFYLRLRVCYMRLASRPQRITRPKELRSYNLVFGMDKRCWFIPAYSEEDIRRMAVLQGLEYPSTPDFNAPE

SEQ ID NO: 129854 - protein, 78 aa, Glycine max
  Coding DNA Sequence Number=SeqID_13076
MDMHKVATQNLEYRKKKGGYVEGEWWIVHLSRRVRPNNLTKELVGNQQELIAFCEGSIGQKQTLVVRLNYKLSLYEDE

SEQ ID NO: 129855 - protein, 163 aa, Glycine max
  Coding DNA Sequence Number=SeqID_13077
MVFHLRLVMSSKQRKGNIGSKGLSKELIQGRLIWLEAYKNKMPKSSPNMHVKQEVSTRVKPRLLCKQSMGQNTPNKIDDDDSNSHQGTIIRSRTIKVSYPNFVRGPLLDDMRPFFGPCEVLGIHHWAICEIPGHAGKPKNIDAQSVSFRDTPEIKWKHRCIIK

SEQ ID NO: 129856 - protein, 118 aa, Glycine max
  Coding DNA Sequence Number=SeqID_13078
  Homolog annotation: Hit_ID=Q1SQK6; Match level="QueryCoverage=96%, HitCoverage=6%, E-value=1e-31, Identity=60%"; Hit description =Helicase, C-terminal; Argonaute and Dicer protein, PAZ; Type III restriction enzyme, res ...
  Homolog annotation: Hit description=subunit; Ribonuclease III, bacterial
MTQKLRLESAVTKGIDGLCSKTIADCVEALIGAYYVGGGLTAALHVMQWLGMNVGHDSPLVHEAITRTLLRSNVPKAYYINSLELKFGYEFSTKGLLLEAMTHPSQQELEPGICYCYQ

SEQ ID NO: 129857 - protein, 144 aa, Glycine max
  Coding DNA Sequence Number=SeqID_13079
  Gene Ontology: Mol. function=structural constituent of ribosome; Cellular component=ribonucleoprotein complex; Biological process =translation
  Homolog annotation: Hit_ID=Q2PMQ2; Match level="QueryCoverage=94%, HitCoverage=100%, E-value=7e-69, Identity=95%"; Hit description =Chloroplast 30S ribosomal protein S11
  Pfam annotation: Domain name=Ribosomal_S11; Domain location=28-126; Score=190.4; E_value=4.4e-54; Accession=PF00411.9; Description =Ribosomal protein S11
  Subcellular localization annotation: CTP_CleavageSite=15; ConfidenceScore=5.14e-01
MAKPISKKGSRKNVRIGSRKHTRKIPKGVIHVQASFNNTIVTVTDVRGRVISWSSAGTCGFKGTRRGTPFAAQTAAGNAIRTVSDQGMQRAEVMIKGPGLGRDAALRAIRRSGILLNFIRDVLLCHIMDVDLLKKDVCKTKKKH

SEQ ID NO: 129858 - protein, 94 aa, Glycine max
  Coding DNA Sequence Number=SeqID_13080
MGLNQAHAFKKRVSSSQGQIWKKERALRRPYQTGAEARVMSEIEEVQEQMKADMEAMKEKMTTMMEAMMSMRKMVGVKCSLLASALDRTSSIKR

SEQ ID NO: 129859 - protein, 110 aa, Glycine max
  Coding DNA Sequence Number=SeqID_13081
  Subcellular localization annotation: CTP_CleavageSite=39; ConfidenceScore=5.53e-01
ILKEVKRGSSSTTTVAGHRRQGTSRDPPTPVPPSLSSPRSTTLFSLDDQCQSIPNVVDQSLFYSLTKLPIQGVPFEGTLVDDWKFDYSSHDARRMTGRQIDWAHLVRYRM

SEQ ID NO: 129860 - protein, 90 aa, Glycine max
  Coding DNA Sequence Number=SeqID_13082
  Subcellular localization annotation: CTP_CleavageSite=33; ConfidenceScore=5.19e-01
MALAISVGQPDTSTIRPKRGRIRLSLAHQWAKRASTAKCSFSVLSAIEESGRASISRLHVKLEISTLSATVIFSQAQRTTSAKLISTYSR

SEQ ID NO: 129861 - protein, 176 aa, Glycine max
  Coding DNA Sequence Number=SeqID_13083
  Gene Ontology: Mol. function=protein-tyrosine kinase activity; Cellular component=integral to membrane; Biological process=protein amino acid phosphorylation
  Homolog annotation: Hit_ID=Q9FVN2; Match level="QueryCoverage=72%, HitCoverage=21%, E-value=8e-28, Identity=46%"; Hit description=Dual -specific kinase DSK1
  Pfam annotation: Domain name=Pkinase; Domain location=2-176; Score= -83.8; E_value=0.0014; Accession=PF00069.15; Description=Protein kinase domain
  Pfam annotation: Domain name=Pkinase_Tyr; Domain location=2-169; Score=-150.2; E_value=0.003; Accession=PF07714.7; Description =Protein tyrosine kinase
  Pfam module annotation: Pfam domain module=Pkinase::Pkinase_Tyr; Domain location=2-176::2-169
MIVYEQVCNDSLEQYLTRGSFQSLTSKQRLKVAIGTARGLKYLHGNNIIHGNIKPSNIILTHDFEPRIGDFDFGKVKHGPKKSSKDNSVRNSGYAAAEYVENGKVSNKTDVYSFGVVLLELISGRRATDKLLGGKSLVGWKVMASNSGNNFTDRARISTFSKPHKVEALCNGSSFF

SEQ ID NO: 129862 - protein, 88 aa, Glycine max
  Coding DNA Sequence Number=SeqID_13084
MGAYAKDEKLLIHFFQESLIGYNSDMALDRMQLQNMCKKGNESFKEYAQSIADLVFIGERIEAGLKRGKFDHPALMNEKSGANEEDEN

SEQ ID NO: 129863 - protein, 76 aa, Glycine max
  Coding DNA Sequence Number=SeqID_13085
MGETHEIPHHNLADFEPCLEYATEGHVVGGILLQNTLEGPQFRPQPQPLHSITGKIPPIMEGMGKVGSSRGKAQGR

SEQ ID NO: 129864 - protein, 210 aa, Glycine max
  Coding DNA Sequence Number=SeqID_13086
  Gene Ontology: Mol. function=chitin binding; Cellular component =extracellular region; Biological process=chitin metabolic process
  Homolog annotation: Hit_ID=UPI000044A8F0; Match level="QueryCoverage =58%, HitCoverage=99%, E-value=2e-22, Identity=35%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
HVLAFRGQHALAFRGLHVLPFKGLHVLTFRGLHVLAFIGLHILAFRGLHILAFRGLHVLAFRGLHALTFKGLHALAFRGLHVLAFRGLHALAFKGLHTLAFRGLHVLAFRGLHALAFRGLHVLAFRGLHISALEDSRDRAYKALNGPGEVQQGPRVSNSDYEPPLVLWSARRPQQGHHAPINRAFIEKYCTPRHRVRHHNSGHQTHRHHL

SEQ ID NO: 129865 - protein, 228 aa, Glycine max
  Coding DNA Sequence Number=SeqID_13087
MPPLLLLRPQGQTTNCIPRLVAKKMNLGGKVESLAVEKDRLAKVVANLEARLKESESRLGEQAYFFVKDLDLGLFDPFKDVKDGVLLDEKEIVVEEEAADEGLVTHLMGLSSILWGFSPDVPPLMVMRSKCERHLIEGLVMVGHFYLQKYSFDGCEKSRGYLGFCRSMYQGRTLGFGTVATYPSVGGQREAHGCIFQGRKARGVATNVYSRKTSEKPEKVWSTNFKRE

SEQ ID NO: 129866 - protein, 442 aa, Glycine max
  Coding DNA Sequence Number=SeqID_13088
PQALSRLAEGHEFVKPPSMNECCPVSGVETLTSLRELQVDVACQAPELGQVLFGLALKTNVTFVYCNRRVRCMCNTLAYMSLMEWARTGVVVHASLFIVFLLPCFLASFCAFWLSVSISSSSNFQRSKDTHQGASNNESSSTKRVRASRQTGGGASRPRGGSWLSATAGEPVPVTVNLPPSASGGVRKGRGGGHVRASPCMRRSLCVRLPLSIPTIAGYEWVKLENPKDSCPGCQFTLDHFSVCSTGALECGPFLTSPKQLGDGDHFFKVLVIDAMDDDMPLMLNRDREPCFPFYWESNPTRFKSYDKDLLTFVDRAILSVPSVSDPLAALDGIMGDFTWRPLMKQVGPVAIAVEVTLNAPSSVLAKRKMDDIVGSSGHKKLKALMSLHAQRWAAGLMPTAGCLSTVQDVPLAPLTVKTLATPAPSPPPAVAIQEVAHAADE

SEQ ID NO: 129867 - protein, 247 aa, Glycine max
  Coding DNA Sequence Number=SeqID_13089
  Gene Ontology: Mol. function=protein translocase activity; Cellular component=chloroplast inner membrane; Biological process =intracellular protein transport
  Homolog annotation: Hit_ID=Q9ZST9; Match level="QueryCoverage=63%, HitCoverage=83%, E-value=5e-53, Identity=68%"; Hit description=Tic22
  Pfam annotation: Domain name=Tic22; Domain location=49-247; Score =109.2; E_value=1.2e-29; Accession=PF04278.3; Description=Tic22-like family
MVTSSQRTNTIEQHASTNTMRSIPLPTSIVSSTKSNQGLELLSIPGHEKECKKMRNVGFLGPFLPRIGKLSSIGLLGYTPKNPNTRRTDGVAWTLKPASVIFQLHPSTLRPLRHVAKSLVGTSIFTVNNSNNEFVLISDPDGAKSIGLLCFRQEDAEAFLAQVRSRSRELRSKAKVVPITLDQVEGIAFRFLLDPVQIRNALESELLAVKKRNKHYCPVYFSKEDIEQELSKVSRASRAPGVSQHIT

SEQ ID NO: 129868 - protein, 428 aa, Glycine max
  Coding DNA Sequence Number=SeqID_13090
  Homolog annotation: Hit_ID=Q69J07; Match level="QueryCoverage=71%, HitCoverage=82%, E-value=3e-25, Identity=29%"; Hit description=Kelch repeat-containing F-box-like protein
  Pfam annotation: Domain name=F-box; Domain location=9-56; Score=17.9; E_value=0.037; Accession=PF00646.23; Description=F-box domain
  Pfam annotation: Domain name=Kelch_1; Domain location=134-180; Score =17.4; E_value=0.041; Accession=PF01344.15; Description=Kelch motif
  Pfam module annotation: Pfam domain module=F-box::Kelch_1; Domain location=9-56::134-180
MATCIDEREDKAPMHGDILEAIFSHVPLIHLVSASHVSHEWKRAISTSLRYVNPAKPWLTVHIQSPRAPHVTATFAFDPRSREWFEIHAPSPNHITALRASHSTLLYMLSPREFTFSLDPLRLTWHHARPPRVWRTDPIVARVGSHIILAGGACDFEDEPLAVEAYDTESLAWLRCEPMPEILKGSTASTWLAVAVSGDKMHVTEKKSGVTYSFDCGTMTWQGPYNLRPSENVFYCVTGTIRGRLMVAGLVGDAENVKEVKLWEVKGELGLGLRYWCEEIGAIPKEMVVRLVMGEGDCCCCCWGVVGSIEVHWVGDYVYFQNRMEMEMVVCEVVNGRCEWWSVRNVAGNDVSRMGRMVFCGGHVGLEDLKRAIKDNLKNLGNGMVFQFETDQVCLILSFQRFQTTLHAFSNTAENNNVDVSYFPKFSY

SEQ ID NO: 129869 - protein, 89 aa, Glycine max
  Coding DNA Sequence Number=SeqID_13091
MEFHKKTFEGQLRDVDKVGEYCLKKRELKNTSASEEIVRRKKDNELNGTLEIGKRMIEGRQLAKGLTEDSPSSVRDGFSLFPQPDFDAM

SEQ ID NO: 129870 - protein, 222 aa, Glycine max
  Coding DNA Sequence Number=SeqID_13092
  Gene Ontology: Mol. function=structural constituent of ribosome; Cellular component=intracellular; Biological process=translation
MNSDCDFKDIVPTNFEHRGLNMLVLDVMRRRGDMCGDARDWCWGLGWVVESEEMVGWHWKLLKGVGGEETPVEVEEYDMSSPMSRPIVSGLFTIFGNEYLRRPNNEDIERLLQMGAAREFSVFGIAGSNNDITMLNGSNVFDEVLSGRAPAVQFTMNKTQYNMRYYLADDIYPDFATFVKTISMPQVEKQKLFAQRQESTRKDVEWVFGVLQSRFIIIRGPA

SEQ ID NO: 129871 - protein, 179 aa, Glycine max
  Coding DNA Sequence Number=SeqID_13093
  Gene Ontology: Mol. function=electron carrier activity; Cellular component=endoplasmic reticulum; Biological process=electron transport
  Homolog annotation: Hit_ID=Q8GUS1; Match level="QueryCoverage=59%, HitCoverage=15%, E-value=2e-55, Identity=99%"; Hit description =NADPH:P450 reductase
  Pfam annotation: Domain name=NAD_binding_1; Domain location=68-170; Score=49.9; E_value=8.4e-12; Accession=PF00175.11; Description =Oxidoreductase NAD-binding domain
QLEPTRHSGRGLTSCVGPGFKTQSLPFHCYYHHHSTTSATIVDTIIPPPPPPPTPPLSPLPPPLPLPTPLFHCRERLALKEDAVQLGPALLFFGCRNRQMDFIYEDELKNFMEQGALSELIVTFSREGPEKEYVQHKMMDKAANLWNLISQGGYLYVCGDAKGMARDVHRTLHTIVQQQ

SEQ ID NO: 129872 - protein, 385 aa, Glycine max
  Coding DNA Sequence Number=SeqID_13094
  Gene Ontology: Mol. function=electron carrier activity; Cellular component=endoplasmic reticulum; Biological process=electron transport
  Homolog annotation: Hit_ID=Q8GUS1; Match level="QueryCoverage=92%, HitCoverage=51%, E-value=0.0, Identity=96%"; Hit description =NADPH:P450 reductase
  Pfam annotation: Domain name=FAD_binding_1; Domain location=89-313; Score=403.8; E_value=2.4e-118; Accession=PF00667.10; Description=FAD binding domain
MVLKLLFCTGAKRLVPLGLGDDDQSIEDDFVAWKESLWSELDQLLRDEDDVNTVSTPYKAAIPEYRVVIHDSTVTSCNDNHLNVANGNAVFDIHHPCRVNIAAQRELHKPESDRSCIHLEFDISGTGIIYETGDHVGVFAENGDETVEEAGKLLGQDLDLVFSIHTNNEDGTPLGSSLPPPFPGPCTLRFALAHYADLLNPPRKASLVALAAHTSEPSEADRLTFLSSPQGKDEYSKWLVGSQRSLLEVMAEFPSAKPPLGVFFAAVAPHLQPRYYSISSSPRFSPQKVHVTCALVCGPTPTGRIHKGVCSTWMKNAIPLEKSRDCSWAPIFIRTSNFKLPADHSIPIIMVGPGTGLAPFRGFLQVASFCIILNEEGKFWGGGVE

SEQ ID NO: 129873 - protein, 183 aa, Glycine max
  Coding DNA Sequence Number=SeqID_13095
  Gene Ontology: Mol. function=electron carrier activity; Cellular component=endoplasmic reticulum; Biological process=electron transport
  Homolog annotation: Hit_ID=Q8GUS1; Match level="QueryCoverage=100%, HitCoverage=23%, E-value=1e-63, Identity=75%"; Hit description =NADPH:P450 reductase
MASNSELVRTVVESVLGVSVSDSVMVIAATSVALVIGLLVFVWRKSSDRSKEQKPLAVPKLLVKEEEEDEVDAGSGKTRVAIFFGTQTGTAEGFAKVKEALKRMNNGKIVSPNGISIKALAEEIKARYEKAAVKVADLDDYAMDDDQYEEKLKKESLAFFMLATYGDGEPTDNAARFYKWFTE

SEQ ID NO: 129874 - protein, 157 aa, Glycine max
  Coding DNA Sequence Number=SeqID_13096
  Gene Ontology: Mol. function=protein serine/threonine kinase activity; Biological process=protein amino acid phosphorylation
  Homolog annotation: Hit_ID=Q9M0X5; Match level="QueryCoverage=77%, HitCoverage=18%, E-value=2e-20, Identity=40%"; Hit description =Receptor protein kinase-like protein
  Pfam annotation: Domain name=DUF26; Domain location=68-122; Score =56.2; E_value=1.1e-13; Accession=PF01657.8; Description=Domain of unknown function DUF26
MVRYSNRSFFSTVDTRPVIGLSNTANISNQENFTHLMFKTVNKTIDEVAIAAKKYNTKQANIFGFQNLYCLVQYTPDLSTQGCRSCLSDVVGLLPWCCEGKQGGRILNPSYNVRYELYLFFHANTTASSPTPMPTPSVSVPPTPTTSKSGGMYFLKN

SEQ ID NO: 129875 - protein, 85 aa, Glycine max
  Coding DNA Sequence Number=SeqID_13097
MRIKRSFKVVMGPRTRLVVSFKTRKGKQDSKGLSKELSQGKSIWLEAYKKKIASIISKYACKLGSINKNQAKAIVQAINGGKHTK

SEQ ID NO: 129876 - protein, 103 aa, Glycine max
  Coding DNA Sequence Number=SeqID_13098
MTISALVWKHIACIRGDNESKAVTICTRGIGSNEFSANDLVLSIVEANMLVGKSNMSNLAKPIGEEKRVENVVVKKLVEESQGKEDCVDLEEGDMYEVVVNGH

SEQ ID NO: 129877 - protein, 126 aa, Glycine max
  Coding DNA Sequence Number=SeqID_13099
MYDFVFGIWVEKTARVSWHKKRWCPFHSTLEFIWISSNNSRFRKGHFSLNYINSEIVAAVSLSGNLSMPAIEIAHEHGWNCIIDGRIVVSSKEAELWSMIYGLRMAEELKIERLIVEALREIVFLG

SEQ ID NO: 129878 - protein, 625 aa, Glycine max
  Coding DNA Sequence Number=SeqID_13100
  Gene Ontology: Mol. function=metal ion binding; Cellular component =nucleus; Biological process=regulation of transcription, DNA -dependent
  Homolog annotation: Hit_ID=Q6Z2D6; Match level="QueryCoverage=96%, HitCoverage=97%, E-value=1e-126, Identity=42%"; Hit description =Putative coiled-coil protein
MCTGIEVDEIVLEIFLAGFLLDPEKCGMLSLPDKQRLVREIARQSKDASSMLQSFTRRELLEIICAELGKERKYTGYTKSQMIEHLLKIISKNSNSHINGNMPAQSPAKSCIGTKRKKKPASQDLHHAPLGNSKEKTVKTFLCQNVACKATLNPEDSFCKRCSCCICHHYDDNKDPSLWLTCSSDLPNEESCGMSCHLQCALSNQMSSILKGSCGIKLDGAFCCVSCGKINELMKTWWKQLLVAKEARRTDILSLRISLAHRILVGTEVYKEVQKIVETALKLLENEVGSLDHVYASMTRGIVSRLSCGAEVQRLCSSALECFDSKFSGLFSICVENKDAPTCSIHFEECLPTSVVIVLEYKDKLLKNFLGCRLWHRISTIDYPEQPTFIVLRPEKRFKLENLHPSTEYFCKASLFSSTGILGAAEAKWVTPCEPSNPSKVISGGGNRFRWSPQRPSGTGVDMCTQDRITAEIHPTESANSDMKLSTGEHPGKKHIILNIRSRFEEFLSKPQPVEPFSYKNLAAVSPSTPSKSYEMRQIPGLNSRKRSKENDYEYSVRVVKWLEHQGHIDEIFRVRFLTWFSLKATQQERRVVSAFVDALIDDPASLADQLIHTFSDEICCEQKS

SEQ ID NO: 129879 - protein, 1266 aa, Glycine max
  Coding DNA Sequence Number=SeqID_13101
  Gene Ontology: Mol. function=protein serine/threonine kinase activity; Cellular component=membrane; Biological process=protein amino acid phosphorylation
  Homolog annotation: Hit_ID=Q93XL9; Match level="QueryCoverage=59%, HitCoverage=81%, E-value=1e-170, Identity=46%"; Hit description=CTR1- like protein kinase
  Pfam annotation: Domain name=Pkinase; Domain location=715-1000; Score= 204.1; E_value=3.3e-58; Accession=PF00069.15; Description=Protein kinase domain
  Pfam annotation: Domain name=Pkinase_Tyr; Domain location=715-1000; Score=242.2; E_value=1.1e-69; Accession=PF07714.7; Description =Protein tyrosine kinase
  Pfam annotation: Domain name=TPR_1; Domain location=1179-1215; Score =4.3; E_value=1.7; Accession=PF00515.18; Description=Tetratricopeptide repeat
  Pfam annotation: Domain name=TPR_1; Domain location=1216-1249; Score =35.8; E_value=1.5e-07; Accession=PF00515.18; Description =Tetratricopeptide repeat
  Pfam annotation: Domain name=TPR_2; Domain location=1104-1137; Score =7.3; E_value=4.7; Accession=PF07719.7; Description=Tetratricopeptide repeat
  Pfam annotation: Domain name=TPR_2; Domain location=1179-1215; Score =6.9; E_value=5.1; Accession=PF07719.7; Description=Tetratricopeptide repeat
  Pfam annotation: Domain name=TPR_2; Domain location=1216-1249; Score =34.1; E_value=4.9e-07; Accession=PF07719.7; Description =Tetratricopeptide repeat
  Pfam module annotation: Pfam domain module=Pkinase::Pkinase_Tyr::TPR _1::TPR_1::TPR_2::TPR_2::TPR_2; Domain location=715-1000::715 -1000::1179-1215::1216-1249::1104-1137::1179-1215::1216-1249
VEEEERHGTARRRSRRIVVVLLRTCERASPSSVAAAATYFFPRQFPERGLDESSKQRLDQEKRKIVNSIKSPDTNFAAFESDAPKKQTTTPQSPTPDVKNDVVFSSTKQNAVSDIFTGGDKFRTKQKQIAAFCDWLIDKKKDRNRPSHHFKPYPNEEEEEEEDERELLLRPPPPDAAAQVVKDAVDRSFDRQVSLPRLSSGSSYAGSLFTLDGTATFSSDVTKEETSSFRQVFTEEDATQKQQEEEEKEKRNTAQKYRESYYLQLAFTKRLSCLASLGSEPVLTLDAGTETWDAESVSYRLWVSGCLSYTDKISDGFYNILGMNPYLWVMCNDVEEEGKRLPTLMALKAAEPSDTSIEVVLFDRHEDSRLKELQDKAQELYSASENALVLVEKLGKLVAICMGGSFPVEQGDLHKRWKLVSKRLRNFHQCVVLPVGSLSSGLCRHRAILFKRLADYIGLPCRIARGCRYCVSDHRSSCLVKIKDDRQLSREYVVDLVGEPGNIHGPDSSINGAYVSSIPSPFQISHLKESQSPYVDVAACSQSLGNTSLDALKDALEIFFPILWNKIIPILKFDLVVTQSVSGCVQEDQQAEETDLQKNNNGSIYPAIDQTRGGAEPPLIPFGLKGNHKECAILGLLNFPPVYEGVSEDLHPATEASLHEYPRLSKDSVVVLEASNKEIEIIVKGSSGGAGNIPRYLNLEPSLAMDWLEIPWDDLRIKERVGAGSFGTVYRAEWHGSDVAVKVLTVQDFQDDQLKEFLREVAIMKRVRHPNVVLFMGAVTKRPHLSIVTEYLPRGSLFRLIHKPASGEILDPRRRLRMALDVAKGINYLHCLKPPIVHWDLKTPNLLVDRNWTVKVCDFGLSRFKANTFLSSKSVAGTVGCMAVNSLMTVWGGENVPFQECFKGAILCPPEWMAPEFLRGEPSNEKSDVYSFGVILWELVTLQQPWNGLSHAQVVGAVAFQNRRLAIPPNISPALASLMESCWADNPADRPSFGSIVESLKKLLKSPADAIKMVRDLTIAISNSQFHLDHLPDPSQSPIPDCEIPMDKTVKDNSAWNDIVLQGVMVLVMVLSYFFMHDVPKKLWAKLRLSNRADIQAKRHFVQGAQLLARARASKSKALAKEAQAQAQRAIALDPSDAAPHLLKALALDFLGLRSAALDSLDEALSPAAAKSLSDSERGDALLKRAELRLGTSQRGRVDSALADLTESVRLSPNNAKAFFALGDCYERKKMNDDAIRAYGTALELEPQFHAAEQALNRLDSSPMNN

SEQ ID NO: 129880 - protein, 41 aa, Glycine max
  Coding DNA Sequence Number=SeqID_13102
MVMHARTCEEEPPLFSDSVAVPCQERVAMLVEGGIMECCNG

SEQ ID NO: 129881 - protein, 40 aa, Glycine max
  Coding DNA Sequence Number=SeqID_13103
MEYQQELSKALRQGQLTKHLDQYVKKYESRLEDLGIRLCI

SEQ ID NO: 129882 - protein, 162 aa, Glycine max
  Coding DNA Sequence Number=SeqID_13104
  Homolog annotation: Hit_ID=Q6CQF3; Match level="QueryCoverage=34%, HitCoverage=59%, E-value=2e-08, Identity=72%"; Hit description =Kluyveromyces lactis strain NRRL Y-1140 chromosome D of strain NRRL Y- 1140 of Kluyveromyces lactis
MLSEAKPEETLVEARSDTDVQIVRLTWVGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 129883 - protein, 78 aa, Glycine max
  Coding DNA Sequence Number=SeqID_13105
MSRNFTDCLTMGVKYLEVIKRGSHPNKQMARRLWMTKGRRMTIICLCVPSDTIVSEWRKGVRNDHNLSPHVIGLAASG

SEQ ID NO: 129884 - protein, 84 aa, Glycine max
  Coding DNA Sequence Number=SeqID_13106
MAADPTKTLMNYLTPTLEMLENNPFSGATHEDPKQHLGRMSLDAACGGNLKLKFPTDAIKIIEDICSNPYNNLKDKRIIKGGVD

SEQ ID NO: 129885 - protein, 164 aa, Glycine max
  Coding DNA Sequence Number=SeqID_13107
MKKKKNPNLESVFEEFMAYHASSTTNQNSMKNHEIHFEIQVGELAEAVTQFMSRQEKSFVEAEVQEKSLEKDEEQAQQQWEKYSTVENQQENILQSNNLPHQLIDKKGRQGEHEETLSGVLSLITNTFLEMIWNVLPDYMKFMEFLARRRNFKEDVFFVTFKPP

SEQ ID NO: 129886 - protein, 552 aa, Glycine max
  Coding DNA Sequence Number=SeqID_13108
  Gene Ontology: Mol. function=hydrolase activity; Cellular component =membrane; Biological process=dodecyl sulfate metabolic process
  Homolog annotation: Hit_ID=Q5PHM1; Match level="QueryCoverage=92%, HitCoverage=77%, E-value=0.0, Identity=74%"; Hit description =Putative hydrolase
  Pfam annotation: Domain name=Lactamase_B; Domain location=172-394; Score=55.7; E_value=1.5e-13; Accession=PF00753.17; Description =Metallo-beta-lactamase superfamily
MTSPIWDYQRKVFALKWPVISPHLNYPLILNIDSGTNNLRGHAMKLNQIAKHLALAGVLTSLSLSAFAAAQQQDATPATQQANNALYNKLPFADKTDFDNAHKGFIAALPQTMIKGEQGNVIWNPAKYDFVKEGEKAPDTVNPSLWRQSQLINIGGLFKVTDGVYQIRNLDLSNMTIIEGEKGITVIDPLLSAEPAKEAMDLYYANRGKKPVVAVLFTHSHVDHYGGIRGVVDEADVKAGKVKIYAPAGFMEEAVSENIMAGTAMSRRASYMYGNLLKPDAKGQVGAGLGTTTSAGTVTLLQPTNYITKTGQQEVIDGLTYDFMMAPGSEAPSEMLWYVKEKKMIEAAEDVTHTLHNTYSLRGAKIRDPLAWSKYINAAIDRWGNDAEVIIAQHHWPTWGNDNIIKLMKGQRDMYRYINDQTLRMANEGLTRDEIAANFKLPESLEKQWSSRGYYGSVSHDVKATYVYYLGWFDGNPATLDELPPQQAAKKFVEYMGGADAIMQKAKADYQQGNYRWVAQVTSKIVFADPQNTDARNLEADALEQLGYQAEA

SEQ ID NO: 129887 - protein, 200 aa, Glycine max
  Coding DNA Sequence Number=SeqID_13109
  Homolog annotation: Hit_ID=Q1SP02; Match level="QueryCoverage=84%, HitCoverage=36%, E-value=6e-18, Identity=33%"; Hit description=IMP dehydrogenase/GMP reductase
MQIGGYLALLQCWIYEHFLSVHQCVTDDAYEETSPRASRWLTMKAHMKGITGAPYRARCDALTVTDVCWLPYSDHRGVRGFEPISSFQGQIRWGPTVVTVRPERVLCQFGYIQSIPPPPVSASLSYDDIDDRWMHFSDHVVVVGDLCVVPGQVFADYMEWFFQISHPFMIPTQQVTSPDMHLLQTMRTTCSRTSHSSSGI

SEQ ID NO: 129888 - protein, 40 aa, Glycine max
  Coding DNA Sequence Number=SeqID_13110
MATPLGITLLSGVFPRVSFGCGTCDNPAQWRDLGSITMLA

SEQ ID NO: 129889 - protein, 283 aa, Glycine max
  Coding DNA Sequence Number=SeqID_13111
  Gene Ontology: Mol. function=chitin binding; Cellular component =extracellular region; Biological process=chitin metabolic process
  Homolog annotation: Hit_ID=UPI000044A8F0; Match level="QueryCoverage =71%, HitCoverage=99%, E-value=3e-35, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLDFRGLHVLAFRGLQVLAFRGLHILALRELHVLALRGLHVLALRGLHVLTFRGLGLHVRDFRGLHVLAFRGLHILTFRGLHVLAFRGLYVLAFRGLHVLAFRGLQVLAFRGLQVLAFRGLHVLAFTGLHALAFRGLHVLAFRGLHALAFRGLHALAFRGLHALAFRGLHTLAFKGLHALAFRGLHVLTFRGLAALAFRGLHIHAFRELKFLGHPPDLGGGPTMLAQPKDEAIAQLLCIPGQDFAQAAAWRRVWIMHTNIWMTLLLRNILPSDHHSDPPC

SEQ ID NO: 129890 - protein, 63 aa, Glycine max
  Coding DNA Sequence Number=SeqID_13112
MGSKIYPKVHENPKAFFINSSPILLEPLAHGSGNWSFPKEDCISRPLDPTKDNPIGDIPMGAL

SEQ ID NO: 129891 - protein, 80 aa, Glycine max
  Coding DNA Sequence Number=SeqID_13113
MGSKSILRLMRTLGPSLGSLAQSTWSLVPNALAERCLRPVVDQQVTKSNAKDKQKYYVRDRQVITHPTQDVKEVLLGGNL

SEQ ID NO: 129892 - protein, 45 aa, Glycine max
  Coding DNA Sequence Number=SeqID_13114
MGAKHLTRTKEWSHVIEQRFPDEIRAIMKHSSKLEGGGHMNSARQ

SEQ ID NO: 129893 - protein, 248 aa, Glycine max
  Coding DNA Sequence Number=SeqID_13115
  Gene Ontology: Mol. function=transcription factor activity; Biological process=regulation of transcription, DNA-dependent
  Homolog annotation: Hit_ID=UPI00006DBFD1; Match level="QueryCoverage =90%, HitCoverage=72%, E-value=2e-65, Identity=58%"; Hit description =COG0583: Transcriptional regulator
  Pfam annotation: Domain name=HTH_1; Domain location=26-85; Score =62.5; E_value=1.4e-15; Accession=PF00126.17; Description=Bacterial regulatory helix-turn-helix protein, lysR family
  Pfam annotation: Domain name=LysR_substrate; Domain location=109-248; Score=3.8; E_value=0.00047; Accession=PF03466.10; Description=LysR substrate binding domain
  Pfam module annotation: Pfam domain module=HTH_1::LysR_substrate; Domain location=26-85::109-248
  Subcellular localization annotation: CTP_CleavageSite=34; ConfidenceScore=5.09e-01
MASTGFLKSVSKTRLKSCPACVVRRLEDLTLFVRAAALGSFSEAAREAGQQPAQVSAAIKRLETTLNIRLFARSTRSLRLTPEGETWLPYATQMLDTLQAGLQKIQAPGDEVRGTLQIAVPSDLGRNLLLKVFCAFRERHPALRLRLHFSDHLTDVFKDPVDVAFRYGYHEDASFISLPVAPENRRVLVASPQWVARHGQISSLEELSRHSALLYVLRGRPFDRWPLISGNEVHTVEMNGAIMSDDAE

SEQ ID NO: 129894 - protein, 118 aa, Glycine max
  Coding DNA Sequence Number=SeqID_13116
MIQNDQGLQAPHGATSCGFKLRLLLHLPLVKVKKEKGKNLMMKSTLEKKDNHEWLRRSVRRQPPHFLLCKKTLVSIATPLGIEFIPHVKELLDEGLVRKSLNPCALLVPKIGIINMKI

SEQ ID NO: 129895 - protein, 174 aa, Glycine max
  Coding DNA Sequence Number=SeqID_13117
MGDISKMKDIYKRWTEYLDSTRSRVNHPPPIHPYNQYEEEKTPTLESVFVEFTAYHATSTANQNSMQNQEIQVGKSYSMENYQWEQELQPYNQYEEERTSNLDNLLMKDKEVTESTQRAFKSLEIQVGKLAEEVTKFVARREENFVEVETHEESLEEEHDSKEKDEDKSEEKSQ

SEQ ID NO: 129896 - protein, 77 aa, Glycine max
  Coding DNA Sequence Number=SeqID_13118
MSVKNHVGCLGVHDKTNHTLGDQSGSQCFARMLQPYGINIGLKEHSNRMTKKGHNINSLPLKGLSINSLPLKGLIVV

SEQ ID NO: 129897 - protein, 81 aa, Glycine max
  Coding DNA Sequence Number=SeqID_13119
  Gene Ontology: Mol. function=ATP binding; Cellular component =mitochondrion
  Homolog annotation: Hit_ID=Q2PMM5; Match level="QueryCoverage=96%, HitCoverage=4%, E-value=1e-32, Identity=97%"; Hit description =Protein ycf2
MFRKFFYSILFLLLVAGYLVRTHLLFVSRVYSELQTEFEKESLSSCSGTIRRFSRRNTEFCFWWQHAMGWWSHLWGQINTF

SEQ ID NO: 129898 - protein, 225 aa, Glycine max
  Coding DNA Sequence Number=SeqID_13120
  Gene Ontology: Mol. function=DNA binding
  Homolog annotation: Hit_ID=Q1S0F5; Match level="QueryCoverage=84%, HitCoverage=36%, E-value=5e-22, Identity=34%"; Hit description=IMP dehydrogenase/GMP reductase
MSWHFWYLELSFFPNVNGLVDLAAIDAFLAYHHSKESPVIVVLANACDTFDRRCDKSGARIVCCTPALYVWLVSHLFRHESRPVCPLQGHRLCTEKGKANWEQLLASVVGGSINWFPRWKERRVGVLSSCEGFPNVPLMGTRGCINYNPVLAIRQLGYPMRGAPSEEGVTPFIAWGFSDPNARILQGFRKAWGVVQRKDKELRGSSNGIIGGYHKWLKARVQELD

SEQ ID NO: 129899 - protein, 178 aa, Glycine max
  Coding DNA Sequence Number=SeqID_13121
MLVPGTQQCVCPSIEVTPAIAWRNYQKSKDKKSTQNSIPRDLFEKHKRDHSQKVEAPKSEFQIKFNLHTPFPKLLVVHPVDVDLSLTDYFMLGGLHAQVYIQNQATAYPQGMCISKATEIKVVADKVCPCLPIWHAAKKKSFKLCYYEEMPSRKMNVEVMNFSRNYSSLFSGKRFFML

SEQ ID NO: 129900 - protein, 159 aa, Glycine max
  Coding DNA Sequence Number=SeqID_13122
  Homolog annotation: Hit_ID=Q1T254; Match level="QueryCoverage=73%, HitCoverage=36%, E-value=7e-11, Identity=33%"; Hit description =Peptidase aspartic, catalytic
MGVKYSKRSSEGCMPPNKWSPDEIRVAGCVICSGGHDSGCCIPTEDTTHEVNYMGNQPRPNFNAGGPQQQGTSLYDRMTKLEETLAQFMQVSMSNQKSTESTIKNLEVQVEQWAKQLADRSSRSFGANTEKNPKEECKAVMTRSKVERAKRATVQWKLR

SEQ ID NO: 129901 - protein, 68 aa, Glycine max
  Coding DNA Sequence Number=SeqID_13123
MVSIELITRQPESCPPLHITQPATCKTEEATRPTWAFQGVPIEGGAFWWKQPNLPGRARRQPPPSFPL

SEQ ID NO: 129902 - protein, 259 aa, Glycine max
  Coding DNA Sequence Number=SeqID_13124
  Gene Ontology: Mol. function=protein kinase activity; Biological process=protein amino acid phosphorylation
  Homolog annotation: Hit_ID=Q2QZ78; Match level="QueryCoverage=97%, HitCoverage=45%, E-value=8e-60, Identity=47%"; Hit description=AT hook motif-containing protein, putative
  Pfam annotation: Domain name=DUF889; Domain location=34-255; Score =337.9; E_value=1.8e-98; Accession=PF05970.5; Description=Eukaryotic protein of unknown function (DUF889)
MAHKFCFEALDQSLRDIITDKSKSNQIFGGKVIVFGGDFRQILSVIPRGTRSNIVNAAINSSYLWDSCEILTLTKNMHLHRNLESVDEQETATFAKWILDIGDGIIDDENDGYATIQIPAHLLITQYDDPISAIVKSTFPDLDQHHNNPEFFKSKAILASTNETVEQINDYVLSFIPGDHMEYLSSDSIDKSETSENSYFQSITTEFLNSLKTSGLPTHSIKLKIGSPIMLLRNLDQNQGLCNDTRLVVTKDGKTCNCN

SEQ ID NO: 129903 - protein, 339 aa, Glycine max
  Coding DNA Sequence Number=SeqID_13125
  Homolog annotation: Hit_ID=Q1T493; Match level="QueryCoverage=94%, HitCoverage=64%, E-value=2e-29, Identity=26%"; Hit description =Nucleic acid-binding, OB-fold, subgroup
  Pfam annotation: Domain name=Rep_fac-A_C; Domain location=112-245; Score=-64.9; E_value=0.038; Accession=PF08646.1; Description =Replication factor-A C terminal domain
QQLLSCTLWDDYCLQFLEFLDDYEGSYPTSINNSFKASKLIINQPVMEIQEFNERLAELGIEARSGFKSHGEGSTQLSGSIQLSSKESFFGKAEGKTIADINTISEEIVCVTVGTITRIVLDNHSWCYTSCIQCHKKSDAEMTPFTCACGKYNKEVVLRYRLEVMINQGNESTKFLLWDRECSELIGQSADAVNKLKIEDGDVDLNASPLALDKLLGYELAFKIKVQPKFRNSAVLKCSADSSLINAVMDMLVDAETSSKMNISVSDSNHSAQHESQSLSVTADHDPLLGLPLTPTKRQTFQDCDDEAGTSQISPAQLSSKKLKKTWRNLVHLVVFKLC

SEQ ID NO: 129904 - protein, 68 aa, Glycine max
  Coding DNA Sequence Number=SeqID_13126
MASSSTLTTDRLKILSHPPQEMLRLFNLSISPTRDIRQGTSDKVNAAPMYIRNMQRMKHGIIKYTGHG

SEQ ID NO: 129905 - protein, 76 aa, Glycine max
  Coding DNA Sequence Number=SeqID_13127
MFGVKYPYQNIRVEGVPLGVGVQKQATVAQGGHWWSWVVENEVLGFGWHFGEEISLSELISLSQSPLFALSVRIHA

SEQ ID NO: 129906 - protein, 91 aa, Glycine max
  Coding DNA Sequence Number=SeqID_13128
MVIDTDVWKEVARLDMGGVRKFEEITDGYRKMQNYRGMRLDPTRNLRNRLGVGGLTAEDKMLVYPLLGLLASVPIFIVGFTSIKEFVSTGT

SEQ ID NO: 129907 - protein, 455 aa, Glycine max
  Coding DNA Sequence Number=SeqID_13129
  Gene Ontology: Mol. function=glutamate N-acetyltransferase activity; Biological process=arginine biosynthetic process
  Homolog annotation: Hit_ID=Q7WP92; Match level="QueryCoverage=98%, HitCoverage=57%, E-value=1e-121, Identity=48%"; Hit description =Hypothetical protein vrgS
  Pfam annotation: Domain name=DUF586; Domain location=355-433; Score =177.7; E_value=2.8e-50; Accession=PF04524.3; Description=Protein of unknown function, DUF586
MDGLLFWKLTGAEALSQSFELNAELLATDARIDRHALLGQPVTFTLPTQSLLSPRYLNGKITRVAVRSEELSGTRYAVYQLRVEPDLWPMRRDRNLRIFQGQTVPQIVQTLLQENGVNVETRLGSSYRVWEYCVQYQESSFDFISRLMELEGIYYWFRHEAERHVMVLCDGADQHEAFAGYETIPYHVTASGGSVTEEGISQWSLCESVTPGMYSTDDYDFRKPNAWMLQARQNPVSPVPGAVDVYDWPGHFVDHSHGEFYTRIRQEVWQVAHHSVSGTGTATGIAPGYRFGIVNAPHFSDNGEYLVTSARYDFEENGYASGGGGARHNIAFTVLPSSVTYRAEPATAWPKTHGPQTAKVVGPAGESIWTDRYGRVKVKFHWDRLAKGDDTSSCWVRVSSAWAGQGFGGVQIPRVNDEVVVDFINGDPDRPLIIGRVYNEASMPPWALPAAATQM

SEQ ID NO: 129908 - protein, 123 aa, Glycine max
  Coding DNA Sequence Number=SeqID_13130
  Homolog annotation: Hit_ID=Q2QVF7; Match level="QueryCoverage=69%, HitCoverage=19%, E-value=3e-08, Identity=34%"; Hit description=RWP -RK domain containing protein
  Pfam annotation: Domain name=RWP-RK; Domain location=19-70; Score =48.4; E_value=2.5e-11; Accession=PF02042.6; Description=RWP-RK domain
GENLSFDRVVVFYIAQRQRVPRMTLSDLSGVFHLTISAAAVKLDVGDSTVKSICRRGKLKRWPQRKVQSLAKKVRVLERALNSPDPGVKRRTLDEIRRLQQEIIENCGGITPTGIPMLQFDEE

SEQ ID NO: 129909 - protein, 149 aa, Glycine max
  Coding DNA Sequence Number=SeqID_13131
  Gene Ontology: Mol. function=nucleic acid binding
  Homolog annotation: Hit_ID=Q1SKA8; Match level="QueryCoverage=75%, HitCoverage=44%, E-value=9e-09, Identity=30%"; Hit description=Zinc finger, CCHC-type
  Pfam annotation: Domain name=zf-CCHC; Domain location=97-114; Score =17.6; E_value=0.0012; Accession=PF00098.13; Description=Zinc knuckle
MSLATLFGKLQEHEMKLMRLNQHEENDKKKKGIALKASSSILEKSDKEGLNEHNNIEEDDDFSLFIKRFNKFLRNKGNRKRSNFNPKKKGEDSSSVPKCYECDQPKHLRVECPIFKRRMDKSDKKTFKDKKGKKTYITWEDNNMDSSSD

SEQ ID NO: 129910 - protein, 50 aa, Glycine max
  Coding DNA Sequence Number=SeqID_13132
MKMVKIGSLSAREDGALSELAFTQRLYTTHPSSRISMRLVDDALSQKMSG

SEQ ID NO: 129911 - protein, 143 aa, Glycine max
  Coding DNA Sequence Number=SeqID_13133
MLSKTGPDERRETRLSLTLPFSSSSFSIEAPSKASTFGHHFCPKSRKEAIFGVVKTYEKAWTVLETKTNDQSEPRAISRAKLGVEESNFDSNFAVKIGAAEFWLVQKNACVWLAVERVVQNEFWMFASRSHGQNVGLSIRDFQ

SEQ ID NO: 129912 - protein, 237 aa, Glycine max
  Coding DNA Sequence Number=SeqID_13134
LPSQGAPFEGTIVDDWKFDYSSHDARRMVCNDQAEMTGRLLVGSLTFDNRIMNYIIVRILLPRSSNLAQASEEDLILMWSFLTGRQINWAHLVRYRMHKALRANAPLPYPQLVTLFLLHFQIPLDDEPFVQVKRSFAIGPGAVTSFGYRTDRNGQWLKKDALPPQDEHTHSPPPQRDDSALMTEVLSELQGLRTYVGERFDSLDNRFAGMDIHLTQLEEDVGYIRHSFDLPPPPPPS

SEQ ID NO: 129913 - protein, 77 aa, Glycine max
  Coding DNA Sequence Number=SeqID_13135
MGEESWSLVRNHLHKELISWSEEYINLVGGIERFEELKHSLLVDGLSMVTMDKWMNITDMGYVIASQYNVIIISLSR

SEQ ID NO: 129914 - protein, 115 aa, Glycine max
  Coding DNA Sequence Number=SeqID_13136
  Homolog annotation: Hit_ID=Q3LSN0; Match level="QueryCoverage=59%, HitCoverage=22%, E-value=5e-07, Identity=43%"; Hit description =Nodulin-like protein
MADCIVAKHTQRAIQKVDNKWSGQHEAIGTCCVEVESDRFPLMDKRIIQRILWIIQHAQKIYLLRAIHNPEKSIILTSIASEMHRRKELNVYQLLSFDPSHGVRLLIAVAALEDA

SEQ ID NO: 129915 - protein, 227 aa, Glycine max
  Coding DNA Sequence Number=SeqID_13137
DQRLRYNSQFSSRIILDPKYLDIDFFNDETFDCYQVFQNSGLVDFMSLKLPYYLELVRVFYSNLKIQDGIIRSEVHGISIIIDQSLFFSLTKLPSQGEPFEGTIVDDWKFDYSSHDARRMVYNDQADMTGAGAVTSFGYRKDRDGQLLKKDTLPPQDERTPSPPPPQRDDSSVLMNEVLSELRGLRTYVGERFDSLDSRFEGMDTHITRLEEDVTYLCRCFDLPPPS

SEQ ID NO: 129916 - protein, 98 aa, Glycine max
  Coding DNA Sequence Number=SeqID_13138
MTCGDKLWSFPTPFHHLEAIVCGGTQRQIMVILRLATQARSIRRHAETNYGHSAPCVDQEERIRQYQDDVPVQIIFKIFVGSAGRKIHRSNGVSLERN

SEQ ID NO: 129917 - protein, 216 aa, Glycine max
  Coding DNA Sequence Number=SeqID_13139
  Gene Ontology: Mol. function=ATPase activity, coupled to transmembrane movement of substances; Cellular component=integral to membrane; Biological process=transport
  Homolog annotation: Hit_ID=Q8GU58; Match level="QueryCoverage=82%, HitCoverage=22%, E-value=5e-33, Identity=35%"; Hit description=MRP -like ABC transporter
MVSVTWQVLIVAVLAIVASKYDQGYYQASGREIIQINGTTKALMNFTTETSLGGITIRAFNMANRFFKTYLNLVDASATLFFHSNAAIKRIKQFIHIPAEPSAIVEDNRPPHFLPSKGRIDLQSLELWFSPLIQDQVQDSPPSVLRCHEAWLKDLRTKLSIIPQEPTLFKGSIQKNLDPLCLYSDYEIWKALEKCQLKATISSLPNLLDSCGVLNL

SEQ ID NO: 129918 - protein, 220 aa, Glycine max
  Coding DNA Sequence Number=SeqID_13140
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=100%, E-value=4e-34, Identity=33%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSTSEDYMSSTSEDYTFSPLEDYMSLPYEGYTASPFEDYTPSPSEDYTSSPLEDYTSSPSEYCTGLHVLTFKGLHVIALRGLHVLAFSGLQGLAFVGLHAPTVKGLLILTFRGLHVLTFSGLHALALTGLHVLTYRGLHNLAFRGLDALAFRGVHILPFRGLHALAFVGLHTLTFKGVHILNFRGLYIVAIRGLHVLPFRGQHDLPFRGLHALALTGLH

SEQ ID NO: 129919 - protein, 58 aa, Glycine max
  Coding DNA Sequence Number=SeqID_13141
MRRRILNAENKNSILLPFASVGEENNDLLGLSSKLRYKRHLVMMTVWISVPKLWDYFR

SEQ ID NO: 129920 - protein, 85 aa, Glycine max
  Coding DNA Sequence Number=SeqID_13142
MDCDYDLDRNINVFLTICIHNWDCISHDIYKCDETTMQPLLVKDLNKREATCVVRHSWLHSWSTSHCTLLGALCKLLGHQRTHLV

SEQ ID NO: 129921 - protein, 96 aa, Glycine max
  Coding DNA Sequence Number=SeqID_13143
IGSVVDAVDVTVVVGIPPDGVDVLNSDIESGESSEPELSELPAVPSRSGRTILMTLVLGTSYATHEWNCDIVMAEWTKRMRNINMRVVAIDKICIV

SEQ ID NO: 129922 - protein, 365 aa, Glycine max
  Coding DNA Sequence Number=SeqID_13144
  Gene Ontology: Mol. function=caspase activity; Cellular component =nucleus; Biological process=proteolysis
  Homolog annotation: Hit_ID=Q6XPT9; Match level="QueryCoverage=98%, HitCoverage=93%, E-value=2e-67, Identity=42%"; Hit description =Metacaspase 3
  Pfam annotation: Domain name=Peptidase_C14; Domain location=106-361; Score=127.6; E_value=3.4e-35; Accession=PF00656.12; Description =Caspase domain
MASRQVRCNQCGSLLMVSAETRVVECTVCHGMTQIRPSITGAWSEVVYNSFHQFGGRLRSFANTIMPGSGSVNNSNPRGYYGTPQIAYYPPPPQSLRPSYNAYGPKRAVLCGICYHGKDNQLNGTVNDVKNMNIFLVKECGFPRESILILTDDMEERNPQKFPTKYNILKAMRWLIEGSQSGDSLVFQFSGHGCQELDTNGDFDELDERDEAICPVDWEKQGIILDDDINAAIVRPLPYGAKLHAIIDSCNSGTVLDLAYVWSQRDTWDYQYGGPDKDTSGGLAICISGCGDYQSSKEIPVLSGGGGGNAVTGVFTYSFIYTMLNEPAGLSYGGLLSSMRSTIRGMLNNPNASLFNTDFTLAPRQ

SEQ ID NO: 129923 - protein, 89 aa, Glycine max
  Coding DNA Sequence Number=SeqID_13145
MEVHLFTIIIYLSITGQSQRRDLEVEAIVGVELQHVASGVETSIGFSVRRCLHNSRDEFFFIDLKRGKRGGGGGPGGGVREGGNSGIGG

SEQ ID NO: 129924 - protein, 383 aa, Glycine max
  Coding DNA Sequence Number=SeqID_13146
  Gene Ontology: Mol. function=caspase activity; Cellular component =nucleus; Biological process=proteolysis
  Homolog annotation: Hit_ID=Q75LR0; Match level="QueryCoverage=97%, HitCoverage=96%, E-value=6e-93, Identity=48%"; Hit description =Putative metacaspase
  Pfam annotation: Domain name=Peptidase_C14; Domain location=101-379; Score=182.4; E_value=1.1e-51; Accession=PF00656.12; Description =Caspase domain
  Pfam annotation: Domain name=zf-LSD1; Domain location=8-32; Score =13.5; E_value=0.029; Accession=PF06943.3; Description=LSD1 zinc finger
  Pfam module annotation: Pfam domain module=Peptidase_C14::zf-LSD1; Domain location=101-379::8-32
MASRQERCNQCGILLMVPPEVHVFECAVCHGITQIRPTAGPWSQAYNSFHHLAGRFRGFVNTMMTSSVNSNPSYYGTTHEFGYYPQPPQSLRPSYHVYGSKRAVLCGIRYHGKSYRLKGSVNDVKCMKYFLIKEFGFPSASILMLTDDREERNQLRIPTKYNIQMAMRWLIEGSQSGDSLVFHFSGHGTQEMNMYGDEIDGFDEAICPVDYEEQGKILDDEINAAIVRPLPRGAKLHAIIDACYSGTVLDLAFVCKMNREGYYTWEDQRCPRTDKGTRGGLAICISACEDGQTSIDTSALSGNEATGALTYSFIQTVQNEPGLSYGRLLSAMRSTIRGTKTGIVQLNGPIASLLNRLLGLDLRQEPQLSSSEMFDVYTKRFVL

SEQ ID NO: 129925 - protein, 192 aa, Glycine max
  Coding DNA Sequence Number=SeqID_13147
  Homolog annotation: Hit_ID=Q2QVF9; Match level="QueryCoverage=69%, HitCoverage=58%, E-value=1e-11, Identity=30%"; Hit description =Expressed protein
MFPNAEESKSENKITVTNSSEFQQETRFRVGDSAPMDEWGSASSPPWPVAIEGGEGDTALAKSRVLTREEVLRRRLRRTRQLGRCYRAHYWALMEEMRSKYRDYCWSYGKSPFKEDHNDNSDNNNHQNGVVSGGGDDIVQCRYNGCKTKAMALTNYCHTHILGDSKQKLYRGCKAVAKKFVLVEVKLEDTAK

SEQ ID NO: 129926 - protein, 149 aa, Glycine max
  Coding DNA Sequence Number=SeqID_13148
MENNGGLWWLMVAVGDGESAWDVRNGFGRKKEEEMGVTPSVAKEYPKLVNINTQGSMVQNAMFHSIMRWLSKDIVATCPSRASEGEAHGCAFQRRKDAQSRHQRLFVENVGKTEGNRSKIKILSSGVIFTLEEGISTSHVCLEGQQSIF

SEQ ID NO: 129927 - protein, 124 aa, Glycine max
  Coding DNA Sequence Number=SeqID_13149
MANNNVPAQIPICWKVINGTVATYPFAGERGEAHGALAPTYPPSKRKSDLRSSFFKGESSDSFYLESGHFKALDLKNYLFYLGRSLPPSSPRRARLLPPEATAFWRNILEGPSGSGCYLHPHFY

SEQ ID NO: 129928 - protein, 145 aa, Glycine max
  Coding DNA Sequence Number=SeqID_13150
MANEVDFKIELKVSANCCEGSKRKVKKALRNPEVLGNVNPHILIKKLQKVGKHAELWSYEEFESEEKEELLANEKEKQNVWEQEKQPHPCDIKIDKTKDVTRKKKASKACVEEHMPRFEPPPFLRPTERVGDYFSDENTTGCHVM

SEQ ID NO: 129929 - protein, 190 aa, Glycine max
  Coding DNA Sequence Number=SeqID_13151
  Gene Ontology: Mol. function=glyceraldehyde-3-phosphate dehydrogenase (NADP+) (phosphorylating) activity; Cellular component=chloroplast; Biological process=reductive pentose-phosphate cycle
  Homolog annotation: Hit_ID=P09043; Match level="QueryCoverage=96%, HitCoverage=67%, E-value=1e-59, Identity=83%"; Hit description =Glyceraldehyde-3-phosphate dehydrogenase A, chloroplast precursor
  Pfam annotation: Domain name=Gp_dh_C; Domain location=106-189; Score=- 16.9; E_value=2.2e-06; Accession=PF02800.10; Description =Glyceraldehyde 3-phosphate dehydrogen
  Pfam annotation: Domain name=Gp_dh_N; Domain location=17-145; Score =150.2; E_value=5.6e-42; Accession=PF00044.14; Description =Glyceraldehyde 3-phosphate dehydrogen
  Pfam module annotation: Pfam domain module=Gp_dh_C::Gp_dh_N; Domain location=106-189::17-145
MVGGREGYRKGVVEAKLKVAINGFGRIGRNFLRCWHGRKDSPLDVIAINDTGGVKQASHLLKYDSTLGIFDADVKPVGDIISIDGKVIKVVSDHNPVNLPWKDLEIDLVIEGTGVFVDRDGAGKHIQAGAKRAAALNIVPTSTGAAKAVVLVLPTLKGKLNGIALRVPTPNVSVVDLVVQVTKKRPLLKK

SEQ ID NO: 129930 - protein, 328 aa, Glycine max
  Coding DNA Sequence Number=SeqID_13152
  Gene Ontology: Mol. function=RNA-directed DNA polymerase activity; Cellular component=extracellular region; Biological process=RNA -dependent DNA replication
MVIVATEKESTTHTKILDIYGKYLEQPFIIGRNKKVVFGFLKDRIWKCIDHWSGKQLSEASKEVLIKSCAQAISSYCMSVYLLPAFLEEDIQRMKNSFWWDSKTATSRGINWLSWDKLSMKEEFGGLGFHNLHGFNLSMLGNQGWKLITHPNATVTKFTKLNIFLKELSRFRRLRVSDKVDQAQNTKDLIFKVLQILPSQHQQKFAMMLWCIWKQRNEKLWENLDTNPNISVSLPMQLLHEWQHARKHSRTPTVSNIQIPATWCKPSLGFLKFIVDAALFKDHKCFGVGICIRDDKGAFVKAITHLSPGWPKPREAEAWGHLQAITWA

SEQ ID NO: 129931 - protein, 235 aa, Glycine max
  Coding DNA Sequence Number=SeqID_13153
  Gene Ontology: Mol. function=hydrolase activity, hydrolyzing O -glycosyl compounds; Cellular component=cell wall; Biological process= carbohydrate metabolic process
  Homolog annotation: Hit_ID=Q41638; Match level="QueryCoverage=99%, HitCoverage=83%, E-value=1e-133, Identity=94%"; Hit description =Xyloglucan endotransglucosylase/hydrolase protein A precursor
  Pfam annotation: Domain name=Glyco_hydro_16; Domain location=2-155; Score=201.9; E_value=1.5e-57; Accession=PF00722.11; Description =Glycosyl hydrolases family 16
  Pfam annotation: Domain name=XET_C; Domain location=179-229; Score =102.0; E_value=1.8e-27; Accession=PF06955.3; Description=Xyloglucan endo-transglycosylase (XET)
  Pfam module annotation: Pfam domain module=Glyco_hydro_16::XET_C; Domain location=2-155::179-229
  Subcellular localization annotation: CTP_CleavageSite=35; ConfidenceScore=5.18e-01
MVVLRFSFILINTQVLASNQKGPTCLVTSASGTVTAFYLSSTNSEHDEIDFEFLGNRTGQPYILQTNVFTGGKGDREQRIYLWFDPTREYHRYSVLWNMYQIVFYVDDYPIRVFKNSNDLGVKFPFNQPMKIYNSLWNADDWATRGGLEKTDWSKAPFIASYKGFHIDGCEASVNAKFCDTQGKRWWDQPEFRDLDAAQWQKLSWVRQKYTIYNYCADRKRYPQVSPECARDRDI

SEQ ID NO: 129932 - protein, 189 aa, Glycine max
  Coding DNA Sequence Number=SeqID_13154
  Homolog annotation: Hit_ID=Q9AVH2; Match level="QueryCoverage=24%, HitCoverage=16%, E-value=3e-18, Identity=93%"; Hit description =Putative senescence-associated protein
LGKPLVEILPPGQLRGFCPLLAWLGSAVLGYGPVLSFGLVGPLLPPVISFVARILPTLACAPLAKSGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPIAMTICANQRFLSY

SEQ ID NO: 129933 - protein, 339 aa, Glycine max
  Coding DNA Sequence Number=SeqID_13155
  Homolog annotation: Hit_ID=Q655R7; Match level="QueryCoverage=46%, HitCoverage=69%, E-value=5e-53, Identity=60%"; Hit description=OTU -like cysteine protease-like
  Pfam annotation: Domain name=OTU; Domain location=140-252; Score =134.3; E_value=3.3e-37; Accession=PF02338.9; Description=OTU-like cysteine protease
MINGNGTQTEYWGESSGSTSHSSQQDVEDDRMIALVLSEEYAKLDGAVGRRLTNLEPVRLKLLVELVQGISNALKGHTGTAVLIYFFLSLPVNFLELALSFVSHVPRINSFIPTVSDASMDHQRLLQRLNVYGLCEVKVSGDGNCQFRALSDQLYRSPEHHKHVRKEIVKQLKDHRSLYECYVPMKYKKYHKKMAKTAEWGDHVTLQAAADKFSAKICLLTSFRDTCFIEIMPLYQAPQRELWLSFWSEVHYNSLYEIRGKGGKKSIKRPFNSEALASRTLDFQLRIDHFSDLEDILIAHYFLLFVCQFIFATTFTPFQPPPFTRWIFWRSAPCMIQDI

SEQ ID NO: 129934 - protein, 62 aa, Glycine max
  Coding DNA Sequence Number=SeqID_13156
EKEGGVCRPARPGELGCFHQKAPPSVETPWKIAQQCFLSTSDLSRNFMDCLMMGVKYLEAVK

SEQ ID NO: 129935 - protein, 117 aa, Glycine max
  Coding DNA Sequence Number=SeqID_13157
MEKKGNDQTCIDIRKHSRHGHYSLPRTFVCQTPNNISVATCPLAGERGRGSPVRFQKEERCAESPPTFICGKRRENRRKPVKMKILSSGVVFTFEEGRQKRGSCSYVPSIEEEIRPT

SEQ ID NO: 129936 - protein, 75 aa, Glycine max
  Coding DNA Sequence Number=SeqID_13158
MATRDSYWNQVASVLNILDDELIKNVGDYILRLLIIFLNKLNWQASKYACIKQTLLLFLQKPCVASQVTFKYSHR

SEQ ID NO: 129937 - protein, 71 aa, Glycine max
  Coding DNA Sequence Number=SeqID_13159
MIDGLGVAGIEAAMLGQNTLVELCSTQMAGTDSHITMIDGLGVAGWGVGGIEAQAAMLGQTCVVLTIGEVI

SEQ ID NO: 129938 - protein, 171 aa, Glycine max
  Coding DNA Sequence Number=SeqID_13160
  Gene Ontology: Mol. function=protein dimerization activity
  Homolog annotation: Hit_ID=Q1S735; Match level="QueryCoverage=94%, HitCoverage=30%, E-value=9e-47, Identity=54%"; Hit description =Probable transposase [imported]-Arabidopsis thaliana-related
  Pfam annotation: Domain name=DUF659; Domain location=106-171; Score= -68.6; E_value=0.081; Accession=PF04937.6; Description=Protein of unknown function (DUF 659)
MDEDPVRIVEELRRTPKSPVSSKSQKGKNTIHVDDYFMPRTTPKAQPSLKSVLQNKKIVEKCDKAIAKWMIDAIVPFNAINSTYYQPMIDVISSMSPVYKSPFFFYRICGPLLYKWFDEGRKLVKIYQEVWKETRCTMMADGWTDHPRRTLINFLVYCPKWTIFLRSIDAS

SEQ ID NO: 129939 - protein, 74 aa, Glycine max
  Coding DNA Sequence Number=SeqID_13161
  Pfam annotation: Domain name=zf-C2HC_plant; Domain location=17-66; Score=51.8; E_value=2.2e-12; Accession=PF07567.3; Description =Protein of unknown function, DUF1544
MSSAEAPSSQETSTPNTPQNGATKETMMCIYCDKGVKGGGINRFKAHLAGQKGQVEACKKVIVDVQQQMKQLLE

SEQ ID NO: 129940 - protein, 201 aa, Glycine max
  Coding DNA Sequence Number=SeqID_13162
MSLYDSVYQNMYFAFIKFTLLDKQGAVGPVKPADRPDHEDATVFRVFNQDFPLYIKHEDLSEIAHGGQCLCISVIQLWILHLTNTSMRAENSDVHGFLEPQFIQRFGQSQFESKSYMKNWMHNSKRDVYLGAYLNGPNNYLKGINNRALKGLDDTPQPKFKAGARWIVVKYFNDVRPLEAERFKVLRIQWAQYYLKLRNQT

SEQ ID NO: 129941 - protein, 108 aa, Glycine max
  Coding DNA Sequence Number=SeqID_13163
  Homolog annotation: Hit_ID=Q9XF97; Match level="QueryCoverage=42%, HitCoverage=11%, E-value=7e-09, Identity=60%"; Hit description=60S ribosomal protein L4
MGFVVSSWWGSLGFATIVAVEITIVGFHEGVAVEIIVLQLTVWCTELHSCAIDGENKEPVWELQDRHDVVVAGEDVGGDGGGSDGKDDGVTPLVHVDFPVPTMPDPAQ

SEQ ID NO: 129942 - protein, 94 aa, Glycine max
  Coding DNA Sequence Number=SeqID_13164
IAREVLDVAAPIIQPSVTTNEIDRVIHLATIAAASMRFFNGDLPPWRCSGRQKRRGERRRHPLGNKPWKKELHHQDEPWIRSLERMLQWRKRKR

SEQ ID NO: 129943 - protein, 142 aa, Glycine max
  Coding DNA Sequence Number=SeqID_13165
MYKAKKEMVGRFQRNKKKMESYLEVVDSMLKNLRCIGIHNLAFWNSLIYTHGDLELLGKLNEGMRIYKNFEGDFARQAAIRDRNIVMSDKLNLDEDEDDDVPQPLDNTMEDVNPNESNIGEEPHSFDGEGLLEVDSILAPWI

SEQ ID NO: 129944 - protein, 490 aa, Glycine max
  Coding DNA Sequence Number=SeqID_13166
  Gene Ontology: Mol. function=nucleoside-triphosphatase activity; Biological process=defense response
  Homolog annotation: Hit_ID=Q1SI91; Match level="QueryCoverage=94%, HitCoverage=88%, E-value=6e-43, Identity=31%"; Hit description =Leucine-rich repeat
  Pfam annotation: Domain name=LRR_1; Domain location=131-158; Score =0.6; E_value=2.2e+02; Accession=PF00560.23; Description=Leucine Rich Repeat
  Pfam annotation: Domain name=LRR_1; Domain location=223-245; Score =8.7; E_value=6.8; Accession=PF00560.23; Description=Leucine Rich Repeat
  Pfam annotation: Domain name=LRR_1; Domain location=304-327; Score =3.2; E_value=72; Accession=PF00560.23; Description=Leucine Rich Repeat
  Pfam annotation: Domain name=LRR_1; Domain location=333-357; Score =0.2; E_value=2.6e+02; Accession=PF00560.23; Description=Leucine Rich Repeat
  Pfam annotation: Domain name=LRR_1; Domain location=36-61; Score=2.7; E_value=91; Accession=PF00560.23; Description=Leucine Rich Repeat
  Pfam annotation: Domain name=LRR_1; Domain location=63-84; Score=1.3; E_value=1.7e+02; Accession=PF00560.23; Description=Leucine Rich Repeat
  Pfam module annotation: Pfam domain module=LRR_1::LRR_1::LRR_1::LRR _1::LRR_1::LRR_1; Domain location=131-158::223-245::304-327::333 -357::36-61::63-84
MLLEYARSESYLILRDSPVQKIWHGSLSIPDSCFSNLGTLIVGGCQFLSDAVLPFNLLPLLPKLEELEVKNCEYVKTIFDVKYITQDRKMTTMGATSIPLPFPLKKLTLSELPNLENVWNEHPHRIPRMQLLQEVYVDNCKRLASVFPTSVAKDLLKLENLVVKHCEGLMAVVAEHNADPKGTNLELTFPSVKSLTLWDLPKFNYNGIYCIHDATKIIELTPNLQHLTLGQNELKMILHGEIQGNHLNKLKVLTLCFHVESDVFPHGFLQPVPNIEELVVCDGSFKEIFCLQSPNVDDTTLLSQLKVLRLESLPELVSIGSLNLVPCTMSFSNLTKLKVKSCNSLLCLFTSSTAKNLAQLQNMEIEFCESIKEIVSKEGDESHEDEITFPQLNCLVLKDLPDLRSFYEGSLSFPSLEKLSVIKCHGMETLCPGTLKADKLLGVQLKSGYSDVMPLEIDLKSTIRKAFLAEIPFRMESACYSLAIITYPTF

SEQ ID NO: 129945 - protein, 49 aa, Glycine max
  Coding DNA Sequence Number=SeqID_13167
MDAAGNNNSESESESACSNILTVQMTIRRVKIGPKKNCVKGNVVNILSR

SEQ ID NO: 129946 - protein, 372 aa, Glycine max
  Coding DNA Sequence Number=SeqID_13168
MDIYGPENLHLPQRYTEQSLSKFTVEQVYHLYDCEDYLRKNLSALDPEMQDAPVESAPLTMSAEACSMDPLSSAKGNGKEGINNMESIMWDEPSKKFLISEIDHIESFVEQLSVSLKRICKKLNENEIEYSENPCIPSKIEISSTNPDQKNPDFGFCECGLMLGKLNFVLTHSPVSLLSLILSQIQHALYWEDRREASIVSNFVDKEKLLGLTNMTSGIDIEVVVGSPSFGIVPLTGQLGHGNGKAECVKLDPRAIEIPKPNNDKYASSGKISIGSYLHLNDINACMIKGKGFSGTKRYFGDLGTTQLRSAGSNIAFAAVAEISDSVLKGAVSGFQQGILKLAMEPSVLRTALMEGGPDRKILLDRSPGVDE

SEQ ID NO: 129947 - protein, 453 aa, Glycine max
  Coding DNA Sequence Number=SeqID_13169
  Gene Ontology: Mol. function=transferase activity; Cellular component= nucleus; Biological process=paclitaxel biosynthetic process
  Homolog annotation: Hit_ID=Q1RZ42; Match level="QueryCoverage=98%, HitCoverage=95%, E-value=1e-130, Identity=53%"; Hit description =Transferase
  Pfam annotation: Domain name=Transferase; Domain location=8-452; Score=302.1; E_value=1.1e-87; Accession=PF02458.6; Description =Transferase family
MAHQNAILTVENKDVTFIKPSKPTPTTILSLSSIDNAPDNDFFMQSLHVYRWENHNSPNTPKLGPAKLIKVALSEALFYYYPLAGKLVRHADGKFRINCNSEGVPFIEAICNCSLSSIHYLDCNDVEIGKHFAIDFPSEDEFGNQYPLVFKVTKFLCGGFTLVMGLSHAILDGTGQSQFLRAVAELASGKAEPSVKPVWERERLVGTYTSQPMQNPMDNASFAVSPFLPTTDYSHECSKVDSESITRLKTSLMKESDNKESMKKKGFTTFETLAAYIWRSRTRAMKLSYDRKTLLVMTVGLRPHLLNPLPDGYYGNTIMDAFVTLTVRELNELPLLEVVKLIRESKEVAFSDDYIRHSIDSMHTKPMEYYYERGGITFITDWRHLGLLEKVDFGWKEPVNTMPVPSDMYGLIGLCNIFLPSNLDPSMIGGARVYASLPSAAMPKFKEEMKALT

SEQ ID NO: 129948 - protein, 155 aa, Glycine max
  Coding DNA Sequence Number=SeqID_13170
  Gene Ontology: Mol. function=pyridoxal phosphate binding
  Homolog annotation: Hit_ID=Q10EM3; Match level="QueryCoverage=92%, HitCoverage=13%, E-value=2e-36, Identity=55%"; Hit description =Expressed protein
MHLSLWKPISQCAALIMDKSRRKEESNVEMRRNPSMLRKLQENKLREALEEASEDGSLSKSQDIDQPDSAANQDDGLGRSRSLARLHAQREFLRATALAAERIFESEEEIPSLQEAFAKFLTMYPKYQSSEKVDQLRSDEYSHLSPKGISFQVAG

SEQ ID NO: 129949 - protein, 79 aa, Glycine max
  Coding DNA Sequence Number=SeqID_13171
  Subcellular localization annotation: CTP_CleavageSite=39; ConfidenceScore=5.24e-01
MTMTTLNGDSGRDMVVAMTNVILVVMVAVATTATTVIMVVMMVVTMLTTKSLDVLKRLKHVNNKVPKPSIQYFENTSPT

SEQ ID NO: 129950 - protein, 90 aa, Glycine max
  Coding DNA Sequence Number=SeqID_13172
  Gene Ontology: Mol. function=protein domain specific binding
  Homolog annotation: Hit_ID=Q39558; Match level="QueryCoverage=58%, HitCoverage=19%, E-value=6e-10, Identity=62%"; Hit description=14-3 -3 protein 32kDa endonuclease
MHKRVIATASLCSMSSLNSRRVGTRSWIGSHDDSDVALLIATFLLLIDRRDDVPQGVARMDLVIVCNGDDVPLLHDEFFVVDSGKGTHQH

SEQ ID NO: 129951 - protein, 711 aa, Glycine max
  Coding DNA Sequence Number=SeqID_13173
  Gene Ontology: Mol. function=serine-type endopeptidase activity; Biological process=proteolysis
  Homolog annotation: Hit_ID=Q9FGD4; Match level="QueryCoverage=95%, HitCoverage=94%, E-value=1e-175, Identity=71%"; Hit description =Protease-like
  Pfam annotation: Domain name=Peptidase_S15; Domain location=459-681; Score=-112.9; E_value=0.06; Accession=PF02129.9; Description=X-Pro dipeptidyl-peptidase (S15 family)
  Pfam annotation: Domain name=Peptidase_S9; Domain location=495-710; Score=139.1; E_value=1.2e-38; Accession=PF00326.11; Description =Prolyl oligopeptidase family
  Pfam annotation: Domain name=Peptidase_S9_N; Domain location=26-400; Score=-42.3; E_value=4.4e-07; Accession=PF02897.5; Description =Prolyl oligopeptidase, N-terminal beta-propeller domain
  Pfam module annotation: Pfam domain module=Peptidase_S15::Peptidase _S9::Peptidase_S9_N; Domain location=459-681::495-710::26-400
MRPLFRLAQVARRHYKASSPPPPSPPKAPKKPQKFSFDGATWEDPYSWMSQLNDKVAMRHMDVCVEQEEKYAEAVMSDSDNLLNKLHFEMASRMPFDLSTPPLRWGPWLYYRRAEEAKPYPVLCRRLASLYEDFISHKYPPAGFDFTTGKTIEQKLLDYNQEAQRFGGYAYEELSEVSPNHQFLAYTMYDKENDYFKLSVRNLNSGSLCSKPQADRVSNLAWAKDGQALLYVVTDKKMRPYRIYYSLIGSTDEDVLLLEESDENAPKGGRSVDCHYLLFSPVDDPSSTRKWEEVLVDDPGLIIEDIDFSDKYLALIVREGRKVQLCSVGLPLPFGKGAVKLRKLDLQYLPIPRHVCQITPGPNYDFFSSVMRFIISSPVMPDAVVDYDLATGKWNIIQQQNVLHDRTRILYGKNSASISMESSNSKHSNPVNVNSEDDHLWNDLSEFYACEQYEVPSFDGVLIPLTIVFARNNKIEAKKPGILHGHGAYGELLDKRWRSELKSLLDRGWVVAYADVRGGGGFGKKWHNDGRRTKKHNSINDYISCAKFLIEKDIVHENKLAGWGYSAGGLLVASAINRSPDLFRAAVLKVPFLDATNTLLYPILPLIAADYEEFGYPGDLDDFLAIREYSPYDNIRKDVLYPAVLVTSSFNTRFGVWEAAKWVARVRDLSVYDPKRPILLNLTTDLVEENRYLQSKESALEATFLIKMMEY

SEQ ID NO: 129952 - protein, 792 aa, Glycine max
  Coding DNA Sequence Number=SeqID_13174
  Gene Ontology: Mol. function=signal transducer activity; Biological process=G-protein coupled receptor protein signaling pathway
  Homolog annotation: Hit_ID=O81225; Match level="QueryCoverage=95%, HitCoverage=90%, E-value=0.0, Identity=53%"; Hit description=Extra -large G-protein
  Pfam annotation: Domain name=G-alpha; Domain location=360-749; Score=- 35.4; E_value=1.8e-15; Accession=PF00503.10; Description=G-protein alpha subunit
  Subcellular localization annotation: CTP_CleavageSite=62; ConfidenceScore=5.40e-01
MSPAVPIAAGKIPVAAAVALSDALSLPVVQPLSKELKVPSSEPAVSPTSVIAFDRTTVSPTSARSSSALLLSHSNCEQASFDFNDSSQRDYASTLSSDYPSSHNISPLKTNETEHEREAKRTPVLGLEKEEQQHEAKERVKRENVIKKTKKGSCYCCLKGNRLTEKETCLVCDAKYCANCVLRAMGSMPEGRKCVGCIGLPIDEAKRGSLGKCSRLLKRLLNYLEVRQVMKAERFCEVNQLPPEYVCVNGNELTFEELVTLQSCANPPKNLKPGNYWYDKVSGFWGKEGPKPCRIISPHLNVGGPIKADSSNGNTQVFINGREITKVELRMLQAGTILVCALGSLPVPSNSKCSSSCGFLSCNVVTRPVHGIVHKLLLLGYTGSGTSTIFKQAKILYKSTPFSEDERENIKLTIQTNVYAYLGILFEGRERFEEESLGNLKKSHSSVLDTTGTSPKLGDKTIYSIGTRLKAFSDWLLKTMVSGKLDAIFPAATREYAPLIEELWDDAAIKAAYERRNEIELLPSVASYFLERAVEILRTDYEPSDLDILYAEGVTSSNGMASAPEETVDTADLHDSLVRWVKIFAPIVSCEKFSRYQLITIHARGLAENCKWLEMFEDVELAIFCVSLSNYDQFSVDGNGCRTNKMISSRKLFEAIVIHPTFEQMDFLLILNKLDEFEEKIKRIPLTKCDWLSDFCPVISRHRCGINSNSINNSPSLSQLASYYIGVKFKRLYSSLTGRNLYVSLVKGLEPDSVVEALQYAKEILKWNEERPNFSLSDNNSMYSIEASSFSH

SEQ ID NO: 129953 - protein, 33 aa, Glycine max
  Coding DNA Sequence Number=SeqID_13175
MEWNSLSTFAASFFDRSCLSSACPRLMVRRPGS

SEQ ID NO: 129954 - protein, 90 aa, Glycine max
  Coding DNA Sequence Number=SeqID_13176
  Subcellular localization annotation: CTP_CleavageSite=66; ConfidenceScore=5.85e-01
MLFFFLQRFCFLSFLLLQFSSSSRAASSFFFFFAAIAAIVAVFRRKVWVFAFVVWVFTFVLLLRVSASSSRKRCREVVGLFTDQVICKAY

SEQ ID NO: 129955 - protein, 103 aa, Glycine max
  Coding DNA Sequence Number=SeqID_13177
MDDRWGELDAGFDEQVITLQNMDTQDTLLPSISPIEPLLGRGHRIKQPFTHLQDYVTNTARRLNPSNCSPSPKADSGALYPITDYVNYNHFSLAHCAFLESIS

SEQ ID NO: 129956 - protein, 101 aa, Glycine max
  Coding DNA Sequence Number=SeqID_13178
MIDNNSGCSGNNSPVEEENKACEVAIHFDDRVEKTRERESCACRKGQKEVITDYILQKHCIEEKRSEEIAIVFWGPRKRKKQGVSPLSKFPSFVSAVESDP

SEQ ID NO: 129957 - protein, 373 aa, Glycine max
  Coding DNA Sequence Number=SeqID_13179
  Gene Ontology: Mol. function=hydrolase activity, acting on ester bonds; Cellular component=cellular_component; Biological process =lipid metabolic process
  Homolog annotation: Hit_ID=O80470; Match level="QueryCoverage=93%, HitCoverage=90%, E-value=1e-161, Identity=77%"; Hit description =Putative GDSL-motif lipase/hydrolase
  Pfam annotation: Domain name=Lipase_GDSL; Domain location=36-354; Score=174.9; E_value=1.9e-49; Accession=PF00657.12; Description=GDSL- like LipaseAcylhydrolase
MALLNSNDMLVLLILLLNVSFYGNVDAQKNGLGASFIFGDSLVDAGNNNYLSTLSKANIPPNGIDFKASGGNPTGRYTNGRTIGDLVGEELGQPNYAVPFLAPNATGKIILSGVNYASGGGGILNATGRIFVNRVGMDVQIDYFSITRKQIDKLLGESKAKEYIMKKSIFSITVGANDFLNNYLLPVLSIGARISQSPDSFIDDMITHFRAQLTRLYQMDARKFVIGNVGPIGCIPYQKTINQLNEDECVDLANKLALQYNARLKDLVAELNDNLPGATFVLANVYDLVLELIKNFDKYGFTTASRACCGNGGQFAGIIPCGPTSSMCRDRYKHVFWDPYHPSEAANLILAKQLLDGDKRYISPVNLRQLRDL

SEQ ID NO: 129958 - protein, 234 aa, Glycine max
  Coding DNA Sequence Number=SeqID_13180
  Gene Ontology: Mol. function=zinc ion binding; Cellular component =nucleus; Biological process=regulation of transcription
  Homolog annotation: Hit_ID=Q76KU9; Match level="QueryCoverage=99%, HitCoverage=100%, E-value=2e-68, Identity=57%"; Hit description=DNA binding with one finger 5 protein
  Pfam annotation: Domain name=zf-Dof; Domain location=26-88; Score =134.4; E_value=3.2e-37; Accession=PF02701.6; Description=Dof domain, zinc finger
MPSSNSGESRRASKPQSSGGAAPPPPEQENLPCPRCDSTNTKFCYYNNYNYSQPRHFCKSCRRYWTHGGTLRDIPVGGGSRKNAKRSRTHHVAATSSSSTSSTMTSAQEHHAHTLLAPVASTHYGVLDGDVKQTSNGNGNVCGSFTSLLNNTHGSGFLALGGFGLGHGYDDMGFGIGRSGWAFPGMVDGGNIGGAVASSGLNTWQLESGEGGFVSGDCFAWPGLAISTPGNGLK

SEQ ID NO: 129959 - protein, 617 aa, Glycine max
  Coding DNA Sequence Number=SeqID_13181
  Gene Ontology: Mol. function=nucleoside-triphosphatase activity; Cellular component=membrane; Biological process=transport
  Homolog annotation: Hit_ID=Q6K4D1; Match level="QueryCoverage=96%, HitCoverage=84%, E-value=1e-179, Identity=53%"; Hit description =Putative ABC transporter
  Pfam annotation: Domain name=ABC2_membrane; Domain location=341-554; Score=146.9; E_value=5.3e-41; Accession=PF01061.14; Description=ABC -2 type transporter
  Pfam annotation: Domain name=ABC_tran; Domain location=64-241; Score =106.1; E_value=1e-28; Accession=PF00005.17; Description=ABC transporter
  Pfam module annotation: Pfam domain module=ABC2_membrane::ABC_tran; Domain location=341-554::64-241
SNLEFIATIEEEAIIKSKERNTISTKTKEEGIFLTWEDLQVTVPNGRNGRKPILKGLTGYAKPGQLLAIMGPSGCGKSTLLDTLAGVKWALRRSNGKAYVTHDDAVLSTLTVGEAVYYSAHLQFPESMSNRDKKEKADFTIRQMGLQDATDTRIKGKGSKGLSEGQKRRLAICIEILTSPKLLLLDEPTSGLDSAASYYVMSRIASLKIRDGIKRTIVVSIHQPSSEVFELFDNLCLLCSGETVYFGPTSAATEFFALNGYPCPPLHNPSDHFLRIINKDFKLDDEECFNKTLPKEEAVDILVGFYKSSEISNQVQKEVAIIGESEHGFMERNRTQTAFLTQCHILVRRSSLHLFRDVSNYWLRLAVFVLAAISLGTIFFDVGSGESSIQARGALVSFVASVLTFITLLGGFPPFVEQMKVFQRERLNGHYGVAAFVISHTLSPIPYMVLMSLIPGVITYYLSGLHTGLERCLYFSCVLLACILWVESLMMVVSSIFPNPNTGITVSGGIMGIMILTGGFFRLPNDLPKPFWKYPMYYVSFHKYAFQGLFKNEFIGLNLASDQDGGAYISDKEILTKIWQVEMGHSKWVDLAILVGIIVLYRLMFLAIIKSKEKMKA

SEQ ID NO: 129960 - protein, 141 aa, Glycine max
  Coding DNA Sequence Number=SeqID_13182
MDMHLGSFISSQITLMAQHNSSRLGVPVLITALCKARGVHSDFLTLESLSPAINLAYIKKNYWNLDDPIVTFRGPRKARGKRSEAPSTTPPAPAPSPAAAEEETTPAQSPQPSPLSAPAPKEIQPSALDLNEDQPQEEQDV

SEQ ID NO: 129961 - protein, 287 aa, Glycine max
  Coding DNA Sequence Number=SeqID_13183
  Gene Ontology: Mol. function=RNA-directed DNA polymerase activity; Cellular component=extracellular region; Biological process=RNA -dependent DNA replication
MISIPDTLLARIIKTKYCPLGDFMGSSLGHNPSYTWQSLFSSKIVLKKGSKWRIGDGSNINLWTDPWLQRENNCYPSSPTVVGLENLRVIDIIQHETKGCNMDLVNNIFNEEDADIVSKTPLLPQILEDKLIWASTIDGSYSVKSAYLLIMEKILKLDHLASKFELQLLWNKKRPPRVKMMIWRACRSCLPTRANLRTLGVECPITSTISVWSYIGLDQKVLQLVDQLDPQNRGRVSMVMWSLCRRTNDKHEQFTDVSACIRDSKGCFFLFKSEWKHPCLKVIEGEA

SEQ ID NO: 129962 - protein, 55 aa, Glycine max
  Coding DNA Sequence Number=SeqID_13184
MGVKHFEVVKQRSHADKQWSPDEIRLAHHPVIQDPIMFPLQGPSSQVFFPPSHEL

SEQ ID NO: 129963 - protein, 621 aa, Glycine max
  Coding DNA Sequence Number=SeqID_13185
  Gene Ontology: Mol. function=nucleoside-triphosphatase activity; Cellular component=membrane; Biological process=transport
  Homolog annotation: Hit_ID=Q6K4D1; Match level="QueryCoverage=89%, HitCoverage=76%, E-value=1e-177, Identity=57%"; Hit description =Putative ABC transporter
  Pfam annotation: Domain name=ABC2_membrane; Domain location=312-524; Score=165.9; E_value=9.9e-47; Accession=PF01061.14; Description=ABC -2 type transporter
  Pfam annotation: Domain name=ABC_tran; Domain location=31-210; Score =50.8; E_value=4.6e-12; Accession=PF00005.17; Description=ABC transporter
  Pfam module annotation: Pfam domain module=ABC2_membrane::ABC_tran; Domain location=312-524::31-210
MQRRKGVEQHVAPMVQPISNKKVKMRRINECSIFCDLIKGRLGSNTRQTGEILINGKKQALAYGTSAYVTQDDTLLTTLTVGEAVHYSAQLQLPDTMPKEEKKERADFTIREMGLQDAINTRIGGWGVKGISGGQKRRVSICIEILTRPGLLFLDEPTSGLDSAASYYVMKRIATLDKKDDVHRTVVASIHQPSSEVFQLFDNLCLLSSGRTVYFGPASAAKEFFASNGFPCPPLMNPSDHLLKTINKDFDQDTELNLGGTVTIPTEEAIRILVDSYKSSEMNHEVQKEVAVLTEKNTSSTNKKRRHAGFLNQCFALTKRSSINMYRDLGYYWLRLAIYIALAISLATIFYDLGTSYRSIQDRGSFLMFVSSFMTFMTIGGFPSFVEDMKVFERERLNGHYSVTAFVIGNTFSAIPYLLLVSIIPGAIAYYLPGLQKDFEHFVYFICVLFACLMLVESLMMIVASIVPNFLMGIITGAGIQGIMIIGGGFFRLPNDLPRPFWKYPMFYVAFHRYAYQGLFKNEFEGLRFATNNVGGGYISGEEILRDMWQVNMSYSKWFDLGILLGMIILYRVLFLINIKTTEKLKPIIVSFMSSSRSSPKPTIQIMQNPNATPLQEVQVI

SEQ ID NO: 129964 - protein, 260 aa, Glycine max
  Coding DNA Sequence Number=SeqID_13186
  Gene Ontology: Mol. function=protein kinase activity; Cellular component=plastoglobule; Biological process=protein amino acid phosphorylation
  Homolog annotation: Hit_ID=Q2JTT7; Match level="QueryCoverage=56%, HitCoverage=23%, E-value=2e-17, Identity=31%"; Hit description=ABC1 domain protein
MACSIFDFRPKFALMRVSKKPRQDNGKPDHTIHLSVIVPFELKTNPVEAFFSKLSQQSVWLLCFINHTLTVPRVVLHPSSRRGLIGPRDVAVTLGRAELIKYKQQNESICLPRFLDFGLLCQMDKRHQLAMLASIIHIVNGDWASLVRALVDMDVVRPGTNIRLFTLELEQALGEVEFKEGIPDVKFSRVLGKIWTVALKHHFPMPPYITLVLRSLASLEGLAIAADTNFNTFEAAYPYVVRKLLTDNSAATRNILHWVL

SEQ ID NO: 129965 - protein, 140 aa, Glycine max
  Coding DNA Sequence Number=SeqID_13187
MDGVIWFSIIWSLCIEIMWSIFKDAELNADMVWDMVKRKETQTFTGPVKVAPCNLGFIEYCYALLLYSGYLLACGASMEAGSLSFNERHPLGNKPWKKELHHQDEPWIRSLERMLQWRKRKRERKRKGEHEIEGRKRERS

SEQ ID NO: 129966 - protein, 110 aa, Glycine max
  Coding DNA Sequence Number=SeqID_13188
  Gene Ontology: Mol. function=protein binding; Cellular component =nucleus; Biological process=multicellular organismal development
  Homolog annotation: Hit_ID=Q76BW4; Match level="QueryCoverage=72%, HitCoverage=45%, E-value=7e-25, Identity=67%"; Hit description =Flowering locus T
  Pfam annotation: Domain name=PBP; Domain location=20-110; Score=41.4; E_value=3.2e-09; Accession=PF01161.10; Description=Phosphatidylethanol amine-binding protein
MPSGSRDPLVVGGVIGDVLDPFEYSIPMRVTYNNRDVSNGCEFKPSQVVNQPRVNIGGDDLRNFYTLIAVDPDAPSPSDPNLREYLHWLVTDIPATTGASFVYYWLGLNK

SEQ ID NO: 129967 - protein, 75 aa, Glycine max
  Coding DNA Sequence Number=SeqID_13189
  Gene Ontology: Mol. function=protein binding; Cellular component =nucleus; Biological process=regulation of timing of transition from vegetative to reproductive phase
  Homolog annotation: Hit_ID=Q84XL0; Match level="QueryCoverage=80%, HitCoverage=34%, E-value=2e-26, Identity=90%"; Hit description=SP3D
MGIHRLVFVLFRQLGRETVYAPGWRQNFNTKEFAELYNLGLPVAAVYFNIQRESGSGGRRKEKILWESHTIKNNT

SEQ ID NO: 129968 - protein, 169 aa, Glycine max
  Coding DNA Sequence Number=SeqID_13190
RHPLDPEKSNKALGFSALITGLCQFYGVLVTPSKVIQPPITQAFIEKYCTPRQAQGDTQQAADAPTPQQPDPVRPLSVEQYLRHVVRQQAANHRGEVQLHECFYRFSLSQQRQDSTPFVAWPGDWPTEEGTGPARSPGKAEEAHMDEDMTNLLGYLGEGGATRPRSPHL

SEQ ID NO: 129969 - protein, 72 aa, Glycine max
  Coding DNA Sequence Number=SeqID_13191
METEVRNDGRLCFGQLLHAAVPVLFGNSVNGEVRDAVSCAVSMNKNTPHFYIAIPGTKGDHPTEVTMHRRFF

SEQ ID NO: 129970 - protein, 72 aa, Glycine max
  Coding DNA Sequence Number=SeqID_13192
MGHRCKLFSSCHRTIHLEDKRKDGSRELKSHIGGVGSVATYNNPLNMWECVEISKKRRKGNRKEMKKWKRKF

SEQ ID NO: 129971 - protein, 125 aa, Glycine max
  Coding DNA Sequence Number=SeqID_13193
MMIHRCAAEHGFKLRPPTAIAAVKLRYFDTPQSHCGCISRIFPQCKAEGVESKYSLNVSNQLGLRSLTNLQQRHKIRSFQLRKPRNKNKNNYKGWKPKQGMTEEYVSANCSTEYQSCLETPLTAK

SEQ ID NO: 129972 - protein, 73 aa, Glycine max
  Coding DNA Sequence Number=SeqID_13194
MSCFEYESEKSGLDGGFLTFPQIGVDKGSHGKKIDFSEQVLRERVGRKEALNNIHWCIVLYYNMRLFFIKPNQ

SEQ ID NO: 129973 - protein, 54 aa, Glycine max
  Coding DNA Sequence Number=SeqID_13195
MVSSLSTLTPPQNGNHHGGRVVGCHVGEVMNRVVVNVLNNSVEAEESADQGTQG

SEQ ID NO: 129974 - protein, 129 aa, Glycine max
  Coding DNA Sequence Number=SeqID_13196
MKRSDHLRRQAVYLLLACSFSLICKRGEIANHCNNSTLCSSFTTNPDSEHDYFCRKKGSLELFKWILGHLPTAISINHEKYMQMCMNFISSFLQLYLREIHYDHQVLLDYLISKDTGISCAKYLLRYSL

SEQ ID NO: 129975 - protein, 467 aa, Glycine max
  Coding DNA Sequence Number=SeqID_13197
  Subcellular localization annotation: CTP_CleavageSite=51; ConfidenceScore=5.07e-01
MKTPSHSNTNIPAREDRGPKGTPANHHTSRTTCNRHLAKFQNIFHTRCYVTTASRSSRKIPPGANPILSVSPVKCLRPVNSGGSAASSTTLSAPTQSVSFFTPPTLFFFLNNYQFIPLTKHAFHVPQEPRAFVSTSKEKEKEILIASSQVVTKIQLRIREFDSRAEAKRASDEERSCCSSPHSSVDQCLRKIVTEMMVLLTVKSEFVQHVVVNALVLVSKFLYTMGNNWDGFIHLLCCSLEMAIARMISCSSEPPSGAENSEFDCFDVEFLMQYGLKNFDWSTVAGVVRVLRVICKHLKEEDYDDGLIKVYYDSVNSCLLKMPWDLLDEYWSSEFGRMKDNSTINQLHLKNFSVMDPVMNFLGTFLQLLCSLVYRNDSVETGCDSVDKHPLFLTVVNLIPRLAKWCLSEQENNAEMHAIHYLKHKLLKGVCAPISAIKGPSHQSFGYVKYRISNSSRKRGEWRLNFK

SEQ ID NO: 129976 - protein, 303 aa, Glycine max
  Coding DNA Sequence Number=SeqID_13198
  Gene Ontology: Mol. function=catalytic activity; Biological process =alkaloid metabolic process
  Homolog annotation: Hit_ID=Q6RYA0; Match level="QueryCoverage=96%, HitCoverage=98%, E-value=2e-77, Identity=50%"; Hit description =Salicylic acid-binding protein 2
  Pfam annotation: Domain name=Abhydrolase_1; Domain location=38-297; Score=29.9; E_value=9e-06; Accession=PF00561.10; Description =alphabeta hydrolase fold
MNNSGNCIDKKHYVLVHGACHGAWSWYKLKPRLESAGHKVTSLDLAASGINMKKIDDVHTFSQYSQPLLHLMATIPKNEKVVLVGHSLGGLNIALAMDKFPKKVAVGVFLAAFAPDTEYRPSYVVENVCFLVLRLPGKFYEDLQKVQEVVDVKGIYIIRKNLSFLLLQYIERIPPSEWFDTEFAPSGNKTSILLGPEILAKKLYQLSPIEDLELAKTLVRPSSLFVEDLSQQKNFSKERYGSVPRAYIVCTEDLTIPIEYQLWMIQNAGINDVLKIKGADHMAMNSRPRELFESLQKIAAKYA

SEQ ID NO: 129977 - protein, 430 aa, Glycine max
  Coding DNA Sequence Number=SeqID_13199
  Gene Ontology: Mol. function=catalytic activity; Biological process =alkaloid metabolic process
  Homolog annotation: Hit_ID=Q94G63; Match level="QueryCoverage=97%, HitCoverage=96%, E-value=2e-69, Identity=51%"; Hit description =Ethylene-induced esterase
  Pfam annotation: Domain name=Abhydrolase_1; Domain location=210-424; Score=44.9; E_value=2.8e-10; Accession=PF00561.10; Description =alphabeta hydrolase fold
MSSENCLGRKHYVLVHGACHGAWCWYKLKPRLESEGHKVTVLNHAASGINMKKIEDVGTFSEYTEPLLQLLDTIPSNEKVVLVGHSLGGMSIAIAMEKFQEKVAVGVFLAAFAPDVEHRPSYVLEKDLELAMTLARPPSFFIEHLSKEKNFSKQRYGSVPRVYTVCPEDLGIPLNYQHWMIQNAGFNDGVEINGADHKPMLKPRLESEGHKVTVLDLAASGINMKRIADVDTFSQYSEPLLQLMTKIPSNEKVVLVGHSFGGMNIALAMEKFPEKVAVGVFLTAFAPDTEHRPSYVLEQNTSSEDLDNEFAPSGNKTSMLFGPEYLSKKQYQLSPVEDLELAKTLVRPSSLFIEDLSKQKNFSKHGYGSVPRAYIVCTEDLAIPLEYQLWMIQNAGINDVLKIKGADHAAMFSKPRELFNSLQKIATKYD

SEQ ID NO: 129978 - protein, 124 aa, Glycine max
  Coding DNA Sequence Number=SeqID_13200
  Gene Ontology: Mol. function=catalytic activity; Biological process =alkaloid metabolic process
  Homolog annotation: Hit_ID=Q84WR3; Match level="QueryCoverage=98%, HitCoverage=63%, E-value=3e-28, Identity=43%"; Hit description =Putative acetone-cyanohydrin lyase
MDKYPKKVAVGVFLAAFAPDTEHQPSYVLEKDLELAKTLVRPSSLVVEDLSKQKNFSKEGYGSVPRAYIVCTKDIAIPLEYQLLMIKNTGFNDVLKIKGADHMPMNSKPRELFDSLEKIATKYA

SEQ ID NO: 129979 - protein, 242 aa, Glycine max
  Coding DNA Sequence Number=SeqID_13201
MEDKFRAQNQLFALCLHLICNSWKLFVEFPLFGEFLDQSSCKRRKIVGDGLHFLADGMPTSIDNSGSIILHIKNYKEDRGGFKYYNIKPFKKAGECLLSLNNSVYNLHQKKLFPYNPKVLLKRYWWHGWTGNREILCWFIVIGLSAHSCQHCATGVHLVTVLVHFKSVDYSMGLGLHAISGESGEPYHGSRVHEWFLPVFNLEFVKVIQAIIALKDVFLADTCLSLGTWSLHSCSYKKACNE

SEQ ID NO: 129980 - protein, 320 aa, Glycine max
  Coding DNA Sequence Number=SeqID_13202
  Gene Ontology: Mol. function=catalytic activity; Biological process =alkaloid metabolic process
  Homolog annotation: Hit_ID=Q94G63; Match level="QueryCoverage=96%, HitCoverage=88%, E-value=1e-55, Identity=50%"; Hit description =Ethylene-induced esterase
  Pfam annotation: Domain name=Abhydrolase_1; Domain location=138-314; Score=-6.1; E_value=0.024; Accession=PF00561.10; Description =alphabeta hydrolase fold
YNERTPSSAWLDTEFAPSGNKTSMFFGPNFLSNKLYQLSPIEDLELAKTLVRPSSLFVEDLSTQKNFSKEGYGSVPRAYIVCTEDIAIPMEYQLWMIQNAGINDVLKIKGADHMAMNSKPRELFESLEKIPRLESEGHKVTVLNHAASGINMKKIEDVDTFSEYTEPLLQLLDTIPSNEKVVLVGHSLGGMSIAIAMEKFPEKVAVGVFLAAFAPDVEHRPSYVLEKDLELAMTLARPSSYFIEDLSKEKNFSKQRYGSVPRVYIVCPEDLGIPLNYQHWMIQNAGFNDVAEINGADHMPMFCKPQELCDSLQQIAAKYQ

SEQ ID NO: 129981 - protein, 470 aa, Glycine max
  Coding DNA Sequence Number=SeqID_13203
  Gene Ontology: Mol. function=nucleoside-triphosphatase activity; Cellular component=membrane; Biological process=transport
  Homolog annotation: Hit_ID=Q6K4D2; Match level="QueryCoverage=89%, HitCoverage=58%, E-value=1e-124, Identity=55%"; Hit description =Putative ABC transporter
  Pfam annotation: Domain name=ABC_tran; Domain location=92-284; Score =133.0; E_value=8.1e-37; Accession=PF00005.17; Description=ABC transporter
MACLHDESVSSAPTLAYETKPQQSVIDLEATTLEMEAFRGPRKMNRGEGEGVAQKEEIGICLTWKDVWVTASNKKNGSKSILQRLTGYAKPGQLLAIMGPSGCGKSTLLDTLAGRLGSNTRQAGEILINGHKQALSYGTSAYVTQDDTLLTTLTVREAVHYSAQLQLPDTMSTEEKKERADFTIREMGLQDAINTRIGGWGCKGISGGQKKRVSICIEILTRPKLLFLDEPTSGLDSAASYYVMKRIVALAQNDHIQRTVIASIHQPSSEVFQLFNNLCLLSSGKTVYFGPASAASEFFASSGFPCSSLMNPSDHLLKTINKDFDKDIEVGLAGTRNIPTEEVIHILVNSYKSSERNQEVHNEVAVLSKKDIGSLDIKRGNAGFLNQCLVLTKRSFINMHRDLGYYWLRFVIYVALAITLASVFYDLGKSYDSIKDRGSLVAFINGFITFMTIGGFPSFVEVMKNFRGQD

SEQ ID NO: 129982 - protein, 96 aa, Glycine max
  Coding DNA Sequence Number=SeqID_13204
  Homolog annotation: Hit_ID=Q42798; Match level="QueryCoverage=48%, HitCoverage=9%, E-value=1e-18, Identity=82%"; Hit description =Cytochrome P450 93A1
MKMICGYDILAKTRLFVNVWAIGRDPNHWENPFEFRPKRFMRDGQNELNKMSCTGSLSAPLHLTKRTALVHPLSEISALSRNSLMSAKRFRIALSA

SEQ ID NO: 129983 - protein, 143 aa, Glycine max
  Coding DNA Sequence Number=SeqID_13205
  Gene Ontology: Mol. function=catalytic activity; Biological process =alkaloid metabolic process
  Homolog annotation: Hit_ID=Q94G63; Match level="QueryCoverage=83%, HitCoverage=44%, E-value=6e-43, Identity=63%"; Hit description =Ethylene-induced esterase
MEYLLNSITQEEDTMSMIISGNCIDKKHYVLVHGACHGAWSWYKLKPRLESAGHKITSLDLAASGINMKKIDDVHTFSQYSDPLLRLMATIPKNEKVVLVGHSLGGLNIALAMDKFPKKVTVGVFLAAFAPDTEHQPSYVLEK

SEQ ID NO: 129984 - protein, 213 aa, Glycine max
  Coding DNA Sequence Number=SeqID_13206
  Gene Ontology: Mol. function=nucleoside-triphosphatase activity; Cellular component=membrane; Biological process=transport
  Homolog annotation: Hit_ID=Q6K4D2; Match level="QueryCoverage=60%, HitCoverage=18%, E-value=9e-39, Identity=59%"; Hit description =Putative ABC transporter
MIVASAVPNFLMGIITGSGIQGIMLLLCGFFKLPNHIPKPVWKYPLHYVAFHTYANQGMFKNEYEGLRFASNEAGGGYVSGEEVLRNTWQVDMSYSKWVDLAILIGMIVVYRVLLLVIIKVKEKMKPVVVSISCMSSSPKKTIQSSLSSSSFLLLHRPTSSNDNTTIFFIVTFFAHALHTLRWPQLHQTQQLQQFYSMCCLHHGGFIATPSKI
